United States Patent 9,487,797 (GENOMIC PLANT SEQUENCES AND USES THEREOF) - sequence listing, part 108

SEQ ID NO: 105892 - DNA, 2956 bp, Oryza sativa
  unsure (1)..(2956): unsure at all n locations
actgtccnagttcgacatacgatcttcaagccccnnnnnnnnnnnnnnnnnnnnnnnnntgaccttttgtcctgttgatgttgccccggcccttccccgttagcttcttcgttttcgatgaagatgtaaacaagttggctgacttagcagttgacacaatcattaaccattaacctcttgttcttggctgctctctgaatggtatcaaaattttttagacggtttataactttatatgatgtcaatcacatggttcttgaaaaccagcggttaccggccggtaaccgtccggagttgacgatcagttcgagcaagtgaccaaaaggatatggttgtttttaaaattgaattaagaactattttgtccaaataaaaaaaactgaatttaaatttctatcatgtaaaatccggtaaacggccgttacaagatttgacagagtccgataatcatggacaaacaggtttcaactacttattccctccatttcaagatattagcatttttttttctaggattcaaaattataccataatataaatatttttgggacattgattttagtatatgaaaatccatgtattttcaaccaatcagaagcttaggaagagaaccaaagccattcaaaatttaaattttgagtaatgagacgaataaaaagaatatttctcatcaaccttaatctttgttaaacaaatcataaagcttatattttagaacggagagagtaggtggaccgatgcacatacaaacccgccattaagttgattggatgaacatgaacagcacgagaggaacatttcatttctggtcacatttgagcagctactcgctttcagatcaaatcttccattaatttcctgttccttgtggtttctcagtgggggcatctagtctcagtcgctgacgagccaatgcatcgaatgggcgagcatgattagattattggggggacagtggtgcccattgcgaagtgactaatgttcatgatattcgatcgagcaaccctggagtaccttctactcctactatactatccactgatccacagctattagctagctgctcagatgattggaagagtccaagaaaaactgtaatgcctttaacatcggtcaatcatagatggttggagtggattgggactgacaaagagacattatccgtcagcaatctacattgccaattttcttttcaggcctgaagatgagacatgcattagtcacagagaagattttcaggatttcactagtccttgacagtttttgacagttactagatgcaaaccacttactccctccgtcacataaaaaacagttgccggcaacaaatatagatagagctatcaatttttggctacgaatataatttgttcttttttaggaaggagagtataagcatgaatatgaataactaacagtaagatgactagaacctagatgtccatgctgcatttaagtccaggtgtttgcgtctgggctctaagctacttttcttggtgcagatgcatgctttgcaacttcttcctccttgagctttaggaaagaaaaagaaaagcttaattgtatactataagcaagaacacgttcggttcagatccattttgattcctgagatctcgcagagcgagatttgtcatccggtttatcgatccaaagtgggcgttttcccactaatcttttcatcatcttcttctttctgaacctgttgacatcaaaagggagaaaagaaactcgatgtactcgctcatcttatgttactatcaatcagaggcagagatgatcagatgaagcatcatcattcaggcatcctgctcgccactgcccatacatgtagaccatctcctggaaagaaaaagagatcaggcttcagtggaggcagttcgatccattttatctttctgaaacttcgtaaaggaggctaagctatctcgcagtttttctaagtctccggatgactcatgtcacattgtcacacggcctcctctcctttaagttggcaacgcgtgaaaaaaagaaaaagaacagtgtagtgctgccatgttagtagtactccaatccaggcaagtatcagtctactgaaatcatcatgattcaagccatttgcttgagacatatcaacttggcacggaacttaggttttgtttgatgaatagttagctggtgagaactttctacttctgttcattttctacttaatctaccagtagatgataatatggtctgagaaagttggaggttctaagataagctgtaactggacctcagtcactcactacactattctgtgctcacttctagccattgtggagtaatattgtactagatcatcagtgttctttcagaaaatgtgcagccgtgcatgctgatctgaacaatcctgaaggctgaagccaccaaatgtgtaaaccccccacctttatctgtcactactcactagtgcatttagtacttaattgcgtgattagggcgggggaacactgcacttaatggcatgattagtggtagtaattaagtagatcaccatcatcatcatcatcatggtgtccatattggagagagcctatggggagccaggcttttcaacggccctggaaacaaggcggcatgtccccccaggagtccaatcctgtctccacggcaacagctaacgtcgctctgcagtctccacacaccaattaatccccccttaccctacaaacctttccatgggccatggatgatgatatactcatatgcacccccaaccaaattaaccaacgtctcctcgacgtatatacctctccgccgatggaataaccaacccccaaccatgacatgttgtgtcacgccctcttgttcccctcacgtttttcgggaacgcgcaaaatnnnnnnnnnnnnnnnnnnnnnnnnnnnnnnnnnnnnnnnnnnnnnnnnnnnnnnnnnnnnnnnnnnnngatctgcattcaaaacgcgct

SEQ ID NO: 105893 - DNA, 759 bp, Oryza sativa
  unsure (1)..(759): unsure at all n locations
ccggcgggggggggggggggggagggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggcgggggggggggggggggggggggggggggggggggggggggggggggggggggggggggggggggggggggcccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcatatcgcagtctaggtcatagaaacattatatggacttaaacaaggagaattatgtaacatgaagaaatagtagtacaatttgaacatgatacaactatttgcattgcagttacatagatgatattagattcgaactaggagggaggtagtgcaatagttgaacacaacgacgatgtaatannnnnnnnnnnnnnnnnnnnnnnnnnnnnnnnnnnnnnnnnnnnnnnnnnnnnnnnnnnnnngatgntacncatcacgg

SEQ ID NO: 105894 - DNA, 705 bp, Oryza sativa
  unsure (1)..(705): unsure at all n locations
cgctgctagataatctcctnnnnnnnnnnnnnnnnnnnnnnnnnnnnnnnnnnnnnnnnnnnnnnnnnnnnnnnnnttctacaatttcatacaaaattacaagatttttaccatattgactcttagcttatacgacagtttagtttctgtctaaactttcagatatttcttctgattacttgaatattttgattcaatgccaaaaaaacttcataagttttgaacttctctacttcatttatttgaaatctagttgttcttttcaactcaacttgaaacttgatgaagacactgcgattatacattctcattgcttggcactcaatgtactaatgggaccaaagtttgcttggcttctttgatcttcgaaaagtgaacatcaaactgttccaagttttgaatcgcatccattactgtttaatactctatcatgaagtttgaaatgttgcactggggaccatcattatctttagaccgttggataatgccttcactgagagctgtgcatcttatgaattgacagaaagcacccttggaattcactggaatgaaccttctattgattgaccacgtgtgcattatgaaattggtaaggtgtactgtaacgctggtagtgctgttatgcaaaaatgctattgtcttcctccggaacatggaaatcaggttgaactctacttaggggccaaccgttatattggttgaagg

SEQ ID NO: 105895 - DNA, 1628 bp, Oryza sativa
  unsure (1)..(1628): unsure at all n locations
agcgtatagatagcttcgtaggaccnnntcgnaannanccncnaggaattcggtacccctaatttacacgcatttgacagtatatcgaaatgaacattttacatatttatatactactccagattgcacacactgcttgaggccttgagatgcgaaaacagccgatatacacctatatgacaaatcaccactgctgtacgtactactagtccctggcgatctcgttgctgggatttggctcgtttccgttatcttcacgatttggctcgttgctgggtgtgtcgcctccggcagtcatgaacccggtggtggatgacctgacaaccgagttcaggatgtcttcgatcctcctctcgacggcgaccatggttgggcgcacatcccggctgctattgacacactgctgcaccagccgtatgaactcccagaacccatcggtgcttgtggcgtcccggatcgctcaagatcaaccgcatcacagcgttcggcagcccatcggtaatgccggatctagtcaattccatcattccaaattgcagtgaaaacgaaaagagtaaatttcataaaactacagatattataaccaaactatcacaaaactacatatttaaggaattatatcacaaaattacacatttagcaccaaatttagcacaaaactacatattaaagatgaagtgttacaaaactacacgtttagttactaaattatcataaaactaaaggtttagaaccaatttaatcacaaagtaataatgtttatagctccaccataacaatggtgctagggatttaaactccaaaagttatagttttgtgataagttcaatattaaatatgtatttttgtgatacttaacctaaaatctgcagttttgtgataaatttgatgctaaatgtgtagttttatgatacaactccttaaatctgtagttttgtgataatttggtcaaaatacctgtagttttgtaaaatttactcaaacgaaaaggaatcgccaatactatggttgtgtttgcaaacccatgttcccaacccctctccctcgtttttcgcgcgcacgtttttaaactattaaacggtgtgttttttgcaaaaaatttctatatgaaagttgcttaaaaaaatcaaattaatccattttttttaaaaaaattagctaatatttaattaatcatgtgttaaaaagccgctccgttttgcgtgcaggagggatgagttcccatcctgcacttgcaaacacaccctataaccattcatattttcaacacataaaacaggtccatcaaaaccacacgaagttttctaataatacctcacaaataccccatatactttatccaatctttacccatttagtactgtcggcgacatgggacccgggggtatcgtgactagaagcttgggcagccgccgtcacccacgtggcctgaccccctcgggggggtcgggcccgagggtgacatggccacccctcctctgtctcccgagggggcccnncccccccnccccccccccccccccccccccccccnccccccccccccccccccccnccccccccccccncccccccccccccccccccccccccccccccccccccccccccccccccccccccccccc

SEQ ID NO: 105896 - DNA, 731 bp, Oryza sativa
  unsure (1)..(731): unsure at all n locations
cggtcgtgatccgacacgctatcgtgannnnnnnnnnnnnnnnnnnnnnnnnnnnnnnnnnnnnttagctggtgagaactttctacttctgttcattttctacttaatctaccagtagatgataatatggtctgagaaagttggaggttctaagataagctgtaactggacctcagtcactcactacactattctgtgctcacttctagccattgtggagtaatattgaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctcttctttcgtttttttggatttttagtgaatataatgaaatttcagagaggggggactgggctttataggggggaggcaaaaaatcgcctcccccagggcggcaaggggggccgnctggaaaattccatgccccctcgcccgccatttggaggcggncccccgcacagtacaaaaatggcctaacggagggcgggaaggggtgccgcctgcaaaattcgttgacgggccgtgcccgaaagcaaccg

SEQ ID NO: 105897 - DNA, 744 bp, Oryza sativa
  unsure (1)..(744): unsure at all n locations
aggagaacggatacaagtatttatcnnnnnnnnnnnnnnnnnnnnnnnnnnnnnnnncctgagagcagaagagttgctcttggctgcctctttctctctgatcctgaaatgaaacctcaaattgggtgtcactgtacactgaaaagaaaatccctcttggtgagtatggttttgggtcttttttttagcagaaaaccagagggatgaaagtgtaaatatttctaagaagaagaagaagaaaagggggttaattaaagcaggaaattcttccctgtctatctttctcctccatttcttgttctaagctaccagccttccactgttgcgaggcaaaattccccccccccccccaattaatactagaattaactaacaatatattgtacaaattcatccaaagatccacatgcccaaaacatggaaaccattttaatcgctactactatgtactccctccgtctaaaaaaaaactcaacctaagaggagttcggggttccttctagtacaataaatctggactatttttatccagatttattgtcttaggagggagatttctcttaggttgaagttttttttggaccgaaggagtacatttctgcattttctttacacagcgtctgaaaccacaaactgcatgtctgaattgtgaacatcaaaactgtctgttctccaccttgcagagactgtacatgccaactctgaaccagagagactagacctactactgtctctgaactctgg

SEQ ID NO: 105898 - DNA, 669 bp, Oryza sativa
atggatatcccatggaatggggcgaccgggatatagaaagccttgggaaaattaccgcgcactccacaaagggccaagggcgacctccaagctcaggaggaaagctcggccctttgctctgacccaaaagagaaagggcagcgatgagcgtgaatagaatacccgaggggtcggacgttcacatccccataagactgaatggcgagacggtaccgccctctactgttttgaggggtgggagctaaaactgaacctcaataggaagggataagaacggatatatgatcaaggactgggatatatagtgtgtcagcaggggacaagaaaactctttgggatgagatgaagaaaaggttctagttccctgagggatcagaagcaatgacaaggaattgcgcattgcaaacaatggacaaggcgtggcgcggatagaaaaacactctgaacacacaattcgtgcagaaggggaaggcaccatttaagaaatatgggaaaataacgctgaaccaatgggacaaatttgtaaagttcaagacctcgccggaagaaatggccaagagtaaaaggttgtctgacttggccaatccaaaaaaatggcaccatcgactgggctacggtgggtacgcacgtaagattgcactgtggtataaagaggatgaggaaatgaag

SEQ ID NO: 105899 - DNA, 742 bp, Oryza sativa
  unsure (1)..(742): unsure at all n locations
ttcccatgatagatttttctaagagtcatccgtagtttcttgacttcgaggttcagcacgtcctgtctcgtatccagtgcaaacttgagatgtcagtctantaccacgtctcctagtcgccgcacatagacagatagtctccagctcgagctttgtcctttccacattcactttgcgagcagatagctgtggctagcctctcgcaagagggtcatgcggtcgccactcatctatagagcagtggtcttgtgacatagatagattgagaggtacatattaagcagtgtagtggtcaaaatactagtaactggtgtgagcactataatctctcgtagtctgtcatctcggtgcttatcatcccctactcggataggtaccaacccccatcatacgttgcatacagtgaatggcccgggtaagtctgtcaaggacatcgtcacctcagaaatgatcgatggtgcgcgagtcagcattgtatctgacactgtacagttctcccaggtagagcaccccacacttgtgcaggtgttgtacaagcaggctcagatgatgcctggtggtcaccaacttatgcagcttcgcgtaccgtctgtttggggcagcagccagcgcatcaccagtagcatatctgccagagtgggccaacgcctcctcagacccccatatnnnnnnnnnnnnnnnnnnnnnnnnnnnnnnnnnnnnnnnnnnnnnnnnnnnnnnnnnnnnnngatacaaggcgtgg

SEQ ID NO: 105900 - DNA, 641 bp, Oryza sativa
aatttatgctgatttaatttaatttctatatagactcatgtttttacctcataacggatttacttttaatgtcatgacaagttactttctttaccatcagaaaatcttagcaaagaatttttcaaatgagaaacctctttttccaaattagcacaattttcacaatctaccatgacacctttgcttttacgacatttggggcaagaaagcagttcattgtttttcacaacatcttccatgtactcaacacgacctaaagcatcttttagtttcatcttattcaaattacatgttgagcaatccaaaacatcatgaggttgttttaactttttagcagaaatcatgttaaacatcaaactagcatgaaaagcaatttgatatttttgcaacaactttttagttaaaaacaactcatccaatgtgcgtgtgtgcaaagcaaaactacaagcaagagaagatctatttttcaaatcatgtgcagcattaacatctctaatttttgaaatctcattcattaaaacctcacaattttcacaatcattatcattaggaataagagattttaatttatcaatttcagatttaagagaatcaatgataaattcccggtttctatatatcttctcacacctcctaattct

SEQ ID NO: 105901 - DNA, 725 bp, Oryza sativa
  unsure (1)..(725): unsure at all n locations
cgcccacacgctcgtagnctacngatagcccctnnnnnnnnnnnnnnnnnnnnnnnnnnnnnnnnnnnnnnnnnnnnnnctgccagcgtgtttccggctatagctctataaaccgtttttgcaaacaggtggattgcattttggcatgcggttggccggtacacatgcgctagaaggtctgcaaagatcacgatctttgcatgccgccagtgcaaccgcatgcaaaaatcggattttcgcatgctgatgcttaagccggctgcatgcgaaaatgaaaaatcgcgaaaaaaaaataaaaatccccaaaaaaaaacccctagccctaagcgcccgagctcgccgatgccgctcgcaccacgccggatccatcgtgcccgagctcgccgacgtcgtcgtcgtctcggataggtcgtcgtggccgcacccaagctcgccgccgtcgtcgtagccgaggttgtcgtcgccgtacctccgccacgctcgagctcgccgtcaccacccgtcgccgtcaatgttgccaaggtcgccgtcgtcgcgaggaggtcctcgtaggtgtacccgtgccggatctcgccgcctcgagcttgtagtcgcccgagggagctcgttgtcacccgcggggagagtgcccgtgcccgatcccgctgaaggagggcggctgaccccggatcttgctcggggagggctacagtcccaaatccgatctggccgcctccgcccccccg

SEQ ID NO: 105902 - DNA, 726 bp, Oryza sativa
  unsure (1)..(726): unsure at all n locations
tttgggcccctttgngnnaaaaaagttcccaaganatnnntcacttngnngggaggtgtnnggatncaagnttatngatttngaaccctggttcgacaatcagcgtaaatgtctcatcgaagtcaatgccaagacgttgtgtgaagccacatagaacccaatgagccttatatctgtcaagagagccatcatcttaaacttgtgacgaagttagtgtcgggtgtattcggaatgagctcccaagtgtgattcactagcatagcattgtactcatccattggaacatgctaatttccaactcaagacactagccatagtttccttaaactccacatcattaagaaactagtaatagacactactcttccaacgcaaacaccactattccatacttaaatttaatgctacttatctcacataatgtcttggatgttatgtagaaaccatgtctaatgcaagacgtggtttccttctctttcctcatttattcacttgccacgtcatttttcatcctaggtggcatcttatttaatgctatggacaacatcctagtcattgggttgggaatgcccttagagaaagtttaatagtatagcccattactagctccaaatcatttatagcccatgtaatagcccattcatacaataggtggttactatatgtcacgcccagaaatttaagccaaatttttagactattttgtgtattaaatccctgtccagg

SEQ ID NO: 105903 - DNA, 701 bp, Oryza sativa
  unsure (1)..(701): unsure at all n locations
aggttatgtctgcttcgnnnnnnnnnnnnnnnnnnnnnnnnnnnnnnnnnaatcttaggaaggcttttcaacaagtttgcgccgccttcgagccactaattgatgtagatggtgaaagtggagatgatgattaaggaaagaacatctccgatttttgcttcatggcgcgtggtgaatctgacacagagtatgaagataatgaggtgagtgatcttgaggaagctattaatattttgagtgcaaaaaataagaagtagaccaagaaagatgggaacggtggggagtgaagggatgagcggtggggagagtgaagcgataaggataaggcggagagagatggcagtttttatatgtcgtgtttttaataggattaattggattaatgccattgcaaacatgtcatatataaaaaaaatgccagtattattcgtgaaacatagtgcgtgccattgaaatttttgaaaatttgaaccatgccactccgtcatgatttctgtcatagagatagatgccaagttgttgctatatcaccgattcaatttcatcctttctctctcgtcttgcatagattgggtttgttcgtccgttcgtcgtgcagcatatgggatcaagaagagaaaaaggatcttgtgcttgtggtaaatccccccaaaaaagaaggaaaaggatgggggagaagtttcttgaagcggatagagaat

SEQ ID NO: 105904 - DNA, 957 bp, Oryza sativa
  unsure (1)..(957): unsure at all n locations
actgggatctgagccttgatggtctgctgcttgcagttgggcctacacaatttgtttcaatataataattaataataccaaaattaaataactactcaatgcaaaccaactaatagtagaatagtccctctatttttttttaatgtatcgcatcatggactttttcattcaactctgactaacatttcaaccatacttagttaagtaaaatggaagaataccgagatatttgtcataaaacatgcattaagtgtcttgtatgtttgtacatgataatttttccgataactacgaatagttaagcaaacctcgtcgtatcaaactagagaaacctaggagctaccacttacaaatctaaacactgatgtaatgtgatcttgatgaagttgtaatcctatatatctataaagttcatccccactaagtatagttaatgctaattctctcttctctcatgaagctacaacacctcaattgtttttaacctttggatgattcatcaagggtgtaaattgtatctcttcacatcacctcaattgtttgtaagctcttggatgattcataaaggatataaattacatctcttccctccaaaggacacaccaagcaacccaatcatttataacctacggataattgataaaggtaaaaaaaatataaacacatgaaaaaaatcgtatagtaggtaagaaagaaaattttagaagtaatatctagtatattatcacataattctcccgcagcaacgcgcggagtacccatctagtactaattaacatggaatgcctaatgtatgatgggaattcttccccacataaaatacattcccaactattagtatgttaaaacaaataggttattaattaaattntttgtggccaagaaaatatttgtatgtaagtggttggaaaaagggaaagtttaaagtttagaattaaaaacctaatgattttaaaa

SEQ ID NO: 105905 - DNA, 866 bp, Oryza sativa
  unsure (1)..(866): unsure at all n locations
gatgtgcncaatggagactcgtcgtnnnnnnnnnnnnnnnnnnnnnnnnnnnnnnnnnnnnnnnnnnattcggccgatcgtcgtccccgactttacgtccacgaccgaacgtcgcctcggccgcagctcgtcctcgtcatcgtcaaccgaatgaactcatgcatgtgtgtgaggggtttgaatggtatatatatgtgtgatggctttggatgacatgtggggccggtttgggttttttttgggatgatatgtggctatgtgctatgtggtgatatatgtgttttatgtgttatatgaaatgttgaatgtgggtgatatgtgttgaaatttttttgatagggcatgtgggtgttatatgttcaacttcttttcagatgacatgtgggtgagatatgttcaatttttttatatgacatttgggagatatgttcattttttttacgtgacatgtgggtgatataagttcaattttttttatatgatatgtggaatttttttacatgacatgtgggtgatatcagttcaaattttttcatatgatatgtgggtgatacaagttcaatttttttatatgatatgtgggtgatataagttcaaatttttggtagatgatatgtgggtgatataagttcaatttttttgtagatgatatgtaggtgatataagttcaaattttttgtagatgacatttgggtgatatatgttcaattttttaatgacatttgggagatatgttcaattcttttttaatatgacaggtgggtaatatatgttagatattaattnnnnnnnnnnnnnnnnnnnnnnnnnnnnnnnnnnnnnnnnnnnnnnnnnnnnnnnnacatgtgaaatcataaagcgcggcg

SEQ ID NO: 105906 - DNA, 3650 bp, Oryza sativa
  unsure (1)..(3650): unsure at all n locations
cctgtctagagatagaaaaagggaaagagtgaaggaggagtatgacatgcgggtcccacaatttttttaaaaataaaatgctgactggactgccacgtgtacgccacgaaggccaaacccaccacggattggattgagggggggtatttcgtccggtatgcatagttgggggtgaaaaatatccggttttgtggttcgggggggggtaattcggatgaccgcaaaagttcaggggggtaattcgtactttttcctatatgataactcacctcgatttccacaaacaagacccacatcgctatgcagataaggcgaactttcgccgccaaaaactatttcttactttgtctgagtggaggttgcgatatgcccgtccacggtccgcctgcacaaacacttcttcactagtggagccttaaaccgtcctcctgatgtatgaattatcacaggcggaactaaaacacgaacgggttaagttgtcctcctgtaaaaatttttttatatatagtcttcttccttctcgaaccctgttcagtttaattagccgagatttttctctcccaaaacaaacaaattatagggtggggttttaaactcgaaacttttagtggattttcctaaggcggtcagatccatacattctcacacttgttatgaagtttttttttgctttttttttgtcttatctgtgatggatatcttttagagctctatgtgtgtgtgcatatttgtttttggcttttatgcttttttatattttaattttgtggcaggtgctcgcactcataattctatgcatgggaatcatgtgcctaacctgctttgaacctacacacatacacagagatatgtactgctagtagctcactagctcgttgaatttctgaatatattagtcaacacataatataaaataagcatgtgattagatttatttttgtaagggcaacatgccgttaaaaaagtgttgctaaaacaatcatatatatgtatgcttagataatcatgtattatcacagaagaatatgagctgggcaacctctgtaacatgttacagtatggtgtttgtgaattttcggccaaattctgaaagttttcgtctcaaggatattttcatcattagaacaaaattgtatgttactaatagaggctaactgaacagcgatggtaaatcgtagaagttaaacaaaaggcaatgacatattatggaactgaaaacagtcagtggcagattatggatctaggccatagacaatggtacacgatagattttctctaattagatcatgccattacaaatatacagtattaaaaaaataccactactaatcataaatcggctgccattagcattttctaaaatttgaaccatgcaaccatgtacacatcaggcacccgtgtactcgttttttacatacggcattttcgtatgaaccattttgcccttctctcccaagttccagccttccccctcttccccaccgccggcaagtacatcctcgaatcagatcggtcacccctgcctcccgccgttgcagtggggactgggacaagacatggatccaattacatttagagaaaaataaacattaaaaccttcactaggtatatctaactggccttgatagacaggagttagagatgccaaaaggtaatcttcaattttttatatagaatacagcttaacaatatttattctaaaaccagagattattacctctgttttaaaatgtttggagttgtttgcatttaaggccccccttgattcaaaagaaattcgtaagaattttacaggatttcatttctatagaaatttttacactttgaatcaaagaaatgaatcctatggaaatcctatgaaatacatatggaatgcctaatacaatgcaagttttggaggagttataacatgaggttctacctcatgaaaacttttctttgagtctttatctcttctctaattcctgtgtttttcctacggtctaatcaaacggccattcctgtattttggaattatctggtttacatttatattcatatcaaaatcctgtgtttttcctattcttatattttctcaatcctgcaattcaaatgaccctaaatattacgatggatcattagtgttctttgaaaaacaacgtaaatatcgtttctcagcttgttgtgacttgtatcagtacgatttatatttttctatctgcactgattttttttaataagatacagtatatagttaatagggcgtttgtatttaatacagagtgtgtactatagtgaaagaaataaatacgataatacatgcatcctagtcacacgggttaaaataaaggacccaaaaaacgtgtaacacctgcaacatgtgtttgtttcttttcaatatatttgttttgtatctatggtgtgcattactgttgacgattggtcattgcaaatcttattacagcttactttaaatgacaacgtagttggtaggacagtatctcttaaatctttgacaaaatattcctaacgggggacactatcgcgaactgttagagattatacatacgcatgactggtttaggagtgtggttgtctgggaggcgaggcttcgttcgtttcacggtgagtttagaatatttacggtgcacgtgaaacgagcgtagctcaactagttagttttaatttcttgtgatggaaccagctcaactagattcaaatcataaatttaacatggcgctcggtaggcgacatgcccgtagttactttgccaatcaggagatatgttagcccaatcttccggagatgttaattgggtagagtgtttgtgtgttcatagatttgaatacacacgtgttgtgagcgtctgcgtttatactgtgtttctaaaagaactaattagtatataattaattaaatattactaattacaaacttaatttttttaaaaaaaatcaaaaattattgtagactatgatcattttttacacctccatcaacatgactgaggtgcccgccattctcgttttcaatatccactgtaacataaaaccatttaccaaccgaatactttaataagactaataattaattgttatatatattcaaaagttaataatgttatgtgtttgaaaacacagggtgtattatagagaaaaaatggccaaatacgatgctgcatcatcatagcaaactcgcacgagcaaaaaatgaaaaccccgaacgaacgtgttgcacctggcaggcgtgttggtttcttttcaatattttttttatctacggagtgctttatcattgatggttggtcattacgaatcacagattactttaatcactagttgatactccctccatttaatcactagtttttttaattttattttagtcaaactttttaaaagtttgaacaaacttatagaagaatatggtaacacttataacaccaaattcacactactgcaaaatatcaaataagtgtcggcactataggtgccagaagtgctaaaaccagcacctataggctttttcccacctccgcgggttgaaatcgtaaaaaaccgacaccttgaagtaattataggtgtcggttataaatannnnnnnnnnnnnnnnnnnnnnnnnnnnnnnnnnnnnnnnnnnnnnnnnnnncacgtgtcgtaaccgtctatgcc

SEQ ID NO: 105907 - DNA, 747 bp, Oryza sativa
  unsure (1)..(747): unsure at all n locations
cgtatagacggttagnngaaccttgncaannnncgttnnnnnnnnnnnnnnnnnnnnnnnnnnnnnnnnnnttaatttggtgaattatttagtgaaataaataaattatttagtgaactattgttcgttactgaattatttagtgaaatatatgaaaatagtttttttagtgaatttagtgagtttggtgaattatttagtgaaataaatgaattatttagtgaattattgtactttagtgaattatttagtgaaatatatgaaaataataatttttatagtgaatttagttaatctggtaaattatttagtgaattattttgactacaggtcaactaaaaatagcaaacaaatataaaaaaataattagttcatatgtaaaaaatggacaaatactatcggtgacgggccttaaagtaatgcctgatacagattacgtcatgtttatcgggatttagtttaaggcccgtcacagatgactcatccgttacaggctttagtttaatgcctgatagagatgatgtcaactctatcgggcattactttgatgcccgtcatgggctctagactaagcccgattgagataatgctttgaccatatttggactanggttcactctccctcaaatctagaacgaaaatttttcgaagctcccccactttttgaaccctagcaccggccaccctttgggggcccaccggcgcctatcgccggcgttccccgagcccttatgcccggcgccacct

SEQ ID NO: 105908 - DNA, 2449 bp, Oryza sativa
tgaccccacaaagatgaaaatatatcctccttacgcaaggtaattaaataacataagaaaggaccatggatgcttacttaatagaagaagtttctccgaacccatagcaaagtataccgacagctccggtactcctcccgaattcctcctagaaagctacactcgtcgaggtagaagtcggatgagcaccaaacttccgggcactcctccagagcttcccctcactctcgaccttattttaatgtacaaaagatacaatagagcctcttgtaattcagctcaaagttgtgtgtgttggaatgagagtaagctcctccttttatagcctccatatgatagtacaagtatgggaaacgaccaaactaccctccaaccgtcattgggatgaaatcaggagcgtacacgtggaaggctggtgattaacagccacaacaacggttcggccggaccaaaaaaatgtcttcccggcctctcctttggcgggtaggtagcttattgggcctccaacatcatgtactttgatttggctcaattctaagtggttttggttgacatatggggccctcgaatcagtgtaaacgcgtcctgaatatgcggaggtgcattttgtcgcatgacagatgtgttttctcctcaaaatacccgcatacacatatttcaccaacactagtggaaatgattagtaataaaacctaccactaagttggataccatattttatttcattatatgcaagtattgacggtcaaatattatgatttaaggaccgtcaacaacacctccacacttaaccttcactcgtccgagtgaaggctatggactctacaacagggttatgactttcttactaataatcatgcaaacaaattattcaaagtcatacctatagttgtggatctttatagtgtcttccatgcaatcctgagcaattgagaaatggaacaatcttgactcaagtcaccctaacttttcatgaagaacaacttagggtttttcatgtaacacaaaattataactctgctttgttgctcaattgattctctcgatcactcaaagtgtatgattcctcacaatggcatatgattgcgccttctctgaaactactttgaatcatcattgcaaaactgccactagaaaattgcaaaaataccactagaactgtcatttgagtggcatccttacaatattgaaaaaaccggtggcaaatttgcaaatgcccctttcttttcctaccatctaataaggcttatgtggagctcagggtgtggaaaagagtagagcactacttgcatcacatatattacaaagtcaaataatggatccacagaaatacgagacatactttctggtcaaaaatgtgcatgtgtatgtggatggttaatttgtgggtgaaaaggaatgaaaataataactccttttgtgtacctcctccatttattttctcttttgaaattttggaaagtgcatggctatctctttttttttctttctttttttttctcatcatcatgctccatacttgtatgagcactttttttctttctttttgcatagccatgcctctctctcatttttttaaagaactttggaggaagaggcataaatgacatggagtatttattttgtgaatagtggatgaaatgtatgacaaatgatgaatgctaacttccagtgtagaagtcaagcattggtgggtgtatgtgatcttgaccatgaaagtatgaaaagcatttcatacggatctcaaaacttgacagcgctcaatgtaatgacaagcagcgtatgtagcaagttaatcatgaataatcaacctatggctctagtaggaataaaaatatcaatgaggagtttaccatcgttatattttctttcttttataaaatgaagtgtacaacatgaagtgcaggatttctatcatcaaactatatcttattcatcaattacctagataacagggggtccctattggatatgtcaccacaagcaacaagtaatcagcaaacaataataggcatgcatgttattttaaggaagaccatgaactctaattgtaccatccctagcttgagtttaattatcttcgatattttagaattagaattgataatcaaattgaactcaagatagaatggatgtccaaagaaaaattgtgcaaacctgctttctgtataaaacagaggatgattcatatggtttgtcatggcttatcacttttggggtgatcttgctttggttacggcgttgatgtgcaagatcacccccacacttgtctttgtatctgggatgctttattggacaccaaaagaaaaaacaaagaccaaagtgaagcggaaaggactcacttggttggaagaccaaggaggcgactttattttattttattttattcatgaaagctagacctaagataactagaaggaggcctaaggactcatggcattaaaaacta

SEQ ID NO: 105909 - DNA, 1327 bp, Oryza sativa
  unsure (1)..(1327): unsure at all n locations
catgtttnnanatagatactgctcctnnnnnnnnnnnnnnnnnnnnnnnnnnnnnnnnnnnnnnnnnnagaaatttaggactgtgacaatattagaaatacattatgtacaccaagaaatgatgtttaacttatttgctccattatttcattacttttatttataaaactttggtatgccacatgttccttatttcttgcaaatccattatttaaattttagccaatttctattatacaaaatatatttgtcccagaaagaaaatctcaatggaatgacaaggaaataattggctcaaaagatgaagcatgcacttctcattacatcaatgttgagaattttattctttaacgtatgtttatatcacgagatcaaattttggttggtttgaagcgtattaaggagataagctagcaaaattcttgtgaattatccactcaattcacgtaacgaggaggtattatttcagggatcaagaggccataacatgttttaataggttttcacgttttataattgatggttttgcagtaagaagtcgtaagaaaattctactagttacaactggtgtcaggaaatttatttgtcgatagggctaaccaacccgtttgagttgtaactcctctaggtatgttgaaaatcatttaggtttttattgctaagcttgagactgtgcctttgttcaagcaactacatacaaatattttcttgggcacaaggagttaattaataacttatttgttttaacatactaatagttgtgaatgtattttatttgtgcaagaattcccatcatacattaggcattccatgttgattagtactagatgggtactccgcgcgttgctgcgggagaattatgtgataatagcgtacatattacttctaagattttctttcttacctactatacgatttttttcatgtgtttatatttttttcaccttgatcaattatccgtaggttataaatgattgggttgcgtggtgtgtcctttgtacgcaatagatgtgatttatatcctgtatcaatcatccgagagcttactcaacaatggaggtgatgtgaagagattcgcttgacccccttgatgaatcatccaaaggttcccatcaattttggtgttgtagcttcatcagataagagataattagcattaccgacacttagtgggcatgaacttcatagcgagatagcatccgccttcatcagggtctcatgacaccagtgtttagattggtaaggttggttatcaataagtcttgcttgggtagagctcgctccgcgtgggttgcatggatagaagttgttctacctacacatgccg

SEQ ID NO: 105910 - DNA, 1118 bp, Oryza sativa
gctcatttatattgtcccatttatttattccatttgatgggtgtcgtcgcgtcttcttttcatctacttttgtttcattctatggcatttggactttgtgtcacaaattatattataagtgaggcactaataaaaaatgtgtttttcttggcaccttctttcttttttttcctctagtggataaaattcgaaacacttgtgaaaatataactgaacgcccttgtttaatgatcactagttgtcgtcttaaaacaattgcctgtaaaaatatccccattttcacaagctatcttcctagccaactacttttgaaaatattttgtcaccatcggttctgctacgcaattgcgtgataaataaaacgcttcacggtattaaaaagggttaattggatccatgtcactgcaaatatgacatactaaaaaaataccactactattcttgaaatttgttgcgtgccgctagaatttttaaaaaattagaaccatgtcactctgtagatggatgccaagctgtctcgccagtgacctcgagcctccgccccgatatcaaagacgtcaccgctcgtggatgctgctattgctattcatgcggcccaaagcagagccaccccttgaggcccatgccgcagatgccatggacactaacttcctccttagggttgcggcagctttggcggcgacgaggaagagaagtagaggaaggaccagaaactcttcatccccgggctctcagccgtcacggaagatggcggagggttggccactggcacagcagagggaccgtggtgtgacgtcacagacctttctccgctctagcccaccgccgaggagtagagcgggggggcaccgctgcacggtggaagcatggcgactaggtagagggcggatgttttggaccccgagagggaagaagaggctggagtgctagacttggacgagaacacgagcctgcccagcttctcccgtaggcagtaggcacatattcctccgctagccatcgccaccaccgcttgtagggatgctcgctagcttcgctgcagtactgaattcattcaggcatgcttgcactaccgagccatcatcctcattctcattatccactcctttctccggtta

SEQ ID NO: 105911 - DNA, 721 bp, Oryza sativa
  unsure (1)..(721): unsure at all n locations
gagattcnaagtaagacacgctgcctnnnnnnnnnnnnnnnnnnnnnnnnnnnnnnnnnnnnnnnnnntcattttcgagttattgcggcctatttggacatactcgacgcgtagactgttctgttatccatcaatacaagcccgcggggtttgatgtgtcgcacacagatactgcaacactccggatgcaaaaaaaaaaagggatcggtcatcagggcaactgttaattatgggccatgttaaagagccgtgggaaaccaataatagagccaaataaatctcttgctgtcaaacttttcatagccgaacacacctcaatgaactcattcgctcggaaaacaacctacagagctgtcgggaacaacaagagtacttcctcgctccactaatgaaataatgtattctcgggtcttaaaatcgcctcaggcgaaacggggcaccccaagagaatactccgaaacatatgtgtagattgccgcccccttcccctgagcattgactagcggcgaaataacccgatgacgcatactgctgcacgaaactctgtgcgcaggtgtcacgatcctgtaaccggaggctggagacccagatgcggggctaccgactgctacatgagcgcctaattaaaaaacggnggccgtctaaacgtctaggcatgcgtcagcgcgggaactagaaactccgcagaagactcgtcctgcttaagacgcgagcgacattt

SEQ ID NO: 105912 - DNA, 722 bp, Oryza sativa
  unsure (1)..(722): unsure at all n locations
tttcgtcaccgtgttgataaacggaatctcacagaatggagcctttaattgcactgtaacagcaaacaacttttgggaagggaaaagctccagctccagtgtttgaaaatccacaagcgaatgtccaaaatacgacctgttagggaacggtcgatgtataatgcgtagaaagcagtcatatatccgtaactcacaggtctgtagggaactctaaaatgaaagttccggcttggaagacagtaacttccgacaacnttatggaacgttcagtggtcagtccgtacatcctgaacgtagaaacaaggatggtcaggacgagctgttgggtcctcttcgagtataagcaacatggcctcatagggattcttgacacttggttcaaactgagtgcctttggagtatcccaaagcatcacgtggaaccccgctgaatagtgcggttttgcctaacacttcgtagtcaaaaaaggaaccatcgtagcacttctcgagggcgagaggactttatgtatgtacttttggggggtcaccaagcatccatattcatcgccgtggatctaatgcactaaataggaactcaataaggtcattagtcctttaacaagagatgtcattattcaccggaacccagtagggggnnnnnnnnnnnnnnnnnnnnnnnnnnnnnnnnnnnnnnnnnnnnnnnnnnnnnnnnnnatgangttagncaaactccgggcaggg

SEQ ID NO: 105913 - DNA, 1561 bp, Oryza sativa
  unsure (1)..(1561): unsure at all n locations
aaaattttttctattggattgaaatcctccaaaattcttatgtattttctttaatcaaaagggcctaaatgctttttaaaaaaaccccccccccacaaaagggggggnccganaattaatggaataaaatctttattttttattcaattatagtttttggttttcactacatatggtatgtccagcatgtataacaaaacttactaatacatgggaaggaatggctcggagaagactcttgtctagtactactatgttccacaaatcttaacctgatcgatcaacaggcttcaaactttctttttccacacttcgatttgtttgagcgcctctgtttttcccctgtttgttcggagctctgttccgccactgtttttcacgtcattcatattgtgtgatttgtgtgaactgtcacatttatcttcacgtgatttagcccttgtttagtttccacctttttcttcaaactagcaaggtagcccgcgcggcacctttacttagtggtgtttgaaattttgttatcatgtttatgtataggttctttttaaaaaatatatcttttttacttttaaaaatctgcatttatcaataatttgttagggattgttttgaaagttggtttcgttcattggacatacggacgtgcgctaagaggggggcatgttcttagacatttgtctacatgcatgcgtagctatgcaggtaagttggaccgacgaggacgtcgggacatttgacggttgtgtgtgacatcctacttcacttagaatgtggcctttctttttttagaaaaaaatgtgacctatgttgctcataaacattgtgtgcgcttgagtacaaccaacttgtaagtcattgtcccttccaacatatcattttcgggctaactattttacacaaagtgagaacaaaaatgtaagtgggatgatatttgaaagtgggcgtactagttggatgagctaggctgtgttgttctagatgataggttgttacaaattgtaaactaaaattacttaaatcatgtcgtaatatgtcgcaagaatggagcagctggttcatatgaaactataatttatattacatgtgtttagatttttttaaaaaaaatatcatattaattaaaaccgtaatatattttttatactaaagatgttttttagattttatgatatattagtttaagaaattttttattaaaaatgtggtaatatgatttctttatctaatttattaaattaagacatacccacgtactcttgtttgcttctcctacctccatccataaatcgaaatatttaaattttatggtaaattataagggattataaatactactcgtaccatccaaccatctctcatttaatttttatccaatattactttaaccaccttataattcgccaactaccctatttaatgagacttattgaatgaggggcaaaaatatccctttttgggttttggggggggcccccttttttttttccccttctagattttttcttccttcttatttcctataaaattatatgatccattttaggcagaagatagaattaaa

SEQ ID NO: 105914 - DNA, 936 bp, Oryza sativa
  unsure (1)..(936): unsure at all n locations
gtgtgcattgaanatcgatataacnnnnnnnnnnnnnnnnnnnnnnnnnnnnnnnnnnnnnnnnnnnnnnnnnnnnnnnnnnnnnnatcaagagtaattggactgtacttatatatccagtctgcccccaaaattacatcatatccctttagtggtattatattgaacttgttgctaaatgtctccccttgtatctggtaaaccaattcaggaacctgtacttcagatttcaattctccccctccagcgactaccactttctttgcatcagtcgacactagaggacaatggtttctgacagcatagtcttgatccataaatgtgctagtgctgccactatctaccaggccaacagcccttcttccattaatctgaataattacagaaaaagtatctggcctcgtggttccatatacagcattgtgcgacacaaacataagctcttcttgattttcatcatcaggtggtgcttcctccttttccaacttgcagtcctcctgattccctgttaactcaccttcttccccctcatcttttccttcttccccttccatgagcaaggcatttaaagcctttttcactttacactgatgtttaggaaaccagggctctttgcaaaaccaacatttcctctcctccttcttctccacctgttctctaggttggcctctgttgacaacatttcttccctgaataggcccagcctgattctggaacctattcctgttaaagttcagtagattcttcctagcatttgctgctctctcatagttctttgtataccaataggattccagcagcccctggggcttatggccacacacatcatgcttaatatcacctctgagccctccaataaagcagctatttagatactnnnnnnnnnnnnnnnnnnnnnnnnnnnnnnnnnnnnnnncgcgcgcaatcaatngacgc

SEQ ID NO: 105915 - DNA, 945 bp, Oryza sativa
  unsure (1)..(945): unsure at all n locations
attcttgtgttctgccaatatctgttctcctgatnacaagtctcttgtctgaacgtaaattgtaaccccagactatgttcacttaagactatgtacaagtatatccttcccaataaagaaaatctccatatatcattttaaaactatttcgaatttccattccatggaattcaaccaggaacagtaacatttgattgaacaataactgtctaataaagtttagttcacagcatttctaatccaaaagcattcaccagcggaaacacttaatatgcacatcttgagaaaagattaaactaatccaaaacaaaaacaatgccaataatacaaaatatacaaagtttgtgagacacaattaccttattggttatttgtgtgcaatgtctcacggaatggccttcgtctcttcgatggagctccttttgccctaatctcttcaggatcaagtactctcttctctaatggctggttactagacgaaaagtgagttggcataggaccaaaatctccggccacgatgttctcatcggatgacgatcctttatccaaaatcccctttaagaaatccatcgccttttctgtctgctcagggttcctagcggcctcgaagaaagcatcactacctagatttcggaggctacggtaccgaaccatgtgttcagaccacacattaggatcggcattcctgtctgacctaaatgccgcctttgctcccattgtccacctatccacgacacaacaacgagggatggtgtcaaaaccaaggaacttgactacaacaaaaatgtgtgagcaagggatgtctttgcactccatcttccgacagtgacattccacaccttccaaagcctggcctttaaaagaaaggggtgccgaattcccgagtttaaggnngcgggngtttcgagnggattcaaaannngngggtttcaaaatgtgaactcg

SEQ ID NO: 105916 - DNA, 578 bp, Oryza sativa
cgtgatctaagcatttgtattacagtatatgttgttcattggttaatttagggttaaatcatgttttctttcctagaatacgtatgacaaggcaaattggacagaagaaaaaacttacacattgtgtgaaatagcatgtgaggaaataagggatgggcattgtcctaatggagcatggacaactagagggtaccagaatttgaaggccaaatatttccaaagggctaacctaaggcattcaaccaaacagataaagaatagattcacccatctaaagaattattacattgcttgggtgtggctgaaccaacaaactggagctggtagaagtgctagtggagaaataattgcatcaaatgcttggtgggaaaaaaaaattaaggtatgcagttgtcaaaaatttagctagtttacatgattttagagttttttgtgatattgatttagtgtcaatacaggagaagggggacgccaagaaatttcgccatggcaaccctgagtacttagattttcttatagagatatttcaaggagttgcagttgatggttccacagcatacatccctggttttgaagag

SEQ ID NO: 105917 - DNA, 3846 bp, Oryza sativa
aaataattgataattgcagatttttaaaagtaaaaaagatatattttttaaaaggacctattcataaacatgatacgaaagttccaaaccccattaagtaaaggtgccgcgcgggctcaccttgttagtttgaagaaaaaggtgaaaacaaacaaagggctaaatcacgtgaagataaatgtgacagttcacacaaatcacacaatatgaatgacgtgaaaaacagtggcggaacagagctccgaacaaacaggggaaaaacagaggcgctcaaacaaatcgaagtgtggaaaaagaaagtttgaagcctgttgatcgatcaggttaagatttgtggaacatagtagtactagacaagagtcttctccgagccattccttcccatgtattagtaagttttgttatacatgctggacataccatatgtagtgaaaaccaaaaactataattgaataaaaaataagatttatccatatcgccctgagtaaagcatttaggcccctttgatttaaagaaaatacataagaattttggaggatttcaatccaatagaaaaaatttcctatgaaaacctttgaaacaaatgattgaatcttatattatcctttgaacttcatatggaatagacaatcctatagagattttagacaatttagcaagagctccaacttcgtagaagtttcccttttagtctatctctctcatctgattcctacgtttttctgcagtccaatcaaacggttatttctgtgttttttttatattttgcaattctttgttttacacttttttcctatattttacaatactctgttttgcacttataatactattagaatgccgtgtttttctattcttgcgattcaaaggtaatcttaattccatatttaactatgagtaaaaaaaatattcttggtgacgtggacaagtctttctgtacattaaatcctgatatttctataacttaattattgaagattctgagatttgaatcgacataagttaagatagtaatagttttgaggtaggtagtctgccaatttgcgcacatgaacacatatatttagaaggtactagtagtcagttctctggctagagatatgcatagtttgaaagaaaaaactttaccgttcttatacgacgcaccgagaggacgtctataaaaaactaccattccattccacgtatgtgttggctcttattaccagaagaaactagggagatgcgccagttactgtttaatcacgcatcgtgtcttctctccaaacacttgtgcctgggacttggaggcgttgggaaatgctgtgctgcaattacactccctcatcttcctttgccgatgactagcaggtaaggttgagagtgattcggataattttcgttctaggatagtttcgatctgatatatccgaaaatttttgaattcggatacttttttcggatatgaaaacgaatatgatataagtgatatccgttggaatcggatatctgtcggatattatcctgtatattcgacttacacataaggcccataagctagctcaacccaaagagaaggcaaatcagacttcttagaaaaaataaatttcgaattaaattttatgatactaaataaactcatatgaaaaagttatcaaaaacatagttgtagaactcattgagacctaccaattttgttttcgtcatttctccatccgagtttgattgaactatataaattttaaattttaaaatataagaaattcaaataatttctttgggtagtacatgatttcaaatgaaaaaattatcaaaaacaaagttttataacttatcaagatatataacttttattttggtaatttttctatatgactttgtttgaacaatttgaatttgaatttgaaaatatgacaacttcaaacaacattttcaaatactaaatgatttcaactgaaaaagtcatcaacagcaaagttatataactcatcaagatctataacttttatttcggtcatttctatatccgacaaagtgatagtaacattgttcacaaaatttacatatctctcatttgtttttataaactataatagagagatttaaattttgtgaacaatgttactatcactttgtcggatgaagaaatgaccaaaataaaagttgaatgtcttgatgagttctacaacttttatgttcatgacattttcagctgaatttatttactgcttcaaaatatcattcgaagttttgaaattcaaatttttaattgataaaacaaagtaaaaaaaaatagccaaaataatagcagtaaaaacacaataacatgatagagcatgattttaaaaacacaatatcaaaaatcgtttgtgagtagtgaggggtttttatattctgactaatattcgtcaccgtattcgtttcgcttcgtattcgctccgtatttgtattcgataatattcgattccgttttcatatccgggtttccgattccgatttcgattaaaaaaaatatgaaaacgaatatgatagagctagtttccaaccgtattcgatccgttttcatccctactagcaggcccaggctaaccacactttggtgctttgggtgcagttttttagcctctgtgataacatcttgcacaatgataaacctaaagtctatgccagttttgtatctgccatgaactaggtactgcagtttaagtgcttgtgcatatatattccccaggttatgtcagaatttcactgttgtaaactagttcattcatagggtctatgtctccaggacatgcttggcagagtgatggggatattgtagccttaattatttcgaaagctgcgtaccaagttgggatggtttttgatcttccacagaactttctcataaatcaatcgggttattaggacaaaaccgtacgattcattttcagatgttttttttttacgtgtatacaggatcgagcactacaccaactgatcatttgtactttgataagaaaaaacatgataaaccccggagggattcatttgctatctttgccatagtcaagtctgtaggacatcttttcttgtgctggtgtgatgtaaaaatccatatcagtctagcacgatttatctggttcgatttcgagctgtgaagattgtccagacgttctagtcatatcttaataataccgagacgccaccttcataaaacacacactataaatgttaggatacgcgtaggctacgatagcataaattaaaattttctatcgggtaaactaggaaccatgtaagtattagatcatagatcgttaccactcgacgcgctgtgcagcggaagaagacgctgagaagtcgaaggaactctcgcgtagtagcgcgcgtcgatgtagaggaagtagtcgatagcaccggctcgaccttctcctccttgtgcgttctcctcgccgtactcccacgccgatcagcaccgcaaaccagcggcgcctctaccggtatccacacgtacagggacggaacgccacgcgcagatgtgctagcccccgcgcggctagggttttgctcggggagggaagtgatgcctaaggtttctcacgtgatgcaatgccttcgccggtcacacccctcacgaatatataggattcatcactcgggcctccaaggcccgtaggactcctattcggatccctatccgaattaagctcatattggatctctatccaatccccttatttcggcccattaagcgtgcgacactggaggttcatatatactcggctgtaacccgaaaactccttttcggtccacgtgtcaacagaggcccctagcagaacgtattgacctaccgggcatacataaagatcatatcggctgaacctc

SEQ ID NO: 105918 - DNA, 1091 bp, Oryza sativa
ctaaaggaacgcccgttgggttatttccggtcgttacaagttggtatcagagcccccttgaccttaggacgacccgtagatcccaagccttagcagtattttcgaaataaaaatcctctgttatttgtgaaaaccctctagtctttctctgtcttgctgcttcatttatcgccaaaatctgattttttttaaaaatgttgcttttctttttgtttttgtttgtagatggccggcagcgtcacccgtcgtggtttggacatgactggtttcgtcttggagctgcggggcatgtgcgttgtcctggggtatccacatggagtggactaccagggcaggccgcttccggagcaggaaggtgacgatgcagagccccacgctgcttgggaggccactgcagtgtcgcgtcccaaaacgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttaaaaaggttttataaaaagaaaaccctaaaagaagtcttttccccctcctcctccctttttgggccggctcggcccattccctccctctctctctctctttccccccccggcccatcggctccccgcgcgcgcgcgcgccgctgacaggcgggcccgcccgccgctctcgctgacgggtgggacccacctgtcattttccttctcccgccgcgcccgtcgtcgcgcccgtgccctagcgccgccgccgccgcggattgcgccgcatcccgccgttcccgcgcgcattaaagagaggggaatcattccccgtgattccctctcccgtttcccccaatttcccctctctctcttcctcggatccgtccggattcatcccgtaatccttgccggcgacatctatggagcccgagatccccgggctcgttttctttctttccggccgcgttttcccccttttggggctatataattgctcc

SEQ ID NO: 105919 - DNA, 839 bp, Oryza sativa
  unsure (1)..(839): unsure at all n locations
cagtccnnnnnnnncctaaaannnnngcnttnctnnnanannnaggaannnngnaccgcgttcttaccattactggatcgaaagacttttatctttactagatttttaatcgannnnannagctatatatgcacgcctnaataaaaaagcaaagcaaaagaaagaaaggaacatgtgaccaaggcattatccagtagatacagaggattccaagaatcttaggagcttaagattataaaggagaagaggctgaccaaaaaaggctaatttgggcgttcagaactcaatttggggatattgctggtagatttcaatgatccattcatttttgtactctgccccacctgtatgtttatttatcatcatgatgcctgctagaaaagatcttagaatccttttctcttattactttggtgatatatcttgatgaaacctaagtgacttatgatgttttctttgaggacactgtttgtaatttcactgacttaaatttccaaaagcagtatcatcttccagtcagttgagtcttttcaagaacagatcgaagtccataaccataagatttgctatccttagaatgaagcaactatccctggtgtacgtacagtagaaacacacacacacacacacacacacacacacacacacacacacagagagagagagttgtgcctccagttccaacttccaaatgatattcttcattgtgcactaatgagatgttaaataaagttccattgcttctgaacgaccttacaaatgaatttactgtttagagccagtttaaggcattccttaaaatatgtgggaatttgtgtaagcttctactgccaaaacag

SEQ ID NO: 105920 - DNA, 926 bp, Oryza sativa
  unsure (1)..(926): unsure at all n locations
cccgtcatttccctagngtccngnannncncnnnannnnngaannngnaccccttcttgatgccagggagatgcctattttgtctatgcttgagaggattagaaatcagatcatgaacaggttgtacaccaagcaaaaagaactagaaaggaattggccatgtggcatctgcccaaaaataaaacggaaggtcgagaaaaatacagagatggctaatacatgctatgctttgcctgctgggatgggagcatttcaggttagcgacagaggatctcaatacattgttgaacttaatataaagagatgtgattgtaggaggtggcagctcactgggattccttgtaaccatgccatttcctgtctaagacatgaaaggatcaagccggaggatgtagtgtcattttgctactcaaccaggtgctatgaacaagcttatagctacaacataatgccactaagagatagtatccactgggagaagatgcagggtatagaggtgaagccaccagtatatgagaagaaagtggggaggccaaagaaaactaggagaaaacagccccaagaactagaggatgggactaaaatttcaaagcatggagtagagatgcattgtagctactgcaaaaatggtggtcacaacaaaactagttgtaaacagaggaaggctgacttaaaacttcagaagcaacctatgcagcaaatggcgacttcatcaattgttgattcagaagagcttgtcatcactcgggtaatatttatacttattttggtcgtgtatttgtttatctccactaactatgaattttaaactcattgtatatttgtttcaggaacctgtcatcactcaggtactattgatgctcattttgcttgtgtatatgtttagctgcactaaaaggaatgttaaacagaacatatattctctc

SEQ ID NO: 105921 - DNA, 681 bp, Oryza sativa
  unsure (1)..(681): unsure at all n locations
accttcnnaatccngacgtannancnncnnnnnnnnannnnngaancggnccccgttcttaattgggaaaacaattaacatacctgttttttggtatatattcacattgtaagaatcaaaaacccgcgggtttttttcaagtaatctgtgaatgaattaactgaaggaccaccagcaggtacaaatttagcccaatatgaggaaattaattaaacatctcaaatagcagggggggggggggcacaaaaaggtaccaaccaaaagcaaagtaatgatttatccatactaaaaaaacaaacaggtaaacaatccaaactgttttcagtaattttctaataatcaggtatgtgaaccaaataatgcacacagcagcatatttatttagcaaagaaagttggaatggacggtattgtaggattgtaaaggtcaattctgtcaagttaacctattggtttctggttgtacatcttttacatagattataaaaggtatgtgattttaatacctaaatcatagcaagcacaataattttatgagcagatactatcagtatgtttaaaggaagagggtgaaagtgcaagctagtcaaataatacataacttagttaaaatgggattttaacctacagggcagcactcatcgtcctaaactgaagctttatcatcccaaaccaataagta

SEQ ID NO: 105922 - DNA, 873 bp, Oryza sativa
  unsure (1)..(873): unsure at all n locations
ttcttgacgttcaagnggtactngattnntcantcananncnnccgancaaggtatcgatttcgaacccgtttaatataattccctaacgttgaacactgtagtactggaagaacaataattaatatcagcattcttatgtggtgtacttaaaaaaaaaaatcaatataactatcaaagacacacggctcaactaaaacgatatatttaaacacttgcacagctgttttggcagtagaagcttacacagattcccacataatctgaaaaatgccttaaacgggctctaaacagtaaattcatttgtaaggtcgttcaaaaacaatggactttaatttaacatctcattagtgcacaatgaaaaatatcatttgaaagttggaactggaggcacaactctctctctctgtgtgtgtgtgtgtgtgtgtgtgtgtgtgtgtgtgtgtgtgtttctactgtacatacacgttatactgattaagtaggcctttttagcctacaaaaaatatttgggttttgttcaggagactggtttttgaatagtcattctcacggcatgttatatgcttattttgattatgacgtgagtcatgccctaggttatttagactcatcgatttatatcacatttgatggatctttttgagagttttaactcggattcttgtcatatgtgttggattatggaccgtatagtatttttaactcgggtttctttatatttccatttttggtatatcaaagctagagcagtcggctggatcttttatcaagcgtctcatatgcttagttgaatgatactttgaatgattcggttgtaaanccantcggttggatgttatttacacggggtaccgaattccgagtcgtccgc

SEQ ID NO: 105923 - DNA, 3350 bp, Oryza sativa
  unsure (1)..(3350): unsure at all n locations
cgctgtcctttgatataatctcaatgatagcacccnnnnnnnnnnnnnnnnnnnnnnnnnnnnnnnnnnnnnnnnnnnnnatcagggcaccacgccggcgcttaaaaagatcgtgttcagcaaatcatcgtcgcaagacacacatatgtgatcctctcgaaatttgggttgatcctcagatttgttgtgaggataaaaaaaaacatttcgacagtgaatatcttaattgggatgtgcttcgattatgcacttgtaaataaaaattcgaaacttgttggaaactgatataaggtattcttccatctttgaagaggtatatatatctccttattattttagtgataaaaaaataaattgactaaactgattagaagataaatttatgattagtaatgatgaagctttttttattcttggaaagtacatagaggtatatatgccacatattgttagttatgaggtatatacctcctgaccgacatatatacttgtgctttaaaaatgaaataaaaattaaaggatatttaaaaaaatgagttttcaatcttattctaacctttaacatttgttttggtaactccgtttataaaaagagatcttaagtatgaagaggtatatatctttaaaaaataggtggaaacctcaaatggtatacaagcactgactctgttactatcttcatatgtaaagacacatcggaacaaatgggttcgtaccagggacatctagtttccaaaatttagaacgcgattgggagccacaatagacagtagccctccgatgcaaatgatgcgcaacagcgtcgagacggtcaacgataatggatagaaaatgatgttctagagatacagcggcgaagaaaatccgccggtggtgacaccactcgctggagctccggcaactccccgtcaatctcggcttcctcaaggcgagcatcagatctgactattttttttatatataaaaatggaatgactagtttaactatcttcaaatggcaattacttctatgggcaagtgggcccaaactaattctgtgatccatttcacaataggccagtttggatcactgcaattgtggcgatccagatcagggttcaccaaagcgttttaggtgaggttaccatcaccccatagtaaagcggttatcacggtacccgcgcggttatcataaaaacagtggttacctcgaggattaccacagttttaacaactgagaaggttaccacacgtgataatcgcgtggttttgtaaaccctgatgcagattcagtgggccttaatggccactacattagtttgccatttgccaaccatacaagagtgagtccgttgagctttcgtggggcggagacgatgtaatcttgtctccaattatatcattttcacatggaacatttgttcgctaagaaatgtatagtatatatttggacaatggattttgagtcaaactcatttcttgaccacttataatgtgttatgtatgcttgggtcatggattttgagccaagctttttttttaaccacttatactgctaggacggtagcatccaattttgggcaaaggatgtatgaaaatttttccacctcctattaggttgttatgaaatagttatactttgttgggtacatcagtattgtgacgagtcaaatgcgtgttactaaatatccggagtctaatgttacactttcttttctccaataagatggtatggtagtgtagtgttgaactgctaataactattcccttcggtttcataattcttgacgttttaaataaggttgaggtcaagtgctagaacaatatatcgatttattttacaaagtgctacaataagtaaaaatatttttattgtattatatattataataaaaatatagtcaaaatatattttaaagatcgtgtcattgttcaatatgtcaagaattataaaactggagggagtaaagatcactctacgtttacctcgccaagtgcctagtgcctataaataggataaccgctacttctctagacaaacccgcactccaaaatcagtaaaccttgaccatctcttccactgactactagaaatcggtgataaggagagttagaacatgtgttgctggttcgacaaaccaaatactagatatacactgagaatgggatgcatggggaattcgagaagaacttccgtgatgtgaataggatccaattgtagcagcacggctcactgtatttgatgacaatgtggttgtatagtcaaaggttgtgctacactgcccccatcccattttgggtgcataggctaggaagtggttggtgctgtcgctacctgtcatggattgtgagtctcacctcgatcgaccgagtccacatgcccaacgcttgtccacttccggccaaaacgacggccgaaaccttttaaggtgcttgagatgtaccagatggaggtacctccctcactacttaatcacccaccattgatcagttaagcacaacttaggaatagaaaacaatatattataaaagtcgataattaattccttttacatgtaacagtctctctctttttttgcatccggtttgttacttatcttcgattctgtcgttcacatcttaacacttgtccaaaatccaatttccctaattaattcttcaggttctcatctaaatttagagtccaaagaaacacatataatcctctttcgtccatacacaaagacaaatatggctcgatcaactagtttgatgaatctttgtatgtatacaaaattcttggtcattgtggatcatcagtggtggtggtgttttgtccgtgcggcacttgctgaagaaagatgttcttatcagcaagcagggcttatcgatcctaattcttttactgattaattagaaccccacctctaatatgtatgaaagtaaagttactaatctaaccttccacctaaacatcgagttaatacctaactcacttttttaataccttctgagacatacttcttccttccctaaatgtttgacgtcgttgacttttttaaatatgtttgaccatttgtcttattcaaaaacttttgtaaaatatgtaaaactatatgtatacacaaaaatatatttaacagtgaatcaaatgatataaaaacaattaataattacttaatttttttaaaataagacgaacggttaaacatgtttaaaaaagtcaacggtgttaaacatttagggatggagggagtaccttttatcacagaccgttagatggcaagcaatcaatagacaccataactcccaagcacaggaggaagtatataggtgcaggggtaccaattcccagtttggggcgntggaacaggactctacttcaagaacag

SEQ ID NO: 105924 - DNA, 747 bp, Oryza sativa
  unsure (1)..(747): unsure at all n locations
gtggccttgaatgccattgagatgcgcctcgcgannnnnnnnnnnnnnnnnnnnnnnnnnnnnnnnnnnntgtcagtgggatgtttatgttaccacaataagctcatctctagttgcccttgagaaaaataagctcattgctggaagtgactatagtttcacagtaatcaattgtggtgacttccagatgcctatgtgcttgagtactgtactttgtctgggtcaaactatccagatgtcactttactttttgcattgtcattgctactgtcacacttgagtttgctgaatcgcttaacttttgcagtatgagcatatggtgttgtgtagtatcacattatcaaatcatagagcaattaggcttaaaattttcgtttcacaaattagtcgtaatatgtacaattaaatttttttctaaacctatatttaaaactttatagagatgttcaaacgttcgatatgatatggtgaaaatttttaagttgagatctagacggggcctgagtcctaaccacctcgtggcggacacctgccttcgtccctgtggctccaccacttgaagcctttgccataaaaagtaggagtcgtcctactcctacccctacccctacccctgctgcagtgctataggctagccctacctccctggctctggtttctctctttctctctcgcctncttcgcttcgctccattggaggaggggctcattgctcccttcctcccttgctttttcttcatanagagg

SEQ ID NO: 105925 - DNA, 750 bp, Oryza sativa
  unsure (1)..(750): unsure at all n locations
accatctccagctgaggctgcagggataattgctcggttaaaggacaaaaggtcagcagctaccctttttttgataagttgcttgtagcttcctgtatacgaagtttcattgtattatgccttatcttatctatactgtgggttaaaattgcaacagccttgttactttttaccatggtattttacatattctagtgtttatattagtactaaaagagagtcactagaatctaactaataatattagagtaatgaatttttaattgcaataatgatatcatggctgatattctatattctatcaattggtaatgaatgaagaatccctagcttttcagagggcacgacaatttgtgcaattcagaagggatgtatataaatgctaaaagaagtgattatgtatggttgggttgctttttataatcgccacctttactacatgtgtttttcacactattccttgtgagcatgcttgtttggaatgcaaaactgctgtatataatactgtccttttttctgcagtgttgatgagttgcagaggctgttgaaagacaaagaggcatataatgctttcttcaattcactcgatcaagttaaaacccagaccaacgtaagttttgttgctgagtacacaggtgtttgaaatttgtattggtggctgtacttagatgtttnnnnnnnnnnnnnnnnnnnnnnnnnnnnnnnnnnnnnnnnnnnnnnnnnnnnnnnnnngagttacataggnggcgg

SEQ ID NO: 105926 - DNA, 748 bp, Oryza sativa
  unsure (1)..(748): unsure at all n locations
gcgctgcatgaatgcacatctccttnnnnnnnnnnnnnnnnnnnnnnnnnnnnnnnnnnnatcagggatttagctcaatctgatctcacgagcatagtctagatcgagtggagttgtgaagcagctcggagatcgttcaatcatggtgatctcgaagaagttgagttgtgggaaatcgttcgatcaaggtgatgttggagttgacggcacaatcaaatatcgagatcaaggctgagggggaagtgggaagtgagtcgtagtgcccggtgagggagacagcgtaagtacgtaattagagctagctagtaagctaagtacggcgccgccgattaaacaccataaaaccacggcggcacacgtacgaccgatcaatattcgatcgatttaccttcatcttgtaaggacacgataggagcatcattcctccggagacaatctcagatcgaaggggcgatcgttaacgaaagcgcgagattaattttatcagctctctagtgtgattctctctggaatatgctgagtatcattcgtaagtcgcaacccaccgtaagctatgcaatctataactatacntaatttagtggtgatccatgttaatcatacaggaaccacctatatnatttatcgacaaattttcttttaaaaatttgatagatataattataggacaatcgcaatgtaattacactgtaacttgcatgtaactacagtataacttgtatataactttcacgtatttttgaatcat

SEQ ID NO: 105927 - DNA, 751 bp, Oryza sativa
  unsure (1)..(751): unsure at all n locations
gcggccattgatttgagatgcgcctcgnnnnnnnnnnnnnnnnnnnnnnnnnnnnnnnnnnnnnnnaatagttccgaaggctcttgaacccagaactatgtgacttttcaaaatgtcaaaagttgcaggggcaatggcgtggagggagggtacactagtccctgcgtccccaggggatgtttagatatacagttgtaaagttttagcgtgtcacatcggatattgtattatggtgttgtatgggttgttcgggctctaataaagaaactaattacataatccgtcaataaaccgcgagatgaatttattaaacctaattaatccatcattagcaaatgtttactgtagtatcacattatcaaatcatagagcaattaggcttaaaattttcgtttcacaaattagtcgtaatatgtacaattaaatttttttctaaacctatatttaaaactttatagagatgttcaaacgttcgatatgatatggtgaaaatttttaagttgagatctagacggggcctgagtcctaaccaccttgtggcggacacctgcctccgtccctgtgctccaccacttgaaagcctttgccataaaaagtaggagtcgtcctactcctacccctacccctacccctgctgcagtgctataggctagccctacctccctgctcctgtttcctctctttctctctcgccttcttcgcttcgctttcattggtggnggtcttcattgctcccttncttccttgcttt

SEQ ID NO: 105928 - DNA, 651 bp, Oryza sativa
cgatatatattgttcgttggtggagagacgtacatgaaatatgtctttttgttgtaggcaagacaacaaaaacgtggttgtggtgttgaaacaaccccctcttgatgagagttgaaagaaagagaaaatctattttggtgttggtggatgacccccacatgtatggtggcccccacacactcctaatattttagagggggccacgaggaaatattttctccgtgtgctcaacatatatccccaaagcctccttcgtcaaagggtttgcgccaccccactttagaggaccctacacgtttaaatccacgtgtgtattaaaaaccccctctccaaaagaaaagcccaagttcggtaaagcaggttaaaaagaaagccaaagaatctcaagggaaaccctggtttataaaatcgtggggtttcgccccctggaatgaacggaaattttgttatgctccacaggggcggaacctaagaaaaccccaccacgcgcccttttcaggttcggccctttctggcctttgccaacatttctttcggcgtaacccatcttttgggaaaccgtattacggcctttattaagttaaaccgcttccccaacagaacgccaagcccagcaatcaattagccagaaaccgaaaaccccccattccc

SEQ ID NO: 105929 - DNA, 712 bp, Oryza sativa
  unsure (1)..(712): unsure at all n locations
cgcgcgatttgaatgcattgaacaagccnccctacgacnnatgcctcctctagaactcgagggaattcgcgtaccccatatgaagacgtttggatacaaatatatcagcccgacttgctttagctttcgatattaccaaaaatgggaaatataaaggaaacaccgagtaaagaaatactattaaggtccataagtccaacacatatgacaagaatccgagtaaaaactctcaaaaagatccatcaaatgtgatataaattgatgagtctaaataacctaggccatgactcacgtcataatcaaaataagcatataacatgccgagagaatgactattcaaaaaccagtcacctcaacaaaacccaaatagtttttgcagcctaaaaaggcctacaaaatcagtataacacttttctgtcaggcacctttttatttgcattgtagtaattccacagaattatctaactgcgtcaaaaaggattttaacagcattgggctatattgtcgtgagcaagtgttgccaaagcaaaaacaaatgcctaagcccctaaggatcacaacttaaccacgctgatagcaaaactgggctgaagtactgtttaagcccaggcccattagtactcccgatcccctaatgagataacacccgaggcatagcgcccgtttgtctttccccgcgaaactcttgccacttttcctactcactgctata

SEQ ID NO: 105930 - DNA, 509 bp, Oryza sativa
  unsure (1)..(509): unsure at all n locations
ccgcttgattgcgcttcgnnnnnnnnnnnnnnnnnnnnnnnnnnnnnnnnnnnnnnnatcccaattaagatttgacaccgctaactttttttttataatgctatatcttcacgaatcactgtaggaaaccaaatctagattggagaggatattatcacatgatgcgtgccttgatcgtgttttgctggacacgatcgtctcacgcacgcgaggacgcgctcactgtcgccgtgtgtcaggcaacactgccggtgccgaccacatcatatgctctacacacagaatgagctagatcacagtcgtctacgacatcacgaatctgcgagatgctaacttgagctctagcgtgccgattggagcctatttggacttcatctcaaattccccgtgcatcctattctcagggcatcgcattgtcgaatcgccgagacaaacattttgttctttctcaccgctgcttttccacgtacagagaaagatgaacgatggccagggtttatatctactaa

SEQ ID NO: 105931 - DNA, 815 bp, Oryza sativa
  unsure (1)..(815): unsure at all n locations
ccgctgnattganattgatatatcnnnnnnnnnnnnnnnnnnnnnnnnnnnnnnnnnnnnnnnnnnnnnnnnnnnnnnnnnnnnnnntaaattcaaatgaaattcacattttctgattcttttgcttgccgtggagaattggagacctgttttcaagacttgtgtcatttgtgtggtccactttctccgaatttgttgtggtcaccagattagctgcactgcatgtctgcatctctgcagatctcatgttcatgatttgagacctcccggccacttcaggacgggcattcaatgttgaattcagcaggaaagtataatgcagtaatgcacatgaaatgctttgaaatcaagtgctgtgcaaaactgaaaatgaggcaacatcaaacaagtggaaatgaaaatgttttcttttttattgaagtggaaatgaagttgacacgctgcttaggagctaactagagagtcttcttaggaaagctttagcttcgttttaatccatcaaaaaagctaaaatgtttatggtacttttaattctagaataagctgtagctaatcgaatcaaaaactccccaaacatacccattatcacatatcgcagcccgccatgtttaggaaggttgtcccttcccttggtacaagcaccgaaaaaatgcccatccgatccgaccgttcgttctaaatcggttccagatcggacggccaaagacagagatatgggacaccgctcattacaacaagggtctaaattgtacggccgcattttttcgcttatgcttatgtttattattcaaaatttaaattttcaagcttaaatt

SEQ ID NO: 105932 - DNA, 637 bp, Oryza sativa
aatcctgagtcctcttgtcaaatccagaaagcgcatcatcgaggtcttgttgtgcaagaacggttcgcatttttacttgccaaagtgagaatcttgtgtctcggtccaggagcggtagatcatacttcaaactcgccatgggaattaatcctgaatttgctagaaagaaattagggtaaatctagcaaaaaaatgcgaaacctggtacgcttctcgtgtgcacgtagcgtagatctgaaacttcctggtacacaagcttgtgtgcgcgtagcaattccacgtgaatagaaaatcacgtgacaggaacctgatcgcttccatcgttgacttccttttcagcctcgggaaccgtgcgatttagttggatgtattgacgccgctgctactcctggacgtgcgcgtagacggcttgctgctgctgcttgccaatcttctgatgcgtgcgccgtttccaggacgtgggctgctgctgccctaatttcgcgcgggcggtagggatgacgccgatcagatcgatccggcgcctcgacgaaccggcggcggctgcgtgacctgtagatcgatctccaaagctctcataccacttgctatggaaatagatgcacaatggagacgcgaaatttacgtggaaaacccc

SEQ ID NO: 105933 - DNA, 670 bp, Oryza sativa
  unsure (1)..(670): unsure at all n locations
gacgccacgcccccctttgaaanctanaggctctcgnccccnncnnnnnnnnnnnnnnaggaattcggtgcgcggtgctacaccaaccggccaagaggagaaaggaaaacattattagtcatgaacatcagtgacattagatgaccttttacatgcagaatctgagactaaacatatacactaatcacactaatcactactactgctgctatatattactggtgtaccaaaaatatacaagtgcatttgataaaggttatacaggtctggatcagaactgtatattactgttgcaccaaaaataaattaatgaactgtaattttctctggattatttttggatgtgattactaaagctcgctatgtgtctgctctttttgcactaatagatgttatgtggggcattcagtatcagcgccggaaccgacgccaacagccagaacaagcgccgtgaatgttggatcaagttgttaggattagtttcagtgattaagtttggtaagaagattaagtcgtaagctcctggctagaagctgttgggttttcattggtaagccatataggccattcggtttaagggattaatcaaaaaagagttaatcccagttcctggtatttccacccacggttccgggaagggaggcgtgccgtctcgccctccggttcaaca

SEQ ID NO: 105934 - DNA, 613 bp, Oryza sativa
  unsure (1)..(613): unsure at all n locations
cggtgctttgttgatccatcnnnnnnnnnnnnnnnnnnnnnnnnnnnnnnnnnnnnnnnnnnnnnnnnnnnnnnnnnnnnnnnttaggattgggttaaggagtcctccatctatataaggagggatcctatctcaggtcagttaggcattagatcaagatttattagcgcccatcggccctgccttcttggtgcaacggagagcgacgtgccgtttaggttcagggccattccctgttctttcctctattatgatccaatctattccccttcacccgtttcatcccaaataatcctagcacgtgatattaagctcgcaacagaaatatgctagtgcagcaatagtaatatggaaccacgaatccatgatagaagaaactataaagaatatagttcctgagtaaattgagatgaccaagaatggatgccttacaggctacgctggaccctggccaagtatctgtccagtttggacagttttatgaaaggttgcattggaccctggccaagtgcagtacaactcaacatgtgtttttaatttctatcaacttcaaaataaaaatcagagtacatacaatcagaaagtttctaaacagcatccaggagaaagcaga

SEQ ID NO: 105935 - DNA, 683 bp, Oryza sativa
gaacttttaacctttttaagcaccaatggatcctgccagaaaccgcgcatggttcttggaagggggcccatcaaaaatttcttgaatcgggtccaataaacaggaaccagcataaccctttttgacccccgggagagaacatatatggtttcgaaaattataagtctggaaatctggagaagctccccaagcccgtgggaagcttaatcttgggcattctaatggggcccctcaaaaagctcggcggaactattggtaatagccggtttccgggtgggaaaaggtaaccgctctcacaattccacaactaatcgagcccggagcataaaatgtcaaaactctggggcggccaaatgtgcgtgctcacattaaaataataggcgagggggtcaattgccgcttttccaccgcgagaaatatctcggctccctcgttatatgaaattgtccatcccctccgcgaaagaggcgctgctacatggccctcttcctacttttcttctccccatactcatacacgcgctcctctctttggggggtgggcattattacactcacggtggcgtatgggtcttcttcgcaaaggggcggctttcattacaaaatattctcaaatatcctcggcgcgtctctactaggaggcgggctaagctcttctattcatactctccacagcggagaact

SEQ ID NO: 105936 - DNA, 670 bp, Oryza sativa
  unsure (1)..(670): unsure at all n locations
agtgatgaggagtggggacaacaaaagcaccccaccgcgagagggtgtttttgtacaacgttaacaaacagcctaccttgtttgtcagagaagtagggctctcacacagagagagaaagaccacaatattttttttttctaagaaaaccgcagaaagaggcgcccctttctcaaaagaactagatacccgcgccaaaagagacctcagtagtgattgaccccgttatacacaataggaggcatccacaaagcgcgataacgtttgtgtctgccgcggtgatgcgcccaaaaccataatatttagcgtaataagangcacaaggggcgaggcttataaggagggagtttggtgaacacacacgcccaattgttaaaccgggagcagcacttaccgcgatatatatattacccccaccaagctttaactcattgaagaaggcgcggccccctctccccagaagggaaataaaggcggagccagggatacccggttatagcgccagatgtccagaaccagaaaagagcgcctagaagagagccttcgaagggaggaaccccctggtattctttaaagcacccgacggagttttcgcccccttggaacttgaaggagcgattttttgataatgctcgccgagagggacgggaccttataagaaaagccgcagca

SEQ ID NO: 105937 - DNA, 752 bp, Oryza sativa
  unsure (1)..(752): unsure at all n locations
cgcgtcccattgatgtatnnnnnnnnnnnnnnnnnnnnnnnnnnnnnnnnnnnnnnnnnnnnnnnnnnnnnnnnnnnnnntgtaatttaatttttcaaacacccaaccgcaaccgcaattttctacatatatcaatactccctccgtgctagaatataaggggctattgggttcctaaaaacatcacatcaaatctttagacacatgtatgtagcattaaatatagataaaaagaaaaactaattgcacagtttgcatgtaaatctcgagacgaatcttttaagactaattagtccatgattaggcataaaagtgctacagtaacccacgtgtactaatgacgggttaattaggctcaaaagattcgtctcgcggtctccagacgagttacgaaattagtatttttattcgtgtccgaaaaccactttcaacatccggtcaaacatccaatgtgacacctaaaaatttttatttcaccaaccaaacaggtcctaagaaattttagggctggacacggttattaagaaagtaggtagaagtaagtggttgagggttgtgattggttggaaagagaatgttggtgcagaagttgttatattttgagacaaatcctgatggctaaaaattgttatattttgggacggagggagtataaagcttaaaacagaataccatatttattaaatcctaatacagtcattttccagtactttatctgcttccgatatattttttaattttcatgaattttg

SEQ ID NO: 105938 - DNA, 743 bp, Oryza sativa
  unsure (1)..(743): unsure at all n locations
gcgccaccggatttgacatcaccatgcnnnnnnnnnnnnnnnnnnnnnnnnnnnnnnnnnnnnnnnnnnnnnnnnnnnnnnctcgctcctgtaggctgtagtcctatgtgagttgtgactgaactgaactccacggcaggaagcatattcccgccatcatctccggtggttgacggccttttttgtcgatgattactctataataaagccatctcccggttgggcgagcatcaatggcgaagtagtgagggtccagtgaccactttctcctgtgggatagagctgaaacaaaggaaacatcactttctcctctgggagtaatacatatccggtccaatgcactagcagtctagcagcagcagcactaccgctgtccggttgttgcttgcttgctcgtcagctactactactagcttagctagttgcagtgctggattcttgacggtagctttactactactttacggtatcagcaatggcccatttgaatcaaaaacctacgaacgcatttcgtagggattaaatcctatatgaattttcctaataatccattgattcaaaagattgaggtttttcaaaattctatgaaactcctattggatggttcattgtacatagattttagagaaaacttactgggtcatcggatatagattttagaggaaacttaccaagagctaccatcttttgaaaaaattccttttgaagttacctttctcaactaaatcctgggattttcttgc

SEQ ID NO: 105939 - DNA, 753 bp, Oryza sativa
  unsure (1)..(753): unsure at all n locations
cgcgcccctnngttagaacaaactcatagcnnnnnnnnnnnnnnnnnnnnnnnnnnnnnnnnnnnnnnnnnnnnnnnnnnnnnnctcactccactacaattttgcatgtgataagccagtattttgcttctccataaataatcattgttcttgtgacaatttttgtctagtgagagattcttatcccaaataatctttctactccaagggagaagcagaacattgttcaaaaatcaagaccttatcataatttatttactaccaccatgagatgatgattgaggtaaatagtaaagcatcgaactgtacggcggtggagttgtgagggcataataccaacgaccaaagttcacattctttgagcatgtgttaggttagtcaaaagatgccaagatggtgtccgtatgtgcttggtcaaacggttaattaaactataaccttcgaaaaacaattaaacttaagaaacaactatatgtctataagagtataagcaagttaatcctaaagacttatttctttttcaaattaacgtgttctgtaaaaatcatcggcgatactattaactcaaattaatatataaatgggcctaaaagcttaaggcccctttaaatcgcatgattgagaaaatgtaataatagaaaaaacacaaaaatttgatatgaatgtaagagtaaaatagatgattgcaaaacataagaaaaacacagtaatgacccttttgattggacccgcgaaaaaaaccgcaggaattag

SEQ ID NO: 105940 - DNA, 725 bp, Oryza sativa
  unsure (1)..(725): unsure at all n locations
cgcccagggtagacgcntcggtgnnnnnnnnnnnnnnnnnnnnnnnnnnnnnnnnnnnctttaaaaaatcatattaatccatttttaaaatttaaaatagagtgtatgacaattattcaagaacatgaaccgatgaattaaatattacagggttgaaagttgtattttaaaaatgaagttctaatatatgttgatgaagatttttttaaaaaaaattatagcgtttaaaaacttggaagcgtctcctcgtaatccattactcgtaaacaaaaaaaagaatacgacctaaacagctaaggccatgtttaaatcccacccaaaaatttgttaccccgtcacattgaacgtttgaacacctgcataaagtattaaatataggctaaaaaataactaattacacagattgcgactaatttgtgagatgaatcttttaagtctaattgctccatgattagataatgtggtgctacgataaacatttgctaatgacggattaattaggcttaataaattcgtctcgcgggttcctgatagattctgtaattagtttttttattaatacccgaacaccccatgcgacactctatgtactacccgatataacacgcccaaatttacgaccctggttcaaaaccacccccctaaacggctaaactaatttcggtgctttttctcanggaccattttgaatattacgcgttattattttgacctaccctgcaaat

SEQ ID NO: 105941 - DNA, 1536 bp, Oryza sativa
tcgaacccatgaccagaaggtagtgtaactattacatgcactttggctcgaagctatatttatatacctcataactgtctaatcttagataaaacaagattatctagaacaaaacaatattatcttggatgcacgaaggcgtccatatcatgatcagagctgttccaagacgattgggtagactaatataaattagtatggatgaatcacacatgcaagtatacgtgccacatgaaaatgccctttgatgaaatcaaattgactttgttacattaaatcattaaattaataaatgtaaaattcagtacggaaaaataaataggataaaatggagctttatgataagaatggacgaatattcaacattattgatggcggcaatatatattaaaactgggtctaaaagtatgtattactccatccagtcatttatatttgaaatatgggatttactagatttcaggctcataaaaatttataaattttcagtcatctaaaattacacacattgctaaaactaaaatcatagtgctatgcaatgtgaaatttcaactctaaatattttgttatatgtgattttactttatttttatctaaatttgaatttctctgcgatgtattttttttaaaaaaaattgttcaaccttctaaagaagggactataatttgttaaataaataacaaaagagtaatgggaaccattatattataatacaatgggtgacaaaagtaactaaaattttcgaaaaattctatgtgcctcaaatctatacactcccttgaatatacatgacttatgggagtagcataccgacctcatctgatgtactatctcattgattttatatgtcctcatcgatttatatgtcgtatttcgattttaaattcctccaattgacctgacaagtgaagtaggttgaagaaatagaaaacggccatgatcggttattgaaagtcgctctatagcttgcacctatatattttggatgcccgcagccacagccgctgaagcaagaacagctgcggaacatgcccaaggtcatcaccttcaaaatatatgggatttttgcaacagtttgttgcaagtttttgggacaaatattttcaagtgtttcatagctcatttggaaccttacaaatttaactaatcattgctctcacggatttataggatgttgaatcctcttgttgtgttaaatgatgctcacattattttggattctgcaataaaactttcaaattaacatgttgttaatcccttctgttgcaactctatttattttgtttcaatacaatctagtactatggattagtagtgatgtttcaccctcaacctttgcttgatttcttttttgtgtgtttgtggtttgatgtttttccactgcaggggtagacaggtcaaacgcgctcactattgaattctcatcattagaatattgtttgaattcttgatattgttaaattcaattttggtaatttgttgtgagggtgaggtcacaatagtagtgccacctctattgattcccattgagttcc

SEQ ID NO: 105942 - DNA, 671 bp, Oryza sativa
agctccaagtaatctggatggcgaagatgcggttttgcaactggacaatcgggtgttttatatctttgtgtttaagttggccttaaaccaaaaataagaaaaatcaaatttagtgtaattgcatactgatattatgattcaacttatcagtctaaaaattaatgtactaattgtacaccgagcaaattcctacctgaataaaacggagagaatatgtttattcttttgtttcaaagacactgaattagaacttttattatcttctaaacctttttaatttttaatatataaaatgaaatctctcaaattttatttttaaatctgaaacttttgtccacaccatcatgtctgacgtggcgaaactcttgccacaccagcttaaggtttacttttagaaataactttggagattttatttttaaattaaaacttcaaaaggttcaaaactaaaaaaaagtaaccgaatcataactataacgatttaaaacgaagaatcttttttaggtgttgttatttgaaatagtttgcactgttagttaattacattatttatttatttatattctatagagggacatgtagctgtttaattgtaggaaaaagtacgaattgcactcgtgaacaattgcggttgtccgatttaccaccctaaacttcaataccagttattt

SEQ ID NO: 105943 - DNA, 2420 bp, Oryza sativa
agggatgaaaattttaagaccctaaattctagttaggattcccataactcttggttatacagtattaccaatgcaagaaagaatggtaacaaaggagtaaaaaacacattaattgaaggtcaaacaaccaaagtttcatacaaggacattcacacatggtccttaccaacttgaggggatataccttcatgaaaaggaaaggtggctttagcagtttcttgagttttgataataaaaacctttaacaattattgggttcttctaacactcttgcacagtatacacgatggtcatcatcagttcatgattcatcaccacatgcaattattgctcatcaccggactgaaaaacgaaaaagtctattttgaccctctcaactattttcggaatcttatgtgtatcgctcaaccacaacattgggtatatcagaccccaagtattaaaaccaatacaaaatgactcccttggttattttcagggtggttttgtctggcgtgacgcactaaccttggttagactggctggttttagggctagtacttgaggaaaaaagagagagtaaaaatataccgggatccacatgtcagtgaagtacccctcctttcttcctcttatttagctgccctcttcctccttggcaagcggcaagcggcaagttgaacttcaggtagagagaggaaaggctagggagagagagaaaacgcgcgcaggtgggggatgctttggggcttgagaaagccgtggctgctcgtcatcgtcgtggtggatgactgcggaaaagaagcagcaacaatagctcgcaatcttttgcccctactgccagctccccttctaggatctagagactgttgtgcctccatttaggctccgcccaaagcgctgataactaacgggcgtggtggggtgcagcatgacgacatgggagatcttcatgttggtggagtcgtcgatgacgacaaaactgtacagaggggacactgaggtgagcaagacaggctacgcatctgctatagaggatgctggcatgaccgatggacacctcatccgtcgccaccgcggaagagatgatagagggaagaaagaagatgagatgcgggatttacatgtgggtttcattgctttttttgctttcatgatacccacgtaggataaagactagttcaacgtgccacttaagcaccacgtgacatgatcgatgtccaaactgcttggggagacaaattaaactggtattaatagtggagagatgcaatttacctgtttacagttgagggatacaaaacagattcagcttatagttgatggaatcaaaatggacttctcctaagaaactatgagtcgaaaggcccatactaagccttgtaataaatgacgcaaaatgagcccataaatggcccaccaggggcccacctatttccaacgtgtgcaaacgaatccaagccccataaatggcctacacgacacaaggccgtaaactgcgaacgcgattactcgacaggataaagcagagcaacgggagccatggttctgcaccaaccgaactaaaagagccgttcgttgctccacttatgatttcgcagattagtgatgaactgatgatattctaatttttggtttaggcgtgctttagccacagaaattagaaggcatggataaatgctaccggagtatatactccatttatctcgaaatacatcttatatcaatatttgtggtgatagctaggttgtgtctaatccagtagtaaggtactacatccgttttgctgctgacttttgggcacacgtttgaccattagttttatttaaaaattttatgtaattacaatttattttgttgtgttgttttatcactaataatagtttaagtatgatttatatcttatgcatttacataatttttttaataagacgaatggtcaaacatgtgttcaaaagttaatagcgtcatcaattaaaaaatggagggagtcctatattttgggatgaagggtatgttactttagaatgatgtctaattcgcatatctgaattctttctttttaagatattgatttcttaattgttataggacattgtacattgaagctttattaataaggttttgcctcatggagtggtttattattcgttgagctgatgaaatagtaaacgtcttctccaaaacaaatgacaatactgaaacttacgtacttgatggccacgtcattcatgtcgaactcgaacttatagataatcatcagtcatcagatctgcgcaaatttactccaaggtcaatatcacatttgtagttcaataggcctaatgtcaacttgaagttaccaataggcgtgtcaactaaaaaaaaagatgggctctagaaacccaaatagattaaagtagaacacagaaggttctcaacatcactaaacgcaagggtaa

SEQ ID NO: 105944 - DNA, 748 bp, Oryza sativa
ctccctattctaatatacaataaagtatactagagcctcttataattcagcttatgatttggtgtgtgtttacaagtgaggatgagaggggtatttataggtgaagtgccttgggagtgtggagatgctccaagcatccaaagagcatcatctctcttgtgttgccaagcgttcaagctaatgacggtttctaccggtgaaaacggccataactgtcattgggaggcggattgctaccgaactgaacttgggctggggcgaacggcctctgctagggttcagccgaactcaggggttcggccgaacccgggacggctccgttcgctccggttttcgtcctggacactcattttggggccctcaattcattggtatgaatgtttggcccatatggaggtgtttaatttatgggtccaaaactccttaagttcggatacgagtttgattctcatcctccttcatgtatatttcctctcaaccttggtagtttgtcacctgcatataaatatacaccaacacttgtggaaattattataaataagccctaccactatgttggatgtttacaattatggtcttatgctggtattaacggtgttaattcgatacttaacagccatcaacagtaatgtttatttgtgttactttaactgatacatgatttatctcttctctgtccctactattatatattataaaaattgaagatgtttccgcggtccgtcacccgtgtttgagtcgattataa

SEQ ID NO: 105945 - DNA, 660 bp, Oryza sativa
tctagcattgtccacatttatatagattgatgttaatgaatctatacatataacatctatatgaatgtgggcaatgctaaaaagtcttgtaatataaaacggatggagtattgaatgttaattagaaaacccggaaaaaaaataaaagcatccatgtaagttttagattgtaactcacagcaatggcagctttgatgttgtccgtggtgagggaaaactgaaggctaccatttgtctgaactcttaggagtacgtctaccaggtcctctttctcgagctccatggaggcctggcgcgccgcctgatgctcctcgatgatggtctccatgaactccatcatctccttcctctgccgcctcatgcggccaggaactcggctgacgagcatggccagccgcgacgacgggaagaggtccggcaagctcgggcaggagaacagcttgatccctcgctccatcagccggaggaacgtctccctgtccttgaaccggccgcttccgatgatggcgcgcaccgacgagtcggcgacgcacgacgatatcatcctgctcaggttgacgacactcgccgtcgccgtcgtccctttcggcgacggcgacgccacggcgaggaggaggcaccggacctcctgctcgcggacggctcggaaggacagcacgc

SEQ ID NO: 105946 - DNA, 826 bp, Oryza sativa
atattgcatttgatctgggatgtatttgagttgtggtgtatttcttttaggatatgtgatgtattttttgtttgagaatctgtgatgcatttctttccagatctgtgatgttagtttggtttgtggataatttgaggatatgattgaggatatttagggatcagatcaatttgagaaaaaaaaaagaattacccgggactgctcctaccatctttagtcccggttattttacccgggactaaagatgggcatctttagtcccgcattcgtagtcccggttatacaaccgggagtataggggggttcccacccgcgagtaaagcccctttctccaccagtgtattatgcaacccctgtgctacatgtatagtacagaggggatgcataatgtataaaaaagtggagacataaaatataggggtaggacatactcttattcattcatccattgctcaagtgtacaatagtgagtttccaaccctctatttataagcataatgcatatataaaaagtaaggtgaagggtcttataagtatgttgggctgggtcttcatggtccaagcccaaatgtttcctaataagtgagacttattgcttggatgagcatatataatggtggttgcgttggataagcttatgtactgcgcgacatatggctgaggagttgtgacacctgtagtgcgcaacgagataatatttaaatgttcgacgaaacgtcggcgacctcggctagacgccgggcacgggcacgcggagtatggggcgaatgatgaggtcagccttccggcgaacaccgatgccgaacgcctcagtcatgtcgagctt

SEQ ID NO: 105947 - DNA, 3261 bp, Oryza sativa
  unsure (1)..(3261): unsure at all n locations
aggatccccaacccatctttaacaccggttcgcaacccctttagttccggttttacaaccaggacaccaaatcccgaaataaagatggatatctttaattctgattaaaataatcgggactccatctttagtcccggttggtgttatcaacccggactaaatttttagccagttctttttttttctgctcacatgatttgggcacaaatcatttataaaatcattcataaaatcatccttaaatcatttgagcaccacgaatcattcctccataaatcattcgagcaccacaaaacattcaaaaaatgcccaaagctgcattttctccatatcccattcacaaaattcccaaatacatcacaaatcattcacaagataacaaaaacatctacaaattctaaaccaaaattatccacaatttcatccacacatcgcacagatcggaaaattcatcacacatatcgggaaaggaatcgcatagatcgagaggagggcgccgggcatcgccggccttgctggcctcgctggcccgccgtgggagcgggctcggncttctcgccgggcggccacctgacgnttcgnnctgccgccgtgggagcaagcttggccgcctcgctggccgggcgggcgccgctccgctgcccgcccgtgggaacgggcttaaagccctcgtcggcccgccgctcgcccgctagtaggaaaaggagagggggaggggnagnagnagnagagggccgaaaggaagataagaagaggagagnaggagaggagagaagaagaagataaaaagattcctcctgtacctctatcctctctgttaccgtgccttgcgcgtcctcccgcgcgcatttttttcagattccactcgcgtgcctttttttcatcttttctaccggttgatataaccacccaagattaaatatatgatttttagtcctggttgttgatatcaaccagtactaaagataatagggtcttgacacgtcgtgattttcaatgatctgggactaaagatgatttttagttctggttggtgttaccaaccgggattaaaaatcattggaattctaaaccaggataaaaaataatttttagtcccggttcctattcaaaccgggactaatgtgtttttggccaatccggcaaagattacttcaccagcagtggatgttgtctaacgtggcacaaaatagccacgtcgaggtatctcagcgccagctactgaccctttttccgtataaaaagtgtcagctcggtggtgtagttcatgtaatccgatagcgaggtgcaagattcgaatccccctagcccattgtttttccaatttttttcttctcccttgacttgctctaattgttctgttattttcattttaaaatatcgtgtgtgttttgttttaacttgaactttaaacgaaataacacaagttttatttaaattaattttatttaaaagaaatatcacattttaaaaataaattaaaagaaataacacgtttagtacatattttaaaaatagaagaatggacttaaaaaaatacttgagctttgaaaaagaaaattaaaacagcaagcttgaaccctagttgctataacggcacgagaagaacctaccactgaggtaacccaaacttactgattgctttagctttcacagctatttacccagtagatatgtcagcgccaatgaagttgacgctgaagtctcctgacgtggcgattttgtgccaccttggacaatatcttaacaccaaaaaccttggcgctgagacgttatatctcagcgccaaacgccaaacccggtggcgctgaggtcgcggcttatttttggaatagtttttgacacggtctattcttataataagtttgttaaaagggtcaatttgtcaaatttttggtccaggacgtggtggtgtcaaaggataaatctcactggtgtcatccattaaagaacatcatagatacttgggttaaacaagaatccattggtgccaggtgacaccacacctaacacgaagaatattatttaaattatattgacaattgtcggtgaataggaacggggtacctatttatccagcaaaaggattattattaaataaacaacatgctcagaatgtctttgaaaataaaaataaaaccctagggtggcgtcgctaggggccctttccagagggcctcaggcccacgtaagatttcatatacagcgttcctcctggatgggggagaacgttgcgtatatggctcaaaactctaagtattgaagtagcttgcggcctggtttgggtcacaaataaaccgcaaacgtgccttaagaatatagcttagggtcagcctcgggcatggccatgttctgggcctcgggcttgccctaacccttgcagtttttatggtcctcggcaagaggggcatggcaacatgcaagtcctatatcttaagaagatgagctaagatctgcctcggatgcggtctaactctaggccctgggctcaccttagcccatacaggtcgcacgttgctcgaggaagaaaagcaacgaggcttgccaaacataaatgcgtgatcccatgtgtgctttgggcctggccttgcctcgggccctaggctcccccgagatcttgtatagctcacgtcccctgcttagaggggcgtgagaaggtacaagacgcacaatctcaaaatattcttccatcgacgacgtcttcaagaagctcatcaagaaataataaccattctttaagcgcggcagggcgcgacctcaaaaactctcaggaagtggggcatgctccccaccataaataaaacaggtttacagggggatccccggccagtctgaattgaaaggacgtggacaagacgttagcgttgagtcactttggatggtggcgcctgggacacgtgtcccgcatgactcgcgccacttgagttagccaaatgggcgttgtttcaggcaggtcgggcctcgtcgggcccaccatgcaccacatggtgagcgtattggtggaggcccaactgtctcgaatggagctcgggagcccggggctgtgaaccgtatagacttgaaaggttccttgatggttgcgttagaaatctggccggcagcgacaagacggctcataagacaagactaagagtagatttgtaataatgtgagcccctcctagactggaaggggattatatatggatgaagggttgctttctgttaggttagtacttccgctttgtagcctgaaaaaaaggcctctcttatactgagctga

SEQ ID NO: 105948 - DNA, 542 bp, Oryza sativa
ggctactcgtttgttggtgcttctttcttttttttttctccatggctcggtgcaatgtctgtgcccaatgcggcatggtgaaacgctcattggcggacaaccgttcccaaaaaatccccaatcggcattcaccggcgactccacgtcggcgttggaggatttctccgagagcagtataaaggaccaagaatagagagaggaatctgttttcgtgattatattagtgagatgcaaaatggatttgcgagttgttacccttcttcttccttgatttctagtagaacgttatgctatcactggtggagaaaccatctttggtcggtcagccaaatttcacaacagtcccggttctaataaaaaccgggactaaaaaacatctttagtcctggtttaaaagttgaggagtactttttgatctttagtcccgggactaaagatcatttttactcccgattcaagaaattgtcgggttcaagacatacatcaactatttttactccccgttggtataaacagctgggactaaagatcttttttagtcc

SEQ ID NO: 105949 - DNA, 690 bp, Oryza sativa
aagttcagactcatgggacttaatctgtgttgtgttaattttgaatgtgaacatctgtttattttgttggagttatgactttgttcttttgacgagaacatcagtcacctagttcaaataggggattggattgctcgtattataggtcttggtgaaataatttcaggtgaattagtcgaatttggtttttggatgttaattccaccttttctcaactttcgggagacaaaacactgattggtctcccacatgttgctttacaaaaagaactaaactcttggagattattccacatgaattcctatcagttgttgtgaactagctccagattggtctcccactgcctatttttctatagtcaaatgctcttgtgattgggaggtcaataatcgctcatcagcacatattttgagggaacatgggagggaaagcaggctgtacctcagattttcaatagtggaaagtattcttattttgcataaatgatatagatttaggaggagagtgcacgcaggcaccaggggttctcaaacagaatgagaaaggattattaacacatagaaagttcagtttaaaatgctttcaaatagaggtcatacatggtcatgccagaacgtttgtatgattaagactagttgctagagcgttggtgtgattgactagttgtttttgtatttaagggcatgggca

SEQ ID NO: 105950 - DNA, 1079 bp, Oryza sativa
cctatttgctctccttcattttcagtgcaaatgtgcaatgctgattagagtttgcagatgctgtttggtttagtttagatgtggcattttgttagtggtttctttgatgaaaaattcttggctatgataaagtttgctttctgaatatatgaatagtggccatggttcaagaaactccagttaggtgggataatttatggtgattctgggcgcaattcggggaaattttttttggcgagaatcttatcattgagataaagagggcaagaatatcaacagacttttaatcttaataaaaagcactcttagcgtaagagcaaagcattgcaatctcgtgtgacaagaacgtttctttttctccatctttttcttttttaccaaaaaatgagtgttgccaactgctgcaccttcttaggccggtttgttcttgtttggaacgcacggaatgcccgatgcaaaaaaaaaaaagaaatgctgttaacaaatcactgtcctgacacggctaattaggtggtaatttggtgcatctgcaaagaagcaacagatgctttctttcactgaaagcatatttgcatgatttcttgtttctgcttgtcctctctctgatgctgactgtattccactctgcgctgtaatgccatgttagtgattaatatgttcaaaagagcataaaagaattgccaattggatgttagagattactgtgttgttcaaaagagcataaaagaattaccaatttgatggtagatgttactagcaccaccttggtgtttccccatggttttctggaattctgcccatgatctttctgcttttctgaaagacatatgtttcagaggtcaagcttctgaaaggttattagaagggatgagtcgtcattttgtctgtgggccccactagtcagtgtcaatagttgtaaagggtagaaattttctcgctgtttttcttggaaacaatttcattgcgcctgatctgatggtcggtctggtaatcaaatcaccagatcctgaaatccaccaaatcaaacagtgagatttttgcagaggcaaaacaagaaaagcatctgctttatttctctc

SEQ ID NO: 105951 - DNA, 1352 bp, Oryza sativa
cccataactttaaacactgcaatcatcatacagtgagtgaacatagtacagtagtgatcatacagggagaattgcaaggtgaagatagaagtaggaatcagaggcatttggaaatgcaacgaaggataagatggctcagagccacgttgatcctgtgatagctgaggaagaagctctggatgcaaatcagagtcgtttcctgattgcaaactggcctgatgaaactgctttctcatctgctgagctactcactgattctaatgaatgggatctgattgtgtcatttggggcattcatcagtgtgatgcatcacagattaccaggtttcagggtgaatgccgaaatactgaagtccaaacatgtggtttttgcatgatgcagtttccctgaactgaaatgtgtctcactaaaccaccaggtgcttaacatttgttttttgtaccttccaatttcatacttattggctcctaattagcagatcaaactcagatagcaccctctgttaattgcatataaagatggaccgaggaggaagagaaggatatgcattctcctgcatatgagcggtgcggaccagcatggagggaggaggccgtaaatctcatgcatcgtcggataaactaatatgaaacttgatttgacttggtttgctaacccagttcaaaatctagcctgcatatatgtaattaaatcctacgccaaagactgaaaactatctcaatcgcacacacatactccgtatttcacattcccactaattttcaagttctgggattatataatgattccatcgttgagctatctgctgtacgaattggagatcagtgctctgaatccatgtctgaactctgaagtttgaacagagccagtagattagtttcatgacttcatccatctatggtagggtgaagatactgtgattgaaaggcatgagagggaaaaaaaatcaaggagatgggtctgccatggacgaacccgggggaaaaaaaatcaaggatggttccaaatctttggcgaaggagaaatactgtgcatcaacgaagggtgggcatggtgaggcgccggtaccgccaggtactcgattcatgacagccgtccgatcatcctagatcaacggcctaaatttagtaccggcgtgcactgctggatggtaaaaactctcctccaacattttgtagataccaaataaattgaggggagataggagaggaagaagatgaagagaggatatagagatgcatatcaagttatcaacacacgttcttgtggacaacctcatctgaagtttcattggcttcaatagttcaattatttccttgcaaattgcgggaccaggactgggatgcattagg

SEQ ID NO: 105952 - DNA, 1835 bp, Oryza sativa
ataattgggtaataattattttttgaatgctatatatcatgaatacatggttctataatatgatatagtagtaaaaaaatagccaacatggtcttgaattgttgatttaatttaaaactatggccactcaaatctatctatctatctatctatctattatatactaaaagtccattaaattaaacttcctataaacgctctcaagctgccatgtggcgctctaataaattagagaaaatcttataaattctaagaaaaaagcaaaacatctaccccttgattttcacttattttgatgggtccaatattatacaccgttagataaaattgatcttaaaacaaaccaaatactatgggtcccacctttcctccttctcccgtgcatgtgtacgtgggtatatatatacacttacgtaccgtgtacgtacacccttcttttcttttttttcttctttttccatttatataatatggatatatacttttttaaataaccataaatttacaacataaagaatctaccatcatagaatctaccatcatataactcactggtaactaaattaactctacaatttttgaaaataaaatttaaaccattatatgtgaccattaaattaataatgtaatatagtttccacttaaacatgtgtactcattatttttactattattttcaaataatgcactattttaaaataaagtttacacaattatattgtgtacctatcaaataaacagtttaccatgtatattaaaccgatggacccattatttaaattatcggaactattttttattacatcggactattattctcaaataatgcatggtttcaaaataaagtctacaccattatattatgtacccattaaattaacaatttaaaatctatattaactaatgtacacttacactagaaccggtggacccattatttaaatcatctgatatattatttgctaataaataaagcgtctgaagttctcttttttgcccgctgcacaatgcacgtctgcacctttactttttgcacgcgtgacaaagcatcgtgtctgaggcatctaaggtgatcacgactaccgcagcactaccattttgctacatatcaaatcatatatagagatgatgcagtgagagaagaattaagcactgtgggttgtgtttttttccaacacttggctttgtttaagctgaaaccgagagttgattacagaataataataatgtattgtggtatgtcgcatttggattttgtactatttgttcgtatagacgaaagaaatcattatgttataaatgtgagcacaatattaacgaatatcaatagcactcttacaaagactagggtgttataagggagtttaagatcctctttttgttccgattccatagtttgtaaatggtgtcttttttaaacaacattttaactttttagaaggcaatttattcgtttataccctcaaatagctatcacataaatcagataattcatcaattttagctgtcctaaaccctaagtagtacatattttttttatgcgagtcatggtgatcagtaaattggggatcaatggataatcaaagtcgtaagatgaatatgtaagagctactatgaacaactgtcaataggtgtcaaaattaattgctactaattagacatctaatggcttgctagccacataattaatttctctcaacatatatataaacatgcacgaagctggaacaaatattaccatatgccctatacatatatattaagcggtttaatattctaattacacgtgttaagtcctttaaaatttcttaaaacgctctcaagctgtcacgtat

SEQ ID NO: 105953 - DNA, 1369 bp, Oryza sativa
acatgggtacttacgctttcccctccctttttttatttttccctttcttctttttttcaatgcatacacttccctccctttcttactatatcatgcgccttcttgagatgatttaatcataagaattttgagtatcttgctcttgcatttttcatttgtggccatactacacggtatgcatatagatggactgtatgatacttaactagcaatagtttcttatttactcgagaaaaaaaatgatttaaaagtcataccttaagaaaaagtttgtaaatggttttttaagataccttaagaaaaagaactttagtttgcccttcatctataagacaaaatttttgaataaacaataattttacctttcaataataaataatataagtgcccgcgcatgtgcgcgggccaccttcctagtgtatcctaaattaaacatgtagatcgtctaaagataattgtttatttaaagcaccaagatgactcctatgtaaatacctagtgcttgcacatttacacccagataagtctccatgaaaaatagatctaataatttatgataacaaattatggtgtacatgcatatcgtgtaaatacaaataaaattaggaactggatgcatgcatcaatcgagcacgcagaggccatacataattatcctgcctaatgtcaatgataaatcaagcaaccaaataaataagcattgcaactaccatatgtaattggtccacatacgtacgtgtggatctgggatagaagggtgacggtggatttggttttgatccaatggccaataatattgggtcaaccactttaaataaaaactgacggttagatgtttttttttctcagaattttctttaaattataagagcgccacatggcggtttaggagcgtttgtaggagtccacgtggcaacttgagagtatttgtaagaagtttaatggacttttagtatataataatagataaatagatagatttattcaattattaatttaataaaactaatttggtaatgtaaatattactatatttgtctataaacttagttaaaattgaagcagtttgactttgaccaaagtcaaaacatcttataacctgaaacggagggagtaattttttagtttaataaatgaaagagccaaaactaaaccatgaatggattgcgtcaatacaataagataatttcaactagataaactttggaagcattaattgatggtttctcagttctctccactggttcaagaagtatattagcgtgatcctcaatcaaattagacaaagacaatattcatattatgaacggttgggttggagaaacaactgatcacatatgctacaaaatcgttgaacgcctttaattga

SEQ ID NO: 105954 - DNA, 591 bp, Oryza sativa
ttcgtcatctcccatggagagcaacgacgatcatgcactgaggagatggcgtggatgacagcacgagctgacgcgtctatgccaattagctttcgagccagtaggatttcttacgtatttatcaaatttggcaacaaactaaacgtacattttttttaactttacttaaaaaatggtatggttgataatggcatcaaagtggacataccattcatatttgtcgcatctgtatattaggtttgttttttatgcgacgggggaattcgtaggttatcgctttcttggtatgtgctgcattggctggaagcctagaaccgctgcataggtgataggaataagttcaccggaggtccctcaaattaacaccgagatttttttgaggtcccttaaccacaaaaccagaaatctccacccctaaactatacaaaaccgttcactcaaggtccctagacagtatatatgggtggtttcactgacgtgcaatcctagtcagcaaaaaaaaattaaacaaagcacgtggggcccacatgtcatctgcatatcttattttcttctcttttcttctcctttctctcttctctcttctcttct

SEQ ID NO: 105955 - DNA, 2517 bp, Oryza sativa
ttgatagtctggtttactcaacaatatccccgtatcatttgtaaattttattatcagaacaagtttcatatttctactcatcaatttaaaacaacttaaacacagaattcaagcttgtacattagatacactaacactacgcggtaatagtatcgaaaaggaatggaaatactaagtagcaagagttaaggcagtagcagagtagaagctggagacgtgtaaattcacctcaggcttctacatttctccggtgcctcctagtccaacgacatgcgatagaacaaaaatatatcggttataagatttcagggccatcagagatcaaacctcaattcaacttgatcaatgatgcaagtcattggcaagtatctcttgtacttgctttttctcaaaagtcggtcggttttatctgaaatcttgaagcaggcacgaggtgttgccacttctttaatttatactttctggccaactatgctgtcgaatcattttttctgctcatcttattaagtgctcctatattatctcgaacctacaataccatagcatcgaatacatgcattatgttaggatcccaattcaaatgagaaatgaacataaatgccacttgaatgcattccctttcatcagctggagcaaaaccagaggtattcatgagcacactgagtggcagtaacggatgatgactggaacattttattagttcctgcatcaactcctaacaactgagttttcatctttatccagaaagaacaaaacaaatgattttcatggcatcatcccgcctatctagtggtagttttggaccatttcttgagatgcacttgcatagccagttctatccatgcatccaccaatggagatgaacctgatcatgattccacaaatgtgtcatggtcaccatcatcaattggatttctggcccattaaatgatatgtattagtttgtgaaagaaatattcagtgaactaaatagaccgatgagcacaattacacctccagcctctacacaatgcgcatatatacaaccaaccatgaatcttaggtatctataatttcgtttcaaataggtttgtgtattagttctaagatgtaagatgagaaaaatggaatttgcggacactactggacagactgaagatgaattcatggagcgagagtctcatcccacgcatgacggagcgatcaagatggcgatggtcaccatggatgcaggcacagagctccttgcattcctgatgccttccaggcctacaatggcgcaaggcagtggtatctgggtttctatggtgccaccaactcaagatgcatcccaaatccctcacctatgttgcacatatggtgttggagatgtagatgtaaaaataagatgagtataaagtgtttggttcgataggatgctgatagttaggatgcagtcttgccgatgaatgctggcttaatcaaggaggacatgggcaagtgctgttggcatttttaaagagctgttggggcagtgtggttcttttggaaccttgtttttctttctgcatttttattgtttttctatatttttatgtttatacccataaaacattttttttcaaagattagtactgaatttatgcccttcagtactattcataacattgtcaatgcaattacacagttgaaagacaaactcaccaagcattatcccaccagctagttatcaataccttttcatgaaacatgagaaaatggagggaagcagatatttgggaacatgctgtgctaagtgcttgcatgcgataagacagagctgtcactaagtgaccagagcatcataatcagccacacgcatgatgtttaccggaggaaaaattactcttcaacggaccatgaccaaaactctagccagctttgctggcaggttttgctctgttgcatttcctgatgcttcctagccctaccatgtctacatggtttcacccaaaaaaaaaagaaagaaaaactgacagaaaggtttcattagtatcatgtaactatgaggtctcatcttttcggtaccgagctcgactgtttttcctactgtgaattgtgactgtgctccaccatatcctctaactcttaaataggaagagacctgtgttttgtttgatgtggtgtcagtgccattcagggtccataccagtcaacttgcaacattcaaatgagccctccagcatattcccaatgtcacgcaatacaagaaatgatgaaaaaaaaaacagggaatggaattacatttgaacttggtttggacgatagatactggcatttgagaccctgagtccagccagaagtagaggttgaaacaatttcatttcgctacacttcccaatgcccatttaccaaggatagagtcagggtcaaagcctcgagctgagttagccgaagttagtatgtcttcgattaggtctcaatatttttaaattttcaaaagttaagggccattttggtttgttgccaatttatctttgtttatttgtttgttttctttacctttcttgattttctttt

SEQ ID NO: 105956 - DNA, 696 bp, Oryza sativa
agatgtggcaaaaatctcatttcagtacatttcccgatgcctgtgcttaggacttcgaccatcctgaaaattttaagggtgattttagggtcgttgaggatatattatgagctacaacatttattagcgtaaaatttactattaatatctctttggattaatagcaaaataagaattgggaattgtagcaaaatgaacttgttgcgactgttaagtgtagtagtatgtcctccgatggatacgaatgtatactcaatatatatgccatttagggtcaaattaatatacagtaaaaatctccaaatccatctcctatattgacaacaaacgtctacttctggctggactcaggtatgccactatctatcgaccgaaccaagtccaaatgtaattccatttcctattttttcatcatttcttgtattgtgcggcattgggaatatgctgcgtttgttttcatcatttcttgtattgtgctttgggaatatgctggagggctcatttgaatgctgtaagttgactggtatggatcctgaatagcattgacaccacatcaaacaaaccacatctttcttcctatttaagaatagttagttgtaaattaaataatacccgtgtcaagtgtaggacttgattccgggtggactggttccgccatcaggaacttaaccaattgagctacgctcactttgcaaa

SEQ ID NO: 105957 - DNA, 668 bp, Oryza sativa
agaactgcattctcgcaagcgaaaaagcaacagtgttgcttgggggtgggggatcaagattaccaatattattaataggcatgaataacatcttgtgtacatgggttagcaattaaaacaggatgagaatctttcttgctaattctgagctgatgcaaaactaagagcttaccatgaatgaaaggaggcccgtgagaatgctgcagaacgaaagtatatgtcagactatgaagagagataggtagaaaagatttatatagtaaaactacagactacatatatcactagagcagtggaactacattttgatgatttagagtccacacatctcactattaaatagaaggattaattggatctatgctatcataataagtttcatgcttagaaaatatgccattattgttcacctacatcgactcccaaggaaccacacaagcatgacttcatgttctttacaagaatggaaagatgtaaactggtctagatatctcttaagtttgaatgacgactcagcccaacaactccccagataatggtgggaaatacgttatgctcaaatattgtgcttagtacagatttgtacataccttgccacagaccacataggattccaagattccggatgaactgcaaaaacataataaattaaaagtgatggaaattgg

SEQ ID NO: 105958 - DNA, 579 bp, Oryza sativa
tctccaaggaagctaagttacacattgagtagctcgctaatgtgaacatcttcctctcttcatcacatggtaactcacctcattaactctctccgtttcataaggtagcactttctagcattgtccacattcatatagatgttaatgaatctagatatatgtgtgtgtgtctagattcattaacatctatatgaatatggacaatgctagaaagttctacattatgaaacggagagagttaatgaggtgagttacaatgtgatgaagagaggaagatgtacacattagcgagctacaaaatgtgtaacttagcttctttgaagataaatctggtggataatccagttattcagtagaaagtaggaacagtaggctctaggaaatgctatagaaattttggaacacatatgcaacaggaatcgagtcaatcaagctgatttgatgagagccgagaagtacatgaggagttgcagtcttgcataaactgtcctccccgccactaataaaatatacacatcagtgtgtgcaactttttcggtctgaacctagctgggtaccgagctcgaattcgccctatag

SEQ ID NO: 105959 - DNA, 728 bp, Oryza sativa
gacataggtggtgtatgaaagtcatgaaggtaaagatgaagattgatcaagattaagtgtttcacgtaaaataaggtgttaataacttgttattaattgagttttaattattacaaacttgtaaaataaattaatctgatattttaaacccctttcatcattttaaacacgaaacacaacgcatcattttaatccaaaagtttgtctccacctttcataagaatagtagtacagcccaaaggcttgtaaacacgtttgctcacttacctacataagaacgtacacgcataccattatattacacataaatactttcgaagacaaacgacatgtctattgactgacgagattagtgtgtcctttaggccgcgtttatattcaaacttttttcttcaaacttctaattttttcgtcacatcaaatatttgagcacatgcatagagtattaaatgtggaaaaaaaaataattacacagtttgcatgtaaatcacaagacgaatcttttgagcctaataacaccatgatttggtcatgtggtgctatagtaaacatttactaatgacagattaattaggcttaatagatttgtctcacagtttacaggcggaatctgtaatttgttttattattagtctacgtttaatactttaaatgtgtgtccgtatacgacgaactaaacacagccttataccatatataaataagggaaaattggaaccatgccatta

SEQ ID NO: 105960 - DNA, 1881 bp, Oryza sativa
ccattcttacagccatgatgtctagaggcttgctcgggcggcggcgaggtggaggtaggaaggaggcggggtagcagcgagctggcgagtcaccgtccgtgtcgctccagccctaggattccttaccattttcttttgtttcatccaaaattatcactgtctaaaatttaaaataaaagtacaaagaaaggtgatacataactgattgacaatcacttagccacgcatgctagtcgagaaaaatcgaatgtaccttacgcacgaaaggctaacgactagcatcacacagatgtaactacctagtttttactaccctcttgtagtattacaatgtcgtgaatggactaataaacacagtaaattaaccaccggcaatccccaagtatttacaaaggtatatatatatttcctctctcagtgatatataaggctacgtaattacgtaagtcactgaatgtatattagagcgatgaaataataggacacacatatattatgaaggtgacaaattatcaaatatcccgattacggtcagtaagggtcttttgcagtactgcacagtagaaatgctcgctgacatgttggcccgtagaggatctggattgcatcctaagagcaagtataatagtaggctataagtcggctaaatgctgatgtggaggagagaagagaggagaagcgggctgtaaacttacagcggcttggacacaagaaccaagaaactctgtgagaaagacaagtaggccatgtaataattataaagagctaactattatataggtagactaaaagaagactataaagaactttatagaatacaggtcgacagtattattagccttgctctaatattcgtggacgattaattacactccggttgcaaattcagcatgctgcccacacacagtgtcctgtgtcctcccccgcccgccagttggatgcttcccggatcccggtgcccgccgtctcatccgatccaacgaagaaagaagagaaagaaagcccgcgagttcgagtcaaaccgggcgacccaaacgttgtcctctttccttgaacccaaccacttgttgacaaagtccatctcccgccacattccaccccggatcctctacatcttcaacaccgcaacaacggtgacacacgaaatggctccatcgttacagcatatttttgcaaatgaaatataatttgttaataaaagggcggttcagattgtagccaaaataaaaccttactaaactttggtaagttaacattatccaaattttggcaagattttttttatgtatttactaaagtttggtaaaagctaaatgtggacatatctttggtaactttgctagaaatatagtatggttgaaaatatcatcaatatgaaacagcccaaaaacttttatatacgtgttttagcaattaaaaaaggaaataaattatgttaaaaaaccttaaaattaaactcaaaatttaaatttaaggttaaaagttaaaattttacggatgataagcataagcgaaaagatgagaccggttggcttcgttgccacataagatccggctactctcccccacgtagccgcctcgcctcaccttcaaatacgagctgcctccactgcctcgcccaccattactacttcctctccttccttctcttcttgccaagctcaagctgatcaagccaagaagctagctagctatgtcgtcttcgccgccgacgagcgcgatggcggcgggaacgtcgtcgtcgtcgggaggcggatctgggccgttggtggtgagcaacggcgtgctgctcgccgcggtcatcttcctgttcatggtcgtcgtcttcgtcttcctcctctacctctacgccaagagatacctcggcgcgaacccgctgct

SEQ ID NO: 105961 - DNA, 965 bp, Oryza sativa
  unsure (1)..(965): unsure at all n locations
tacaagtttgatataaagtttgtcttcattagatttcacatgaaaaagttatgaattatttttaaatataaagtctttagaccatccgatttgacccatatgatattcaaatccaagtttagaccccggggtgactcaattgacaaagttaaaggatctaaatgagtgatctccaagttaagggcccaggatgatacagtcgagcaagtttgaggacctgaccagtcaattaacgaagtttagggacggganataacacagcggtacaagtttagagaccggcgatggactttactctatatttaataatgaatcaaatgataggaaaataattaataattacttaaatttgaataagacgaacggtgaaagatgttaaaaaaaatcaacggcatcaaatatttagatacggagagagtacccaaaatcccttatactatgggacggaaggagtattagaattaagaaaaaatatatgagactcatttttcacccacacacacaaaaaaaatatataagacccatttacacatgggaccccatgttatctctctctttttcttcttccttcctctttctctttctctttctctgctcttcccatgcggcattggcactctcacacgagctccaccgttgtaaaaactgtgtggtttaaaaactgaaaatattaccacatatgataactataataaccgcatggttttacaaatcctggccttcaccttcgcctccccgagttgtacgcacagtcgcttcagcttcgtgcgccgtagcggcaggctccagcttcgacggtccgaccacatcgttcaccaccgtctgccgactacctctgtattgtccgagtaaagatcgtgagcgaaaagccctcgtattttaaatggcaattttggaaggagatagatgctcactcgcttgcgaagaagggatggcttggcatcgatttgtaaaataatatgact

SEQ ID NO: 105962 - DNA, 530 bp, Oryza sativa
tcaatctcggcccatcctgctacctccctctgcttagcctgcttctctgccccacaagtagaactacagacctagctttgcatagtggattgccatatgcttctctttgaccccagctcacaagtagaactataggtctagctcacatagtcgattggcatcttcaacctctggaagatagtccgtgtagaacgatgcaagaactgatcctcccatcaaatccggtcgaatcttcctcgatctcccaaaattggttgagggcttttgattcactcaatctcctcttttcatttttattaaaattggagctaatccacaaaactgtgggatataaacggtgatttctaaatagagattaaatctagtgaattaaagaggaactgaaaagaaaaattatgtggaaaatgacgatggagtagtggagaattgatttttacaattaatcggagaagggaaagcatgaggaggttgatcgatgtggcggtggagctaggattcgacctgacgactaaaaaaccgtgtagattaaa

SEQ ID NO: 105963 - DNA, 2024 bp, Oryza sativa
gaaaatgagagaagagtgggtcccgcttaagagagagatagaggaaagaaacaggagataggtaggagatagaagaggcgaggtggcagccacatcaatgccattaggatcctttaaagggtgtgacaattttggacctgagatgacatgctttaacaagatttgaaaattgcttatgcattttagagttaagggacctagataacacactccataaatttaggaattgcgccggttcacttcactctctatataaaaggtgccagcagcagcagcactctttaggggaggaaggaggttcagagacttggagatatataccaacgcaacgatccatttcactattttaagagcaggggttgacatggtccgaaacctcatctgttgattgaagtgaaagctgagaaacactgcacggtagctaaagaagctagtagcattctggttgcaggagtaggaatgtgatgtactaggaagttcagagattgttcaatttcttttggaccgagaaagactgaaactcgtcgagtaaggggatggggagtggcgacagtgggcagccgagcaccctctcacgttagtccgccatcagagtgtcgccatggattgaggtgcagcgagtgcacttctttttttccttttggaaggactcggctagctctggatgtaacgtcgtgccaaaagtgcttagcaccctctgtaacaagatttgaagacagctacttgctaattcttctcccttgctccgaatctgatcgaattggcagcatatatgcaagagtagtgtgttaggaagttgagaaagttatcaacttctattagagtccaagggcccaaaattccagaagtactgtagcaagagtatgctggttgcagggaagtatgaatgtgaggtgttaggaagttcggagattcttctataatatcggtattggatcttgacagcccaaaattgcacgagcacgaagaaggaaaactagcatacatatttgtttgcatgtgtagtactagtagtttacaggcatattgcttgtatatcaaaaaaaaaaaaaaactgagatggctataaggaactagtcaactaaaggtatttaaaataggagaaaccacattcttttaaccattcatttaatataggtcgattgaacctggatctgctaggtgaaagcgaaatcaactggtcgtatcgaccgagctaggcatatggttctcatagccagtatatatgagtgttcgacacatcgacaacatgaagcaatgtgttgatggccacggctaggtcagtgaaatgttgatgactggagaacagtacggagctccagtcgtcgggacgtggcacacccaattttgatatgggaattgcttgatttcgggcgctagaaaatttataaattttcatgtcacctgaaattatgcattcctaagcttaaaattaatgtgcaattttaattcgttttaattttattttttattattgttggttttgctttactttttttaatctaagtttgaatttcttttcacgtattttgtgtttttatgagttataagtttgtttcatctaaatttgtaacttttttatgttagaatgacttattatttaacttttggggagtgacaattgataagtaatagtgaaataaagagagccattggattttcatctaatggattagaaacgtgaccaaattatttggaagtttcaagcacttgaaatctaggcactcattggtccatttcttagattgaatctgtgttgtgtcgagcgctgatggcatggccatcgacccgatgtaccacgacgagctcccggcctcccgcaacacagctggttgcaatcttgcctactttgttgtttctaattcatgggtaataaatacgactcaagtaaaccaccctacctaactttggataaagggggtgtttagatctatggtataaagttttggcgtgtcacattggatatacagtcatatatttgaagtattaaacatagactaattataaaacaaattacagattcc

SEQ ID NO: 105964 - DNA, 2182 bp, Oryza sativa
catttttgtcaagagattgcacacatggctgaaatacacacatcaaattcaaggtactgccctctcttcttagtatataagtggcgttgaggaggaaaagaaggggtatattgttcaacatttcgtagaaaacagttaattgaggggaggaaggagatcaagataggacagaaagattcatatactttttgctcacaacttttcacctgaagttctattggccacacaatataaaccttggggggtttggggcaactctaccatgcacacacattgcaggactaggactaggactaggatgcattaggaagcacagtgttggtgaaagcaatggccataaccctcaaactcggacactccatgattgggcacttaattaagtgttacactcatgtcccatgtaggcttgcgaccttgggaagatatgtttgtcactataactttcactaattctagaagaatttgagacctcggcactttggtttcactatctggaagaatttgggaccactaggagtgggaggctctttggtagtctagcttccactatttctagaacaactcagacacctcagacctcacttgtttccagctagattgatatggctcctcaaatgatctctagttaataatgatgcgatgctctttggatgcaattttatgttgtgcaaattttttattaattcttggtgatggcatcaccagaagtgagttaaaaacatccattcaagttgtcctgtaaaaaaaaagagcctcactccggtgctttctactcgtagtaaaaaacgatctgaaccattgatctaatttgattgaatggttcagatctatttctactaccatctcatcttatggtagtagaagcgtgggtgggcaaatttgttaaaaaaaaaactatgtgcggagggtaaactcgtcttctaatagttactaaacctaacagcgtacatgatcacgacaccgccgctggcgtgcgcgcgctcctctctacctgcagccggacgccgctgccgcatgtgtctccccccatcagaggctacgcagcagggcctagcatctcagtgaagcgggatactttcgccataggctgtgaaggccccacggtgcacacatgaaaaacctgagttggatggatcattgttgcaaacgtcttcgatcgaatcaaatgcatgtctattaaatttcactgctactaatatatgagtgttcgattggaatggtcaaaggtagatctactgaatatctgaatctgacgatgaatggctcgggccgtgcctttcactctccgggggtgtttgtgttgatggagatggcactgctggctagatgggttagcagcttgcgtacactgctctctgttgtctttacaggatttttttgtgctcaagctgtttctgggacaactaaattcagcaacaaattctttatgtaactttcttgacacaccattaatcaaatggtaataaggtagagtctcgcgtcaaaaaaaaatcatcaacaaagcgcaatcaagagttatatgaaacaaaattcaaacatggatgatttatatttctatcatattgtttcattcatggcacaaatagatccacgtaacatttgaaaagcagcaggcattaacctttaaacgcgcagaacttcaacgaaaatggcacaataccaagagcttaactgctactctgccatgatgtctcgctgcggcacacactagttacatacatcatcaccaacagcagaattcatgaaacatcaagcactacaatttttcgtcaccaactgcacaagtaagcaccagcagtgccaggatttttcgtcaccaacagtataattcagtagcagcaacagcagtattttccagaagcaaactctagccggtatggatccaagcgagtctccgccgcacgcggaggggccgggatcgtcgtcggagcggcctccgaattgaactgcgcaccgctgccgcgattggatgttgatcgaagattatcaaaaaaaaaacattttatagaagtgatatcagttgatcgaagattatcaaatgttctccaaagtagaacaatgaccatgtgttcagtcttcagcgttatggcatatctagaattagggtcctcatcatgcactaaaataaaaattagtagcaattctaccaagcttattcagaatagtaatattgcatttgctg

SEQ ID NO: 105965 - DNA, 660 bp, Oryza sativa
agaagaacccgcgcccgctcgacgaggacgacatcgccctcctcaagacctacgtgagtgccccgcagatcggatcgatccccctctcgtcttctcctcctagggtggaaattcttcggccgatctgagcttgattcacgggttagggtccccttgttccgtagccatggagtcgcgctcgtggtagatctagggttttcgatctctcgtgctcgcgttactacctgccgcactcgttggcgacaactatcatgattttgtgcagagaatcagttcttccgcatgctcaggatgaaattcgtttagttggatttcggtacatagccatagctctgtgaaacctagtccatcagatattttctctgcatattcatctcctttctgttgcattttcctctctataaagagcttcacttcaggttgcactagttagttagttagttcccacttttctttatcccgcaattagcgtgtgcgataggaccctaaaacattcatctcattgtataattttgctaaattctgccgtgttaatttaggcatctagctgaatttgctaattttatactggtctattgcttaacagggtcttggaccttactcgaccagcattaagaaggttgagaaggaaatcaaagagagctcgaattagacctatag

SEQ ID NO: 105966 - DNA, 562 bp, Oryza sativa
aatttacttttatagagatatcagatataacgtataagcgagtttataaatactatgttgctttcgggtggtataggagcacacaatggctacctttaacatttaaaatttgtcctaatatatataaattactacttcacatattcactcatctcaactaattacaaccatcaagataaaaaaactaatttcaactctctttttttcgtctattagtttttttagctaatcataatattcacctttttgtcaaaaaataaaaatagaacataaacttttcatttaattttatcttacttctcattaaagttttttttcatcttacttccaactaacatctcaactctaatatctctcattaaatgatgaatataaaagtattttctggtcaactttaatctttattaaagaacatagaaattttaaatttaagaatggagatagtaataaaactaaaaggatagtaataaaactaaaaggcttcgtaattgtcaacattaatcgtccacttatatatgcaggttatgctggtgctcaaagtctcgcgaagcgcgactacatg

SEQ ID NO: 105967 - DNA, 1379 bp, Oryza sativa
gatgtttttaccgatactttgttacatcatctatgtataagtcggtttttagttcgttcgcttttggaaatacatatccgtatttgagttggttttaagttcattcacttttggaaatacataaggagttgtataagaaaactcgcatgctaactttagacgaacggactcctaactgcagctcatgatttttctaaaaatatatgtatctaagcgaattctcacgatgaatttcatcttaattaaaccatataaaaaataagattaaaatggatttcatccgttgcaacgcacgggttttttttctagttgaatgaaatacaaagaagttaagtgcttttcttatcttagtgaaaaacttatattacgatcaatataaatcggatggagtactcagcggtccatctgttttaatagctttttactactctctaatgatgctattgtaggcgatttcaaaacaaggttgttagtatcccgattcgtattttaatatcttatgatactacgatcctatcaaggtaaaatgataccgatctcacctagtatcctaattttcatagtatcacgatcctacaattcattactgtacgatcctacgaaatcttaagtagtatcctgattccacgatccctatgatactataaaatattatttaaaataagatggtttgaaaataatgtaaataaatatgctctagtttatataaaaatcagtttaatatatcaaaaccaatatgatttctcttaataaatatctctatttgcatgacatatattattactgtattttttatatataatggctatatgtaattaatataaatattaattaaacttaaaaaaatatcataatatcctgatcctactatacaaaactactttaagcaaaatgataatgtctactatcccaatccaaacaaacttgatttgaaatgagggaggcaagtagtcaattagtcatgtcacatcaggcgtttcttttcctttttctgttggcgcatttaactacctgaagaaattcgcaaccgcatgaatgattaaagtgttcccctgccttcttctgttgttgtgtttcaattgtccatatttgcttttatatgtcgcagcataatttacttataaacatggacattttactgttgaagcgtgtaaagtataattattcaggttttacttttaagtgttgttttacctttgcaaatgatctaagttattctctccgtcctattttaaatgcagttgtgagtttctctgtccaacatttaaccgtccgttttatttaaaatatttttataattagtatttttattactattagataatagaacatgaataatattttatgtatgactttttattatttttttcataaaattt

SEQ ID NO: 105968 - DNA, 1946 bp, Oryza sativa
aggaggaaaagtgtggctttcttgctgcgggtgaagactgaagacgcgttggatggactgactgctgctgatgatgaatgatgatgcagagccagcccaggggaggggggctaaaaatgctgacgatagcaggaaagtctcaacctattctttttgttttgtttactagtacaccccttctgtctatattttgcattggtgcatggtatttgtaggcctttttgtggttcttgggttggagaactttgagagggatggatggatggatgggttgggtggaaatgtgggaaaaaaacaaataatctcatttcctttttttatgtactttgctttacatctttgttgaataggacttatgattttcttttctttttcgtgtttacatgcgtctttttcagaataggacatcttagattccagactatagtagaaccgtaaaagagtaatatgtatcatagctttttcctcttgttttaggctacctctctttttataaaataagtgtaatgttgatttttttggggaacgtacaacaccctttcaaaaaagttagcgagatgtaatgcggatcatacgggtcactttagttgccgcttttcttgctccaattacgtggactgacaacttacaattattataaattattatagctttttagtgttgttagacatacgttaaaattatattcggtgcacctgtaccatatttagcaatggctactgatgtgcacatgaaacaaagatggaacatcagaagatgagtcatctgtatcttatggatattaaatcgtcggcgcatttatttggatagcgagaaaatactagcacaacaaagaatttgagacacggggcaccgagcgtgcaatcaattcgatgataatattagttgatgctaaatatggaagtggaattcaattcttactccgttctaatttgcttacatatttagtaatgtgaacaccactcttattgttttgaaaatatcctttaaattttcttcaataaactttctataaaattcaaaatttcaatacactttgttctatgaaaaatgctagacttctatagtttgtgtagcactatctacacgcgaggctttacattcctgcatcatcgcagggtttttacgaggagaaccgcattgtcattcgttgtggggatacaaattcatgtaacaaaattcaccaaaacagcgagggccaaagtgagatggattaaaataaaaagttttgtccagattatgtcacgcgcgagttctgagaccaggttaggttgtgatgacgtcgctgtgcaagtgggccccgctttagtgttcttcggttccctggggcccacatttggcagaacctaaagttggagatttgctgtgacctacgatcgattcgacgatgttaattaatctgcccccccgggcaaaacaacaatatttttaatcctcacttttaattaatgcttgatactcacttatcaatggaattagtaatttttttctcccaactaattctgtacaatacattcaatgggcataatgctaatttcagacgcaaatcactgaccaactaatcagagcaaattaagtggagcagtacgacctgccaagcttcagttccgtatcttatttggagaaggaccataggatgccaataatcagggtgacctgattatttaagaaattgtacacggattaattagtattagtgaaatagaggtctctctactgccattcaagtaaatttgatgacatggaagaaagagaaacaagcatggttgttatacatgacaacagctcagagttgactcttagtatttattagagtaaattttattgcatggtgatgaaagaaaggaaaaaagagtaagaaaaagtattttgatatattaataattagagatcttattgtctctacgtaggatactagtttttagataacatagaggtcatatatg

SEQ ID NO: 105969 - DNA, 1696 bp, Oryza sativa
gtagctcctttgactatgtcttcatcccacgtaacattgacgtggcagcaacgacgatgtcgcgatgatagtgttcaagctggagtgcatcctagaagaagcagtcgcaagtcgtcttggctcctctggcagcgacaatggttcgcccagctcgggctccggtggtgggggagggtgctaaggcctgcaggatgtggcacccgcggcggaggaggagcgacggcaacggcggagtccaaccgggagtcagcgcgatggtcgcggatgtgcaagcaacgatagctcaacgaggtggacgcaagtcgagcacctccactctagtgggatggtgctcgtgatgttgcacgagtgccgtcgcattagctagcgtcggtgggatgatgcccgtgttgttgttgtcgctgagcatgaggtcctacaacgcagggaggcgatcaagcgacgctaaaattgtgctggagatggcgttgatggagaggtcgagcgagacgagtccagggtgaagcccgtcagtgagttcggccatcctccctccccactccgcttgccgccctccccgcttggtccctttttgtgcatgccgacagagagaggagatagagccatagaggtagagagggtgaggtgaaggaagtggacccaccggcatgtgggtcatactatttttcatcttcttgtttgagtgatatatgggcccgtatattttttagttttcaatttttctccttttatttttttaatcaaattgccacgtaagctccacgtcaatgctacgtgggacgaagacctaatcaaaagagccatgtaggtaccacgttagctaaaactagggataatactgtcgagagatctcatttgtcagtggttttgtagattggggatggattgtatccggttttacggtatagggaaaaatttcagagtcgacgatgaattgtgggacctaaaatgaatattttttttcagctttgcttggatgctgaaatggtgaagcaagaaaaaagaagagagataacagaatatactactataagacaaaatagaaatactccagtattgtattaatcaagtgagctacacgcaatcaatttagtgtttagtccgatagcctaagtacctaaacaacgttgtttgcactgcacggaacgccagcttcattagattggagtctcggcaacaagagagtacgtacagaaaatgcaacttgtttatgacgacgaaactaatcaaattgtacaaggagtcagtggagagatctgagatcttttcacgatatttcagtactaaaatgtcagctattcgatccactacctgcggttggagcttggagcacgtatagcaccacctttttgcggctgagaacgtgattatcttcacccaatttttcttccttaatttccatgaaacaacaaattacgcgaaaaattaacacaacactaattctttctttcctctcgctgtcaatccaatccaatctaggttagagacaaatctctcagcgtcatgtgcccattgcagctaattacattgcctaatccatcaatcaatcgatcgacagtagtagcgatgatacaacgaatgatcgagctagctagctagccggctctgctgagctgagctggcactgggacttcctctgtttcacaatatgagttattttaatattttttctatttatattaatgttaataaatca

SEQ ID NO: 105970 - DNA, 674 bp, Oryza sativa
aacgcacgagtattttttctagttaaagtaaagcgtatgatcggtttctaaactcggttggtatatatcgtctaggtttctaaatttttaaaatgtgtttttagattctctaactggtttaagtgtgttattttagtgttaaattgtcacggctcatcaagatcacgcgtgctttcgtgacacgccaactcacttccttttttcctttttttctcctctttcccttctcttattcattcttgttcgtgtggcaaaaaaaaaaggtaaaaagaagaaaaaaatgaaaccaaaatatccaagagaagggaaaatgaaaatgaagaaaaaagttaaaagattaacggaaccatcgttttgcttattgggggaataagcgaaaaggcatatttgcaagtgaataataatttgtgaataaaatttttatatacgtgttcctagcgatctaaaaataaaggctgaaaataaacttcaatgaaaaaaccctaaaattaacttcaaatttaagattaaaaatttaaattttagctgataagtactccctccgggttgataatacttgtcgttttggacaagggcacgtctaaaaaaacaactttgaccattattttctattataatatgtataaaagtgttaataaatatatgatcttttaaagtactttttaagattaatc

SEQ ID NO: 105971 - DNA, 523 bp, Oryza sativa
ctttgaaatatagtccgccgtcccaaagtatagttatctttctacttcaattttttaaattagctatattttgggacatagtatgatttttgaaaaactttcactggaatcgaactactactacaaatggaattttaaaaggaagggataaatatcatgtaagaaaatggagtaccaaatcagaatatccataatctttatgaacttggctgcaaaaagtaccatatcatgatgaccagagcggctcggttttcccaaaaaggaatgagcccaccacaacaataccgccactccacgtacacaaaaagaaccacacaaatttcagtcctcgttttttttttccttctctttttcttttccttttttctccaaaaaccctaaaaaaagaaattaaactgcgagaaagcaaaatactagcggccgccaagaaattccccccctctggccttcgccttctccgagtttccagcatatgcgccccgaattttccttcagatttgcctagtttttctccctcgctctt

SEQ ID NO: 105972 - DNA, 609 bp, Oryza sativa
tcgactctagaggatccccgcaaccatccattccatggttgttttatgaggaggataaaagttactccctccgtttcacaatgttagactttctaccactatttatattcatgtagatattaatgaatctatatacttatatgtgtctagattcattaacatctatacgaatgtgggcgatgctaaaagactttctagcatcgcccacattcatatagatgttaatgaatctagatatatgtgtgagtgactagattcattaacatctatatgaatatggacaatgctagaaagttctacattatgaaacggagagagttaatgaggggagttacaatgtgatgaagagaggaagatgtacacattagcgagctacaaaatgtgtaacttagcttctttggagataaatctggtggataatccacttattcagtagaaagttggaacaggaggctctaggaaatgctatagaaattttggaacacatatgcaacaggaatcgagtccatcaacgtgatttgatgacagccgataagtacatgaggagttgcagtcttgcataaactgtcctccccgccactactaagatatacacattagtgtgtgcaa

SEQ ID NO: 105973 - DNA, 686 bp, Oryza sativa
gaagatgtcagctaggcttgatccggtgatcacccactgaaatccgcacaacatatacagagtagtagaatggaattgaagcaagaacatgatgatttgtgcaatagaatcccacagcattttcttgtcttgttatcctcctatttatagatgaagcaagtatggatcagtccaccattgtcatgcgtgccattcgcgccatgacgttgaacactcttgagagccgttcgttggcttatgcagtgcatgtcgcatctgcctgagaaatgagactcgctccaacatggacacattctgatcacctcgtcacctcgagctaaactagcgcatgatcacaccttaattagtgatgtacactaagataacgtgagagggcatatagtttagtggttacgagtcatatataatcatttccaccagtgaaccaacctgttggaatcggcgatttttggccgatgacgattgagccacgaccgatttttttttttaagaattacacagtacaacacagacactcacaacgcacgcacactcacccctatgaacgcacgcacggtcgatttctgttaagactcgaggctcaagaagtcaagatggttggtccattcccatctctgatagaggcggcggcgggctaggagtccaagaagcggaagaggatcctaacgaaggcggcggccctatgg

SEQ ID NO: 105974 - DNA, 3731 bp, Oryza sativa
atcaccatcggaaacggaaggcaaagcttctgaaattccaagtggctttactacctgactcccaaggagctagcaccaaccatctatgaatatttcctggagaaagaatataatggtaaaagaggctcttgccaacaacaaatgggtgacagatctccaacctgtattcttcacctcctcatgccacttccaggaatacatcgaactttgggctaaactatagacggtctccctatagctagacatcgacgatgaaataagatggagattggccatggcctagttttcaccgttaagatggtgtgggagaagccacgtcgttgatactgttgctttggtcgatatattatatccacattcatattctaattccaattcgtgcattacctttgtgtgagaagtttatggagccatttggatctatggccagattaagcctgcttctcagacagaagggatatggcccgtaaaggtccatatgtatttggatctgtcccaaacacgtgcactcaatcaattggctattaggaaaacgtactcatccttaagcacattacaatgttgttaatttccttcatgcattttatttgtcacagagaaacaataggttaaactttcaacaaatagagaagtcatgtaagtgttctgagctactggtcctactcatgaatagataatgtgttagtgttcatggtgtaattactctgaactttagtgtagttcttgcttgtgttcaagtgtttacaatgcgcacagagctttccatccacacggctcaaataccagatcaagttctccctttctttatatacagaaattttacggtacttaaagtataccataattaccaaaaaaattggtattgttctagtactggagatattgaattatcaaattttacattaaaaattatgatacctgcaaaacgagtatggcccaattggttagatttcttgcagtggaaccagcccacctaaattcaagtcctaaatttgagactgttgctcgcatttacagctaattttctttcagtgataacggataagtgatgtccgtgatgactttatcaattttaagatatatcgatccaatcctccggacccaatcctccggatatgcttatagggataagatatgcgtgtgtttgtactatgtttctacaaaagaaaaagaaaatgtgataccgtaaaatcactcttcgtgcgactgaggaagagaggggatacgctgataaatatgcttcaacatttcatacaaaaccagctcaccgaagagatgaaagagctcaagagaggagtgctagatgacatgcattattatgtaaatcaacgcgcgtaattttgcccacaacaccacctgaaattttattagccatgcaatgtaaactcaatggcaaatatagcgatgcacattgcatgggactagctaggactaagatgcattaggaaatgcagcgattgtgaaagtgatggccaaccctaactcctcgccacaacatgatggagtgccgcctccttctgttctattcctgtctcatttctatgttggtgtcatatttcactgtttttgaaaaaatttagcacatgtgttgatcactcaatagagtcaagtatgtacataaattgttgaacggaacattcagacttgacagagatacatagcgacattagatttattttattatctcaggtgtcgatatatatactaccttaggcttatcttctaatgaaagtgaaatatgatgaacactgtgtacgtagctaaaacatgttggttgcagttagcaggtagagtaggaatctgaggtttcaggaagttcagcaattcttctactttatcccccggttccaaatttgaacaagctaccaaatcacgttgcatctatagtagtagtatctactatctagcattgttcgtcagagtcttcgacaacatgaagtggcatgacgatcgtcagttgaaagccaattgagggaagaacagctgagctccggtcgtcggagtggaattaatacggcgaggggttaacatactgcttgtcttccctgtttgtaagactatctcggccaataagtttgagaacgactcagtttttctttttcaaataatacaccatatggtctcctcaatttttttcagcacaacttcattattcaagaaattttatccttgagaggtaccaagagtactaaaaatttttactgcaaatttttgtaccacctgaggatacaatacatatgaatatatggtacttatctcctgtacctcttcaaggaacgtaaaatcactctcggtattaaggaaatagtttctctgtactttagtgcggctcttgtatcatagtaaataattaatccctttgtgtctgcataaggatacaatacatggatgcaataccttaaaaaaataaagattactaccctctctactttatataaatggtgctgaggaggaagggaaaggtgatgctcccaaatttcgttgaaaccagctcattgaggggaggaaggagctgaggagagaagcacacattgcagaattaggactggatgcaacaggaaacacttacatggaaaaagtgccgtgctgtggcacattattagccatctcttaaagatgtttacaactttaggtaaatatatatattgcaattttacactcgcagattacgcattagcgtcgcgcaacaatgctcagggtatcttctagtatatgagaaaagaaagtgctgcccatgtaagactatctgtattttcggcctacacaaaccacaagatgttgagggcgaagatgtatttttgcagtatgttctaaactctatatattctcacactagtacaaaaccctttactggtactggttgggaatcggcctaggtaccagtttctcagcctgtaccaatttagtggtaccaataccgaaaggcaggtaccggttctaaaactggcacacatagtcaggatgagggtttgcaaaactatagcattgttccattgttttattatgtcaaggaaataacaagtgggaccttgaatagtactcgtataaaattaatgttgcttaaacactgcactccctagtcatcaaaagatcatgtgtccagttcagctgggtgtgctcaaatggatacagatcctccgcagtactgctgatgcaatagtagtggctaatatgtgggttcgggtccacatgccagtgtctgctgttgcatcagcagtattgtagacaacctccactggtgctcaatggctaatttgtgataattattttagggtacaaagaacgaataaagttgacatgtaaacctaaaaagttttctaaaaattaaaatatataaatctattataaaaatcacattgtttagtagcagcggggcaattaaggtgaatggtgagcggccacccttgctatggccccatgacggcttgatcgccagccatagctcctgcttgctttgagagagagaggggcagaaggaagaatttttttagaaataatacaaatttaataaaaaatttctaaaaataaatgttggttgtctgaaatgacaggatttaaaaaattggaaacttgggatgtgtgtgcacgcacgtgagtgggttgtgcgacctatcgaactttacgaattcgataggccacttacagcaaagtacatgcttactcgtttctttttttttaatcaacccatctaacgtgtccaatgaccgttgtgcgacaggtagcaacactag

SEQ ID NO: 105975 - DNA, 644 bp, Oryza sativa
  unsure (1)..(644): unsure at all n locations
tacacatatcttacttctgtaagcatctctaagagagtgggcttgctttttacgtttatgataatggatatatatatatatatatatatatatatatatatatatatatatatatatatatatatatacatatatctatctctatccctccccctgtaaatctatgttgccccatatataaacaaacctacatgcattgcctgatgcacacccacccgcatatccatttgaatccagatgtcaccatatgcacacagacacacaccacgatcgacgcatatgcatgcacatacatnggtccacaccgcacacaggattaatgactcgctgggccctaactacaagcgcgcacgcctgcatatcccacccactatgccctgccacttctattcactcccccaaggtgcacacccacacacacacacgcagcccttggttcttaccccgccagcctcgcgtcaaaggccggagaggggggcggagatcctacgtttcgcccgcgtgtcaaaccctacaacnaccccacgcacatatagagagtgcgacacccatactgcccaccccatagcctagccgcaacgccccggaggggccatggaccctgtcccatccacacacatgtgcttacccccaaccggaccccg

SEQ ID NO: 105976 - DNA, 663 bp, Oryza sativa
  unsure (1)..(663): unsure at all n locations
agccgcagggctattagtgtaaggaatacatgttaggtgcanaaccagaaaccaggatagaagcatatgcatgcacaacagttggatgcncagagcacacaggactaaggatcagcaggcccctaactagcaagcattgcatgcatgcatatgcagcccaatatgcaatgccacttagcttcactcccccaaaggtgcacaaccacacacacacacacacaattcctttttacccctcaagccttgaatctttggtaggagaagggggaggagtttctccttttgccatgtggttcataccctacacgaaccccaagcacatatgcataatgtagcttagatatttctcaccccttagcttgtttgcaatgcaactgtggggtaatggaccttgccccaaccacacaaatatactcccccacaagagcagccaagttggtgaccagagatatgtgagggcgtggatcaaaaggaattcagctagcacattctcatccatgatcagctgtattttaattatacccgattcagagatttcatttttctttcttttaaaaaattatcccgtcatagttatttgatgtttatgacaagattcgattaaacttttaaaattatgatcaaaacttataatatttatagttgtagtattattctgcatat

SEQ ID NO: 105977 - DNA, 733 bp, Oryza sativa
  unsure (1)..(733): unsure at all n locations
ccgatcatctatgcttgcatgcctgccgggcgagcctgcaggacgactctagaggatccccatgtgaatggcatgaccacagatcaccgaattatcaaaaaaaacctccactaggggatttctgacttctaggcaaggcagaaatggaaaaatatctttcactgcaccacaagaaatttccactcgaaactattagaaaaacaaaacacaccatgttttttcaattaggtagtccttaacaacagcagccatatcaaccatgaatgtgattcacctatatgagactgtcagtgactggacgccgttgctagtgattctcattatgagggaaaaatgcctgaaaaaaatattttaccatggtactaatctagcacaataaaggggcctaacaactccacatagatcatgctgttatccacgctgttactcaatctatgcactcacaaatgatatctgttgggcttttaaccgaccacctttgctaagttcttatcgcactccattcctcattatcttgaccattgggatatcatggagtagcttccatatccacagtatactctagacagaagatgacgagcttttccagaacatgcttgccaaacccatttggattttttttcgaccctctatcaaccccacgtttttatcaacccaaaccctatgcaacaaacccanntgtgtcacaagcataaaacattgccatgtgcgtcgtatcaaantctattcctgc

SEQ ID NO: 105978 - DNA, 1682 bp, Oryza sativa
ttcgagggtaacttttatttccgctaaaagttttcggtttttgggtataccaaccattcaccctccctctggttggcttagttcttatgattcgatcctacaagtctcctccacttgtccacctttagccccaccactctcccgcaaatcatacatcgtcaaagccgcatctcacctatgttgtacctatcgttggctcacctatcgcctctccccgccccaatccagtttctcgagggtataaatagcctcgccatactcctctatcttgttttccacatttcaaaagtttagtgcttttatgctaaagacggagttaaaagaccaaggtttatacctcagttgcgttttacttgtggagtggaggtgaagttccagtaggatcgtcctttttcactgttgctttgttttttctttatgaggactaagtatttattctgtaagtatttacgtttgaatatgtatattaatttgtcattttgtgtatcctagtttgattcctggacatagatttatacacagaatagtatgagaattggtgaaatttttgggcgcgacaatgaactacgtgccaaaagttgggaaacccggcttttccatattttttaaacctaactacgaaccaaccgttcctccgaattttaagctctccaaaacgggacaaaagtctatttcactatacattagagaaaccaccatgatgctatttttggttcagaagtctcacataggctcggatggtctcacatccttccaccaattgaaattcttagcccaaataatgcaccacctaaaattgaattgaaccccagaaccaaaacaaaggtcccaatgattgggaatggtagggaagatgcaagatccatggtccaatcagaccaagcaaaccatcattgagcaatgttcactgcactgtgtgcgagtggatcccatcaagatctcgctcgttcgctcgttccctcctgcaaggcagctggtcacaagtcacagcaaagttatgagcctcgattaatctattataaatctgcaataacaaatcttaccagcaaatcagcaatgcactattcagttgacccaccccgtctgaattctgaagaaaataatgcaaaacaaattcagtggacagagaagagaggagacatatttacgccatgtagataatctattataataattcagtcaataattattgaagtaaattaaatattttaataaattaattaatatataacatagattaaggaatcattgcaacacattaaaagaaagtatttttaagaaaaacttaattttgaagatgtggaagaaataatccacaacaataattcagtggagaagcaaaaagaatcggggcctgaggacctgaccaccgaatttgttatatatttgtcatcaaaatttttctaaaaaattttatagatataaatacagtaaaatcgtagtgcaattatattgtaacttaattgtaatgtaactttcaaataaattttgaaccgttatatttgcttcaagattcatgtaatcgaagaaaaaaaatcacagcgtgcttatagctgaggggattatgtcatgagacatccgcttcatggaaatagtgtgttatcatagaatttttttaaaaaaaattgtattgtaagttacaaacaaactacaatatactccctccgtttcaaaatgtttga

SEQ ID NO: 105979 - DNA, 2015 bp, Oryza sativa
agatcaaaattttgcacagctaatgctggtcatatatttatgccatcatctacgatatgtttccatgtgattgtggccgtctggactttcgcctggccatcgatcgacatgatgtgcatggtcagctagtcactccgcgaccatactgtatgctcgggaagagctggagcactgaaaacaccaaattgcatggacaactgcaggtgacaataagcgatgtgatggcatgcatgttgagtgagacattccaccgctgattctgatgtttattctcagatgatccagtaggaatgacaatggcgtccatccactactcctccctccgttccaaaataagcgcagacatgaatttttgtgtctgactgttcgtcttatttaatttttttttaaaaaacctaaaaagcatcagtcacacataaaatactatttatattttataatctaataacaataaaaatattaattataaaaaaaattaaataaaatggatggtcaaagttgaacacggaaactcatggcaacgtttattttggaacagacagagaactactcttgcatcagctctcatatggggtcaaattcaaagaaatgtttgaaaaactgacgtttaattaccaaccggtaattatctagcaagttttgataattgtgaccgaggtttctttgttacaaaggctccgttccattctgattaagatatagtctgtctcaatttttgtaaggcatgtttttcaaactgataaacggtgtattttataggaaaactttctatacagaagttgcttaaaatatcaaatgaattcattttataagtttatactaattaaaatttaatcaatcatacgctgatgactttatcattttacatgtccttatttaatcctcatcttcatcactttgcaaacaccacatacttaattaactgttgaatctgttgatgagtggtctgaattcaggatcatcactatcagagttatcagagagggagatctgcaatgagcagtacgctgtagtactacatgccatgagttaattatgagtcgcatctaacgggagctggaccttaaactaaaagcccttaatttttacgcaaaaaagggggaaaaggcacattatttggataatgactagctggatgtagccagctgtggtacctgctgctactattttgcattgcaccaccagatcggctcgggtttgcatagctggaacaggaactctgccgttgcatttccagaaaagaaagaaagaaagattgggtataatcatcttcgccgaataaatagttctgaattttgaacatcagatatggtatgccaacttgcagcgatgacatcttgtatatagtgaaagcaacaaggttttttcacaaggataaagagtttggataaacaatagtcgttaaatcaaaatggtacattcattaataaaaaacataaatgaactaaacatatgggaattttgggagatcaatttctagtgcctcctcttatatattgagggcaaagacaatgaagaaaaaaaaaagaagctgccattgatttctctaataaacatataatataacttaagtaaatttatagttgggtagaccagtcgatatttttaaataaattaacttatgtcaaaacactcataaaagctaagctaaactaaaaaaacatatataaaatttcttaaatgggatcaacagttgcgtaaagagcgactatgtggctagttatttcgtgcaaaacgaaggataacagacaatctcaatggacatcatcgaactgattatctacaccacataaggccatacacaagaaatgctctttatgtttttccctcttccagatgctagctagccagcagcataccatttcagcaatcacatcttgatttcttgttctcttcctcgacaaaaactgtcgacacgcaacacagttactactttcttgcagatgcaggtatctatctgtgacaatcgcgttgctcgtacagctgcgccccatggccgcagcaaaaccccgaga

SEQ ID NO: 105980 - DNA, 3455 bp, Oryza sativa
ttcaatttgtttccaatcttgcccctagtaattcaatggttggatttcatttagtacctgatagtactagtacctcgaggtactatctgctggacagtaacaaacctcttcatttggactgccaccacttaccaacactccagagcaacagtcattctttttccaaaagacccctactactcgtatttctgcttcatatctaatcagattccggatcgcatgcctcatgtcagctttgtttcggtgtggcacatatcaagctatcactgcgtgatccttgctaagtgcttcatcgcactctcgatccatgatcatatcaagacatgacgctactgcaaaaaataattttaatgaacactcccttttgttttttacaagcgcactaaaaaagacacgcctaagcaaatgtacttgcgtgaccgatcaagtcccgtccataaaaatcgtttttcacatactgacttcttattagggttgtttgcaaaaatgtgttagttttcaagcgggccccttaatagcttgtgaaaaagcgatgatttatcttcgtctcgagtccccgcatgcattgaccgcacgtaggatgttcctctcctccttaccctcctttttctctcctcatccttcctcctctccaccctccacttttcccttctctcagctctgtccctcactgcacgtgcgatggagggggcgattagatccgatgagcggtggtggaggcgatggcatatctgcctgcgcggtgaagaaggtgggcggatccgatgcacatgatggtggaggaggcggcatatccgacatgtgcggcctcgtgatgacggatccagctacgacgcccttgtgatagccggatccagtggcggcggccttaggataggcggatccgccatcgtcggtcattggagccacggatccacatgcagtgtatgcggggagtcaaggcaacaacaacctcgactttggccgtgggatgacagccacaaggacgacggtggcgacttcacgatgaccgattttctggatttgtttttcaattatttttttgaaaatgtctttgcattcagtgtcctaacttaggtacttgcaaaaaaaaaagaggttttcacaagcagcgtcattaggagggccacctacgaaactatgttttcgtgtgtagttatgatgcccgcgtatgaaaataccgatttttacaaacactagttagatgggtatgtacgatccatctgcccgtgaaaatgagttttggccgtctgcgaagaaaaactgaaaagaaaagagcatcaatataatcgacaagtaccacttgtttccgtagtatgatttgcaaaggatattatattaaaggtggacgtgatatttctttccaaactaaaaggttcatatacgtatacgtgattaattggacgggtctgtccggatcgataagcggctcatgatgactcacccactgtcctttttatagtgcaacaagtgtaataaggccaagcgaatgcgaatctctcgtgcttctcctgttcttaaggacgatggcaccatactccatgcatgcacatagcaagttgctagctagcgatcatcttatatatgtacgcggtgattattgttgttacaaagctccaagtctttggatccacccatgcgtgattgtctatactcccaacgtacgtgtttaaatatatataatggtgttaattttattatgtcaaacttttgaaacttggtaataagtggttgtagcttctattgaagtaaagaccagatattatccattatcttaaaaaataacttttgaaactttgactattaattcttgaaatgtttagttgaaacataaatcgtatggtaggtttttctttacaagtactttcacaattctataattttgttagatattatcattatattgtataaaaaatagaatagtggccaaagttatataccaaacaccgaaaaaaaaatcaacaatgttgtatgttttaaatagagaggtactactacttcgtcctccctaaaatacaacgtgtcctagttttgatcaggaaatatatatatcaacatttaaaatttttgactaataattgaatcgttagatttgtctttgaaaatattctcacatgatattaattttgtagttattcatataacatagtatgaaaataaatcaaagagatcaatgttagagaccgtaaagaaaactaactaatgtcataacttttattttagaaactgggggagtacttgataacaccgtatcatggcgctcgtgtgccacgatttttagtttaatagtgcaaggtaccaattaattgcagttgcactaattggcaggagttctgtatatatttaattaacaagtggagataaaaattttgaaccgatgtatctctttccaaaaaaaaaaaaactatgatcgatgcaaacttgtgtcaataataaaagtggtggccctccaagcatttggacgttgagactagtttatatctcgtcatgtgaggctcctgctagttaaaagttagtaaaattgtgaggacaatattgtgtccttcaatttacaggtttatgcagagtgcacatatatatatacccaccatgcattgaccatttcgttctgtatatatctatctctctgccgcctcaaagtcgatatgatgtgtgctgtgtgcagtaattcagtatctgcagagaagcattgcaaaatatatatagtgtgctaagtatttctaaagatatggttattaggagaccttttagaacataaaaattaaaatggatgttattactttgtcagcaagagatatctacttctaatttataaattgggtactctccttagatataatttgtctgaaaaataatactccttccatccacaaaagttagacatatttcacatttgagttttttcaaataattaagttgatttaatgtgtagtctttatgtatttaaaacttaaatgaaaatataaattaaatgcttgagaacctaagaagtcatctaaatactcgatcattggttgtatgcttacattcactcctggattttgtaacattcaagatgattttttttgtcttgatgataaaaagtagaatgtgtaacttttgtgatggaggaatagtaatcaagggcctcatgatgatgagatcaagtagcaatgaacaacattagtttacctcgttgctggtgtgcacgtggatcgattcgtagtttacacggtcccctacagtttggttaatcattgtttgtttttaatttactaaaccaacagtttactaggatgctgctcgtcgcttcccaatattaatctgttgtcgtctgaattcatgcgatctgggacaaagataacattaagagaaattttatggtactcttgtcgagagtaccaaaatttttaaatgccagctagctaatacttcctccgtactcgtaaaaaaaatcgttttggattgcgacacgg

SEQ ID NO: 105981 - DNA, 1371 bp, Oryza sativa
ctacatgagatgggttggattttgactggttttgatcctgaatttaaatctccatataaaagaatttcatattagattatttgatgatttaagttcctaattttaaaaagctgtatatatctgaatagatatagaaatcgggtaaaaaaataaccttctctataaaaaaaaaccgcaccagaccaaactaccaaagacaatacacatgcatgcataagggcatcttagtattttcaaaatggttctctctcagcaaatagatagaaaataataaaataataatcgctgcagtttcacctccaacaaattatcgagttttgaggatgtccaaaaacaaagcataatttttacagtacccactaataaagacagtaatattttaaatattacttcctccatcttataatataacgagtatcaaatgaattactatatagtacagcgaatatatgcctttacgttgttattatattgtgaactcgtactatattatgaacggaggaagtatgtagcaaattttgcttactattacctcaattaggagtctacatgcatgatgcatgatgccctccctcgtgtgtgtggatgtgcactcctgtactactccttggtggtgtaagtacagagtgtacatacgtatcggttttatttaaatggatttgctagaaactttcgtaagtttttttcctccaaaattcccatctttttgatcattggatcgcctcaagatttgtgcatgaagagaaaattttgttagaaagaaattttcacacgcgtcatgcataagatcctattactatctaatcaaagcattgttgaatggaagttttaataagttacagcgtagttacggtacagatacagtatagttacaatacaattacaatataattataattcaattatacaatagttatatttgaaagtttctgaaaaaaaaattgtgacaattttttagcttgtgcttcaatcccgaaatcaattggactttttttttactgtgtgtttcaaaaaaagaaacacacaaacaattgacttctccttttaccctcaccgagtagtacgccgcatgtgatccacaccaactatgtggggactgagagtctgaaacacactgtcgctcttatctcttttcctacacagactagcatgcatgcatgtataccaatctctggtcccttttttttctcgatccgcccacacacacccacccgaaagatggcccagtaagattggaatggtgtagtaggtgttcaaatttcagatcaagctagccaggctcaataatatagggtcgtgaatcacgcttgctctctcttaaacaacattttttttccatgcacgattcgcttacatatacccatattaatt

SEQ ID NO: 105982 - DNA, 596 bp, Oryza sativa
tagcatgcatgcatgtataccaatctcttgttccttttttttctcgatccgcacacacacacacacacgaaagatagccagtgagaatcgtattcgtgtagtaggtgttcagaatttcagatcaagctacccatgctcaattatatatggtcgtgaatcacgcttgctctctcctaaacaacattttttttccatgcacgattcgtttatatatacccatattaatttgctgggtgtatacttacatgtatatcaatcattggtaggcctgacaaaaatacagaaaacgccgggctttcgagttaggaaatattcctatatagtatatcagacgctaatgagagggctgtgttcttaaaaaaaagttctcggaaagaaatgaaagggctgacaagtgacaaacatcccaacgggaattgcctgcaggattgctggtccagtaacagtgacttacaagttagcaatactgcagaagacctgcactccaaacatccgtatatttgggcaaaaaaaaaagaagggcgcaccaaatgcccccccaaagaattcacatcaaattaacgatttacttgtggggcataataccaattaataag

SEQ ID NO: 105983 - DNA, 2527 bp, Oryza sativa
ctgtatgggagctttcaaccaggaagaatcctatgtcaaaacagtacggtacacgcgcatttaaacacatcttaataaccctgctaatcaaagtttcttgcgctacgcttattaataaggtccattcttacggtggaagctcatgtcctgcacctcgaacaccacgtcgttcggcaaccccgtcgtgcaaaacctgccacccatccccaccaagaaaaccccaaaaaattaaaaaaaacccagcgaaaccaacgcaatttccggtggtataaacaaaaccaccacaaaagaaagggaatcttaccacgcctggcccctcgtcgcgccgccgcgcacggcggacgacatctccgccgccgccgccgccttcttctctgagccgcggcgattcgggaatcgggaggaggaggaggaagcaaagctacatacacccgccgctctcgccgtatagtagcagtagtgcaattgggagggtgggtaggcgtatttagggcgcgaataaattggcctcagaatcccactccaagttcaccctctctctctctctctccccttctcatctgctccgagttattgctggctatgacatgtatggaaagctacgtctccttcgtcctcctcctcctccctggtctaaccaaatctctcctcatcatttgtttccacttttaattactcttctactatctactaattaactaacggtctaacgctatggattatggatactgtgaatctgtgatgaggtgtgtgagctaaccactccatgtctccatgccgccatgggagcggagcggatcatcacatttccattgctttgcttttgcttccatttggggattaaattggaaagttgtttggaggggagacctacttggcctggtctacgctttggatttggacagcgaagaaaaggctaggaaaaaatagaaaagggaaaaagaaaagaaaagaggaaagcatcgatgctctttcttgcgtcaacacacaagaaaaactttgtgaaaagtgggaatgaaaggtcggaggcgacaaaaggaacagggatgcaagaatggtcatcttccttcgtctttgcagcagaaaagaacaatctttcaccaacaaaccatgatcagtactactgctgcagccgattgcaggaatgaattttgcatcggtttcagatatcctttttgtgttaggtactcgtcagcgcctgactaatgtttgttttttgacccacaattcagcagttaactgtagtgatatactatcatgtttgattttgaacgatttatgtactatcttttttttttactttgcttttagattcaggcaacctgattatgaaactttcgtgtgcaattcctctgctttagcaccggtctcctctcctgcttccttcctttcttttcttctgccttttcccaaccagcaatgcacgggcgccatgatgaacatgaaactgcgaaattacacgaaacaaatatactctctccctccgtttcataatttagattcattaacatatatatggatgtttttttttgcggggaacatatatattaatgttgtcaatgctagaaaaaattatattatgaaatggagaaagtacaatgcaagcatatgtcggtaggatgagtgaatgaatgggtcgatgagatcacaacgaaaggtcagctgctcaatgctacgtagctgatacggcgcattgaagacgagctaacgaccctactcgtgaatgtgacgcagactgattgtgagatcacactgtcactgacactacggttaggggcatggctgccttgcgtttgcaggtgacaatatactcacgaggtcacgatcgattactacgtgtatacaaatatggtaccataaatttgtcaaattgaactagaaactgatgaagaacaggctgcctcatggcatatatacctgcatggttgcatcagaccaggacagtggcctgatcggatgcgttggcactggatagtagagaccaatgcatggtggttggagagaaggggaaaggtgccaaaatatgtgggcatgtggccgctgtgacgagctgaacattataagaacattataattgggatttcagatatgctgtgctcctatacagagtttcagaaaaccagtgttgctgctgctgtaagtctgtaactgtaaatatgctccagattaagctagctgcatatctgtgattccccaaaataaatctgataaaagtaatactagtacatacagtgtactagactgctagttaaaatcaaagcacaaggtgttgcacggactgtgcctcctccttgcaggaccatgttcttgctcgtggcctgttgcctttgagaggccggggttggagctcctgctagtaattgcatgttgccaaccgccatttacaccaagagagaaacagttccagcattcaacctctgccatattgcttagccccattcagaccaacagctccaaccatctccatcttggttgggtcacgccattactgcttaattggatttatcatttctcctagctgacaatg

SEQ ID NO: 105984 - DNA, 763 bp, Oryza sativa
atagctacatgttcctagaatttgagtgacaacctatattacttggggagctagagatctttggagaagctcccataaacataacctttgttaaactgaacaactctcgaaaagcgctcttaagcggtacctctattactctataaaaaaccaaataccactgatgaagtatatatagctctcggcctaaaattaaaaaaacaaagctatgtcttatgtaaaaaaaaagttccatttcccaacttatatcctctcattctttatgtgcatataaccccgaaccgctaaaagacgctcaaactctctctctctctatatatatatatatatagcatgtcaaaatgaaaagctatccccagaaaacaaagaaaacgaacttaggcttgattggccgaagcttcatgtcatgactgaataaagcaagggagtctctgtccgtttcattacgtctttctcttactgatctaggatcaaggtagcaattctactactacgaaacaaaaaaaaacttgatttttcagggaaggacaggtttctttttggcaggaatgcaagcaagctaggccaaaacaaggagaaaggctaaaactgtctgagccaagaaccagacgcgctcatggcttcacactcccaccacactaacacaatatgccatttgtttggcttaataaatcatctgcatcatatcaacctttccgtcaatggtttagtttatgtttgactctaacccatggcaatggattaagtaaagcacatgcaaatt

SEQ ID NO: 105985 - DNA, 584 bp, Oryza sativa
caatacaaggtggagcttctactgcctttccgcccgctggtgaagctgctgttgttggcgcctttccggtggctggtgggggtgttgcgactgatgccgcttttcctgtgcttggtggagcagggccacctgcagctgggacttcagctggaccgttgttgccttctggcggtggtgcaacaggaagtgcttcagtacaggcgactggtgggagtgctgtgtctgttgatgcgaaagggcaacccattggtgcttcagctaaggggaaggatgatgtgattgtttcagcggagggagcaatattggtgcttcatctgctgctgtgaaggctggtagtggagctattattgctttggccgatggaaaaggtgatagtacggccggtcctgttgcttctggtacaggaggtaatgtgctttctcttttgcatggtaacttgcatagtttggaacaacaaggggaggtaaacaaaggaaaggcaaaggttgaggtcaaagggtaaggcaaaccttattgttatagatgttatactaaagggcatacaatgcaggaatgttcttctaggttttactgtgagatttgtg

SEQ ID NO: 105986 - DNA, 744 bp, Oryza sativa
caggctccttaggcccattttcaggttctactctaaaagacagctcatacaagtgatcaccaataaccacatccaccacatcaggaatcagagatgggtcaagaaccaaaacttgtaagcgagctatatcataccttctagtaaaattcatatcaacagctttagtaattccaaggatggaaccaacagcccaaatgattaaatactctctcaattcagaaggaagacttttgcactgtacccacacttttggcatcacatatttcacctcattcccaactcccctttccacaatctccatttcagcctcaccaactttagtgtgtacattgccccattcgaccatacgacttaattcagctgcagaaggaaaaatagtatgaaaagtcccatcaccattatcatgcaccacccacttccatctaccaggtattaacctctccaactcagaaataatagaactcacagacatctgtcctttagtgaccttaaccaaagccgctttaggctcatgcttaaccctcattccagctgaaagaggtatatggaagaaacccaaaccatctctagtataaccacgtaactgagcaacaggtttaacatatgaccaaaaaattgggcacgagaagcaacatgatcctcactttcacaattctcccagtaaaacctagaagaacattctggcattgtatgccctttaggataacatctataacaataaggtttgccttaccctttgacctc

SEQ ID NO: 105987 - DNA, 505 bp, Oryza sativa
acatatgcttgcattgtactttctccatttcataatataattttttctagcattgacaacattaatatatatgttccccgcaaaaaaaaacatccatatatatgttaatgaatctaaattatgaaacggagggagagagtatatttgtttcgtgtaatttcgcaattacatgttcatcatggcgcccgtgcattgctggttgggaaaaggcagatgaaaagaaaggaaggaagcaggagaggagaccggtgctaaagcagaggaattgcacacgaaagtttcataatcaggttgcctgaatctaaaagcaaagggagaaaaaaagatagtacataaatcggtcaaaatcaaacatgatagtatatcactacagataactgctgaattgtgggtcaaaaaacaaacattagtcaggcgctgacgagtacctaacacaaaaaggatatctgaaaccgatgcacaattcattcctgcatctgctgcaacagtagtactgatcatggtt

SEQ ID NO: 105988 - DNA, 1665 bp, Oryza sativa
ggattaatcagcttcacttcagaactaactcttggtattaaatttagaaattgaagctttgctaaatagatcatgtatgcctctccctctcccgtccctacaatcatcatctcctttagacctttgctgctgatttgtttgctgccccctttgagagctaaggattctactgctaagcttcgacgccatttcctccgcttccaaaagctctggttagattaagcgccgctttcgcacgatcatgatcagcagcatcagcacgtgattcaattgctttcgccataaccattaactcgtgctgctgcaccaccaataggtacagtgtatcgctgattagctaggaggaattttttatggtacggcttaatgcaccgaagcagctagcaggagctagcaggactggacttttgttttttcacgcaaaaaatgatggttaaaaaaacaaaaggaaaaaaaactctaaattaattccaaagttaagcttatgcgccattctttttctgattatgatatatattttatctcagtttctgttagcatggtgttttatttgctaaatgatgcatttcgtacgaaaacattatatattaagttattttaaaaccttagataaatatatttttaaaatttataataattttaacttattaatcatgcgttaatggttttttaagagcaagtttaatagtataacccacaactagctccaatttatctatagctaatctaatagccaattcatacaataattgcttactatactattaatatatgttcccatctgtcatacacacactgtgtcttggagtccgtactacagctggctacagatctgtagtccgctcctcttctctctcattttttatctcattaaaatatgtttataacctgctattgtacctgctcttatactacctccatcacaaaattagttcattttttcacccgtcacacacatataccaatacaaaagtaaaaaagactaaaaacatctactttatctacttccgatacaattattctctatttttataaactttgatgcgatgatcactctaaaaataatcttattttgggataaataaaatgagctaaaaataaacttattttgaaacgaaggaatgtcctaaaacggcactgacaagtgggccccaccacggcatcgcgccacgcaagcagggatgtgcacacaactcaccgcgcactggtagcaaaatagactcgtagcaccctaggatgcgtgcacggtgtcacacacatttacgcgcgcgtactacaactactatagccccgctcccttgcaagctgtcctcaacaacctccaggttggcacgatcgcctcctcctcctcctttcgacactacccgacgcgacgcgtcctcctccccctcgcgtatatatacgcgcgaccgcacgccgcgctccacgcccaaccccgaccacgagtccccgaccgcggcgcgcgctcgggtcggctcacccaccgccgcgccgcgtccgacgacgacgacgagcattcaaactgtgagatgggggcgtgcaacttctgcgaggcgacagcggtggcggcggtgaacgggaggtcggcgtcgggggaggcgacggcggcgagggtggtgctggcggacggcgcgctgcggcggttcccgggtggcaccagggcgt

SEQ ID NO: 105989 - DNA, 3137 bp, Oryza sativa
agctcggtaccctgtgcagcgccgacgggctggagctcggggccgcggtggcggcggagggcggcggcgacgactaggagctccagcccgggcagctctacttcgtgctccccgccgctatgcggcggcgggcgctccaggcggaggagatggcggcgctcgctgtccgcgccagcgccgcgctggtgggcgaccacaaccggcccctcgtgttcccggaggccgccgcctccgccgccgatccccgcgccgccgggaaggggtgccgccggtcgaggacgaggcggcacagccgtggccgcgacttcgtgcccgatctcggcgccattgccgagtagcacttgaacccgccgtctcgaagagaaatcgatcgagctaaactagcccagccagctcgccgcggcgggaagaagaaaaaaaaaacattagattagttacgtgtaaactgatcgattgatcggaggagccattgaccaaattaagttaatttagctaggaggagaggagtgtagcttagctgtcatgctgtagcctgtagctgtaggtaagcacgcaccaagtgtatatacactacgtgtacatgcacaaccacgtatgtacatgtggctcgccacggtggttgagaaagccaaaaaaaaaaaaaaatctgcacttgattttcccgacccaacaatccgacgcctcaagcctggatccctgactcggggggcccacatcgtcagtgtcagcattcagcaagacccaattaacaggataactactgtgctgatcgcgtcggcatgtgatgtgagtcacccttggacgatcgagacggtgatacgatcatcaatctgtatctatctagcgtgtggtttggatttgttaatgactcggaaatggagacatagccgacgacgaggagaggcggaggcggcccgacacggggagacctttttctcggccgcgcgcgcgcgcgcgcccactgggatggggatgggatccgcggttgatggatgggtggttcgccgcgccgcgcgcgcgcgacgagcggcaacttgcagcttattttgcgaggcagctaaatgatcgatcgagctcggtgcttcggttgatcgatccgatcgggtgggcgcgcctaactcattccccaactgggccaagggagatacgcgttctgtacttctgtggcgtacgtgtgtacatgttaaggctagctgttaagggtcacgattctaacttacaaatctaactgtaagaaattagagtttgaagaagacatatgaagaatatagctctacttttctaattcattttgttaaagcattttagcttgaagtagcttggagctttaacaaacagaccatccaacctttccttcgttggttcccacgcgcatacttcataagcttgtgtgttttacgaaatttttctatagaaaagttggtttaaaatatcatactaatccaatttttttagaaaaaaagtcaatactttgttaaatatgtgttaatccactactttgttttcgtgcatagagaatgagttatcaactactacaaacgaacgcaacctagtcatatatagaaaaattaatcaaacaaaaagcaaatatttacaggtaaaacttttatatttatgtaatttgtggtttaaatacaaaaccttaactgcaaaatttaaatttctactagttgataagcttacggacagacaatgacatgccattaacatctttcaatataaatcctgtaatgctaaataaaaagcaaaaaagatattgctaggacaggactcagtatgtcagtcaacttcagccttagacttgtccaataaacgactgaagatgttgactaaatgtgttatacatctgatgagacttgactcaatttgttaggactctacaacatccgaattctttagaattcttagcaaattagataagccaacgaatctgatcgagtcaagtgggttaacctgcatgttggtgctgcagagataaaactgagataagtgcagtgcatatatgccttcgttctttgctgagctttatatattcgaacgagattacgtagctagtgttctcaaaatagattacatagctagacttgtgtttgcttcttacgcatgcccttttttttactccgtcacgtcctgatcgccacgcaggcgtatcacatatatccattggcggaagcgagtttcagcgcggggttttgtcggaatacattctattcccaaatcttttttcgtggacttgacggttcgaatcgatctcgaaccttgacgccacagtagcacacagaattgtggtcggcacttggcagggaaaatttcgcaaaataataaaataaaatccaatgatgtagctactgttaagctctaatgaactcactttgctaagctaaaaaagcctcgtctttcactcaggcttatgcttagcggtcaaaatttaatttttctttttttaaaccccgcggggtgtatttgtattaaagtagagggaaaaactgtacaatagcccagggggctaggagattacaataagaaaggaaaaagaaagcaggtggagggaggtgcagctacaaaggaggggtgcagctgatgagtctaatttacgtaatgtcggttatgcttccatggttgtgggtcgttagacattggatgccctttgccccgcttacacgctagagccagatctcgtcgatcgctttctcaacgattccctgcgtcgctgtctctatgttcttgaaaaccatgttatttctctctttccagatttcccaggatagtaggataaggatcgatttggcacccttccttttctccttaggcattgtactaacggtttgtgtccaccggtcctcaaggattgtcgttttagaccagttctgtggtcttagctgaggcatgccgagccttgttgctatggcatcccagattttccttgtgatcgggcattcataaaagaggtggtgtgccgtctcgaggtttctgaagcagagctgacagaagtagttatttggccactccctctgctgaagtcgatcggccgtccaaattctgttttggaggagtagccaggcaaagaatttgcacttcgatggtgcccaacatttccatatcatatttgctgataccgacggtatgccccctaggaa

SEQ ID NO: 105990 - DNA, 2354 bp, Oryza sativa
cggaacgcacgctgcatgcatactgtaacgcgcgccgtccaagcttagcttggccatgcacagggtacggtgttagtggtggacagcgttgcagatgttgacctcatctatctcaccactccgccgagagagcgatgcctcgacgggaggatgacatgattcaggtggctagctagcgagtactctagttgaatactactactaccctgcttgcatctgcatggatcggcaagagtataccctgtttaattttccgagattattttacggtggaaaaaccaaaaatttattttcaaaagttagtcttttcgagcagagggagtactcctaaacatctttagggaagacgtaatgtgatcgagaaagatactggtatactactataactgaatgggaaggtgtaaggtgaaaggtgaaagggagtatccaacatcgtcgaacaaacgtgttcactcagaatgtacgactactactttggctagctagtgtgtcgcatgccaagcgtacacgtcccaggtatggcggacgcaccacattgtcaatcagttcagacttgtgagtcaacatcagaggtactacttaacatgtgatgtgaaattgtgaacaatggtaagtttcacacacacgcggggtgggtgcaactgtgcaaatgtgctcagattatgcatttgtcgattctgacaggggacggtcgatcagtcacagttttctgaatggtgctattacgggtatgcttgggtttgacttgaagttgggccggaaatgtgagtttattggaccctatcacatactcctatacaatctctacgaaagcgcatgcatgttcacaaccattgccaatttgccatactataatgtactacagcatagtctctccgttcttaaaaaggaaaaaaaaactaatttctatgaatgaatatatgattatccagattttcatcctaaaaacttattcttttttatatgaagagcatagtatacactattacaacactagcttgagaatagactaatcatatcatgacggaaacctgaatggtttgttgtttatttctactgttgatgaggttagggtacgagaaacaagaaaacaattagcatataattattttatttttaattattataaacttgaaaatatatttatctaatattttaaagcaactttcatatacaaagatttcatgcaaaatacactatttagtagtttgaaaaaacatgccaatgaaaacaaagttaaaatatatcttaattaattggaaaagaacatgtttaatcatcaggcgtgcgatgcatacttgatccaacggctaaggaagtactacatccgtctcaaaataagtgcagctgtggaaatccgtgtccaacgtttgaccatccgtcttatttgaaaaatttatgaaaaattttaaaaaaattagtcacacataaaatactattcatgttttatcatctaataacaataaaaatagtaatcataaaaatttttcaaataagacgaacggtcaaacgttggaaatgaatagtgcaaaacgaatcttagctatgaatctagacatgcacttgttcacgtagatagctagaattgattttttttggacgtagggtgtacgctacagacagtggacgactttttgttgattagaacaagatttggttagacttataaacttctgacatgtaattttatgtaagaaatgaatttgtaaaatctaataagttatgatattgtgataatactttttatacaaatttaaggaaaatatccggcggaaacgtgaaaattaacctatgaaaattagatctaaaaattttatacatttataaaaaaaattatgtataaacatgatatggacgtgactccggctcgggcgtccgatggaaggagattaaaatcgggcgctgacgtcagctcccgatttacgtgcaaaactactttaaactattttttttctcttaaattacttatccaaatcatgatccgattgctccatttgaattcgtttcaaaacaagaccacacatggatatattccgacaaaaaaattagcttattattgaattatttttaaatgttgcacgatgttccaccaggtatatcggagttgtttcactaagtagatcgaaaatgtttcacacgtttaaatcgggtgttgtttcaccttatataaaacaatgtttcagcaaataacaaagaatgtttcaattcactgcaacattagatccatacatagtgaaacattgtgagtacactaggtgaaacatttttggtgaaataaaaaataaaatgaattcccttaatagagggttttcaaaatatgtgggtgatttgttgcaatggaatatttcagttca

SEQ ID NO: 105991 - DNA, 639 bp, Oryza sativa
cctctctctcacgaagcggctcactatggtgggcgacggtgacggcgccctcctctccgccagatccggcggttggggaggcaacggcgtcgacggcggcgtcggcgggcttcggctcccacgggcgacggcggcgggctctccaccgccagatccggtggcctctccgtccgcctcccctcgcctgcctctgcctctcctccattcggcgagcagcggtggccgacggtgtcctactgcttccgcctccggtgagcacccgtgccgacttgcatcctcttttttctctccctccatctcgttcaaccttaaccctatcttcgtttctagatctggaagaagctgatctagccgatggcgacgcgactacatgatttggtggtttttatgatgtttgattcaatgatgtaaaaatctgatgaacatttgatacatgaacttgttgttgatcatatgatgtgtagttttctctttttttttcttttttttttgattttgggaaccggcaccgaatgccttctctgtagtagtgggtttttttttgcgattttgtccatcgctaaccaaatcggattgggatacgattgacggatgaaaatacggaccaatcggagggtgacgaccggaaaaataccaata

SEQ ID NO: 105992 - DNA, 1197 bp, Oryza sativa
actcggcggcgagggcgagcggcgcagctgggacttggccggcgtgggcgaacgcgcggtctcctccccacccgttgcacaccatgccaagagagaagagagagagacgaggaagggagagaagagggaaagagaaagcttacatggactgtctgatatgtgggtcccacgcgggtcccacgctgactcaaccgccacgtcgggtaaaaccgaggttaaaaccaccgaaggacctagagtgaacggttttgtaatttgagggatgccacgtaactggttttgtggttgggggacgattttgtatctcgatgtcaggttagggggtggctagcgtgcgcgtgcactccccccttccctttagtcttaactatatatgttaattaatatatttaacactaatgatagtagttaagaaagattttggagatttttttactaacagattaaaaaaatttaagttagatttgaaaactttcgatttaagatttaaattttaaagtcaaattttaaaaactttcaactcagatttgaaaactttcaacttgagatttgaaatctttcaactcagatttgaaactttcaactcgagaatcgagattcgaaaactttgaagtctagatttaaaaattttgaaaactttcgatttgagatttgaaaactttcaactcgagatttgaaaactttcaagttcagatttaaaaattttcaactctaaatttaaaaactttcaaactcaaaatatcactaaagataaaaaaaatcagaaacaaagtgagaaaaaaaaggtaaaaaaaaaaggaaaaaaaatcgtaaaggaggcgtgcgcgcgccggcgcagcggcgctgggcctgactagtttttccggacaagttgagggacctttggtgtacttttttcctatctcggaaaggaaagcccgcacgaaccccgcgcatagcgaggcccacaatcacggcgcttcggtgtcctaaccggcagcgcgcctccacccgcggatccggccgtccacgcgacggagccccgcgcgccgcgaagagccgcggtgtcacgcccacgcgaacggacgtggcctcccctcctgcagcggcttcaccggcgagagcgacgagaccacgtcgtccccgctcccgcctgagtccctccctgcgtccgctactatcatgtccacgtcgtccggttcttttttttttcctccc

SEQ ID NO: 105993 - DNA, 647 bp, Oryza sativa
cgatgcaggacttcagggtgcgcggcgccgacagcaccgtacacgtgcaagagaaggttgagaactcgttgagaagcgcacgcggagtgccggagacgacgacatactccagcataataacgagcggccggcgtttgcctcacgtgccagcggaggcccgggaggaccaagaaattaaccttctggcgccgcgcgcacacgtcgttcgtccgtcgcctcctgtcacctgcggcattttacacatcctcgtcagcctcacgcacgcccagtcgcccacgcgtgcggtcgatcgttccgagcagagggcggaacaagtgaacgaacgaacggcgcccgagcattttcgtcggcgtttctggaacggcttctgtttctctccactgtcgcagcggtggagatctttcgtcaactgagtttggagctgtctgctctctctctctctctctctctctcccgttcgcgtgcagagctggagatcaaactcaactttttctttcggtacagcgactctccagtctcctcggtcgatcgtttctcctgttcccttctgatgcgtgtgatcataaacctggtatcatttgattgagattgataataacctgctgtaacttagcgaattaccagagttactccgttttgcttgtaca

SEQ ID NO: 105994 - DNA, 1335 bp, Oryza sativa
ctgcctagctggagagtcgaggccaaataccatatagatgtagtgtgaatggccttaggttgtattcttttcccctctttcctaactcacttttatcattttttgcgcgcgtgctcttcaaactgctaaacggggtactattttgtaaagtttttttatatgaatgttgctttaaaaaattatattaatccatttttcaatttttttaggctaatacttaattaatttcattataatcatgtgctttgtttttcgtggtcaggaggcaaccttgcctcccgaacgtagtcgagttgtttcctagagttgggcttgtcctgttagttgtagtcgtcaggcttccagtggtctgcgttttgcccggcctgccagccatggataccctcgctgagtttcttgtggtctctgagacaatgcgctctgcgtagactccagcttctaggtgcatggcagagttgcaggagatggaggtgttgtccagtcctccatctctctattcatcaacaaggtactactagcctcctaccttccagtgatcagccttctttcttacctccaaattccaatgatggactttcaacaggcaagtgaagattgaagattatgcaaaaaatgccacagcctccaaatccatgaggtctcaaaagggtttgcaactaggccttttttttttttgctggtggtcttgggttctctggtattgcatcgccatcatcatcgatctggtcggagcataggaataaatagagataattgcttttttagaattttggagcccttctttttatgtttggtgtgcaatatcaaaattgaatggtttttcggagcttctttacaaatctagctatgtacccaactagctttaataaataataatattctgaggcctttagccttaggcctgtttttctttaaaagaaaaagggataagacattctgagatctatttagtatttgaggtgggttatgatagatctcgttttgcactaaaacttgtaggtattttggcccttggcaaacttattttgttttaatctaatctattttgcaaaagatagtatttctgctctttgataatattaggagattcatgatagtggggcaatataaatttgaaccttaattttcacctgtgtaattactataaaattgtaagatttcatttgacatcaacttaaaaaacagacacaacatagtaactcctcatcagtttgttgcaaatatggtgtctctaattaatttattgttattccctctagtcaaaagaacatgttagtgtgtacccggggtaccgagctcgaattcgccgtatagacatcggatcaaaaatcccag

SEQ ID NO: 105995 - DNA, 805 bp, Oryza sativa
atcaatcctgatttagcatatggtgtttgtctttttaacctctttaatgacgtgtatcgtttaaatcacatatttttttaagatctatttgcatcattgtactctactcaaaatataagacaaaacgagatccatattgaatatattcaaacatttcattacttgtaaaggtaattaatttaaattgtagaagtaactatctacaccctccgtcttaaaatataacaacttttaccccttaagatttgtcccaaaatacaataccttctccaccaacattcttttcccaaccaatcacaatcctccacgattcacttttctcacctacctccactactcaaccaatcacaactctccaccattcacttctacctacttttttaataaccgtgtccaactctaaaaatgattatattctggaatggagggagtataacattaggagtaattatattatgactgagttgaaataagaaactatatgaaataaattcacaagcaaagtgtagagaagatttgcaagtaaatacatttatgagagtaaattcaataaagtctgaaagtaatttacaaaaatcataaaagtaactttatacaaaatggaagtaggttgttacaatatttttaatgtaaacccgttgtagggataataatatgagtctatctagaaattaaatttaatcatcaccaattatggaattgactaaaaacaataataaaagtgatcaactcaaagcattatgaatgtataagaagtaatttaatcaaatataaaagtaatttatatatatgataaaagtaactt

SEQ ID NO: 105996 - DNA, 795 bp, Oryza sativa
  unsure (1)..(795): unsure at all n locations
tttaggctttactgaatttacttttatatgtataagaagtaacttagtgaaacctaaaagtaatttagacatatcataaaagtaatttgtgatttttcatcaaaatataatcatgtgagatcttgttgtaaagatttaattattacgaacacaacggtgtaatcggattgtaaatcggatgagtaatttaagagaaaattttatttgaagtatagatgataggaatattttccctacttgctcaatggattaatagcaaccaaaactcttaaagtactagcacgtggggcgtctctgggtaagactaattggagaggtttctccaattagattttaccttatctaaagtgtggcatggtcagctttaaaattgtgacactggatcctaagacttaaaaacacgtgacatgatatagttgtacttaaaaacacgtggcatgacatggttttgatagcgaaacaaacatacacaaaaattatggcaacaaactagctgattgcacatgagtgcaaacgtttgtgcgtgagcccagcgccagccgcacgaacatgttgcccagccatcttctctttgcatggtcgagatattttcgattttggtcctttggagtgggccatgaaaggccgaaaccaagtgatggaccgataagtagcgggcctcatgacacatttggcatgtttggcttttctccctctcttttcattttgctatatatttgncgataatttttttctcagatgccaanttacttacacagtaacttgtatataacttttaaaaatctctccataaca

SEQ ID NO: 105997 - DNA, 1107 bp, Oryza sativa
tttggatgtgcccagatgtgtgattttgatgatttttatggtttgtgaatttgtaagatgaatgcaattgcaacgagcaatagaatgaaatatattttgtttttttttcattggtaatctacggcattgatgggtcgcattgggctacccgttacaggtgagacacctatgatgggttgcaatgccaccagtcaatggggtcaacatcacctttgacgagtaacaatttgcaacccgccagaggtgtcctatactagtgatgagtcttcacctgttagagatgagtttagtcatcactaaacactcatctctaactagcaccctatcggttagaggtgtcgatttgtgtccatatatcattgatgacctgaaccagcatagcgaattgcgaatttttagcgagtcatgatgtgtcatgtttgcatgttaagtctagagctactgcgttttaattatatagaagataaaaatatcgctagaggcaatcgtgttcctctttaccccctatcacgaacagcacaaaaaaccttcgtgagaacccgaaccggcctcaccttccaccctaccaccctttttgaagattaaccaacctatgaaagcaaataaaaacaacttaaaacctataaaaccattattttgtattctttcagatccgttacaatgcacgggcatagcactagttcatatgtaagaaaaagataaccaatggtagttgatatcctgtatgtatcttgatgccttgcaagtaacataaaaaaaactgtcatttattactaagaataagatcaagaaggtcctctcgtagagagagtaagcacaacttctacatagcagctcagctgctcaggtgaaaaagaagaaaatgtttccactcgggagtaggcctgccactgggtaatcattacccattcccatatccatacccacattatttagataaggtatggataaaacaaagtttacccatttaaattttggatatgaggagggtattatccattttacccactttgtccatacccatttgttatgggtaaaactcggacctaaaatttttaaactcaggttcacattacaaaatcttatcaaatttgattaaaatttgaa

SEQ ID NO: 105998 - DNA, 1335 bp, Oryza sativa
aatgtaaacttggatgggctgattctgtcattaaaaaacttgactagttaagttaatctcacttcgcttttttattttatttttttcttcccctgggtttgggtggggaatatttcttggtgatggattcgcttatgctgcatgtggcatgtggtgtcgaccaggatctcgattgattctcgcgtcatggtcgccggcggggcggcctacactgccactgagctaaaccaagcgatgtgttgggctagctcctgttgttcttggtgaccctacaattatatttttctcaaaggaattattgcactagccgtacttgtaaaagctttccactttattcatcatattatgacaaccatttgctccacgtttttagaagtaagtgctaccttcgtcctaaaaagactgcattttacacagttcatgtttaatttaactgtccgtcttatttgaaaaaaaatatgattagtatttttattgttattagataataaaatatgaatagtactttaggtgtgattattttttaaaaaaaaatataaatattttagataagataggcggtcaaacattggacatgaaaactcaccactgcacttaaaataggacggaggtagtatttctcaagaaaaacaatttcttctactatattggttagatcaattgttttaacctctttattaggtttatgtctcaaaatatttaatttattccttcctatatttaaagtagataattcgtatgaataatatggtgagtactctgttccaaacgttaccttatgctagatgcaatgtgaaatcgaccaaccgctacgtaactgaacagagggtgatgatttgttgatctgaacaaggattttgtccacttttacctagttccattaatatgggtggggtaaaatcatgtgcgtgggttgcattgtttagttgttctttccatcccatgttagagatattcttgtttaactttttcagatgatatgattatattaccatatattatttattgtgagataaagggttgagtatttaaaacaatcttcgactgccctaggtgcaatgtgaaatcaaaccaacagttacataatcgcaatgaatgattggtgggttcaatccaccatttgtttttattttacctagttccatgaatggcacgctacaagtaatttagttaatgagtagcataaatcatatgtgtggggggtttcattgtttgttgttccttccatctcatgccggagacatttttataggagtatatagatttcacggactacatgattatattactatatatcattcatcatgagatcaaagttggagatctaaacaaatt

SEQ ID NO: 105999 - DNA, 725 bp, Oryza sativa
ccgttatatgactcactactatgggcgaattcgagctcggtacccagcttaacatgcaagtacgtcacattaccacccactagtgattattactattctaaagcatgttaactctcatgcaagcatgatacgtcatatagaatataatattgtagagctcaacatataaatatgtcaaatgatcttccttacacctttttcacaatatttaacatttagcatttctataatattttatattcatccatatattccagaacgaagcgcgggtatactagcaattgtaaagaagaaaaagtttgagtcaccacatggcacacactaagattatttaaaatatactgaatcattttgtgatacattgtagacattgatataaactgatagcatccaaaaaattaaaagccttgaaggtgaactcaaattgggctagtggtattttcttaataattttcccatgcaccaaatattttttaaaaaaatatttcaaattttaaagcgcaagaaattttattgctttagttaaaaccccatatttcaattttattaattggtctattcatggaacctttcttttagttcaaatattaaaagccttgaagatgaacatgtcgatgggctatacatcactaaatacgtacctatatatatgccatatctttaaagacgtaaggaacagctaatttgaggatataaatgaaactgagaaagagccaggagacatg

SEQ ID NO: 106000 - DNA, 719 bp, Oryza sativa
  unsure (1)..(719): unsure at all n locations
tatcaagagtctgatgatacaactgaacttaagtagtattttctaagcattcagtctttttttacntagtagtgtttttctcctcatatatgtatgcaatcatatctccatgcacagnatgtttttcaaacatggttcatatgcagcaggacaanctgaagcacaatttaatttaggtgcaattgtaaattacccactgctttcaatcgttattgcaagactgccactagaaaattgcaaaaataccactagaactgttattcgagtggcatctttgcaaaattgaaaaaacgggtggcaaatttacaaatgccccattaatttagaggcttgctaacccacggtataccgttagagcgatataatcattagtcggacacctcacccctaatgcacatggcgggcacgcaccagcttgcgtgcatgtgctagtgctggtcgtggatactgtatattttttttggaagcaattcacatacacaaatacactagctaattactactctgcgcatctgccatgcatgacatgacaagtgctcctcactcatgcacccatagattatatgaatgcctatctttttggtcacacataactacaaactcctctataattgcgtgcttagctatatgacatgttattgttattatagctatactcagtggggtaccgagctcgaattcgcctatagtagtcgtgtatcaaaggggctcaatcacgg

SEQ ID NO: 106001 - DNA, 688 bp, Oryza sativa
tatatttttttttaaaaaataatcacacctaaagtactattcatattttattatctaataacaataaaaatactaatcatattttttttcaaataagacggacagttaaattaaacatgaactgtgtaaaatgcagtctttttaggacgaaggtagcacttacttctaaaaacgtggagcaaatggttgtcataatatgatgaataaagtggaaagcttttacaagtacggctagtgcaataattcctttgagaaaaatataattgtagggtcaccaagaacaacaggagctagcacaacacatcgcttggtttagctcagtggcagtgtaggccgccccgccggcgaccatgacgcgagaatcaatcgagatcctggtcgacaccacatgccacatgcagcataagcgaatccatcaccaagaaatattccccaaccaaacccaggggaagaaaaaaataaaataaaaaaacgaagtgagattaacttaactagtcaagttttttaatgacagaatcagcccatccaagtttacattctagttttaacacggatgctttcatgtatgattaattatttttttactgataggatgctttcatttatgattaattattcttttactgatagatgagttttactgatagatgaggcagccatacacctgttgctcataggtgcagagagt

SEQ ID NO: 106002 - DNA, 521 bp, Oryza sativa
aatccttttttttttttacttttgctagttatatgcccgcacattgtaatggatcagacgcatattgatataactaggaaaatactcgtgcgttgcaacgggtgaaagttattttaatattttaatcgtgttattgttacacagcttagttaagttgaaattcactgtaggaattcgcttggatatatattattctaaaaaatcatgagcggtaattaggagtttgcttgctagttttttaaaaatgatttcttatacgactccttctgtattttcaaaagcgaacgaactttaaaacccgactcaaatacaaatctaccaaagtactggtaaaaatattttaatttttataatagtagatattaggggtagactaaaagctcgcatgttaataggccaagctgatataattagagagatgatggttactttttcatgcatacacattgcacgagtggagaactctgcatttaagatggtagagatatacttcttttgccatgactgattttgattgcaat

SEQ ID NO: 106003 - DNA, 796 bp, Oryza sativa
actcaaaccatatgactgaaggtagaaaaatagttgttctggaaagaatgaccaaattgtaggaagcctagtctcaaccaatgtcgtaaaaatcggccagaatggctgcttactttgacgcttataagtacgcagagtcgcagaggagaacatcacaaaccagcgaattggaaaggaattagcttgtgtgaatgccaaaacagccacctcacctgattaaccgaccaattccatgcaattgcttgattaaactggtaatccccaactaagcccagaaacccactgagcgatcctgaatcagcccgataactagcggcccaattagatggcaaaaccagctactttgtctaccttgcatctctagaacagataagaatttctatcccatcccattcattggattctacatcataacgggagagtattacaagtaagtctcataatatgacaatacaacgtgtgcagatatctgatatctttaatactctaaccgcatcaattatcaaatataaacatatattgggataaacacaaaattagtataattcgaattatttggtcgtattctattcatttggcagtaccatgtctgtctaataactgtattccataatccatactctataacacttggtggtttcaacaggactctttatgaatactcttcaaggatttattattaatctactttcagcataaggggcgtacaatgagaaagcatgcgcatgctctgataaaaatcactaccacatttcaccaataaagtaaaacatggatattatgttatgcttaaact

SEQ ID NO: 106004 - DNA, 682 bp, Oryza sativa
ctgcatttttcaagtcctccagattgaagttccaaccactgattcctcgtatgtactctttctgaaaagcaaaagtcagtaatagcctattggtcaataatacttgaatctatatgcaccgtgcaattcatgactacaataagtcatttttatacaacacagtaaaatatataaatacacagtaaaatatataaatgtgagatatgagcttacttatggtcaaaatatgagcttgctattagctaactataaaacttattattatttaaaaatatatatatttggcacagttgtagaaatgcagtcaccatttagttaataaatccaataaaactcaactcaatctaacacatggagaaaggaaatgatgaaaaacaagctagcaaaactatttggttaatgatgggaatcaatcaagaaaagttgtttcacaccacaaccactgtgacaatatatctatttttagagcctgggtgaaatatgtaaaaactagaggtctttttgacgggaactcccaaggcacaggaacttttaaaatttacacccgcctccccgggaaggggaaaaaattcgttcctttaggggacagtctcatagagagaagatttctctccctattattttctgagaacacaagagaggagtgtaccctctgaccattgggctctgttctctgaaaaag

SEQ ID NO: 106005 - DNA, 679 bp, Oryza sativa
aataagtgtaaaccggcccatgaacttgtgagttgcataacatcccaagattgacttgtaatttttttagagaatctatttataccactgagtttctccgagttcaataatttgctactgacattgtctctttctatgatataccggtaactttatcaattgttttacaatacgccattggaccgagcattctttttttaaaaatacccaaaatacccttttttggacacacaagattaacaattgatttatcacattagaagtttcacaaaagatatgaaaattttcatgtggcctccttacctaacatggaagtttgtatttaagtttctagttctttgcatttctattttttttgtaaaatataacttatctgttatatgctatacaaaatactttttggtggtgtttttaatataaatcatctttcatacactgcagaagatattttttactattatcttttgtgtaagcaaattgtctctcatagaccacaaattttttattttataaaagttaaatatactaaaaaaaacttgaaacttatatagaagtttccatgtttccatgttgtgtaaggaggccatataaaaattttcatattttttcgaaacttctaataagataaattaattgttaacattatatgtatatagggtattttgggcatttttttgaa

SEQ ID NO: 106006 - DNA, 833 bp, Oryza sativa
  unsure (1)..(833): unsure at all n locations
taattgcgaattgaagctagctagctaactgcctattggttctagcttacttggttagttacgagagttaattaagtaaagtcagatgtggtcgtatgggtgcaactgtgcaagcctccatttaaaagaatgaattagtgggcgtgatattacattgtccgtatactgaattactcaattttgaatgggtgctatttagcgaccttgtttcgaattggtgtattttaatcatcgatatattagactacatacggacatatgtaaacataaactgaaatacatcaaaaaccatatcaacaatcattttatacattaattaatatgaacgacagattaacatatattttgataattacacgagagacgaccaaacatatcaaatttatgcataattacggattctaatgcgaacaagagacatttgtacatagtcaagcaatcattccatagagtcaagctgccaaggtgttaaggcgaatcgtgattcatggtttattatttctctcgtagctattagctaatttttgtgacatgatacagattacgcgtcaacgtcatcgtccaggcatccactaagctgctagtgagttctcacgtcttctagctggcaccccaaatcaacagatcctggcttcgccccttgcacgggaatggtaaaccctatctaccacgcaccatgtttgaaatctaggacgccacgtggccccacgaagtcactgccaggtgaggccaaccacccaccgcgcctgtccggctgggttgtggaaaatgtgcatgcattggggtaccgagctcgaattcgccctaagtgagtagttgcacntactgcgccg

SEQ ID NO: 106007 - DNA, 691 bp, Oryza sativa
ttatgcaggcagaaggactagtgcagacgctaacttcgcagaatgtgtttggttgcaacatgtatgtggctgttggcggctgttaaatgccaaatttgtgccaccaatacctgcataaacatagaaaaaaaacatccaacatagtggtagggcttcaatcaaacattttccacgagtgttggtgtatatttggatgcaggtactaaaccgccaaagttgggaggaaatccaacctacagtgaaggaaaatttcatccatacaagtgttgggctctagaactccattttaacattagagaattggccgaactctcgaagaaatggataaggtaggctgtgaaggagcaacaggccagtttctaggcctgttgggccaggccagggttgggccgaaccccaatctcagtcgttcaggctgaggtttggcatggacgctccagatgctctcatgatggtggttgaggggcactttagacattttgcgttctccgaccgtcattacctacttatataaggacatcacctttttacttcactcacacactccaagattgagctaaattatcagaggctctattgtactttattgtatactagaattagggagagagtagagtagaagaagccggagaaattccggagttgtcggtaatcctcttcttttttctgttactctgttaattactctact

SEQ ID NO: 106008 - DNA, 733 bp, Oryza sativa
  unsure (1)..(733): unsure at all n locations
atgcgttgaatttatcttaagaccctgcagagccggagccgttattatgggagatctattgagttgctcttctgtcattctcttacacgncaggttttggttgtgtcatactaaattccccgagcaatgcgcgggggtttcacctagttactctggtaaagaagccaccacattgactcttgtcattgtcaatttatcatccgttgaatatcatttggatgtttagaagttcatttcatgtttgattactcatttactttgctattcacatgtactaagcgcgttgagaaataagcagtaacctttcacgtgttgtcatattccaatagaagtaattaatattctactgcacataaacaactgtgcaacatgatttatactaacaaacttcacatttagagccccaccaaaaaaatcaaaaagccattattcagaaatttccgtagcaacgcacggggaatcacctaaaaattcaatgaccagtctatgctccagtcctctcgtttctcactattcatgaaggatgcgcgtgaaaaagggaaagtatatatagaagttgaaaaatatacaatcgaacatagccaaatgttctgtaatcaaaaagaaaatggctacgaaaatctgtttctggnacactttttgattggttctggttttagctatatataacatttatatatatttttaatttcttttcacttcatatttgcatcgccactaaatttgataaatg

SEQ ID NO: 106009 - DNA, 648 bp, Oryza sativa
  unsure (1)..(648): unsure at all n locations
tgttgaaaccgatacacacaaagttggggttttgaatgaagtatctgggtgaactatccagcaaacacaattacagtgaagtagctgaagctaaatctgtatctagacaaaacgcagggttgcaaaaagaggctactaggggtttttataagaggaaaaacgacgaggcggggtggtgggagcaaaccctagcctttggggtggtgcgagcaaaccctatcctttgtggacccctgatgggctctactgaagacaaggcccaagcccaagtttctggtccaaacattgtttctattattctaggcagctccactcaaatttgatagtgaggctaggctcatttcaaagtagtcgacgatatctttacaatgagtactcatgaggtccaaacgaagctcgtatgtaaatttggtggccgttttaaaacacttaggacgatatatttttttcacacttaggagcacacaaaaaccaatcatagaaaaaataaactcaaatggacgaaatatgtgacatgtagaattttccaaagctctaccgaagagctttttgccttgaaaattcaatctggcaagcagaatttagaggttctaatttcgctggaccgtacaaacggnggaggntaggatgtagcttttttgcacatgt

SEQ ID NO: 106010 - DNA, 747 bp, Oryza sativa
  unsure (1)..(747): unsure at all n locations
acggtaggncntttgagaatagattgcacgatgcatatagcgcgaattggagcttggtacccttttacaaattacaccacacatgcaccactgcttccatcaagatttttcactgcacatgtataaaataattcaatagaacatattagtgggatatatatcaagctaaaaagtaattgaaaaggatgaaaatacaagtgcaactacaacgctttccactatttgcctaatgtggggtatcatttctacaactgccatgaactaaccattccctactaaaagataaatcagatgtcaattacaataaatgtgggagctccccagagtgctctatttgtttagtttaagcccaattatagattttattcgcttaaatattagagaactactatgtgcaataaaagaaatctaaatctctaccacttaactcaataagttgaaggttaaagaaaattaagattaaatcacagtgtaccccacctgcgtttgagaatgttaatttgtaagaatgttgcacgggctatattaatattttaaaaattttaatcatatgctagaatattggttatttattttcaaaaatatctcataaaggcaattagttgatttcatattagcggatttgagtggagatcaactttaaaagaatcttgattttcactcagaactaccatatatatatataatgtataaatgggattatacatagaantatatatttttaattgacaaatagattaataaaaa

SEQ ID NO: 106011 - DNA, 728 bp, Oryza sativa
  unsure (1)..(728): unsure at all n locations
tagcgaaagccaagcttgtgggaaacatctctcccccactgaggtacttgtatcatatgaatatttcctttcaaattgcatgtttgctttctaattgcatcctataaacctgaaaacaacataaaacttgcaaaatagaaaataccaaaaagataggtagggtttgtcatgctaggtaagacaaactagttctctttgttgaaatgatgaatagttgctttgttttatatctctcatatatgggttcataggtaagtgctctctcactcttttttttctttctttcaatatcatgctcaggcttgagagagcataactttatttttctttaataaccatgcctttccctcccttcttctttctttttttttcagaaaggattttctttttaaggagaagaaagcacataaaagcatggagaatttattttggtggtagtatacaaatggaatggaatggataattgctaactctcagtgtaggagtttagcatttgcatatatgtgggtgtatgatcttgatcatagagcatgagaagtatctacacaagtcacaagaatttgataaagttcgatggaatagcaagtaaccaaaatttatatggtttaatcaatgaagcatatttttggctctagtaggaatttatatcaaatgaggaacttgcaatttatgagaatcctcaccaggnggaccttaccaantgaatacgaatatcgactctttcccca

SEQ ID NO: 106012 - DNA, 665 bp, Oryza sativa
  unsure (1)..(665): unsure at all n locations
cttccccatcctcttcttacacaaggcgaccagcccaacggtcatcacttccagtagcagcgctagggaggatagtggtaggtcgttgcgccgcagccccaaggtcaatctgttctccgagctgagctcgtcgccgtgtacctcatggcaatatctggcgctccagaccagggttgactctatcggttgacgcttttgtatagggggtcaccgaaatcccgaaattttcggaaatttcgatatgatatttccgaaattttaagcaaaatttagttgaatttgaacaaatattacccaaattcatgaaaaaatgaaaaatttcggtcgaaataatatcgtatcgggggtgaccgaaatgaccaaaattttcgaaatttcaaaaatttcagtccgaaatttccaaccctgctccggtccttggccggatctggacgacgggatggttaaagcgctaggggcaggggatgaggaagggagacacagatgggaaaggtggaggaggcttcaaaaggtggtgggaggagccgactttggtcccgcacctctgcatctgagaggtttctcgcgggctttgcgcaactcccatggncgncgcctctattgtacagaggagagaggangtaggatagtttgtcggcgggaccacaaccctgcattgncccact

SEQ ID NO: 106013 - DNA, 1145 bp, Oryza sativa
ctcgagcactactacacgtaatatttttttactaatagtcatctcaatgtaggcttttgaagttagatttttagcgcaagtaaaacaaaaaaaacttcattagcacataattaattaagtattaataattataaacttgaaaaatagatttattaaattttttaaaaccatttttatatagattttattttggcaaaaaacacatcatttaatagtttgaaaaacatgctaacagaaaataaggaagttgaagtttggagttggaaaagaactgggccttagttagatactccctcggtctcattttaagtgtaaccataagcttctgtgtccaactttgatcgtccgtcttatttaaattttttataattaatattttttattgttatgagatgataaaacatgaatacatgacttatgtttttaaattttttcgaataattttcaaataagacgggtgatcaaagttgggcagggaaaatcatggctgcacttaaaatgtgacggagggagtagaagttacaaaaaaaatttagatacactcatagcatgacacgtccgtgttagtaagaaaaaattaatatgtatagccttttcatttttttatgttgtttaaatagtcgtaaaatgtttttctttcaaaaaagtagaagatctaaattattactgcctcggttcgattttaagtgtagcggtgggtttctgcatctaacatttctccatccatcttatttgaatttttttatgattagtatttttattgttattagattataaaatatgaataatactttatgtgcgacttttttttataaacttttcaaataaagcggatggtcaaacgttccacacggaaacacacgactacacttaaaatattggatggagggagtatatggtatatgtcttcacaaacatgcaagcttgatttgatccaaaaagcttgaatatgtcttcacaaatattcaaatctgaatatgaatgggtggcatactagtggttaatctgtgtcatttttttctcgagtgtagatcaaatttagaaatgagttttataggatgataacaactattgtataagtgttattaatatttcgagatttattattatacctactttgataaatttcattgttggaataacga

SEQ ID NO: 106014 - DNA, 751 bp, Oryza sativa
  unsure (1)..(751): unsure at all n locations
gcgtggccctgttctcgtcgcacacggtggtatactggccaatgtatatgctagggcgcttgtggcctgtgttggtatttcttagcgatattactaggaataaaatttacagcaatgacgtagaaatactcctgatatattatagttacagagttcatccgcaagcacactaatatacctttgtaacattttacccgagagtattccagcggtattgtatttatttaatcccgtcggaagatcatagtagagagaaccagactaataatttatatgttacttataataattatagtctaagtaggggttacgataaattaaatgatagagtgatatacaagtagagaaatactcattctcatactaaaatatctaagctaagtggaaagaaaatagaaggagaatcttttcctatacttctagtatacatagtatacgtacattctagttatctgattaactagtttaataccctctatccgatgccctcctggtacatcgagaagccatccctgactgtcgagttccttacgacagcctatcattaccatacaaccggggctaaatacggaggactaccatcctcagtaaattaacttaggactatagtatacagtcgggtacaaaaatttgcatacggactttttaacaaacagatccgcatacaaaaacagacttttttttatggggatcatctagagtcgncatgcnggcatgcngcaaagggctaattcaatntcaatngccctcg

SEQ ID NO: 106015 - DNA, 581 bp, Oryza sativa
tacattcgcataccgattaggagtggaacaccgcgtgactgccccaggcgtcgccacaaactgagcaaccctagaggtggccacgagctcgtggctgatgcggcgacctcccgagcggcggcgacctcccgagaggagggccgatgcagggctgtggtcccaccgacgaactatcctaccttctctctcctatcgtacaatagaggcggcgggcatgggagttgcgcagaggccgcgagaaacctctcagatgcagaggtggcggaccaaagtcggctcctcccaccaccttttggagcctcctccacctttcccatctgtgtgtcccttcttcatcccctgcccctagcgccttaaccatcccgtcgtccagatccggccaaggaccggagcagggttggaaatttcggactgaaatttttgaaatttcgaaaattttggtcatttcggtcacccccgatacgatattatttcgaccgaaatttttcattttttcatgaatttgggtaatatttgtccaaatacaactaaattttgcttaaaattccggaaatatcatatcgaaatttccgaaaattccg

SEQ ID NO: 106016 - DNA, 832 bp, Oryza sativa
  unsure (1)..(832): unsure at all n locations
gaggggggagaaaaaggagaaaggggaaggaaaaanaaaaaaaaaaaaagaggaaacataaaaaaaacaacgcctggtnncccaaaccccccccccccccaaggggccaattggaggacgtgaaaacnccnnnnnnnnnnaaaaaanaaggggggaagaaaaaagagggggcgaaaaaaaaaagagggannaaaggacaagggaaacagggagaaaagagagnnngggggggagngcnacnaaaaggagccgaaagaagaaaaaaanccaggacaaaaggagagagcaggaaagaaaaagcgggaagagaaaggacggaaaagggaaaaacgggaaaagaagagggaagaaaagagaacgcgagacaaagaagggaaaaaaaaagggggagaaaaggaagagaaggggacaaaaggggaagaaaagaaagcggaaaaaaaaaaaggaaaaaaaaaaaagagggggaaaaaaaagagggggaaaaaaaagaaggggaaaaaaaaagagagaggaaaaagagaggagggaaaaaaaagaggggggaaaaaaaaggggggggaaaaaagagggcggaaaaaaaaaggggagggaaaaaaaagggagaggaaaaaaaaagggggaaaaaaaaagggagggaaaaaaaagggggaggaaaaaaaaaggggagagaaaaaaagggaggaaaaaaaaaagaaggggaaaaagaaagaggggagaaaaaaaaaaagagggaaaaaaaaaagaggggggaaaaaaaaaagggggggggaaaagaaaaaaggggaaaaaaaaaaagaggggggaaaaaaaaaagaagagggggagggaaaaa

SEQ ID NO: 106017 - DNA, 516 bp, Oryza sativa
  unsure (1)..(516): unsure at all n locations
agtgcngtaggnccaaaagtgcagtgaagannacncccngcnnggtaggcagattcttgatttgtgcgggcttaagaagtctgataatcacaaagtagtaaccatctcattgatcaaccccgatagagtctttcttttcatctaaattattataattttgtcctataacagatagatggagacattttttcttatgaatgtagtaattttctcatagttcattcatgcaaatacctccattatgatggtatatgtattgagaatggtgggaagtcccctcctgcccacatacgactctgcttcaatgttcagattctcataccgcacttcaaccgtcggtagcttaattccaaccctgcacagaggaaacatctttcaaataggagacttagcaatcaaagtttccaattgaatttagcatggttatccatgaaaaggaaaaacctagttattttccttatatttaaccatgccttccaaattaatgtcgtaaccatgtgaatatattttttcgaa

SEQ ID NO: 106018 - DNA, 500 bp, Oryza sativa
gcgtgggtgagagcacatgatctactatagggcgaattcgagctcggtacccaatttattccgtaaagcccatttcactgttctgcaacacctgtactgtagctcgtctattttcgattttttgcatgagcacgtctgcatgtttgcagcgtgagcgtcgtgtgttccggtcacgttcgtgcctggaacgcgtcttctcatggacaattaaaggcagcagcgcacaaactacattttacattaagatatttctaaattaattaccgctactatagaaacgattttttcggatgagaccccttgaggttgctggcaaattaaactgctcccgcctgcaaaaatcgctgccccgagagcgtggttcaaagaccacatgcgaaaaaacaattttcgtaggcaggcttcttaataggcccgcctggcaccaagccgtttacccgtcccctccctctctttattctctcctcttaaaatatctcatttcctaacttctccacact

SEQ ID NO: 106019 - DNA, 534 bp, Oryza sativa
ttttataaaaatcataaaaattctaataaatgtttagccattatttttctaaaattgatggacccattaattttaaccgttagatcttcatctaaaaagaaaatctgatacctgcatcctcaccaccacctccatatatgcgcacttacgtacttacgttctccctctaccctcctaactctccccttctctcctatttcttaagctaattgctattttttagctgatactcaatctatcaaaaattaataatcggatttctaaatgatcataaaactcaagttacatattttctcaattttttttgaattattgtgttatttataattaaatacataagtcaaaatccatatacatagctcaaacttctaatataaatgtttaagatcaaatttttaagcatcatattaaatactaaatattaaatttagatcatgtaacgccgctaaatcgccatgtggcaataataccaatccccctaaaccgacatgtgaccatctaataaattataaaaattcatataaattatattaa

SEQ ID NO: 106020 - DNA, 518 bp, Oryza sativa
tatcccattgggctatgaattgtctttttttaagtgtgaaataccgcacacaataaagagggtccgtgtgccttttgggcgccattcttttttccaatttatacaatcaataacacactcggcggaatcatcctcggacaggagtagggtattactttttgaataagaaggcccgaacttgtataaaattcttcgctccaaacccatccactctactatgttgatagaccgcccttttattgttatacgactcactatatggccaattcgaacttaggtaggggtagcgttaagttctcaccgacttactgccataagttttgactttacccttgattaaatcctaccttcaaaatttttaccctgtcttattgggagcctcaacttcatcacgaacgacttcggcaagatctttcttttgactcgattcaaaccaacggggagagaccagaatcccgtccctttggtatttcaactttggccaatgcttcttcaagataatcttttccgagggggtt

SEQ ID NO: 106021 - DNA, 686 bp, Oryza sativa
acggctggggtctaggacgaaaccctaatcttcacttcacttcaacttcatcttcagagctggcagaactatatttatatagagagcaagggtgagtacttacgtactcagcaagccaggggaacttaggtggttaatgcaagtttcaaagaataggttgttatttttcaatcagttttgttttcaaggttttcaacaatctaagtgtgtgctttccacaaccagagcgagacaagtctcagctcagtcggggtgagaagtaacaaatttatttatcaagattttcacaactcccagagttggcctcaaagctggttttcccaaaccaaaccatttttccaaacttcccaataatagtggtccccaaacgaccaatcacttccagggactttcggtcccactgtcccccggacagctaattgcttcccaagcattaggtttcccaaaccttaacaccttttcataaaacagggtaaaacaaaaactacgctaaggaatcacctcacattcgcccatgaccgtgggcacggctgttcgaacaggttaataaccttttgagagggggtacactatacccacacgacgtttctagccttggtcacccagcccgtgcagaaccaccacctttggtgactttggggctttcacgacagggtttttcgaaagccgaccacaggtttaccatt

SEQ ID NO: 106022 - DNA, 680 bp, Oryza sativa
  unsure (1)..(680): unsure at all n locations
tttacagtcatctcaaatgtccaaaacttaaactcctgcttcaactaatcttgtgaaacgcacttagcagcttgcactttatagcccaaacattanaaatattagagcatttgtgtcatatgaaaaaataattctatagagcccattgaaagaaggactaattttttacccaatcccctttaaaatttctacgaaaatagactattgtagatganttcgnagggagnaataagcatgaggccccacctcccgtctatttttctgttgttgatgtgtatttttctgctatgccaatctactgatggtttggaaactttcctgtatttgaaaattctccataggaagtgaaatgatcatgatatagccgccttgcgctccgtgggtattggtaattaaataagtgaatagttgtgatgaaatgattgcagtttgtcaaagaagcattaattagatcagtgtacatacaagaccttttttcgcggtccgggtatatagcgaggtaagcagaagacaattgacaatttgagagacaacgaaataatcaaatattccggccgttgctgtacatgcgctatagagataaaaaatgctatgtgaacgatttcttcttatagacttatacgacggtcctagtgcgattgggaacgtatggtgaacgccaccatgcatggttagctggg

SEQ ID NO: 106023 - DNA, 742 bp, Oryza sativa
  unsure (1)..(742): unsure at all n locations
atatatatatatatatatatatatatatatatatatatatatatatcagctctcatattaaatgaattcaagtgactgtcaggacaaatatggtacgtatgattgtaccgtgttcgacgaattttcaatactcttgggagccgcatataaagaagggataagagtatgcccaacaacctcctataattaggagatgaggggaccatatgaattttcaacgttctaacgggcctatagaaacaagcgaataagtatgagacgagagagacagcctatagaaacaagcgaataagtatgagacgagagagacagagataataaggtactggatgatatagatactaggaaattccccgcgctttgcttcggaaattactaagggggtaatttttaatatgttttttcaataatcgagctaagtgtaaaaaaaaatattagatattaacaacagataaaacaggtttgctaaactatgtaaggagagaaataaactttatagactctgtagcagattctggatgaaatatgatatcccacgcttctattacatggatgaatatatatgttaagtattataaaaatgttggatatgtatgttgaaaatattatgaaaataatgtgaatggtgatgggttgatatacttgcactcttatttgcataatttaatgaattgtaaatgatgcttgcatgtttgtggagcttantacgcattattaggtattgacgatgagatgccatgtt

SEQ ID NO: 106024 - DNA, 874 bp, Oryza sativa
  unsure (1)..(874): unsure at all n locations
catgtgtgatggatgctgaggtgggtgtcggatttttaagctaaatatcgtaccgatccaagcacttgtctaaatattactgagtgcatgttcaaatattcagctgatagcgtgagctcatatcacctataccataaagacaatgccaatacatatgcatcttcttatttattaatttcagattcaaaaattattatatttaaagcaaacaactatcaagggctacataaaccataaataaatatataattaatgttacttaatcttctcgatacaatacatcaactggacaatatatagtagtgtagttactacttctcgacactttgaactatatgcatatataggagatggattttcattccacaaggaaactatacacacaactttagggtgaatctatcataggggcatccggatcttgagcctttactactttctccgtttcacaatgtaagtcattctagcacttttcatatttatattgatgttaatgaatctagatagtatctaaattcattaacattaatataaatgtgggtaatactaaaatgacttacgaaacggagggggtacgtactaatacgaggacaataggagccctatgaaacccatcaaatttttatttcttcttaaatccaccgctgcacaactcgtcgcacagacgatgcagcggccagacatgcatatatgcagtggtcgcgtgcgttttctgtccatggctagctccgtgctacttctagctagtgcttcaggtagaggtcgatctcgacgatgccaccggtggcgaggctggaatcgagctcttggtgaccatgtacccgcgcgcgagncggaaangnnccgttgccgcgatcaccaccgactgcggctg

SEQ ID NO: 106025 - DNA, 520 bp, Oryza sativa
gaaaaaacatattaaaaattacccccttagtaatttccgaagcaaagcgcggggaatttcctagtatctatatcatccagtaccttattatctctgtctctctcgtctcatacttattcgcttgtttctataggctgtctctctcgtctcatacttattcgcttgtttctataggcccgttagaacgttgaaaattcatatggtcccctcatctcctaattataggaggttgttgggcatactcttatcccttctttatatgcggctcccaagagtattgaaaattcgtcgaacacggtacaatcatacgtaccatatttgtcctgacagtcacttgaattcattttatatgagagctgatatatatatatatatatatatatatatatatatatatatatatatatatatatatattatatttatttattctagggtgtgtttagttccacgctaaaattggaagtttgactaaaattgaaagtttgaagaaaaaagtttaaagcttatgtgtgtacaa

SEQ ID NO: 106026 - DNA, 766 bp, Oryza sativa
ttctccgccgtaatcatgtcggggactggggcacacaggtaacaggccttgttgtgacttcaaactgctttactacttctcgttgttgcaaatgttgtttatgatgctttagtttgttgatcctgtttgtttgatgctgcttggattatgcacagtctgccctaattttttttccctgatgggaccgtttcttttgcttctatcttcttactccctccacatcgcaatgtatgtttgtggagttgagagtagttaatataacttcctaccatttagccctaatttcgtgcaacaaaataggctgggtaattgtggcatgccttatggtaggggtatgttggtcatctgcattaacattttcttatagttagtgcattgttggcgtgtgaatgatggccatggagatatattgtgaactgaagggagtacctagatgttcttcatgccttcaatttctctacatcctgatgcacttaaggtttagctattgctatctgttgtgcctgcaattagttgaatagttccgctgacattattttccatgaaatcttacgtaggagggtagaacactttagtttactttatttattgccaaagtatgcactatttctgtactctggtacaatttaactttcttacattttataacccaattttgatttctcgacctgattattgttgtgttttcctttagctgcgtaactgaactttataaccttgcagtggctaggttatactgtcaatatctagatttcctttctatgga

SEQ ID NO: 106027 - DNA, 1639 bp, Oryza sativa
caggtgcacaaaagcacactaaaaacatcactttgcgagcatattactgtctctccacatggccatagtaaacaattcatcacgggggaatgagtatggcctttaaattactaccttcttccacaaaaaaagggttaaaaactgaaggtctcaaaataataggcatgcttgcaattctacatcacaattatgttgtagaatgcaatcagatagtccttttagtaatcaagctattaccaacgagtctgtatgtacaaaaacatgccaatataaccagcacattctaatgcaagcagacattatggccaaaagtgtagttatagcaacaaaggaaattgttttctcaaatcagcagaataaccaaatattacccaaaagtgtcactacccaaggcctattatattgttcaaacttgtgtttcacatggtacttaccaaagcaccataaccaagctatgctagaagggcagggtgataactaataagcaggagtacttgcaaataattccagaatttctttgagacaagatgaattacaatagcaccaacacagagagatagcatgaccataagatgcctgtaggtaatttttaacggtgaaccatgaaaaggataaatatagtatgaactcctaggtcatactttattgactggcaccgacaaaagtttgaccagccataacccaatgatgcagaaacaggttttgaaattgaatcaagaggaggagcacatatatataggcctgtgaaaaaagagaacagtgctgcagaagatggctgcaagaaatgaaacaatacttccccggaattgatcccctttcctatctcctgtcaggaggtgctaacctttttgctccaaaactaggaactcatgtcctttgatctatttcttttctctatgacaaatggaaccctgcatattccacctttatcacaatttcccattcctatttttcaggaaaggaaaaaaaatcttaggaaatttaattttcctcctgagaatacaaagggatattacttgcatgagtatgcagccatattttctctcttaacaactcaaaactacaaaaaaaccagtgttcacttctagaaagatgtacccttggaataacccagcacactattaaagcagacaaacatgatggaactacaaatttggaaacaaattaaatctcttggctcatatagaatcagcacaacaacccacaatattccataatactatggaaaaccaaaagaaccaaaacttaaatgcatctaatatgtactgtacttggcatcatcacactggaagcagtacctaccaaagcaagcattacatcgaaacaaaccccaaggccacaatatcatttcctcacactagaagtaataagttgcctcatactcttaccctgatttatattttgtcatgaacataccgtaatttagaagctcaaacattacgctgatatggcacaattagggacaaatcaaaaccaaaatcaaacagaggcgagatcaggagggcgtaccggtcgttgcggttgaggcgcgcggcgtattagaaggcgacggagacgagccacgagtcggagtggacggcgacgagcgcgagccagtcgccgcggttcatcccgtcgcgggcgaagttgatcccgagcg

SEQ ID NO: 106028 - DNA, 1015 bp, Oryza sativa
attcgacatattgacacatgcatctgattcaagtggcaccactagcctcataagacaagtttttttttccgcctctcatcgtttacagaaaaaagaataaagcaataaaataatttaatgataaaaagttatgatgagaaaatcttaaaatgaaccctaaaactaaattatgttttaaatttaaaattataagtcaacaagcaaattagcctacttgtatattgaaaattgtgtcaaaatcctcgattttcgacaagtaatgaagcgtataaaccaagcagcgagtagcgacctttattttctttctgtctttttttttgttgtgtcaacgatctaatacgttccttctcgtccaaaaagaagcctatttacttcaaaccagaatttgccaaatttaaatctgcttcttaaacgcaaattcaatgttgacgtactagcaatattaggcttagtttttctttttaactctaaactttaacttcttttttcgttaacacaattttcatactgttaaatgatttttttaaaaaaatttatatacaagttatttaaaaattcaaataaatttatttatcaaattataattattaattaataagcttttctcgttttacgtgcctaggaaaactctctccaacctgttacctgtcgcccccgccgccgaggggggaagggaacagtcgcccctatcgtgtgggggcccacgtctatcctcccgggtggggcccacccgctttccccctccggacgacacccccggctaccccacccgccgcgtcgccgccgtcgccgccacacgagcccgccacaagaacggatcagtcgctgccgtgtgggccccacgcctatccaccctcccccgcgtgggccccacccgctttcctccgagctccgaagcctcgatcgaagcgcgccaccaccaccactcccatcgctctccccgattccccgccggccaatccaatcccccaaatattccaaattcccagccaccaccaccacactagcaagctca

SEQ ID NO: 106029 - DNA, 700 bp, Oryza sativa
tagtacttagtgatggtgtatgaagagcattgatagtctcatggcccattgctaacatgtagagaaggattttgagttccttggaagtattgactggaggagtgtgaactacttcgcaaatagatgggtgtaaaatctgggaaagaaaacttaaagagctaaatgttttctaccatattagttgatctgaaggtgctttccaagtcaaaatcagcttagcatatagaattgacttggtgatggcggtacctggacccttgaagcagcagttcagaactgattgcactgagtattttctctggagatatccatttgatggaggtggaaggaaagagaggctagtcaatagtaggtcaactgatggtgtttgaaacaagatgcacttactcataagcagaataaacaagcacaacaatgccatgaagggaaccttagcaatgccgtacatctggcatcatttaaaacggggcttgttccactgttatactatgaccatccgccttgatggttttgcctggctattctgaagctattagttagcgttacaccttttaagttttacacatccagtgttgttcttttgtttttctaatattatgtacagatatctcttccacatgtcatagctcaatatgacaagggctttatcctttttcatgtaaatatttgagattcagtcagattcttatacttgctactt

SEQ ID NO: 106030 - DNA, 1273 bp, Oryza sativa
ccaatggatatctcatctcatgattgaggggcccggccgttaagaggctgttctcttgccagctgcagctggatggttcggtgttcaccatcggtgaaggtgcttgcgatctcgtcgagttgccgttgttgatctcctgctgatctgttgcatgctaccaattttacctgctttgtgatggatgcaccaccctcctgacccagatagctagctggttgtggctggtgcaatgttgtctgctcatcatgaaccaatccagcttaggaagcctcaattccaagcccccccaaaaaaccaaaaagaaacatttctggtaccggatctcaagcgaggatgacctcctttgaaacatgaatggtaaaacatactaggaagaacatcatttttggtacagggtctcaagccaggatgacctcctttgaaacgtacgagtggtaaaacagtacgaagaacatcaaattttcatgagaattttcataggagacaggttaagagagaacttcaagagattggaccttatgttaacttcttctagagattggaccttatgttaactttcttctataaaatattagtgaagtgaggaaacttctaaaacaattatatggagtgatgaaaaaaattatttggtcagacggtaactatgagtactccataatccgtataagataataacatggtaattctattaggcgttcgccaacgaagccccaagcagccacccaaggtagctaggcggtgcctttgtccgtgtatcaaaaatctccatgcacgggagccattccaaataaaattttgaagctccaagtttttgttccgaaggatcaaatagaaaaattatccgtagaaattgaatcctaacaaaaattccccacaattcctctaattaaaacgaggccgaagcggcttcctgatcggacggctggaaggccatacatgtcctggcattaattatcactcaccttagattattacagctcggagctagaaagccctgcaagttgcaattaatggtgagtatgatctgatctgcagcgaaatgatctatcgatgtccctagttaagcagtcattgtgtcccttacccacctaaatccacgagtgtcagagctaagcgcgatcccgatccttaaaccccaaccccactctcttgctgctccatcaagcaaccaaccccaatccacacaccatacataattacatactaccagctaattaattactaataatgacttaatattccatcatctcccagctcagttatcacttcttga

SEQ ID NO: 106031 - DNA, 602 bp, Oryza sativa
ctactcctgtgctacttgttagccttgaaaaaacaccatgccttaaagatgatgtgtgatagttttatttggctatctaatttgtactacttccatttcatattataagtcattttgacatttttcctaatcaaacttcgttaagtttgaccaaatttatagaaaaaattagcaacatctaaacattagattagtttcattaaatctagtttgaatatattttgatcgtatgtctgttttgtattggaaatgctactatattttagtaaaaaatcaaagcgacttataatatgaaatggatggagtatgattttaatattgtttttaagataaaatggtgtatcccctctgttccaaaatgtagtgttcaaattttgttccaaacataagttatgcaaaagataatttttatcactaaactacctatactattcaatggtgactatagtccaaacagatctcgttcatcccaagaaggcaaataagtctttctacccctctccttatggctgatgctatcccctaaaattattactccctccgatcaataaatatttaacacaattaactttaatcataaaatttaaccattcgtcttactg

SEQ ID NO: 106032 - DNA, 742 bp, Oryza sativa
gcatataaaaaatattgagatgtttaatgtcacattatcaaaatttggactattggagatccactatgttagccaaattctaccaatcatcttgaagaagatagttgtctcaattcacagctgcacaaacacacaaactccaccaatcatcttgaagaagatacctagttgtcccaattcacagctgcacaaacacacaaattccatcaatcatcatgaagaagatgcatagttgtcccaattcatagttgcacaaacacacaaactccaccaatcatcacgaagaagatacctagttgcaccgactcacaactgcaccaacacacaaactccaccaatcatcacaaaaaaggtacttttcctactcccaccagtgacaaattcaaagctgcacaaacacaaaacaagtcagaaaggcccttagaagattgtaaatgctgctacaaagttgtcatatatatatatacctggtgagctcccaggcaaaattcatagatatctgcagcagatactgcatatcccaaagactcaatacggccatggtataaaccaatgactgctgcttggtgactcagcactggagcaccagaacaacctgctcctccaactacattcagctcaactagatgcatgctgtatcctttccacaaatactgggtcagctgcccatatactctgtctcttgcaaccaattggccagtgattactgagtcttttctgcaaggtggccaagacactaaca

SEQ ID NO: 106033 - DNA, 1043 bp, Oryza sativa
cctatctaatatattgaaacttcctaagcagtgaatcaaataaacttgtgtgtaaatttagggagcatagaaaactttacggttagtaaccagaattctactgaagcaaaatcagaaccatttcggcctcgatctgtcacctttgtgcaaacgacggcgagtcctgctcccacatcttccatgattgtcccttcacaaagcaggtttggacaaggattcgagatcggcttagcctttcctgctcggtgccatcagaagatctttcctcttggtggtgttcagtccgaaaatcagtgcgcaagcaagacagaaagacatttgacgccggggtgatccttgtgacatggctcatatggaaggaacgcaatgctagagtgtttgatggaagagcaacctcagcggaacatctttgtgccacaattgtggaagaatgggaagcttggaaagcggccggtctgctgtgcgaaattgaagcaagaagccccatatccagagggatcagctagttagcagcacaggggtgtgtgtgagcttcggctctgttagtaggagctgtgtcacctctgatttttttttcagggtgtgtgtgtttgctctcttttgtttttgctctgtacagttctgaattttctccttcttaatactattgtttggtcggcaaagccgacccggcgaaaaaatcagaaccatttcaacccctgtggactgcataagtgcaaatcaacttaaacaaatgaggcatcagagcaaatcacctataactgatgagtacagaagaattatatctaggtgctgatctgacaacactcttcaaagacattcccaatcaacatagttcaggtttcagaagaaaaacagcctaggttttgcatcacagattcacaatccaaccaaatgcaagggtttctgcagcctgtattttaccgagcgcccgtcgcagccggtgaatccccaccacgaacgccgtccctctctccctccctcatctcctcccgcaccggaggagcgttcgccgtctcgccggcgccggcgccgccgcccct

SEQ ID NO: 106034 - DNA, 2012 bp, Oryza sativa
gaggagagagagcaccaaaccctcgtctcctcctcctccggtggtgggggaagagaaggcggcggcggatagaacgagccgtctactggatcggccgcccccgagaaggtattgcccccgttcccctccgattcgctccccccaaattccccccgcgtaataatccaagggtttgtgttgatcgggtggggttttctcgccgggtagaccatttcctgcggttgattgttggtgcgtgacggaagcggagcgtgatcgggtatcggacgtggtcggattgatgggggaatttctgggattactcgtcgtcggcttaataatcgatgaggcgggtgtgatgtacagcggcgcgattggtcgattcaggtttcagagtgcttgagatcatgtgatttccgctgcgaaggaagttttcatctcctgtgactggaatcacgcgctaatccgtaccgaactctctctattggggcgtcctgttggtgtcaaacaagccgttcacagcgatcctgtctgttcataactattgtttgcctagttgcaattaactgtttatctttgtcagtctaatcttttggccataggttgttctcgccccctaatcagttgttggaacttatctttgtgctttagcttctatggatgagtcgtaggtgtgattgtttagtagtaaaattatttgagtttttgtcttgttcaaatcacgcatttaattggaaaatgttcctcaccaccactgagtctttcagttctatcaaggagtcagcatcttctggcccagccttttttgcgttgctacactttagttcgagagtctcatacatacttgagccaccaactatatacctttggagatttttcttattttccctcttaggcacaatattgacatagtaaaagtacatcataaatttaacttcaagagctaagctctactaattaaagtggtcctttattcttcttattgtccatgtaagaatagttcagtgagaagagttatttgacccgtgtaacttttaagtcagcaaacatttttgtttgactccttgtcctgtctattagcagcctagcatggcatctttagttgaactcttctacaagggactacactatctaatgtgttatcacagtttcttatgtaatagaaatgcaattcatgtcatttcttagcatctaaatgatcaacggatagaaaaaaaattatatgacgtgtataactcatgctatatctgaaccttcaagtgtaccttcttctcatgatgcttctcccaatggaaagcatccctttaacccttccatccatattggttcttaaatttccatgtcttccatcagacagagaacatataagttctacaacctcggtttatccttagaagcagaaatgttcaatatgtcaaaggtacaactccgtgtcctttgctttgaaattcaacatcacttgcacaacatgtcttctgcatcttcaggtactccttattaacatttcaagactatctatatagtattttattttattagaaatgccacgaaaccaccatttattatgcaaatgcaggctatagtgagattcggcttccacaataacccacgaccttgaaagctgttattaagatctattagagttggacacaatctttggaacatgattcagttatgttgtgtgtttgactccacatttgggacacgcgggaattaggttgggtaagcaattgccatttcttccaataatctgatggtcaggtattcaggttagtgaatggttccagacatattagttgcatatatataatgagtaaattggaagttatcacttttaatcatcttaatcctttgtgtcattctcacctttacaaaaggacatataccttctcattcttctcccttttctcaaactgttataaacttataatagtttcctttgttttctctagcccttatagtttgttgctgttctaactctaaaaatgaaaactaaaacaaggggaatttatatctttgggaatactacctag

SEQ ID NO: 106035 - DNA, 508 bp, Oryza sativa
tgaaaggaaaatattccaacatctcctatgttaagcttttttttaaaaaaaaaattctgtagctaggtaatgttctttatcctatcattgggaggaagcattagcttttgttgttgtcacatggacatccaaagttcatgtaaatgatcagtgtgtataccaatattccatgttatattaatgactttcgaatgtgccgtatgcagaatcccaaatcctctcagtttgccgatcacaaggcgtagatcgaggcggttgtcagcggggacgagcgtttggaccaggaggcagcgactcgcacgccgctcggggcatctggggggccaggacagcttcctcatcctccaccacggcagcggctgggtatggagtactaccactcatcggattcggagcagggcttgcggctcggtatctctgccaccacaaggcccaccatggactcatctgctctgccacgttccaccgttgctcatgcagcagacgtggccacacaagacaggaaggg

SEQ ID NO: 106036 - DNA, 576 bp, Oryza sativa
ccttgatctgtggaatggttcgcgagagagcaaatgcgcaagacacgggtgatgttgacaggttcgggccgctgagaagcgtaataccctactcctgtgttctggtggatctgtgtatgaaggagttacagagagctggagagcaagagagttcaaactctagagaccctctcactcctctttgttcccgtcttttttttagtctacgagctcaggtcttctcccctctcctggtaggcatggtcctccttttatatctcaaggggataccacatacaccatttctacctacccttcttttgggtggggacccatcctactttgaccaaaacttggctcgtaccttcgcctgacaccgggataaccctgtcctccctcattaatgggcggagatttgcaatggctgctgtccgaatgaccctccgatgggatgggtcataccaacctccactccgccggaagcaggtgcaacgtggaagcacggttgtttgctgatgacgcgaccggcgtcagaccagtcacagaccggtcattcttgtccaccacgtgtcagtttagcatgcctgcaggtcgact

SEQ ID NO: 106037 - DNA, 561 bp, Oryza sativa
gtactcatcggcatcaaagccgtgcagctgaaagcttcattaatgcctttggttgcctcaacctccacctcatgggaggccccatttgggtttgtgcatccaaggcttcatctcttgcagtttaccataatttcttcgagctcaccgtcgtcactctcgcagatctgggcgtcattgttgtggagctggtgtagtgaaggatccaattgcttttcatatctttaaaagttattgtttgcaaagttgttgctcaaggtgtaattttcccaccatataggggcctcaatataaaacttgctgacctttcacgtagtattatctgaggctataaacaaacaaacaaattcagcttggaagctagtgttttttctctaataaataattcagcttggaatgcacgaatttcacatggaacatttcatttcctgttatgatatttttttaagtttcaaattgatatgcctataaataacatagaaactctgacaacagcaaaatgcacagaacaaaactactgtgccaaatcgatgaggattctcaaagttattgctggtgcgatac

SEQ ID NO: 106038 - DNA, 867 bp, Oryza sativa
taaatggcttcaagttactccatccatttcacaatgtaagtcattttagtattttccacattcataatgatgtgtctagattcattaacatcaatatgaatatgagaaatgctagaatgacttacattgtgaaacggatgaagtattaattatacaaattaatcagaaaacatatatatgtctatatatcctatgtagttggcaccagaagcatgatatgcattgagctacatcatcttaaaaaatagtagtctttggatccctatcatgctttgatctcaactatgcatccatttgtcatatgcatttacaacgtataggtgtagttattgctataaatctcaatgtgcattgaaccctaacacctaaaatactaatattcattggatctcctcatgtgttatacataactactattgaacaaatattatccatttagatattatgagtaaatgattttttttagattgttttttatgagctttctctatccatttagatattacgagtacatgatttatagacgagtacatgatttatagattgtgttttatgagttttcttgaaagtatttttaaaatttttcgctgcaacacgcagggtatccactagtttatttgatgaggtgccaatacatttgagtagtacctgttatgtttttttttcaaagaggagtacacctacctgttatcggtatgaagtggaaaaaatatataactgatctttaatgtctcagatatagaacaatgtacttttagtgaactcgccaatccatgcccccgtttgtctttatcaccctttttcctctctgcgatccaacatgccagtggatatgaataatcagctacgaagtaactcctttccgtc

SEQ ID NO: 106039 - DNA, 3042 bp, Oryza sativa
atgctcatgtttactaaactgctaaaaggatgtattttttaagaatatataaaaatttgttttaaaaagccatattaacatatttttcaagtttttaatacttaattaattataggctaataaaatgcctcattttcggatggggtgaagttcctaacttctcttgaacagtcttagtagagagaatatcatgtgccacggagtagtgatatgttaccatgctatcaatgtcaaaaagtgtataaaaaagtcaccaaaaaaatctgaaaaaaaattctaattaagatgtaagaccataacatataccatcagtccaaaaaaaatcagctcaaaatacgatgtgcataattagaataagaaaaacaaatttcttgctctaatagtgttcaaacacggcactttactatttatctgggatttttctttttctttctcctgtacacatcgtattttgttgtataatttttatgattgtgcatgtcactgcgttggacatcttataattattttttatatttttgtgactttttagatgtattttttggtaggtagtacagtagcatagtaattttatagcaccagatattttctcgggccttattacaccttgctaatgatacactgcacatacccttaagaactacgcattgagctgtacgcatgttgtgtttcgaccactccctccgtccctgtacatgtgtgcatattgtgtgcattaattatttcagtaataaaaacggattacgtattcagtccctgtcatcaggtatattttgttagtactgtttgtaaatggactaagatgtgacatgtaggtggtttaaaattaaattatattatattgcattaattaatggatgcgcaccgtatgactcgtacacttaagggattaaggtgcgttctttatactctcttcccaacttttgctcaatcattttcacatgcacgcttattaaactgctaaatgttactctttctgctctgaaatatatgaagttttggttgggttgggacacatacctatccaaatttgtagtaatataatgtggcccatcaaaccaaaactacttatattttaaaacggatgaagtatatttttgtaaacagaaattctacaggaaagttgttttaaaaaataatattgatctttttttttaaaaaaattaactaatacttaattaatcatgcgttaataagatgttccattttacgtgtttagaggattagttcctgatacaccgtaccgaacacaacctaagtgaacgtgatgctgtgtaacgtgttcgagatgattttatattatactgtacattatacatagtggtattcgtttcggctaagataaaatttaagcatgaaaaaatatactgcataattaattgagttttagttattacgatttttatatgatactttaaaacaacttctctatgtataaagtttacacaaaaacatactgaaaatggtgctaatagaaacgaaggtacaatctatattttaaggggaaaaaaaaaaggccacggtgacgattcgaaacagtctggacttgaccaagctccgccttgggttcaatactacaatacctgcaatactattcgaaacatactcccttcgtactcgtaaaggaaggaagtcgtttttgacagcgacacgatctctaaaacacaactttaacttcttatttctataaaaatatttattgaaaagtgatatatgtatacttttatgaaagtatttttcaagacaaatctattcatataatttttacattttcaaactcaacaacttaagagttattcatgatttatattcccaaggtttgacttaaacattgtcctaaacgacttcctttacgagtacggagggagtataaggtaaaatggctttgacgaattggaggaggtgtagagtccttggtacaatattatacacggaaaatgtacacatacacatatacatatttcacacaatcaatccctcatcttgccatgaactttgagcatagttttaactagcaaatcagcaacagaacaacaataaacacatgcacacaggatatagcaatttacatggacaaaacctcctcggtgtgaggagtaaaaaaccacgggaccaacggtccactacaagctttcactataatcaacaaagggtacaaatagagtcttctctagaacatctagaggcacattacaacaatagctatatcaccaagttacacacttgacatcatcaacatcaaccataacaactaacaagaggtataacaacaataagtagagaaatagtaggttttgtcctctttggttctcagatgagatctaccaaaccatagatgcaaattgcacgaaatttagcagaaatgatggtttatgagtcccttccaagttatccaaaaaaacagcctaatcggacactgtttaacctctcaaactaacattttaccaaatgctgcattacctgaaactacaatcactcgagttgacaaatcaccactcaaatccggtgctctattaaaccaatcctcacacaaattgatcagattgaagtgctcaaagtgaggaacgaaatcacccaagtttggtgctaatccaaccacgtttgtgcctctaatcgctgacttgatgaagatcgggtaagaaccaccaagatgaacaaactgtaactcttcttctccactctcccctccctctcttgtattttactggtttcttctcctcctcaatggctactgctctcactctcccaatggaggctagggtttttctttccaccacaaatgatgagacaatccccaccatgcatcaagacatgaatcaatcatcaatggctcacgctcacatttgttagacttttggattgtaatgggcagagaacaaaggcttcatgtggagggaatttattccaacaaaagaagcatataactagttctcgatgaaaactaattgatatgctagattagatagcttgctctcccttttaaattggtgtgatacgtcccaaaactatttataaaaactaaattaaggttattagcgatct

SEQ ID NO: 106040 - DNA, 995 bp, Oryza sativa
  unsure (1)..(995): unsure at all n locations
tatatttaagatagtagatcataaanctataatttaccataaaatgcatcccaaacctatatatttaatatggagtatcaaaaacaacaaattttataatcaagttatcatacaactccaaatttaccgcaaatgtaatcacataactacaatgttatgaattcgagcatgataatagtgctaaggatttaaactctaaaatagttttgtgataatttaatttttaaatccttagttttgcgatactctaccttaaattttagaatgattttggtgtaaaaactataatttaagatacactatcgtcttaaatatgtagttttgtgatagtttgatcaagctatctatatctatagtactcattttatttttctgggtgcatgtatggggtgttaatcagcggccctctttactgttatctgcattctgcaaaaacaattgaaaaggagtgcataatctcataaacccatgcgcaagaaattggtgactgggatgtgactgtatgacactacaaaagcaagttcgccataaaccactgcttttgtaggtcaagtactcaaatttcaaccaagcacatacttttgcatagcataacttcatgcgttggtttggtaccgtcgacaggtctcttctttcatcaaaagatccgactttgcagtttcctaacctactgatgtgatacctgtaagcaaactaattcaatgtttctgaattcagaacctgggtttgcactggtagttaactgaactccgtgatggagtgttgttacatattcacctgtatgagcactgaatttgatttgtcagatattcaaatcattatgtccaaaatatcaagttgtttttcttcaaccaaaaatagataagcatggacgtaattaagtttgatatgggatgaacactgaagactgaaagttactctcaaattgttgtcaatacacgtcacattcttgttcataagtacattgtacttctcgcccggctattttcttgaca

SEQ ID NO: 106041 - DNA, 712 bp, Oryza sativa
aattcccgtgtccccgacggacgcgcccatgcacgcatcggggactcggggtcgacgactccggcggtgcgcatttgtggcttctactgcaatattgccgatccatcgatcggtagtcggtagagcagctctgccataaacttggacttaattggttacttagccaaaagcccaaaggagaatttgcagctagctaggtagatctgatacagtgaacacaacgcattgcaactgaggggtgtttaaatctaggattataaagttttggcgtgtcacatcgggtattatatagggtatcgtatggggtgttcgagtactaataaaaaaaactaattacagtatccgttaataaaccgcgagacgaatttattaagcctagttaatccgtcattagcacatgtttactgtacccccatattgttaaatcatggaccaattaggcttacaagattcgtctcgcaaattagtcgcaatctgtgcaattagttattttttagcctatatttaatactttatatagatgttgaaacgttcgatgggataggattagaggttaacatctattgttattggtaaaaaaagacccatagattaaattgttggagtactaagaagaggttaacatatattattattggtaaaaaaagaaccacagattaaattgttggagtactaagaagaggttgggtacagagtgagattctaacccacg

SEQ ID NO: 106042 - DNA, 1525 bp, Oryza sativa
cgcattcttaaaaaaaaagtttgcaataggttatttggagtatgtagtttcatgaaatttattcaaataaaaatataagaaaatctcctgtatgaattgggctaggcatgatgcatggtgtgtgtgctcgtcgtgtaatggtaaaaaatggtaggcttcattacagattttagtttcttctaacattttaggtttgcctggttatgcatgtctgaaaatgtcacatggtttctggagggcattcacagctcacatgctggctgaatttatgagagaacctggaccatgcatgcatactgaatcctctgtcatcactcatcagcctgtagccaatgtgatgagagttcaatgtatgtagtacaaaattcaaccccatcttcctttttttgtgactgacttgcaaatttcaaaaaggaatggcatatgtatgggatatacttgattaactggaccagctgtaaacatctattatattattaaaggaatagaaaaagaagcctccacgttcgctctcatggcatagaaattctcacattaatcggagaaaaagaaaaaacagagtccatatagaaatacaatttagaaatagctgaaattcagaattaaaaaataaagaatattagaagaggagactagagtccatatagaaatacaattaggaaataactgaaattcggaattaaaaaaaaaggaatattaaaagaggatactagagtccgtatagaaatacgattaagaaataattgaaattcggaattaaaaaataagaaatattagaagaggaggctagagtccgtatagaaatacaatttaaaaaaaaatagaaattcggaattaaaaaataaggaatattagaagtagagtatagaatctatataggaatttaaaactaactaaaatttggaataaacataataaaattaaaagtagagtttagagtccatataaaaatacaatttacaaataactaaaattcgaaattaagaaaaacatgggaagaagagtttaaggtcaatatatgaatacaatttagaagtaactgaaattcgaaattaaaaattaaagaatattgaaagatgagtttagagtgcacatagaaatacaattataaataataaaaattcagaaataaaaataaataatattagaagaagagcatagagtctatatagaaatacaatttacagaaaattcaaaattaaaaaaaaagaaatattaaaagacgagtctagagttcatataggaatatatataatttacaaataactaaaatttgatattaaaaataattaataactaacacgtatataaaatataatatgaatattacccattaatagttttgtaaagttattccaaaatttaaaattatattgttcctccaatatatttaaataatataatgaaaaaacatatatgctattatatgagagaaaatataataatgttagccgcgcaatctgcgtgggccaccacgctagttttcatcgttgggtaccaccaagttgacaacaatgcacttccc

SEQ ID NO: 106043 - DNA, 1519 bp, Oryza sativa
tacaataattaaaattctgctcgattggagtgttagtaaaaattcattcactttggcccccaaccacatattagatttgcaattactgatttggtgtccagtgtttcaggtgctttgtagcctggtttgagtttggagtgttcgtaaggtgttatctgttgggttggtactcggatgtgtactcttccttgggtatcaatgtaataaggcaaagcttttgcctttgtctcaaaaaaaggatttgcaatttccttgatcttaatgaaatttggtcagcaccctttcgccgacccggcaaaaaaagatttgcaattactgatgacctctgaaatatgaaacatggataatttcttgctatttatttcatcattgacatcactgaaggacagaacatgtttttataggcctgtattatcactcttactcatacatattttgagacggaggaagtatcaacctggaacataccaatgaaacgaggtgatggtgatagggtgtgaaattttaattgccaggacattaagactacgttgttatgctatgattttaggcaaataattccaaagtggagccttctgcatttcaggtccagccttctgaaagtttaaagcttttcttgatactttttgaaaccgcagtctccaaaaaatcctgaggtagctttactgcaataagagggttattcatcccaacttgtaaggcccatgagtgcctttctaattgcagcccacaatggcacaaccaatcccctcatcttttgtagattaagcatggataacagttctctgggttcattaaatttaaacatgatgcagcttttctctcttctttcaattgatgcctacttttattccatatatctgttaagtctctggttttcaatgctgcaccatattactacatagctattccttcatatttcttggtagaccagcgtgaataaatgcaagaatggagggggtgctcgtcttatcatttcaagaggttttgttccggatgtactttctcttttttttaatgccactattattatgatcccatatttttttaaggcacctatgcccatatcacaataacaaaataaatggatactattcaactcggtcatataattcagcgatcagaatcttttcttgacaaggaccagtgtgagaaaccggcaggtttattatcactttatggcagatatgcagctattcagattggccgtatctacacaatcatgttgccattcaatatgaactctgcaatgcagtgtttttgcatgatatatttttaagaccttggtacgaaatctgacaccattaatttcgtaattagccaccatcacatgggaggattcccaatgttttatgctattctgtgcagaggttgtcaacattgtttttcttgcatgtgtgcgtagatttgtaggacataaagcactgttctttccttatctaaacacatgccattagatttctgcttcatgtgaccatgggatggggtaccgagtagaatatcaatccaaaggcccata

SEQ ID NO: 106044 - DNA, 1897 bp, Oryza sativa
aatggtttgcccccacgctttatttatggggtgggggtaaaccggaaaagctagtaagggcatttttcggcctttgttgcattatcaatgcgggtgggtttagttccccttttctaaattaagagttaatataggtaaaaaaatttgaagtaataaaaaattgaaagtttaagaaaaagtttggaactaacaagggctcaaggggtgcatctcttgttctcttgcaagaccctagcactagctgcagtgctatactgccgttgacaagtcacgtatagacaagagcaagtataatagggggttgtaattccgctaaatgctaaagtaaagaagaaaagagaggaaaagcgggctgtaaacttccagtcagcttgaacgcaataaccaaaaaattacgtaaaagagacaggtgtgccatatatgaattgtaaatagctaactattatatgcgtaggctaagaaaaggctataaagaaccagcaagttagttgtattattaatcttgctctaacttagttttcttttttcttttttcttttttttaaaaaagaactcgaccaaaaggagacacatcccgaagacattgcatttaaggtcgggaacttagttaagcattaatttggatcataattcaatagaaattttataggtaggcgtgggaaaaaatatggggtcttttggatcgtaggattaacctcgaatggatttactccctccgtcttaatataaacaataaatatagattcatggtattaggatatatcatatgttattttattttacgtgaaaattgttatagaatttggctccttgctagtccacgctatttcttgccgcacatgtaacatgtttatttgtactgtgcaagctataagagaaaaaaacatcataattgctattactaaatgatccaaggtcttacatagtagctgtataccacactctctttaattaattaatcatttgatgattgcaagatggtcctgaacctagtggaagatgagattacatgcaatccattccagatatgctgctacatttccagatttcacttgcctaacagagtcacaggttaaaattcgcactacaaataaaacagagatacagtagctgagttggactcattgcaaattccagcttcagtacattcatccaaattaattgcacaatttcagcaccaacataattggcacacctgagttcagacaactaccctggcctaacctgcatatgattagatattagaggatcatcatctagcctaattagcatttgggaattgggattactacttttgatgcatcaatggcattctaaagcgactttctgataactgagggaccagtccctctcctgcggacagctgctatacgtgcaagactagtcctcctcttggattggatcacgccttagatagtcctggacatcattaagtttggtcaagtatgagaaaactcggttgcttcttttctgaaagaagataattcagttgcttgtcactacttgggtttcagttactatctagatctatcatgtatgcacttcatcctagttggaaggtgatggagatgcaagctataaatcacactatctgtttaactataagcttggagaacacatgtgatggcacatggcctgaaacaacccaaattatgtcaatcatctcgcagagatgaaaggcatggccttgaaagttgaaacccatccgaatttaaaggaggctttaatagccactgacgagcaacaagaatgcatttgctgaactttcaactcggcctatgaacatcgagctggatccaactcgatcgtagcttgctgagagcttaaatgtgtactctgttctgaactctggacactgtctgtgtccagctaaaccgtggtgcggcgctcaagaggg

SEQ ID NO: 106045 - DNA, 974 bp, Oryza sativa
  unsure (1)..(974): unsure at all n locations
ttgatgctacgataattattgacagcctgatctaatacttcaatcctaggggtttagacagagtcggttaagctgtcgctttgatttgagaaatgagaaattcagagcgcatctcccgtgctcccatttttgtcaagctgcagacggtgtatgatgcgtagtcgcctatggtgatctttttatccacggggaatcaaaactggtcaaaacctagctatgcgagggaaaacggccaacagatcgttcgttaaggtgtcgacttggctttacctgattccctttgtgcgtgtgttggttgtgtcaggctttcatcttttggctcaaccagcatatgctaatactaaaatttaaatttttaatttaattttaaagtagtttttgagttttttttatcataatttcttttacaacataatcgtttaagtcgcaaagaaaataaatgtaaatgttttaatcacacattatagtttttcgctaatacgctatttggcgtattttgtgcatatagccatccgatgaggctatcagttaaaagaattgctcctacaactgcagatcagaatctcttgctgagtagtacctttctaaggattgttaaaaaaaaaaaagcttaatccatatatgttcatttaatcagcgtgtaattgacaagcaagcagtagcataaatttccataacaagctagctaatgaataggacatctaaacaaactaatcctaatcaccatcatgctcttattagttcggttcggtcacatcgtttttaaatccgcacccgtttgtttttgcgtgcatcatatctcttcattcatgtttcgttagtacagctgcaatctgtgcgtacttatcagtgatcaatgcatgcatttgagtgtcactccacgactcctcagcttgggatcagaataggtgacgagaggttgccgatcatttcgtatttcngtgcagtgagccagccggacatacaacctctgc

SEQ ID NO: 106046 - DNA, 1166 bp, Oryza sativa
  unsure (1)..(1166): unsure at all n locations
ttatatttgcacaaattttctgaataagacgaatagtcaaacagtgcaagcaaaatgttaaaatcccttatattaggggacggatgaagtatcatgcatatcttgtattgtattctgatttatgacttgtatgttcctcccaccgcgcttttccctcctccttccgcaccttcgtctacacagcaacgcaaatggatggccggtaacggcccacggcatggcgggggcgacacgtgcgatggaggtggctgaactgattccacggagccacaacgagagacgccggtggtggctggtaggagcgggacgaggaggtgacccctgcgtggcaccgcttgggcaaacgcagggcgcggcgtgaaggaggaggtggcggtgctaccatgtgatcggaggaggcaaagccaatccctaggttggggttgccatggtggcgggggggggggactcttgctgctgaggggcaccgctaaggtcttggcgctgcccgctgctaccgcgggctcattctcgactgcggtggcggtggcgatgaccttgggggaggagagggcatcagccggcgacatcggtggtggattggaagagggaaacatggcgaaggcgatgcggttaaggcggcgcaggcaatgcgtggggatcgtgtccaacggcagtgggcagtgacagtgggcccaccgttttttaatctttgtcattaacatgtggggtcctgcaagctgattcagccaatcaacaaggtcaaatataccacgtgagacaaaaccacctctgtaaccacccgaggagtcgatttggaatggttttaagagttggaggacggattataacctgttttaccgttaagggttgccattcaaccatgtacatgagttgagtgaggcaacgaattcaactaacgaattccttcccagtacgtgtcagtgtgtcaggtcagcggaattttcaatgatgagaataagcaaccaaagtgggaatagagcaaacgtgcatgtcaagtcaagtcacacacaaattaatcgagcaaatcacattaacatcgttgtatataacaactaattagaatcgtggacaaaaacaccgattttgtttggacaaaatataatgtatgngggatctggaatttctctgcggctgcgggcatagttcacgatttaaaagcccgg

SEQ ID NO: 106047 - DNA, 1304 bp, Oryza sativa
  unsure (1)..(1304): unsure at all n locations
agcactaaaaaaatgctttgtaaagatatttttctagtattgtagagacacttttcaaatgcctttacaatattgtagaggcattaattacccttttaaaaatgtctcataagtgtcttatggtgaattatctctacaaacgaagagacattttataaaatgtctataagatggtagaggcattttctagagacattaaattgtaccacaaacatatgaaaccagtccaaaaaaggagaataaaatagtttctttgcttttgtcaagccttgaaatcaggatctcttggacaaatcatttttttatcttcaatatactaaccaactcaactctatgtcattacttatatgtttatgcctttagttacttatatttagtcttttaatacacattatcattctaaaaagtgtctttacatagtttaaaatgtctgaagaaagtgcctttacatatcagacgcattttacaatgccgaaagaatgcctctacaagataaaatctaataaattgagctgaaaatgtctctagtgtaaaagttttctagtcaatttttaaagtggccctataaagtgtctctactctataaaacttctgatcttagaagcaatttataaaacgcctctacaaaagtgcctctatataaggtttttgttgtattattgtgattttagattttgatacatatgaaatatgcaatttatatcattattcaaaacccacaaacgcaactatttagctgctggattttagtagaaaacatattttgaatctgagaatccgcttccaaaatcaagtttagtgtaaattttagagagttgtaactatgaagtactatctcgtctagactataggtttgctgtaacatcagttgggcatttcagagaaactgcaataatagttgaagattttattattaatcgcaacttattcatcttgtaggtctgggtccacgtgtacatatatataatactcaaattgttgcactttgggcccacatgtcaaacgctcatagcattgtagttttctaataaaagtgtactatatagtttagttgttttaaatatttagattttagataaagttgcaacatagtaattttttttactaaatagttcaatttaatttgtggtggggaaaaaatccataatcaaaagcacaagaaaaaagcctaagacccctttacatttgtagaaaacatagaaaatttagaggattttaatccaatggaaaaaattccaatgtagacctttgaagcaaagaattttttttagcggggtaccgagaaggaattcaaaanngacata

SEQ ID NO: 106048 - DNA, 868 bp, Oryza sativa
  unsure (1)..(868): unsure at all n locations
atgtcacgtcttccgtctgtataccgtggtggtatgtggcacgtggttacacgtgagaangatgtgtcttgtgggtaaagatgtacacctctgatcagagtanaatctattcgaatagccgcgccctcggttatgggcagccgagcaatgtacccagttangtgttttaattcttaaaacctgcttaacaactaaaatgtggaatggttggcctgggttggcttgggacgagctaggacccagggtcgggttgccagttcggtctgaatcatcgtaggccttgggttaaggcaggttcgtgtgggttcacggccttgataaataatattgtttagttctagaatcgtgtttacaaaatagccctgagcaactaaatatctttaaatgctgtttactgcaaccataacccctttatggtataactcctttgtactcccttgcatttattctgcatttgtgggtgtgtcttgttgagtacggtggttgtactcagtcttgctcaatttttcccaaccccagaagaggaattccaggaggatgaaggcttcggtgtctagctcgtgcctgccatcaagcgcctgtggtcgtcgccctagtcttccgctatttctcgtttgtctctgtgtgtgctgggccttcgttgcccatgtaataagttatctaattacgcttccgcttgttaaactctgaattgtatcaacttttggtgtaccttgcctcctgggacaaggattaatgcacgcacgtaaggaatgcccgttgggttatttccggtcgtgacaagttggtatcagagcccctttgaccctaggacgagccgtagatcccaagccttagcagagaaaccgagctcgaatntcaatcacac

SEQ ID NO: 106049 - DNA, 749 bp, Oryza sativa
gatgtcccttttgaattgcatatctcgctcggtacccattattccagcccaatccggatttatttggttttctttgtcagcactaaaaaatcagtatccgggattttagtgtgttttccttgtcaatccgacagtcggagtcctgaatatcggtatctacgagtaggactagcacaacaatggtttgaaacctaaaaggggccactgggaatgagttcaactaacctgctagatagacgcgtatatcaccgtatcaacacctgattgaacgagcatcactttttcactgcgtgtacattgaattttgagttgaaactttgcaaaataaagtggagcatgttaccatgttatacatcgcaaatttttatcacaatctttcatgtttatttgacggcaacttgaacccctaaaattgttctccagtatagttcgtacatatgaggctattactagttcactaatgtggcccatgatgactcggccggttagactaggtcaatgagccacgccagcaaaaactaactaaactgcctttaaactacgagggaattattttaaatcggttataatagttgggagccaatatatttgagattggaccaaccagtgagggagtcaaaatgaacttattcttactcttaagtacgagtattttggtaggaccatgggctgtatgggcttttggctcgtccgaaaccagctcgccggcccatctcggcccatgaaatcttccccttcggctcagtctg

SEQ ID NO: 106050 - DNA, 2307 bp, Oryza sativa
  unsure (1)..(2307): unsure at all n locations
ctcacgggctaggttaccacgcgtccatttcttcttgtttgctctctcatcactcgagctcactccactgtaaaaagaaagtttctaccacattatcattggtgccgtaggtaaacccgtgttcatttcgcttcgtgtgtttactcgagtgttttttcatccatcccgtttatttggccgtgacgaaatcggtttcctgacatggctgaatgctccctgattccatcgtactcggctggtttttcgtgccgtttttttaagtacgtttctcgggcaggcgagcacacagcggcacagcggtgcgtctgcaacggaggtgtatgggcgtggcagtcgccttctctttttgtcactactaggcgggcgatggccgctgtacctcgtatgcgagcgcgagcaaaacacggcagcagcgatctgattcgcatcagcaccgcgccctgtgatcacggcccgtgagcacatggaagtgaaccagaattttgcacgtactactgctactcgtgttctccatctgaaaaattgatgaagtgtgttggtaacgtacgaaaaaaacattgatcatgattcggcacagttcgtctcctcgtgacatccagtgatgatcactggatcgatacggtatccggtgccagaggatgcactttttgtatggtgtgcacgaagcagaagcattcaagtactagtatctctctcttttttttctggggtggtagacagggaacgctgcgttcactgcctcagaggttgttgtacagccgacatgtttctcgtgacgaacaatcaatggctctccgactggatgattgtacatcgtgttcttctctgcacttgagttctctctcgcttttttattcaccctgcctcggatgaaagcagcgtactacccgttgccactgtcaaggacactcctcctcataatcctttgtggttaaacaacttactattggttgttactgacatttgtcgttttcatctgaatttaaaacgggcaaagcattccctgacaccctatgtactacagtatatctgcctaatcttcagagttcagctagagaccatcacatcacgtgcactgttcctttcaacgatcggctgctactactacccgatggtgaacatgcacgtctcccgtcgtcaatctggcgatgtgatagttgtaagggtttctctgatagagacttggaggaccaccgacgacgatgttctcagccgatcaagcttgctaggaggaccggatggtagcaatagtagtactactactcgtagtagctataactaagctagctatggactgaaatcatgcatgcaagccgtctgtttctatatgtaacgttgtgctgtgaaactgtttgcacggttcaatgattgatgagatgggagagaactatactagtggctgctgattagtttcactgttgagccatcgtgcaacattgcatcaaactgcagtgccaaaaaagacgccagctcaactagcgagctggagtaggactagctagctatagcaattacgggattgaccattcaatcgtgacttaacctactaacaactgattccgttcaataatggtgccatgttggatagcggtgtgatgctgacaagatagcatctggataatgataatcccgcttcctttttcctagttagagatagtgacttggataatcaatccagcgtaaaccatttgtatttttccggaacacaaagctgccagtttctagggttgcgcatgtgtgctgtggtatgtggagccaaagctaatgacaggggaccagcaagggcatcagattagcagttagcttttgggccatggagaagggatagaactgggcctgaaggcctgatctgtcaagatatgtgaaagagaaggaatggacagaaggccccgtccggtacagcccatagaaacgttcaattggagttctctttgcgggccttacatgggacacgaattgacagaagcccatatggagatagcggacgtcccacacgcttggtgtcacgacgagaggaacctgcatgtgcgtctcggtgcgggcgtcgcctggtggcgtagctatccatgaccgcgcacacggtccacgcggaaaatcctgcgtacgtttccgtcgtaccggtgataaccacggacaccgctcgcgatataacctctccaaacttttcatcaccaacaccaagttgccgatgtgcttatctggtcctggtgttttctggggtaagagctagcaaccgaatcttgtatttcccacacagatccacggcaactgtcngggtnccgagctcgttagtcttaccttgcacac

SEQ ID NO: 106051 - DNA, 1241 bp, Oryza sativa
agtgacttggtattcattccacatggcatcgatgtggtgctacgtgggcactaaaataaaaccaaccttaaataaaaataaaaataaattaattcttggacccacatgtcagttacccaactcctcctgctttatcatcggcggcgaccaatatgaagagaccggcggaccggcgaagcggcggaagcaaaaccaccacgggaaccgaaaagaaaccagaggtgaggaagcctcgccatcgccgcttcccctcatgcacccctcctcttccgcacaggtgaattgctcctatagttgcacactcatattgaatgcaaggacgtcgaggacacaaggggatcggggagtcaaagtggccagggtttaaactagactcaagcttagtttagcagcaagggttcccaacccatctttttcatgttccgtgcgcacgcttttaaaactactaaatgttgtttttttgcaaaaagtttatatacgaaaattgcttaaaaaatatattgatctatttttgaaaacaaaaattagcaaatacttaattaatcacacgctaatagaccactctgttttccgtgcgctggagatacgttcccaaccgcctgcagcgaacacatcctcactcactttacaagcatatggttctcggggtatattcgtacttttcacatgttctatagcggatacatgttcttgttatgttctacagtaaagatcacaacgtttaaatatcatttagcaaattttatatttcgaaatcatggctaattgtctctgataggatcataggaggctggcgtcatggcgtgcatgcgcgtctgtggaattctgaggtcctgagctttggtgcgcaaagttggacccctgatgaaagattgtcttcgtacggaagtccagccgccgccgggtgcccagggcggttggttccattccatcaatcatttttccaatcgttctaattgcacttcaatcctaatctttgggtcgaatttggcgtaatggcgcgtgaaccggtccccgtcgcatatgtaccatgtcattgtaacaacagatcgaaatgcccaaagaatatttctcacaatctttaaagccacttttgacaaacaaacttattatacatccatcgtcgtcgacttattatcttcctcgtatccttttcccatctctctactactttttacacgacaataacacatacagcaatagatagggtaccgagctcgaatatgatttcaaaggccgcg

SEQ ID NO: 106052 - DNA, 1000 bp, Oryza sativa
atttttaaaaaatactagaaactagaagttgtgaaacttaacttttccaaattcttatctactcgctactcgtcaactgattattagaggcttaaacaaggtctaaagctagtgcaatgtacttgataaaatggatgcttaatttgtctaccaacgtaagtggaatcttgcttcaaatattttttttcttagaagatgtcactgcttgctaacgtcagttgagtgggacatgcatgtcaattggtacgcctctaccaacgtggcgatgagtaacctacagtaactagaatcttccaagctcgtggctgacgtttcaatgcgacagggggacttattctaagcaaaataacagagggcgttcaatatattatctagaaaaaaaaagtaaaaaacggtcaaatttcatatgattcatgacaaaaagaagttttaaaaagtcaaatttcataagactccgtgggattgtttaggggagcttaaattctaagaagcaacaggtaaggattcggctggtgagaatatgtagaaatttggaaaaacctagcttctgctctagtttattttttcattctacaactacaactcattttaatttgaagataaaaactattttgaaaagtatttttattgtgggagaaactacaactacccgaagctccctaaggttgtgtttgaaggtgcattttggaaacacttcctctatagcacacacaacaaaatgactcattagcacctaattaattaagtattaactaaagaaattgaataataaattaaagcaattttccaaagcaacctttccatagaatttttttttacaaaaaaacatatcgtttcgcagtttaggaaacgtgcacgtaaaaaagagagtaaaaattggaacagcttaaaaattgtagttaagaacacacccttaatatgccaggtttttcaaagctataattttaattttttattccaagttaaaattgattcaacagatccgatctactctggcaca

SEQ ID NO: 106053 - DNA, 1347 bp, Oryza sativa
  unsure (1)..(1347): unsure at all n locations
cagcaagtccaaanccaactgatttggttcttccccctctacgtatgtacgggtgtatcatggtgtggaatgtgatggagtactttctctagtcaagaattttttttatttttcttaatatcccctccaactggatggcactcgaggatatatttggctgtgttattatcacagtttttccaatccatctatctcgttttccgcgtgcacgctttttaaactactaaacgttgtgtttttttaaaaaaaaattctatacaaaagatgtttaaaaaacatattaatctatctttcaaaaaaagagctaatacttaattaatcatgcgttaatggattactccgttttctgtccgatgggagtgtcccaaccagaaggtgcgaacacacccaaatatatatcctaatatgtagtactccctcaaaaatcaccccccacaaagtttttacgaatcacttcctttctctcgtggaccaaacaaagattttatataaacttaccccgaaaacaaaatgattattgatctaaaccgtttttcaaaaaggcatattcaaacttatttaatttcctagctgaaattcggttatattttcgtcgtccaaacaactacagaaggctggcgtgttcgtttcggtgcagaaccagatccatgcatgtctggtatctcctttaccaaagttttagtactaattaatacatacatttcttgtattaatatattgcagtggccaaagtttgtcacttattaattcccttattaaaagaatatttcacatgattaccatttcgtaactgcccagcttgatcgagctacctattgattgtttttaattgttgtcccaggttcccggtaaaagtaaattatccaaggctcagttacctgcttaagacgctatcttccatttaatcaaggatctcagagtagggagagaaagaaggagagcaaaggtcatgtcatgccaaaagcatttcactttcacgcaaatgctgcttgttcatggaaagaaatggttgctgctctacctgcaagtacccctacggtttatttatatttacgtagcaagtttaaacgcgctgttgcgatgtatgatttctttttagaggtattatgatagtgatttcttgaaaagaaaaaaaacgaaaggagcttctggtagggattaggctctgtgttcgtttggggttgagaaccattcctcaatacataaaacaaagagttgaataattaattaagtattagctaaaagtttttaaaaaataattaatataatttttaagcaactttttggtagaactttttttaaaaaaattataccttttaaccgaacgggaaatgtgtataaagaaaa

SEQ ID NO: 106054 - DNA, 754 bp, Oryza sativa
ggggctttgtgttgactgctggtggacccacagagtgatagtatggctcccctcctgggttagctgtccctgacctggccctttaaatttgaggaggtccattttcatgccatatggcatttgaattgacctcacctactgccaagttcctgtcaacatgggtgtaaacaactacactgcttgtattttggtacatgtatgatgtatcctctagctttcccctatattattattgcagcttgtagaacacatcttaattagcactgcgatgagaatatggagagaagccccatgattgaatttcccttttcgatgcatgtcatgcaatagttagccgtttcagagagttagcttcgcactgatgattagagagatcaattaattagtggaccaaatttcctaattcttgcctaagagccaaaaagaacattattagggggccctttcgaacgcgaaaatttttcatgcttttgtactaataatgaaaattacacataattctgtgagagagtttttagaaaagagaaacttaaaaaaaaaattctaaatagtaacagagttcttgatctcgaaaaaaaaaagatatcttttttcctgtcactgtgaagccactgtttgactttgattggggagattttataataattcccagtacggcaccaaaatcttgagaaaaaaagaagagaagtaaataaaccgccgccaaatcaaaaggttgtggagatttgggcatgatcctaagagatatcgccat

SEQ ID NO: 106055 - DNA, 725 bp, Oryza sativa
ttttagccgtaacaaaaaaaaaatgacagttttaagggtaaaaatctgttaaattttatcttttttattacggctaaaatataataaatttgaaaataaaatttcacatgtaggtgtaatactatttagagtatgtgtagaatttttcctgatatttgctagttggtgtgcacgaaagtttgtgtgaataggatatgttcccttttgtaaggaagggtattattggcaaagttaacatatgaaagggactagcggttatttctcgagtacgcgttagctctgttattgtttgttgcattcagtttattaatatttttttttgtttccgctcatgcaacaatttctaaactgctttgcttttttcactaatctactttgtattctacttttcaagctaggtaattgttgcatgccttttgtgctaacagggcttggcatgttggaaacgtaagaggagtttttttttttttgaaaaaaaaattgctagctagtgaaatggatcggagatgatgcttaaatttctcgtggaactcgtacacgattccgttgttgttctaagctaaaggatgcatggtccaggctctagggcgtttaattttacgcctccttttcgtgttgacagattcggagctgttgaaacagataagcagctatagtactgctactatgcgcatgcattgtcaccttcaatcaatttcatccataaatctccaacagttcgatta

SEQ ID NO: 106056 - DNA, 1284 bp, Oryza sativa
ttacaatttgttgtcattttatttcttgcctccaggttactctttgctcaaaaacattcttttagggggaaactctggttgcatcatatactttttaccaggattaaggctgcctgcctttgttgtaagtttgtgtacagtagttattagttgcagccttaaactggatcatttgaatgaagtagttgcagttaacctcgtgtgatggttagatgtatcagtaattctgcatgaaaccctgagcaaatgttagcctcttctggattggacgaattcatggaaattttatggaaattaagctgtacattatgcgattcttgcattcggaagaagccaatatcaatgtgtgacaacagttctcggtttatgaagttatgttattttcatggtaacatcgttgagtcttaacaatccataccagcaaaaaaaaaaagtgccccctcccccaatcaattttctactattccatacgttccaaaactccaaaatatagttgcttctagcatcattagtatactacaaccatattttagcaattgagatctcctgcagtactgcagataacctgcatctaaattacttactacaaccatccataatttaatttcttcacatatttttctcaactaataaaaatatctcttatttaattttcttaccaactttcttatcttacccgtgagtcacctaatcatttaattttaccttgtctttaatcaccatgaaaaactcaagttcctatattttggatagagagagcatttgttactttgacaggtcccccctacagccaaatgaccacaccagcttgctttccttgctttccttttctttgtctagcgacaggttttcatcaaaatatgtgtaatcattttcttttcttgttttgattttcgagaaggcacaaactagatccaccgaaattaaggcgatggatgaaacgaacagttccaaatgttgagggatgaaaatcaaacagttcaacagttgagggacaaaaattgtttaaggataatatggacttctattcgaattgagatgcccatgggatggtggcacaaacttttgctttcaccaagtagtgtacgtatcttgtgggctgctgtgcagatcgaagcctagcagtaacaaggttgtgcatgaggtatttgggctgatcccatagaaaacaagagccttgactccagtccaatgttccattttgcaccgagttgtgctggattggcaccgagacttattatactccgaaacttttttacccgggtcgacaagcattcaatccgg

SEQ ID NO: 106057 - DNA, 2262 bp, Oryza sativa
  unsure (1)..(2262): unsure at all n locations
acggcattgatttgcgattccagctcggtacccaccaacaatatgtccaccttttccaaaaaagaacaagtatatttttcacgatgattagacacattggtagcattagaagatttagcaacactagcaacaacatgaggttttgcatgcacaacattggattttgaagaagatgcactaatagtagacatgataccagcagatttaaacacagttttgttagtattagatttaaccaaaatctcaccacttctagcaccaacacctaacacaacaggaggatgcctagaattataagcataaggattaaaacctaaaccacggttatgtgtgctaacctttgattgatccaaaatcatgttgaggttctttttaccatcagaaaatcttagtaaagaatttttcaaataagaaacctctttatccaaattagcacaattttcacaatctaccatgacacatttgcttttacgacatttagggcaagaaagaacttcattgtttttcacaacatcttccatgaactcaacatgacctaaagcatctttcaatttcaacttattcaaattacatgttgagcaatccaaaatatcatgaggttgttttaactttttaacagaaatcatgttaaacatcaaactagcatgaaaagcaatttgatatttttgcaacaactttttagttaaaaataactcatccaaagtgcgtgtgtgcaaagcaaaactacaagcaagagaagatctatttttcaaatcatgtacagcattaacatctctaatttttgaaatctcattcattaaaacctcacaattttcgtaatcatcatcattaggaataagagattttaatctaacaatttcagatttaagagattcaatgataaatttatgttttctagacatcttctcacacttcttattcttttcactcaaaatattaatagcttcctcaacctctgtgtcagattcaccacgcgccatgaagcaaacattggagatgctctttccctatcatcatctccactttcaccatctacatcacttagtggctcgaaggcggcgcaaacttgttgaaaagccttcctgagattctctagcttcctcccttgggatgaacccttcggcttgttgttgttgttgttgttggtattctcaccatctttgtcttctcttttgcctctcccaagcttaggacaatgcgaacgaagatgatcaattgaaccacactcaaagcaacgatttggaccacctcttttcctgttcctggcattattcatagctcaagcaattctgttagcaaccaaagccaaattctcctcctcgatttgttcgagttgatcattggatgtggcattaaaaacagcaagaaaagaaggcttagatgaagaagcatcaacatccaaagaagaagaagaagaaaccaaagcactcgacttagaatcaacttcccgagaaagaacattcatctcatgtgttttcaattttgtgtaaagtgaatccaaagtcaaagtagacatattaacagactcctgaatagatgtaactttcatctcccaaatagacatgtcaagaccattcaaaaagtgacgagaaatatcagattatggataatttgtatcataagaagaatcaacagatctaagatcactcaaaattttattaaacctagaaagatagtaatccaaagcttctccaggtttcatctcaaatttaatatactcctttttgaaaatatcacgacgaagttctttaatgttatcttttccttgatgaaagttactcaaagctttccaaatttcgtgagcagttcgaaagtgcgcaacacgatcataatcagaaagagaagtaccactcaaaagaatgttgcgagctttgcaattttgttcaaactcagtttttaaagcagcagtattaatctcttcaggaatcacataaggatgagaaacttttctctaaatatcataatcttcagccataatgtaagattgcatcctactacaccaatgagaaaaatccgttccatcgaaaacatgaggcttagttgaaaacctagcaggagtagccatggcaaaaactctagatcgataaaaattcaaagaagaaaacaaggctctgataccacttgtaggattgaaatacaagaactaagacaaccagaggaaggggtgaatggttggtatacccaaaaaccgaaaacttttagcgttgtcggagatatgggcccnngggtntggttactagttgcatgtatattcatcgcgcg

SEQ ID NO: 106058 - DNA, 2934 bp, Oryza sativa
  unsure (1)..(2934): unsure at all n locations
cgcgggcagggtagaactaacggcagccngcacgccngcaggnnnactatagaggatccccaaaactaatttgatattgtagatgttgctaatttttatataaacttaatcaaacctaaagaacttggactaaaaaaatcaaacgacttataattatatataatatgaaacgggggaaggaatatatatacaccaccccacgagcacacgctatatatatacacacactagtatgtgcacgattaatacatgttcaagacattgagaactaacgtgatcattttacttaaattcctataaccgaagtgcacacgcgtgtataggggccctttgaaatggattggcaaacaactttagagaattcaatttcttctaaggatcttttttttcctatatatggaacctttgattcataggaagaagatagaaaattttctacataattgcatttctatgatctataggaatacgagtaagagattagagattagacctcttgtaaaacttacttttggcttaatttctttttgtgcaatcaaacggattctcttcttatttcatgcattttcaagtcatgcaggattggaaaaactgaaactttaatttctgggttttttctgtggggtttttcctatcctgctggcctaggatttaaacctagcttgtttcatgtatacactcacaacatgtaatgattgaaacaatattcacgctaaatcatttggatgataattccagacgcccctatcctaataacaagcttatacggagttcttgcaactagacaatatagttgctcatttggctttaactcgagaacatgaacaatggtcatgtgtctgggagagtgtaagatatattttgtaccctcaattttttagcactacgcaaccttcctcacccttcattcggccgtggacaaataaatgtacttcaaaagtaaaggtacatttggatggctattgctcatggacagacttaagacaagatatatgttggaccataagaattgtgctccactagacaatgagttatcttgtgttctctgtaatcaagggggtgatagagacaatgatgcatctcttctttgaatgccccatttcatgttgggcctcagttgggatcatatgggacttgacaaaaaaaattgatatgatgatatgagggaagccaaaaaggcggtatcaagaggtgattgcttctggagaaacgtttgccaactgcgtgtaacatctggaagataagaaacagctacattttcgatgaaaagcctttttcttcttcttggaggtttattctcaagactggcctcattttacttctttttagacttaatgagtgagataaatatatagttaaagaccttcagattatttaaagatttaactacatctttaatttcagagtaagtttcctatgacagtagctattatggtcgaataagttacataaaactatgggtctatttggtgaggttaagattctgagaagcatttggttggtagccagtttctgagaatctaaaaggctgggtttctcagcttcttgcttctagttcgttttttatattctacaactaaagattatcagaatctgaactaaaagctagactgctagaaactcccccaaacaagccctataagagttttggcacatgacacacaacccatgtattatggctataaagtttcacaaaaccatattattgatcattttaactttgatctaccatacttttaagttctacactcctatatgagatttgttttctttttattcacatataaatgctacatgtatgcaagtatattttaaaatttttgatataggagtacgtcaaattggttaatggtgtgattttgtgaaacttttaggccacaatatttgggtttatgtatcacatgtcacaatttatgtggttttgtataacttgaaccataatatgtgaggttttacgagatttactccttttaaatgaggttttaagacttaatgagatagtgaaatttagacctcggggcctcacctgttgtgctttgatatgtgaggttttatgagatttactccttttaatgaggttttaagacttaatgagatactccctccgttccaaaatataagcatttttagcatagtgacaagtcaaacatttttaactttaaccattaataaaaaaaataaaaaagatcaatcatataaagttgatgttattagatttatcattaaacaaactatcataagatacaactatttttatttaaaacgtcttacttttatagatattgttagtcaaagtagcataccggagaccgtgtgagggtccaaaaatgctactccctctatctacttttgatagtcatatttccaaatctgaaaaatttatttttgataggcatatttcaatccaacaacttatcatcttaatagttttcttatatttaatgcgtgactctccattcttccacacaagattggctacatgggcatcgagaaatgtaaatattaatgagtcacttgtttacgaggaataactagtagcatatttaaatggatgataagtagaatcatttatccttggtttgtatgtcaagatgaaatatgactatcaaaagtagatggagtgagtaatattttggacggaggaagtagtaaaatttagaccgcggggcctcacctgttgtggtttgataaaaaaaattattcatgctaaatcaactaatatctggcacgtataaacctgaatcttttctatattgttacaaaacgaatttaaagttcgagtccgcgcgtttcgataatgtacatttgctcccccacggtagtactatatacgttgatagtgtgtaaagagcctctgtactcgctttagtgcgtactatatatacaggcgtatgttcggtacattctagaccaaacccaaattaagcctggcac

SEQ ID NO: 106059 - DNA, 2195 bp, Oryza sativa
  unsure (1)..(2195): unsure at all n locations
gcgagcttgagnatcgaatctcgctgcctgcaggtcgactctagaggatccccttcatgctcttaccttttggtgggtcgccttttacagttttactactactggggccctgttcccacacaaaaaattttcatcctgttacatcaaatgtttatacccatacataaagtattaaatatagaaaaaataactaattacatagattacgtgtaaattacgagacgaatcttttaaacctaattgcgccatgatttgacaatggggggctacagtaaacatttgctaatgacgaattaattaagcttaataaattcatctcgcggtttagtacgtaatttgtttacaggtggaatatgtaatttggtttggtattagactacgtttagtactttaaatgtgtatccgtatatccgatgtgacgcattaaaacttttcacccagctatacatgactaaccatgccacttggagggtatcgtgtaaccaaaatttattcatccctatttccaacaataatttacttactcatacctaaatcaaatgagtattatcctaacccaacgaataaagaaaaaacatactcctatatgggttccactcgtagaaatggactactaaaatttatataaaggtgctctttctacataataaatcattcctctgaattttagtcaaattagataatattttataatgtgaacgcaagtctaaaagttttcggcccatagtgtgggtatggggatggggaaatgaaacccattgataagtgtattcatagtattttgtgtttagacttggagttaaatttttgtaagaagtgttggtatataggtttagttgaagcaaatgcctgtttatatgttaattatctaaaatattgttagtatctatgtagtaataatatattatcagtttcctaattatgactaccgtgatagatgtacatgagtatgtgtttgagtttctgtatcagtttcctaaattttgtaggctgatgagtgatgacagtgttttgcgtggtcgacttgctagtggctattgcatttgttgtgcccctttgtaaacggctacattctttcttaataaattttgacaggcaaataattcattatctaaaaggaaaatattatcatttgtttgcattcatatgatgtatcatatatgaaaaacctttaaatttgcatatatttttacactatctttcttttaatcataatcattcgttaagttgaccctgtcgtactcaaattctggcttcaccactgttttcatgagtcatgactatatcttgaaaaaatacaattgcagctatataaaaaaaatacaatatttgtatcttcacaatatgattatactttatatcatgggcagtatatttgtcctccattggatcacaaatataaatatatataggatttaacttttttacacaacaaaagcatttatgtgatactgatactaatgcataggaatttagacatgtttaaaatgccaatcatatgcttagaaagtgattctaaccatttcataattctaaatttgacaagtgaggtgagtttgatggattttccccctcaactttaatctttactaaacaacctagaaatacttaaatttagaaacacaggcagtacactcttatctttcttttttgttttgcattagatatgaaattacaagtgtaaaacactttctagtaattttttatttttttatataaaaagcatggtgctacaaatatatatactaaatagcaccagaaagaattcatcaacaccaactaaaaattctgggctaaaaagatatatagtatgagagagagagaggaggtactattggtggcctcaaaaataaaaatcaaatagaaaggatcggaatggggatattctccgtccgttgtttttccaaatacttcgaatggaagatatttttatacatatctttggcaccaccattattattgctaggttaccattatctgtcctgatcattaattagcataactactagattttgacatgacatgcttgggtcatgccacattaggaattggcccaagttataccgggcttcatatcttgaacgaatgctgggttacattccttcagaccagaattttacacagattcaacatttttagtttaattccaatgaaagctctctaaatttctggatcctactaggtcgagttgacat

SEQ ID NO: 106060 - DNA, 1878 bp, Oryza sativa
gggaccactggtggtttgcgaaatgacaatgggctccgggggtcaaaccacgtttgtgcaagcggcgggggtaaaaccggccccggcaacagggagcagcagggcgacacgcacgcacgcagggacggtggcggctagggttagcttcttttttttttctttttcttttttcttctgtgggttaaatagagaaagactaatgaagatcgaatggcccacattaatttggtcactgggacttcgttcagacctcgattactataaactttattttacactactcggcgagctctacgcatccacggttcctgatcgcctattcgaataacggttttaaaagttaaaattttgcatgtttgttctaatattccccgaaatatacaaattgtaaatttggggtattacattcttccccccttcaatctaattcaccctcgaattcacccaaccataatctagaacactgggtattacattaacattaatataaacgtagaaaatgttaaaatgacttacattataaaacggaggaagtagtaacgtatttctgcgaccgaagagactattatataaaaaagtttgaagaacgacattcgtcatctagatatttacgatacaaataaattaatctgcataacatcacctcacacctgaagaagtagtataagaaaaactttcacgtcagaatttatttattttttgaatgcttttaccaccgcagctacttactcctatatgagattctggccggacaatgattggcaaggaattaaagacactgaaaaaaaatgctgtctaaagagacacaaagaaaaaaacaaaacaaagcagcatagcagcttgatcattctctcccaagacagtactaattattttttcgcggtgatgttagttagtactactgctaattactccctccctccgtttcaaaatatttaacactgttgactttttagcacatgtttaaccgttcatcttattcaaaaacttttgagagatatgtaaaattatatgcctacataaaaatatatttaacaatgaatcaaatgataggaaaataattaataattacttaatttttttgaataaaacgaacggtcaaacatatgataaaaagttaacggcgtcaaacatttcaaaacggagggagtagtagtactagtacgactacttagtacttaatttgatcggccactcacatgtactatgcttattgtttcttttgacaagaaatcgagtagatcttgtcttatcctatcattgatgattaacctaatcgtactatagttcaatatcactaattaatctactgcatcttgtgcaaagcgattaattgtttacacaaacttcaacacaatcgaaggattaggtcagtggggtttggttcttaccttcctgtggtgttcgtctgctgaatactacatccatattattttaatgtatgacgccgttgactttttatctaacgtttgaccattcgtcttatttaaaaaatttatataattataatttattttattgtgacttgattcatcatcaaatgttttttaagcatgacataaatattttcatatttgcacaaaagatttgaataaaacgatggatcaaacgttgattaaaaagtcagcggcgtcatacattaaaatacggagggagtttttttttatgccccaaaatataaagcatagtatacggagttctttcttaattacatgctcatcaacactactatactttaatagttattaatttgtttgtggttatattatgaataattatgaagctaacatcatataaaactattttcaaattaatacgactgtaacgatataacatccatgataatagggtaccgagctcagtgtcaaatcaatcgcg

SEQ ID NO: 106061 - DNA, 678 bp, Oryza sativa
  unsure (1)..(678): unsure at all n locations
catttctttacttgcaaagtattgatcacaccctcttgctgccaacntgcatgccattgctagctagtagcagatgcaaggtggaaattaattgaccttacacacgttagagcatctgcgagatggcctctcaaatgacccttgctaagccaaattttggtaattttagaaaattaaaaaattcgtactccaacaacctctctaattggattggatagctaaaccatccgactgcccaaatctctcacctcattggccaaacttgtctatccaaaatcacttacggatagtgagccccacgtactattccttctccccatatggccactccactccactccactcttaattctctctcgtgctgcagcgtctgctataccattaaaaatcgttggagtgaatgttaaatttggctcttgtaaattttttttgacaagctaataaccaaataaacattcgaagtagagccgataatagcaaactctgttggagatgctcctagcaaataatcattgtcaacccggctggtcgtcggtgaaatatttaaccgatccatctaacttggccagccggcagtccggcacatgcaagcattatgcatatacgtacgatatgtgtacgtggtgcttaagtgcttaactaattccagatagatcatcgatatatacatatattctg

SEQ ID NO: 106062 - DNA, 676 bp, Oryza sativa
caacacgtgcctttagatttactggggccatttgagaccactttgcattgtggctagtgtagcatgggacttgggcttacatggcacttaagggagtgccccgcattgttcatggcctaaccccttcaggctggatacaacttttggttgtgccagccaggtaacaatccttttttgttctccatgtcctgaacgataatcagaatgccgattaatccaaaatttttattctcggaatattgtttgcatattggctcatgaaacggacgtggttctctggaattgaaagtgttaacaaataaacatggtgatgctaaccataaaaacaatctttttaaacgtgtctatacatttaataatcatggatatcatggcttgttaaaacctgcctaactgcgaaccttttaaatcagactttcccgcctctaaataatgacctttccagctcccctttaaatttctaacccgggtggtttttttttattccaatgcttattctttgggaataaaatttggtagtttaatctaatatagctatagtcttacacggaggttttgactttattgaaaccgaagggataccccatcttacctttgtaacatgcgaccgattaaaagaattggaattgtaacactttttctgaaactgctaagctgttggtggaaaaaaaataaa

SEQ ID NO: 106063 - DNA, 987 bp, Oryza sativa
  unsure (1)..(987): unsure at all n locations
ccccagtgggtttgattgacaagctctctgnaccccactgagcttagctgnttagccaaatctctgctgattcatatgcaccatttctgtacacacgcagcacagtagcaaaggtgccgtgcaaagtgtccaaaatataatcaccacctgatatgtgtgcccgccgactcgcattgatcacttgccgacccagctttctttagaaccaagcaagcaacacaaggggtcgcgagaacgaacaaaaagtgaaaaaaaaaaaagaaaagaagcttcttcactacttcgcagaagagaaagcaacaaatggagattacttgagtacctgacattggatatagcccgtgtcttcccccaaagaagaataaaaagcttagaccgagggtttaatcaaagtgggccattcggatcaccaccgggtctcttcttctttctctccgctcaagcgatgaatgctccttggctccggactcaaaaatacaagcagctagcaggcagcaggtacaaaagctctggacgcctcggggtcccacaatctcgtcagaccattccgtcccgtccgtccaacgattcaatgagacnaaagctccattcggttggattggaccaaaaagatgcctgcggtcgatgccatatgtaaggattgcanatgcaggcatgcatgcttgtcgtctgatccgaccccgatccgatccgaatcgactctgttctttactggcagcacagacattcgcgcgtctaaacagnggtacctggaaaatggatgggtcgccctgcactgaccttctctacacaaaatcttaaggcttaggagacatgacactggatttaactaataaaataagaggatggacccgggatctttggttgttggttggttaattgaagaaccatncccccataaatgctctattaccggtccttttggggcctttgcttttgcacgcgattgatataaacaccactttcacggttcacccttaaccgggg

SEQ ID NO: 106064 - DNA, 2002 bp, Oryza sativa
cgatatgatatacatgtagggctaagctagtactccctccgtttcatatcacaatattttctagcattgcccatattcatatagatgttaatatatttctagatttatatatatatatatatatttggacaatgctagaaaatcttataatataaaacggatgaagtagcatatgcatatattccctccgtcgcaaaatataacaacttttagcttaaaatttgtcccaaaatataataacttcttcgcccacattttttttctcaaccaattacaagcctccaccattcaattttcccacctaccttcacttctactccaatcacaacactctcccatttaatcatacctactttcttaataaccgtgttcaactctaaaaatacttatattctagaatagagggagtatatgcggccccagataaatgggagatggatcgatcggtgttggtgtacatgcatgttactattgctagccactgtgtgtccggtctgcgtgatgcatggatggatgcaaagcgcaaaaaaggcatagagagagagggggggtcatggatgcatggaaaatggatgggggatatatatgctatgccccatccccatcatgctggcctcccctgtgagacacagtgccctcttgtctccccgtgacacatatattcgtcgccgctaaagcatgaactgctgaagctaagctatagcccctcatgcatctgagcgaccttcaccaacctcatacccatccatccatgcattgtacgtaatgtccggccatggcgagagatcagtgtagtcagtcatgagtcagtcgtagctgatcactagctcgagtgagtcgcgtcttcgcacgccaagctgccaacccatgatgcacccctagctacaatcgccctggcccctgtccatgcatgcatgtactctcctatagtatattggaggtacatggaaactgctgttagatggacaaaattttagggcatttttgaataacatgagtggaaaaatgaggaatagaaaaaagaaacatatgattctgacaggaatgcaagtgtaaaacagatgattagaaaatacagggaaaacaaatgaatgaccgtttgatttgatagcaggaaaaacgtagaaatcagagatagactcaaaggaattttttaagaggttgaacctcttgctaactttcctccaaaatctctataggatttaggatttctcattcctactaattttaaaagataagatatgattcaatcctatcatcctatgtaaatccttcaaatttcctacacttttcctacaaattcaaaggggctgctaatagacatgcaaattaaggagatttaggttcaattaattgtttgttttctgccatccagcaaatattttatctctagagttgaataatatacaaatggttttggtcaactgtagcttaggggccgggggtgcaagcccacattgtcgcccgttgggatcgtcactctgcgccacgcctaaccgtacagaaaccttatagctaagataataatttctattctggataagataataatttctattctggatatagacctactctaaaattaagtgatttttaaattagcagttatgtttatgcatgtgtcacgctttgaggatggtctatgtcactaccgaattatagacctacctataattcggtagttcaatcatcaccgttggctcattatcactgtcaaatcgtgataagaactgtcagtgatactcaacataccagacaatatatatacctccaatcctatatcatgtacaggaaaacaatttaatcgaattcacactaagtcattccaaaaaaaaaaacaaataagtgactatatattaaatctgttgctggaaggcatgctgactatatatagatcgcgaataaggaggagtatatggaagacgctgtagagagggaggagaagcaaggagagggttttgtgggtattggaaattgccgcaaaaatgtgttaagaatagaa

SEQ ID NO: 106065 - DNA, 1406 bp, Oryza sativa
aaaaaatttaattataaaaaatattatgaagaaaacaaatctaaccatcaattttcaattaaattggtggacttataatttcatcaattttcatttaaatcagtggagttataattttaaaaattggatttaaagacataaataattcaaacagatgaacgcattaaatctacctcaataaaaaaaatctccttaccaaattacaacaaaacatttaaaaacatgacaacgcatattagatattcttgaatcattttacatagtaaagatcaattaaacgtgctctatagcactcttaagtcaccacgtatgatattttaaaactttgaaaaaattgaaattcaaagaaaaaaataaagtactccctccatccacaaaagttagacatatttcacatttgagtttttccaaataagttgttcctatttatagtctttatgtatttaagacttaaatgaagagataaattaaatgtttgattagaaccggaggagtcatctaaatattcattggttgcatacttgcatgcttgcatttactccttgattttataacatccaagatgatttaatattttcttggttttggtgacaaaagtaatatgtgtggatggagggagtatatatctatacattggtttccacttaatttgatgacccattatttttaactattagatcacctttctctttataaaaaaacttaagccaccacatgtcttgtcttaaagatccttagaatgagaaaacaacaaatcataggttctcacttagattgtttacaaagattgaaaaaaaaataatgtaccctccacctccctctccaatcacatgcacataacactattacactgcgaaccctttcttatacctgattcgagttctatgctattcgtttttctccagtctcctccctattttcagctactaaactaaagagagaaacaaatattaaaaagaccataattttaagctacacttataattttattttatatatcatctaatcgatgatggtttctttttgatataaagtctccacatgttaccccataaatcctcctaggcgtttttaaactgatgaacccattatttctagccattagatttatctcatattaaaagacaagtgtgtattcataatacatcatcttccaaaataatatattgcacaactatatttcttcatccaatattattcacgctaagttgcatggagtctcacccacactctacatagaatgttcacatatggattctctctcaaactaaacaataatattagactatataaacccatgcatttagtggagcctcatatcccacccaattcatccgtcaacaaacaatgacaacctacattcaattaaaaaaacaccttacttttgaatttacacttaatttgct

SEQ ID NO: 106066 - DNA, 1471 bp, Oryza sativa
  unsure (1)..(1471): unsure at all n locations
ttgatcatttttacgtttacnaaatcatatttttcataagcagcgggtgggaagattttcggctaagggtgaaaatggtataaaaattttccgaccgtaccgataccgtttccgtaaaattaatagtgataatatatttaccgacggtctttgttgtcaaaatttagtttttttcaattcatatcaacgtgataccgaagttgatactatatagttcaattcataaatatgaaaattttccaaccatttccacccgcttttttttaaaaaaaccaaaaaaaccaaaataaaggtatcgtttccgaccgttttcatccgtaccggctattcggtaattccggccggaggggctctgaaaaccgatgaaacagcacgtacggtgcgaggccctgacttctgagcaaggcttttgtagccttgcgctgttgcacacgccacccctcctcccctccattaaataatgcacacacacacgcacgcgcacacaggatgacaggaaggcacaccgatatataactcctccctcctagtatgatccttatcctgttgtccttcgtttggggtggagcacagcaacacagcatgattgatcccgtgattgattaggccccggattctgtctgcccatcatcccactgcacagcttaatgatagacttaattaacagattgtataattagttccttgctggagaggaggccatatattggctggcactctcaagacggtaggggaaaaagaataaaattcctaaatactaactccatattttaacgtatgatatcgttgactttttgtttaacgtttgaccattcgtcttattttaaaaaaaattatgtaattgttatttattttattgtgacttgatttattattaaatgttctttagcatgacatatatttttatatttgcacaaaaaatttgaataaaacgaatggtcaaaaaagtcaatggcatcatacattaaaatacggagggaataacatttatggccttaggcacatatcgtgattagtgataaaataatagtgtatggataaaacttttacatatatgtttttaacgatttaaaagataattaaaaaaactttgttaaaatcgtcaaaatcaaatttataaaatttaaaatttaacggtggtttataagcttttggtaaaggatgagaccctatgtagaaagtccaccctttgtttctgaatctaccgtttcttcttaatacgttgttcctcatattattaacgcatgcgccaccatttaatcatccgcgtcccgtcttcttataatttaacgccggtgcttttaaaatattcctgatgcgtgtcttataccatattgtgttttgtccgtgtcctcccttcttttcttgactcgggcctggctttcttttttatattcgtccgccctctcctaaatacatcaccgctggtccactttttatataacgagttcgtcggggccttctatatacg

SEQ ID NO: 106067 - DNA, 3868 bp, Oryza sativa
  unsure (1)..(3868): unsure at all n locations
ttcctctctgtgaanttagtgactgnatgttcatattattnttattctctctcatcacattacttttattntnataataantccgtcgtctttanaattcanttttctcttattnnnnnaaaacncnccccccccgtggcttttgattgatcgaacgncctgctaccccaagagnaanaattgtactatttttactcatgatgatatagatgaatctcgaatatctatttttcgatctaacgttagttttcaagtttcacaatatttatttccaccacatattttcctaacatgtgaccgggatctcacttctatctggcacacaacttattcaaccatactttgccacggagacgtggccgtacgatggtgccacgtacgacagcacaagcatttcacttctctactattataaaaattgtacaacagcaccagcatttctcttctctactattataaaaattgaagatattttttccggtaccttagtacgttatctgtgtatgagtcggttttaagtttgttcacttttggaaatatatatttgtatttcagttggtttttaaattcgttcattttgggaaatacatgaagagtcgtataagaaatctctttaaaaaaagacttacatgctaatttgagatgatcagactcctaattacaactcatgatttttctagaaaaatatatatccaagtgaattctcacagtgaaactattataaaaattgaagatgtttttaccggtactttggtacatcatctatgtatgagtcagtttttaagtttgttcgctttaggaaataaatatctatttttaagtcaggttttgagtttgttcgcttttggaaatacaggagcagtcgtataataaatctctttagaaaaacttacatgctaacttaagatgatcggactcttaattgcagttcatgattttctaaaaaaatatatccaagcgaattctcacggtgaatttcaccttaactaaaccgtataacaataatgaaattaaaatagccttcccctgttacaacgaacggataatttttctagtgaataaaatattcctttatagattaactacttaattatatgataaagtaataaattaataaataaacgtaacaaatactcattttgtcccgaaatatggttgctttctgatgttaatttggttttaaactatagctacttcttcgcctcctctatcacactattaaaaaagtatttatgcatgtggtcaaaatctatttttccattcagttggactctcaatatgcctgaaggcgtctgtaaaagtcactatttttccatgcgggtggagcacctgcacgcaaaaatccgtttttcgcgggtgggtgcttatgtcacctgcttgcgaaaagaaaaatcacgaaaaaaaatcccaaaaattgaaacccgaaagcctagctagctcttagtctgtcgttgctcgttgtcaccactgccgttgccgaggccccgtagctcgagatccatcgtcgtggtcgtccaccaccttgccgtccccactcctttgcagacaggagcgcttatgacccacctacagtttaagtttaaaatgggtttcgtccagaaaaatcagttctctcaaccttttgcttttgtatgttttgtgtacagttgattataagttgtaatgcttgctagcaaccaaatttaatttgtgggtgaaacttttatttatgtatatgtgtgtattattagtaacttaaaattaatactgaaataacatgcaatcagcaaacttcaaaattgttgacgggctatacccgtagacgggatttataagtatggggattgttgtaaccagggtatacgcgagactgtatcaagcagacaagaacgcaaagatttatactagtttgagccctcaagaagattaataatcctagtctagtttatattgatttatagataaaaatagcacaaagattacaatggggtgtaagacgaataaacaaaccgtcaactagaagctgtcgacattggcccgacgagatctattcggcaaatacgactatggcttctcccggattgcttctcaatgtggctctggctaccgcttgtaactcgatccccttctcggaattaggggaccttgtattcactatttatagtgtagatctatctttttctccaagtataactcgaagagataaaataggatacgggttggaggagaccttatctttttcgaataagattctgaaacattctattccaggaaaataatttcctttctatttgtagtatttccttaatgaaaggatgtgttcccgtaaacaattggttatatggtgttgtcatattccatgagtccgtgtataggagatatctattatccttacactaacaaaaatcaactctaaacttaagctttaaaaataaattttaactacaaataaataaagagcaaacaatagagtgcaacatctcaactagttacaaatatctcttatttaatttctctacctacctctcatctggactagtcgtaactaattttacccctctctcttggagagaaagctcttgaagtggttatatttagagatgaaaggagtaggttaaaataattagtgtaagcaaaatacggtaaaataaattttctattactcactccgttcctaaatataagggattttggttagatatgatgtattttagtacaataaatttagacatgaagcctgtccagattcgttatactaggatatattacatccaactaaaatctcttatatttagagacgaagggagttgaaatgtaaaggaggagtataagacaggccaagactacccagtacagagttagccaagattgacatgtggctatgttagttacctatggttgagaataaatcggtctaacagaactgacttattagcatataattaattaagtattaaataaaaaattaaaaaataaattaatatatttttacagtaacagttctataaaaatttaataaaaatatattatttagtagttcgaaaaacatacaggtgaaaataagagagttatcttcacttaaaagaacatttagtcaagaacacaacagttgggtgagcaagaaagaaagagagagaaagttcgaggaggccggttgagaaatgaatttatttgaattttttaaataacttatatatagaaatttttttataaaatacacatcatttagtattttagggcctgtttagattccatggcaattttttttatcctgttaaatcgaatattttaactaaacaggcccttaagcaaacatcagttgagtgagcaagccgcaggggatctatgggggccagttgagagttgagagagagtgagtacgtcacgtcacatcatcaaagcggagggacattaccaataccagcaccggacgggtccactccaactccatccattcatccatcgccgtatcgtccgtcctcagaggcccagaccaggcagtttcagtttccctggtttcatgctcttaccttttgttgtctcgccttttacagttttactactactggggccctgttcccacacaaaaaattttcatcctgttacatcaaatatttatacacatacataaagtattaaatatagaaaaaataactaattacatagattacgtgtaaattacgagacgaatcttttaaacctaattgcgccatgatttgacaatgtggtgctacagtaaacatttgctaatgacgaattaattaggcttaataaattcatctcgcggtttagtacgtaatttgtttacaggtggaatatgtaatttggtttgttattagactacgtttagtactttaaacgtgtatacttattattcgatgtgacgcgt

SEQ ID NO: 106068 - DNA, 783 bp, Oryza sativa
  unsure (1)..(783): unsure at all n locations
cttgtatttatacccataggtgtccccttgtccaagtagaattagggaaaccaatatggatacaatctgagtaatccttgccgtttacatgtagaactctggttgtctttccttatccggaactcctcctatatccgaaggttgtttccgtataagacatggtatgtggtgggtcctgccgagatttaatcaactactattaggtatgtggtatccataaccctaacactatgtctctgcagatgatatcgagcaaccacataaatgaacactaagccaatatcattgcatatctctggtaagctagccacacaattcatacgagtgaagtataaactaaagttggtactcgaataattatgcaaataaagtaaaggaccaaaactatataaagaagaatatttcattaatgaataaagtcttataagaggggaaagagttactagaaccatactcaaattctccaaaagacttgaagaactaaggaagactattctaattctaactctactagcactagagcaaaatatgtaaactaaagagcttcttcacttgattcctttctggtgtgtctaaaagtaaagagataaggtccttttatagctgtttatgacagttgggagcgccaataccagtaggtacccgtaattggaaggcgggtaccacctaccttaactttggcttgggcccaacgagcttgtgcttggtcnaccgacccttgcaagccttcctgcccatgaatcctccagatatctttagatggatcttgggccaatggcatag

SEQ ID NO: 106069 - DNA, 2016 bp, Oryza sativa
  unsure (1)..(2016): unsure at all n locations
tcttgttgttcccgtccggccgttgaaaccgaaccgtacccatactccgttaaccggtaccggaanccgtaaccggtgcccgttcttttgttcgaagggccaaggcngcngcgcggcggttgaccgcgcccacggacgacaaggaggtgtaccccgacgacgtggtggtcgacaccgcggcggcggagccgcctccgccgccgcggccccgcgcgcgcgagcagcggcgggaggaggacgacgcggaccgcgacgccggcgacggcgagtacgccgacgacgagcgcggatcgatggtcgtccgggtgccgtcctcccagttgatgtagtaaacttgccccgtctgcatcagcaaagccaatcacaaagcacatttcacacaaattcacatgaagtcatgaactacacatcaaaattcatctaaaaataataccaataaaggaaatgcgcttgaactagacagctagtggtacagattaagttaatcttgcaaatggcgaaatgctgtttcaagaatgtggtgagtaaatgtgcatgatgcatggagaagtttgggtggggaaaatctacaagtacattttggtgacagtctgcaagaacaattaatgcggtggcattcagttgcttccgtgaaacaaggttgagaacctattaataactgatgcccataacaaagtacagcagaacaggggaaagaaaaaaaatctggatcaaatggtgtaatgaatgctgctctctttgtcctcttgtttgtttgcaaatcacagggcaaggttggcaatgaagaacaccaccaccaaattctcatttcatcctttgtaaaaaaaaaaaactctaatctgcaggaaagctgttctacttaaaaagcacataaatgtattgcagtagtatcttcagaaaaggctactgaaataaccataagaagagcatttttgtctactctgttgctggagacaaggtggagatgaacactccattttggtgattaatacgcatgaatcttcattggggtaggcattcattcgtctgttcaaagtactagcagggatgaaaaagaaagggagacactttgtcacaatggaactgaagatttcccagaggtgagaatcatctggtgtttaacaaagctctgcgattagattagaacccaggaccaaaaaaacagagcattgtggtccagaagaaatctatagcgaaatctagagtttcagatagagacagagcaaaaaggaatggatctacagggatgtgtcagaaatttagaatgcaacacagatctgaatgcgcgcttagatcagagaccagagaaggtgtggagatttgaagagccttgatatcatcaacaaaaaaaaagaaaaaaatagtaccatcttttccgaggtttcttttctgaacttttgtcatccctgtgttaaaaagaacggcctgaatctctctgaagatgatcgaatccccaaccaaacgaagataagaaccgaagaaaaaaaacagagataaataaaaaaaatatttgcatagacgaagagaggaatcgcagatgaagcaaggatccaagaacaagaacaagaagagagaagggagacgaggagcagaaagagaagaggaggaagaagaaaaaaaaaatcagcgcggacgggtcgtctcgtctcgtctctctctccagttcgagcgcccgctttcgccattaatgatcaaatgattgatcccaatcgagcccaaaccaaaccacacccacctacctcggaaactgctatccatttatgtcttcaaatgattggacaaagggcggngcgccggcggccaccgncgncggcgccgaaagaatcgatcggggaagaaaaaggaaacgcggcgtatgcatgtatggatgcatgtgtggaaaaagagantggcgagtagtaatagacgtacccggatgtcgaggcactggtcccagtggtanggcanggcgaccctcgaagtgagctcgacggtgaccccctcgttgtggcgttcccttcggcggccgcgggcgct

SEQ ID NO: 106070 - DNA, 6744 bp, Oryza sativa
aaattatgtttgatgttaatgggtgttgcctgcacaaactagaaactcctcccatcttaaaatctatcaattttagcattcggcacaagtattaaaaaaagatgttaaaatcaacttattacatttactaggttgctatattttggataaaaattaattgaagaagttgttatattttagaactgatggggcagttaattgtttggtttcctttttagctaccatgcatacgagacttttatagaattattggtggacagaatattctttgtcatggggatggctgggaggaatatgttccaaggagcttggttaatcatcacatactcttaaagcctaaggccctgtttagttttcatgcgaaaacttttatactgtcacatcaaatgtttgacacatgcacggagtattaaatgtagaaaaaaaaaccaattatacatattgcgtgtaaattgtgagacaaatcttttaagcctaattgcgtcatgatttgacaatgtggcgctatagtaaatatttcctaatgatggattaattaagcttaataaattcgtctcgcagtttacgtgtgaaatctgtaatttgttttgttattagactatgtttaatacttcaaatgtatgtccatatatccgatgtgacacgccaaggctaaatttttttttgccaactaaacagggccttaattctggagcaaacacaaaaccttagtctggctgccccagaacccaggaatctgcatacggcaatggcgagagtgatgtgagcttccgctattacgaatcaacattgacttctactccaacattgctttcggacccgtttggtagagctccaactttaaaatttaactccagaatttggatttggggtgatgttgtgaaatagcctaacatagctccacctctttagtttattttgggagagcgctttatccggctatactcttattttagggggagctgaaaatgtttgactgagctccagctccaatagaagtggagctataggagctggagagtcaaacatgcccttcctctagctacacaagtgaagtacgtatgatagtaagggtccatttgttttgaagggaaattatagaaattttataggattctaatcctataaaactttttcctacatgaccctttgaaacaaaggattgaaaactattaaatactgtaaaatttctaagaaatgtctcaatccatacgagttttggagaattttaacatgaggtccaaactcatggaaagtttattataagcctatctctcttatctaattcctacgattttccgatggttcaattaaatgatcattcatatatttttttctacgttttacaatcctctaatttttatagaattcctatcaaaaaaaattatgtttttcatattcctcccttttctcaatccttcgattcagaggccctgaaagtttatacattgtagatatactccctccgtaaaaaaaatacttggctgctgcaatacggcaaggggattaaggctgtctttagatctaaagttttttttttcaaacttccaacttttccatcacatcaaaactttcctacacacaaacttccaattttgacgtcaactaaacacagcctaattacttggcttgttttggctcaggagttgtaccagcaacatgtactactagtgtactatattactggaagctagtacgactatcttgtagttgtagctacagtgagcttatgctacacgtgacagttccctttcgagctaagcattaacttgatgaacattagttaacttcttcataaagttaattaatatttgtctccaagaaacctaaaccccacaaattaaatctccacaaagatagtaaagtgcagaatacctactacggagtacccggtcaaaaaaaaaacctactacggagtatctagtagcacgccatcctttaatataaacaattgcagcaattacattaaactctataaacctagtaatgccagccaaatatttaatacaacttcaaacaacataccatcggatctagtaatgcccccatttaaattacttatcattttagtttggcctaaccattaatttttcgaaatcagtacaatttaattacaaataaattagagtaaatttcataaactacatatactttacacgatttatcacaaaactacatatttaagaatttatttcacaaaaccacagatttagtgtcttcgtttattacaaaactacatgtacttggcataatatatcacaaaactacatatttaagaacttgtttcacaaaactacagatttaatatctccatcatcacaaaactactacaggttttagcaatgaagacactatatgtgtagttctgtgataaataaatacactgaatctatagttctgtgaaacaagttcttaaatctatagtattatgatagattgtacaaagtacatctagttttgtgataaacggagacactaaatctgtagttttgtgaaataaactcttaaacttgtagtttcgtgataaattgtgcaaaatacctatagttttgtaaaatttactcttatataatagaaatatatttcttatgataaatataaattataaatctaaaacaaactgtacgaatatatagagattaatggtcaaatatagaaatatccatgcagccacgccaagtcccaaattcttgtcttagagtgtgtttggcaccccttgctcccaacataaatagtgtgtacggaaaatagagcgatccattagcgcatgattaattaagtattagctatttttttaaaaaatagattaatttgattttttaagcaacttttgtatagaaactttttaaaaaacataccatttagcagtttgaaaagcgtgcgcgcggaaaatgaacgaaaggggttgggaactaggggtgccaaacatggtttacattaccgtccgtataccggccttaccgcaggggtagggtaatagaaaaaccgctgtaacctccttaaattcaaataaatttaaaaaataatttaaatttttgataaattttacacgaaacagctttaactgccgaacacacccttaatccacgtcgccaaccttaatgttcgtagttgccgtgaagagaggtttgtcagatcagtgtcgtcccatgtcattttcatgcccgcccatgtcttatctgccaatctccattcacgccacaaccaccttattcatggtgctgttgcgaattcccttcctcgtaaagttaataaatatctagctccaagaaacaatattaataacttttagttaaacgccccaaacctcccctaaaataaaaaagtccgaatttcccctaaactattatggcagtataaattatccctcttaatttaaaaaccagaaatttttcatcttcaacttttcatatcgaacgaattatcccctgacccactctggaacggttttagttctacatgatacacatgtgacattctagttagcatataaaataaaaaatgctaagactcaattgtcagttctacctcttctctcgtcactacatatgggccctaccttatatttttatgctacctgaacggccacgtgtacgtgggccaaaatcgctcaggagaccagtagcgaaatatttcaaccttataaaaagttaagggtgaagaatgtctggtttttaattgatcgagtaattcttgttgctacaacagtctataatagtttaggggtaattcgaactttttactttttttactgaggaccaccccatatcaatttttcaatttctctcttctcttccggtttcccactgcacccaagccgccatgttcttccacaattaagttggtggcgaccgaggtcattgagctgcatgataacaacacgctcgacgctgctgcacaggccatcacggctagcccaaaagggtcgtgctggtgcctacaggcgacactccacgatctgtcccgtgacatttgttgccgctgctggcactagtgatcaagccatgatcaccatggtcgacgaggagaagagagatggagaaggggtgatccaaaataataaaaaaaaagagtaaagatatctagctttatatgaaaataggtaactatatgaacgtttggtagatacatataccagccaaatattcgatgcataattcagacaaattaaaatatcatccagtgtaagtaggtagccatttttttataatcaagcttaataccgactaatcgtgaggacgcaattacaaaaccggatacgtcaacgtacctagaagcacgtaacgatgacaagtttttctgtgtgactctccataccatttttattactactatctaagaaaaattgcggctttcgcttttagacgggtcaccaacgagaacgacgagaccgcggttgtacgtactctccccacgtgtacagcccaaaaatcggtgacacgtagcagtagcaaaacccacgttttgttgggctacctggaaaggttttagacgcatgcggctgacgactgacgacgatgggatggagatggacggtgatggatgctctctttgttactacttcttttggtaaaaaaaaataataaaactactggctatactcagatacataaatagaagttatgttttctttaagacgaagaaagtagtattttggacaacacacggcacgcacggacggtccatactagtctcgtactcttgaccaagcagatgtgttggatgctgtaatgcccccgtgcttttcttactataattccacttctgttaacatgttttttaaaccgcactagaactttctacgtagaaattactttaaaatattaattaaatctatttttaaaattgataatatttaaaacttgattattattatacgttgataattacttttttataatattttaaaatttataatatttttacacgttgataattttttccttaactctcattttttttaatcagtcgcgaacagggcaccgagaggcagaatagtagatcgatcgtacgatctatcatatatcgatcaggccatatgcacgcttgcccagctagggacgtgtgaccggtagtgggctccggcctccgcggtcttgggctgtgtccactgtccaccgcttcgccatggatccggatcggccggctgcttgtgccgcgcgcatcgtctcgccggggagctgaccaccggctctggggactgggaagggcagatcaacgagaagtgaacagcgtgaagagaaaaactgttttcgtcaacaaaagatgcattttggagggtccaatagcttttagatactgtggtggtacctgccaaaaacgataatattattgcggtatgacaaaatataaaacaatctgggaatctttccaagtgaaaagagaatctcaaaacatcatcttattgatccacataaaataaaaattctagaccatcagatagagaaaaggagggtgaaagcggccgttggattggattagtaaaaaaaccaatgaaacgctatctagagctttctagccttctttcttgcagggggagagagacagtgcacatcaggcaacgattatggctggatgggctggcttggccgatcataaataaatataataattcaagcccaaagatcgaaaacatagctctaagagcaagtttaatagttgctcttaatatatggtaaaaacataagatcgaaaacatagcccactattaactccaattcatctatagccaatctaatagtcaattcatataatagttgtttactatactattagtaaccatcatgatgcttaaaggtaaaatctccaatgacaatacaatatcaataagacgcatgcatgctcgacgaaacatttgatagtgcaattaatgggtgttttttctaacattattggtgagtaaacatggcaatccattttactacttcaaatcggacaacaatatttcaaaccaataaaagaaaaaaaaacatcttaccttactattatgatgctatgctcaaacgtagacctataatatttagcaacgaagggagtaataaaattagtatttattttcatgataacatttatttattacatacaagatagatatatttgtattgtatgtatagatttttggtcaaataagttttccgaacacctattaagtacataaaaataatatgagaatggtagggtcatacaaaaatgcaaacgatgatcggtggcaatgaggcggctaaactgctaaagcaaaagctaaaaagatgattagggagggagaaatggcagcatagaagacaaatacaaaacccaaccctgtccgctacaacaattctaaaactctattctgcatataaattctttaaaaaacatacaaataaacccacttctcatatttataaaccacggatccactgtcgccgataagtatagctatagactaagtataatttatcagtacaaacaacgtgtaaatgtaaacacgtttagtacataaagaggttaaagtcgtgcgaacgtatgactgtatacgctagttaatcatgaaagtgggataatgtaaccgcaattcggttggaaaatgctataataatcagtataaatttatataaatttctagagcaacataaagaaaataataccattcgtgtttgtagaataatctgagtcaacgcacatgtgacatcgtgaaaatttttataccaacaaaaagggtcaaaaagggttggcagattccgatacatattctagtattttaga

SEQ ID NO: 106071 - DNA, 1062 bp, Oryza sativa
  unsure (1)..(1062): unsure at all n locations
aagcaccgattcctctggttaagccccaactaactctctccctccaggacattttttttctttaagctagcttatggaagtggctaagactgcaactatggcaattaatatcctaagttgatcacttaattaagccatccattcctacacggatataccaacattgttctaagcccatggctgttgaacaatacacatgaccctcctcccttactaatccttttaattgaaaagctccttattggcttcccacctaagcaatattgtcatcaaacatttagacataaaggtaaggacattcataaatgattttattttccatgtaagctattgtagtctcctgattcgttcatgtcgatgttcaaaaggaattctacttttgtaaacaactcacatgttgagaataaagaataaatccatcacataaatttagaatacaatcaaaattaccatctctccattttaaaaagtgtccctaataataccaagtttaggagaatgaaaatgccatgagaagaacaataccttttttgtataaaaaaattatggatggtcattttaaaatatatccctaataaaaccaagtttgggcatttgggcttggatgcttgattacaatttagtactagtgtactacataaatgtcttatctcctccacatgatgagtgtctaataactaaagcaacccctccaaaatcctcctaatcccttctcttaagacacaacccctcttcccttcttccttcatgccctctttgctctctctctctctctctctctctctctcccccttcccttctttcccacgcgtgccctcccctccttgccgttatctctccgttacaccacccgcctcacgccgtcacgttaacttccgccacaaaaaagaaaagaaaggcacacgcgctgtgcatgtccaccgccgcgaccccgcccnggctgccgtggtcgcggtaggcgccacgccgttccgggccgccccgaggctgccgtggtggacgctgcacgaaatcttgtgcttatcgatgggagccgcttgttggagggcccagggggcggcg

SEQ ID NO: 106072 - DNA, 716 bp, Oryza sativa
  unsure (1)..(716): unsure at all n locations
aaggaattgactgcnattctactggtaccaacacccctataaataaaatcggtacattacatcctccaactttaacaaccggtacaaatcaatatttttagtagtttgcaaagtggtttttactgacatgataggttgatcgtgcttagactcactaagtcagcatgggctactgtaggacccatgtgtcaacgcccactcttcttgtcccctctctttctttctccaaaccaagccaacaagcccctccgagcacgtccacttgtgagtccgtccaacatctagctccgagaggctatgatgcaacaggaggttgatgatcgaggacggagatcacaacggcatgggagctcaacaacgcgctcattgcaccatccccaagtcggcgctctctccctcatctcctgcgctacgcacacaaggagctcgaagctcctagcgaccacctcccaacggtcggacaaggggctttgggaggaggtcaacagaccgaggacgaaggtcatagcggcacgggaactcgaggagacgctcgccgcaccatccccaagccgatgctctctcccctatctcctccgccatgtgcgtgaggagcttaaagcttcccgcaaccaccccctagcaactagaccaggggctttgggagggtggtagactggggatagagggtgggtggcacgagagctcaggaggcgctcaactactatcctctttaa

SEQ ID NO: 106073 - DNA, 686 bp, Oryza sativa
aaaaatggttgacatataggtccaaactcatatgttaatatttgctactacatcgacagtaccatagacaatccccactaatttttgttaccttgcgctgttgcacacgccacccctcctcctctccattaaatacttcagatacacgcaacacacacaggaaggcacaccggatattcttcctccaaagaaccctatactggtggccttccctgggggggagcacaacaacagcatattgatcccggaattgattacgtcctggattctgtatgctcatcatcctactactgagcatgtataatagcacactataagcaagctataaatatattttaaatagaaaaaagaatagagaagaacagcgggctaaagatatatagccagctatagcacgaacttcaagatgtaatatgtgtatgacaggtgggaccagatattaatagtatagtaagcaactattgtatgaattaactattacattgactatagatgatttggagctagtagttggcgaaaattctgagcagcggttaagccctggcaacgaacggttttttcttttttttcctttcctcctttaaaaaggtataccccttaaaggtacaccttcttaaggtatatatcttgagtttggaaaaacgatggttttaaagaaaaggttttattcccccgtttaaattcaa

SEQ ID NO: 106074 - DNA, 931 bp, Oryza sativa
  unsure (1)..(931): unsure at all n locations
ttggaaagggagggtatggaagggtattgatttatanctaaagaaggctagagttcgtaanntatgctatttaaggatgtaactctantcatnnnccccacccccccactggttganatgnattacnttgttgaanccccnctnnanangagcaacactagcaacaaatctggaaacaaagcagcaaaaggagagagctcgatcgagaaaagatgatgtaaaatgaagtgaaatccgattacctcctttctcggttcttctctggaaaaagaaatcacgaggaaaaaaaaagcaacatgaatggatgaacctaccaaacgaaccatctctaccagaacgaacacgaaccagaaacaagaaagacaccaggcaaatcattcaaaccctcaccccaaaatttcaatatgaggacgcacagactaaatttgagcactggaagctcaaacaancgcggcaanacaagacgacaacgcaaagaggacacgccgaacaancngngcgacgggaaccggaaagaancccacctttntcgcgtcctatgaacagcgtaaacacagattcgtcgctcaaaagctaggttttgttgcaaattatttcccgagtttaccgccgaaaagtgctaagagttcgaattcatcgaggaggaggaggaagaggggcgagaactctgcttttatcgccaaaagatattgcaattttagcagcaaaaaaaggaaagaaaggtaaagggcagctcaccggatatcggcaaggcgatcacccgttcgaggcggcgcctgtgccgccgcagcgacggcggtcggcggaccccggcggcgccctccgcggtgtactccctcctccttcgacgtgggagaacaacgactttttccgagggcgggctggcacttgtagaacaccagttttctaggttcgggttcccgactaacct

SEQ ID NO: 106075 - DNA, 1270 bp, Oryza sativa
  unsure (1)..(1270): unsure at all n locations
gcgcggattgaaatccagtcttgtatcccatccatacgcacacaataccttcatcgtatgccatatggaatctggactaaccatgtgcattgatctttagcctaagtatcccacataatatctgaccgtccggacgtctccttatctccaagttgactcccaatccgctatactatctcgaggcgtcaagatcacctacacatgaatcaaacaagaaaccatatctcgagcacaagctatctccaacttgactcattgttagcaaacaacagtattacgtacacatagtatccatctagaagtcataaacacaaattatccacaaatatccaatgaaataacccgaaactaaaaccgacacatagtcgaatggtcagaccgcgggcttggtggtctgaccacacgtatacctctggtgtgaccggcaaaccttgaccggtctaaacggtccaattatccagtagtccctgtttatcatctgcaaatccaatcatctctaaacccacttcgncaataatctcttaatacccaaaccaataatctcatatgccaattattcatcatagaataacattcaaacacactttgatttaacaaagtatataanaagttttttcacaaaaatacttttcgtttgcaaatatgatgtttcgcttattccgcgaataggcaaaacgaagaaagtgttatcatttgagtattttcaagtcctcgcaagataccttttagcataaaggaactgcaagtacgttaggatggaccttgtgctacgtactttcagctcttcaagtaacttttgggctatgaacatgaaaaggcttgtcgactagaacatgttgtaaacatttgttaattaacaacctcatttagttagtttgtttgcaatatgttatttctcgaagtattagagaagtatacctatcagcatatgttcgaatcacacgacagtgaaacttgactagagaggagtgtaaagttcacttgtagggctagtttgtttctttctctagtcccgtagctgaagccttgtggacatggtgagcaataccttcgtaagtgtagacaatactgaacatcacaaccagctcccacttagatctctctgagcctacgccaaccaaaatttcagataattaatgagcagccaaatggaatcttggtgagcagcgatctacccaaacggcaaagcctgatatcgacgtgccttatcatctatttctgcaaagaaagggtcacaatgtagttgcatcctacttgcaatgctaatctg

SEQ ID NO: 106076 - DNA, 511 bp, Oryza sativa
gtgttattgatattcttactcggtacccatttatgatgaatcattgatcttaaaatgctctattctaaggtgagtcatagcgtacatctgaaaaagagtgtggccatggtatgcaaatcaacgtgtgtttgattattattctatgataaacaattggcatatgagattattggtttagatatttggagattattggcgatgtggttttagagatgattggattttacaagtgatgaacagggactgctggttatttggaccggtcagaccgggcaggtgctgccggtcaatccggagctatgtgagcggtcagactggctagcccacggtctgaccggccgactctgtgtcggtttaggtttcgggttgatttgttcgatacccgtggataattcgtgtttatgacttcgagatgaatactatgcgtatgtaatactgttgtttgctaacaatgagacaagttagtgagaacttatgctcggatatggtttcttggttgatgcttgtgtag

SEQ ID NO: 106077 - DNA, 953 bp, Oryza sativa
  unsure (1)..(953): unsure at all n locations
tgacattgttttagtgctagaaaaggattttcttttatttttaaccttatttttaatttaaaaaaatgaaccctttcaaaacttatttctaaaatttgaaacttttcgtcacaccaatcgacatggcgtgtgaaaataatactgacactccacctgaccatctgagatggatgtgtatcaaggataggggtggatatcgagctgggtcggctcggctcgttatcctaacgagctaaagtgttggctcggctcggctcgtgtgtcagctcgagctagctcgtttagctcgtgagacagaagaaggaaaagagtagcggcatatgccatgggatggggatgaagacaagggctaccgctcacaaacacacagattgtgaaagaaaatgaatatgatgatacataacgagcttgcactgatcgatcactacaaagcaaatgtaattgcgtggccggattaaaccagtactgcaacataaatcaggggcattccagaactaaaaatgcaaatgaggaatcaataaagacaaaaaatgctataagacatcaaaagattacggtctttgctgtgagacatacaaagatcgttaatcttttcgtggacaccgaaaaaaagtgataactagctgttggacacttctgacattattttattattttcagtttaattgataacgaaataaatttgtttgtaccaattaacttaagaagtgaccttttattatctcctaactgattgcgatgttttcttttgttcagaacacttgcgaacctaataaacatttgccgaccatgcgcaccaggcttaaccagaaaacaaacaaattagccatacaaattttactgtacattcctctccagatcagtttctatttatctgtaaattggtcatggtgagttctagctagttattgtcttattgagggtcttctctgaccttatgtgnaagttacatg

SEQ ID NO: 106078 - DNA, 540 bp, Oryza sativa
attgattgctattcgagctcggtaccctaatatttagataacaaaatatgatcaatatggattttgaattttatatttaattataaataacacaacaattaacaaaaaatgagaataaaattgtaacttgagggttatgattatttagatgtctgaattatttttttgatatattgagtgttaattataaaataggataagttagctagaaaataggagaggaggggagattcggagggtggaaagagtatgtacagcttttttttacctcatgtatgtaaggtgttagtagtggggataccagatttattttctttgagatggagatctaatggttaaaattaacgggtccaccaatttaaaagaaaattgacggtgtgattatagaatgtcacgtgacgatgtatgagcgtttatatgagcgtctatatgaagtttaattgtcttttagtatatataagtccattgaacttcccacgaacgcttttaaaccggcacgtggcgctcgtataaatgcttgtaggtcactacatgtcatat

SEQ ID NO: 106079 - DNA, 629 bp, Oryza sativa
tgcaagtggatttagaattcgagctcggtaccccattcggtggtctatccgacctactatggtaggtctaaccaaagcctggccggtttgaccgcaggtcctctcgcgatctgaccgtcagcctaaaaacagcacgatagaggttcggtaaaaacacgctttctcttaaaccaaccgttggattgagttgcaaactttacagaataaactagacaaaccaaggaacaactccaccacagggatttgcaaattacaaaacggtttaagagaaaacaccatcgattagggctggacgaaaagctcgtgtctcattgactcactcagctcttatctagcttggctcatttggatttattaacaacccaagccagggttttagctcgtttgttataacgagccagatcaagctggcccgtgagctgttcgcgagccaaacgagccaagcacaacagctcaagtacctagttggccagcagcaatatgaagcgaccaagctggcccatcaagaaaaagcccatgaaggaaagaaaaatactaaccctagatggagagacacgtacatgacctgtctctcgcactttgaattcccgatcccctttctactctagcatcgctcgctctccacttct

SEQ ID NO: 106080 - DNA, 661 bp, Oryza sativa
aacgtggcaatccagccagcatatcaaattaaaagaactcgtggacccagctgtcatccctctcctctccctaagaccagatctgtctctctccctatagctcactcgagcggccgacagccgaggcaaagcttatgcagcccgcgctggacgcagagagcagagagaactcgggtggccagcggtccaggcggggtgagctcaagcggctgacggcatcacgggagggctctctgcgctgggccaagggagcacccacgaggacattggaggcggaggcctccaacaccttgctgacgatgaccggagggcttctgcacactgatgcgcttcacaataactatgtgcgccacattagacattgaccacctgatgtgggagacatcgttttagcgctagaaaaggactgtctgtgaatcctaacctcattcacaatttaaaaaaacgaaccctttcaaaacttctttgtaaaatgggaaacttttagtcacaccaatcgacaaggcgtgggaaaactattctgtccctccacctgaccatctgagatggatgtgtatcaaggatcggggccggtatcgcactgggtccgataaggtcggtaatctaaccagctaacagggttggtaaggcttgctcgcgaaggacctccaggtctcttgtt

SEQ ID NO: 106081 - DNA, 663 bp, Oryza sativa
atgatagcctttgtgccatagtcgatgtagtcaaagcgaaggaaacgtggtcgatgaacccgtgcgtagatctgtcgaggtcgattattttcagccatgcgttgtactcctgggaaagcggataagcagctcgcctgcattgttttcagccatggatctcacgaacaagtaattgatgtggctaggcttcgaaggcatcgggcatccatattgcccgttcacgaccatgagcaccaacatggttgggagctggcaaaactagttagtgagacccagccatggcgagaccaactgccatgcgtcctgatagatacatccatggtaatttcctgatgtgacatgcagcgcatgtctgcgaccggtggtatcgacggctcaggcacatgggcatgtgcagaaacatgagcagccaaccgggtgaccattgttcatcctaataaaacatgcaagagccctccagcatctctgtatttctctctcttctttttgttgcaaaagaattatggctcttaataatggaaatcggatgatccgaactaattaattcaattgtgccgtaatttcacccaaactctagatactctgattacaacaaatgtgcatatagtatatttcacattatttgatgagctctagtcatccatggtctcggatcattcatct

SEQ ID NO: 106082 - DNA, 649 bp, Oryza sativa
  unsure (1)..(649): unsure at all n locations
gaagtgaaagcgcttccggtggggaaaaagacgccgccgccgcaaaaagctcgcaattcaattgcgtggttcgtaaaaaagaaagagaccgcacganacgagtggcggggaatgtatgtgggacgttggattccaatctaatggttaaattttggtaagattttggagtagggaaatcttccgggtgatcgtaaaaatttgaaatgtacttagttcgtctcaaaatataagtatttttaaattttgaaacgattttcgaggtatactttaactaacaatatatataaaagtgagatgttttaaataaaaagagttgcatattatgatagtttgttcaatgataaatctagtagcatcaattttgggatggcataaggagattgagtctcactcttttttgaaatagaattacggaatctagtttgttcaatgataaatctagtaacatcaattttatcaattttatatgattgatttttttatgttttcactagtaatagtcaaagttaaaaaaaatgtttgatttagcactattctaaaaatccttatattatgggacggagatagtatcataatgtataagtcgcaagataaagatagacctataagttaaacatgtcagaatataataatatatttgctatcttta

SEQ ID NO: 106083 - DNA, 501 bp, Oryza sativa
gggcctttgtgacatctactcgtacccatgggtactctactgtcgaaaatgtttcctgggcttcagggcaagtaaaattaaaaagagaaggtaaattctacagaccaggaaagggtgctggtcaatgattcgataatggcaaattctaaattccttttccttgagtttcacatgtatcatctactgattctaaacgagcatgtactggcctgatatctgggacctcttcaataccttcagtgggctgaggggaaaagaactagttagatttcctccagatctccagaagatgataaaagtatgggcagaaattcacctgcagatattctaggaggcaccatagtaggtagttgatgatcataacaagacaaaacagtttgcctgcccaagctccacatctgaggtatctacaccattgtagaaaaatcagatggactgcatccctatatatttgatgccccagtgcataaaaattgtaaacaaaaataggttaatgtttca

SEQ ID NO: 106084 - DNA, 799 bp, Oryza sativa
gtctatggagccagggcccggccggcccgtatagggctccgggcttcccccgtgtttttccctccctttagaaccttacccatgggcttccatccttgccccgttttagattagcccctatttcttatccttccctggaagggtagcccgcgcctttcgcgcgcgcatgcatgtatcataggctatgtttcaacccaatgtaaggccgacgatataaaatggaggatattttcagaatataaatcggaaaagaaacccccacatatacacgggcatcttatttgttgttcaagaaaaagaatgctaaaataaatcatatcttagtatatacattaatacatatatcctgtaagggaatatagattcccctaaataaaaaaaacaaatatatttgccgtaaaatagatggtatagattactaaatgtgatagaatgtttattagatttaagtaaaaatccctttgtcctggtcatatataaactcgtcttttgtcaccactacttactatcattgtttttgaaagttaggtgcacttttaataaaagaaactgtatttgtaccactaaaataaatgatacattatttatacgctaaaaatatcatctacactgcataacccagtgtgcataacttattttcacatctatgtataaattgtctaaaaatatcatatctaccagataatacgataacaccgttaaaaatattcatgaatgattttctaacagatgaagtcgaccgtagcagccaactaaggctttcttacataatgccttgaaacacgggtttcgcatcgat

SEQ ID NO: 106085 - DNA, 790 bp, Oryza sativa
atttatttgtagcaagaaccccttccatatttggggtttaattaaaagaacccatggcccaaaaatttggtattagcgttggccaaacgtgcaagttaatataaaaggcctcacattttaagttgtcatctggtgtaaaatgtcatggtggtattaaccacctagttcgattgaagacgtatttacctaaaatatggcataatgaacaaattcaattcccctgagagcatagtgtataatatattaggtggggctgaaaccacaattgttctgctatttttaggctgaaaggtgactggaaatctagttaattgcaactgctgcaacataagctacatcagtcaacagattagcattgcaagtaggatgcaactacattgtgaccctttctttgcagaaatagatgataaggcacgtcgatatcaggctttgccgtttgggtagatcgctgctcaccaagattccatttggctgctcattaattatctgaaattttggttggcgtaggctcagagagatctaagtgggagctggttgtgatgttcagtattgtctacacttacgaaggtattgctcaccatgtccacaaggcttcagctacgggactagagaaagaaacaaactagccctacaagtgaactttacactcctctctagtcaagtttcactgtcgtgtgattcgaacatatgctgataggtatacttctctaatacttcgagaaataacatattgcaaacaaactaactaaatgaggttgttaattaacaaatgtttacaacatgttctagt

SEQ ID NO: 106086 - DNA, 503 bp, Oryza sativa
  unsure (1)..(503): unsure at all n locations
gtaaagttctctgggcccttcttttccaaccttccgttacacgaaacctgtcccttttttcctttgaaaaaggggggttttttataatacacgtgggatttaaagggggagggggtctcccaaaaggggttgttgcaaaaaccccttttaacccccgcgggctttttgaggaaattttttgggtccaccccggagaaaatatattttcctcggcgccccttttaaaaaaataaaaagggggtggtgggggcccacccatttggggggggcgcctctctcctcaaaaaaaaaattttttttctctcctgcacaacccccccaaaagaaaaggagttgtcttctcacacaaacacgcgcgccgggtttttgtttgagaccaccccccaaaagaaaaaagaaaaataaatttttttttnttcgcgggcgcggaacacaaaaaaacggcgggggggttaaaaaaaaccacacctcctccatacaaaaaaaagttaaatcgtggtgcg

SEQ ID NO: 106087 - DNA, 1349 bp, Oryza sativa
ctgggtggatgacctagaggaaaggaccgctggtctcggtgagcagggggcaatttggtctcatcaagccatattccaacgaaaatggaattgaaaatgacaaaaaatggagaaaataacaaagtggctgtgatcacgcgctccatattggcattttagcgaaacgtgttttcgggatggcattccatcgaaaccatttttggaacgtgaccaaatgcccattttctcatttaaagtgtctctcaaaatacttatcactcatctatcaccttccattcaaatccctctccccccaataaataaataaataaataaatagtggatttactcctccctctttccccaaatatgtgcaactcctaaatggtagcttgcatcgatgtcgattttatgcgacaccaatccattccttgccaaaaatccaatcacccatgggatccaaggccgcctcttgttaaataccacgatgtagaacacttgatttttcgttgtttttgctcgccaaagttgttgtttggccgatgtcatggaaaacaactacatctatctcctctcctctcttttccacgtcaacgattttgttttgctggtaactgagagatagcaaatagaaacctttgtatgtgtccttgtaccctcctaacaatatactatcattagtattatagtttttttttaaaaaaaacttaatatatgctaaagtatttagaatgagtagtatagccggaagaaattttatgacagaaaacctaacttctgttagataataataacttgcccgtcagatttgcctccctatcactattgttcacacaatcacactgaagtaggagtaggacgtgactccggctcgggcgcatgatgggaggaggttaaaatcggtgctaacgtcattatccgatttacgtgtaaaactattttaaattgatttttctcttaaattacttatccaaatcatgatccgattacaccattaaatttgttgcaattaaatcttcaaaataagactacacatggatatattccgatgaaaaaaattagcttattattgaattatttttaaatattgcacgatattccaccaggtatatcggaattgtttcactaagtagatcgaaaatgtttcacttgcttaaatcgggtattgtttcaccttatataaaacaatgtttcagcaaatagctaaagaatgtttcagttcactgcaacatttgatcccatatatagtgaaacattataagtacgctaggtgaaacattttttggtgggacaaaaaatgcaacgaattctctatagaaggagtttccaaaatatgtgagttttttttttgtggcaatagaatattttag

SEQ ID NO: 106088 - DNA, 577 bp, Oryza sativa
catgtaccgtgattgaccccaacacacactacgctacgttttttactagtcggctcggctgctcgttggaacgttcgttgcggacgcacgcgctacgagccaacgagaggaatcgtggcagtaaagcgtcagcgtacgcatccgcgcgcgacgactttgaaggtagacaccgtgcgatcgatcgatcgatcgatacggcaggtggccctgtgcatcgcccgtagccgggcttgtacgtctccctacacatcatgtgcacagcttttaatttttttttgtgtgcgtcatggtgtggtgtgtgtcactgcgtggcgcacgaacgtacgtgtacatgtacgacaacgacccttgacccccgagcaaaaaagcgtgggagacacgcctcgtactcgacgttaaattaccattctactgctagtcatcgcaaattacaagtggtatatagtactacaaacgtatcgttcgtcgactagtattgctgtaaattttagccgggattaatacgtgtttgtgcttggcgtagcatggcggctgatgaatggtatggtgtcggttttagccggggtcgtcgagtcgt

SEQ ID NO: 106089 - DNA, 1106 bp, Oryza sativa
atctatctatcatcactaattcctacatgtgatgtattgctaaaagcatgtattttttttctttttattcttgttttgtgctactgctaacacaattgtccatgaaccacacctgtattttttttccgtcctccgccactgtccatgttcaaaacaatggttcaaaatattgactgaaaacgagcacttctgatttcatggcttcaaacatgcggacaatctcaataatgaactttgtctcaccctctcatgggttggatcataactctttaataaagacacattcacataagatgtttatttctccaacagttttgcatgtgtgatgaggactgatgggtgtatagatcttgtgttctacatcaagagtccccattgctacaatgttctttatagtgttatagtgtgatgatttccttttgatgaggaagaggatttagaatcacaactgattctctcaatctgagaagagacttctaaagggtgtcaccgttatggatatgcacaataggatcaagtattttccggattccatctatatcctctgtgatgttatttagtgttaaagaacaaaatttcttaccttcacccaagtgaagaagcatatcttgcttggcatcaaactaaggttttgtgcttgattggttgtttcttgaagcaaagcatcttttcttcaaacttttagaagtgagatctcttgcaaaatttggtctaattagatagaggatattataaaagctctagaaagttattttgaaatggagcctcaaactatgtttccctacatgagaaaaggtaaagaaatcggtacaataagaaaataaacaagtaaaataatattggggatcaaaatagtgtccatgacactttaaaaaaaaagcgtatacggcgcaaaatgatagacaagagaatctctactattctaaaaattgaagatatttttgccagtactttggtatgtcattcgtgtatgagtcgtttttaagttcattcgcttttgcaaataaaactccgtattcgagtcgggctttaagttcgttcgcttttggaaatgcaaaaggagtcgtataagaaatctttttaaaaaagactcgcatgctaacttg

SEQ ID NO: 106090 - DNA, 600 bp, Oryza sativa
aaatcagaaactgtgccttgtagaatatagaacataattttaataaagctctggtcttagagagataaatgaattgtgcaataccatcgtgttagagaaatatctgagttttagtactgacaggccatcgggctagagaattaccaagtgtgcagtactaagttttacaaggatacagctggtatctgcatttttagtaattaagtagtttagaacgatgcattttcttttttaaaaaaattgtagggtaaggctagctgagttcaatttatgtggaatgaagaacacgtttaatgctgctgctgttgactttgtttttgcattaatgatgataggtatacatagtatctactgcaatgggcaaaaaagtgtctttagcatttgtaagatgcaacaactgatactttcctgttctaactatttcaaaaagctgtgataagctacaaaactctacctggatagaaactttcttgaactgagacacttgttggaatactctacttatcttattaacagcatgtctctttgtttccacattgggctacccgttctcatttgatcgatcatgaggactttctatgtgcttagatgtgttattaa

SEQ ID NO: 106091 - DNA, 688 bp, Oryza sativa
tattaaaagaaggggccatataagaacccaatacgagattaatcgaaattcacaataaaaataaaataaaatcctaaattagaaaataaaaggagagtccaagtggaaatataatttaaaaataactgaaattcgtaattgaaaaataaggaatattgagataggagtccatataagaacccaatacgaattagttaatattcggaataaaaataaaaataaaatctgaaattagaaaaagaaaagaagagttcaagttggaatacaatttaaaatcaactgaaattcggaattaaaaataagcaatattgaaaatataaattaaaaataagcaatattgaaaatatatgaacccaatacgagattaattaaaattcataataaaaaataaaataatatccaaaattagaaaaataaaagagatttcaagtaggaatacaattttgaaacaactggaattcaaaaaataaaaaataaaaatatttaaagaacactatactgtattaattaaattttgaaaaaaaataaattctgaaattaaaaaagaaaaaagaattcaattaggaatacaatttataaataacaaaaattgatgataaaaaataaagactattggaaaaaaaagactatctaaaacacatgacgagataaattaattaacatgcctataaaagagtagagtggtagc

SEQ ID NO: 106092 - DNA, 591 bp, Oryza sativa
caacctaaaaagactcaaattactgataaaaatgagctgtgaactgaaaacataaacagacaaagagctttccaaatgcattctcacctcactaggtaccaatagctgtctagtgcaagatgataacttgacaaaacatgatggtttcaaaacacagttcagccataaacgagtcagcaggcaaatggtatctagtaaaatgtttttacaagctcactgctcaccacaggcacagcaaccatgctaagttgctaacaagtaacacagagctggtttgtcaaaaatccacaggaaataagaagatgccagaagcacttcgatacaacataaagtcactgcacttagcaacatttaaaaccttttgcggtttacctctgcaaggtattttgtaacattgctttgacttccattaacatagtggtcataggaagagtaatctctacatttgcaggtaaaagtcgagacagtaacattacgatttccttgatagtgtaagcatacacaaaaaaaaattactctagcaatgatcgacagccaaaagcccccaaatttcataggtcaaactttaatgcctaccaccagggcactttt

SEQ ID NO: 106093 - DNA, 983 bp, Oryza sativa
cgcgcccgctcgagagaacccggagagaagataagagaaaaaggaaaaaaaaaaaagagaaatgtgggacccacaccatttcctcacttacatgtaggccccacatattaatattaattatttttgctgactaggatgccacgtcagcgaaaccacccatgtatactgcctagggactttgagtgaatggttttttgtggttaatggatccaaaaaaatcttattgttaagttgagggacctccggtgaacttattccttttcgtcaactgttttcatgatttcgatctctcgcttgatttccacccgtctcctacctgctgccgtagattgtatcgcggagataacgttctgtttgtattgaacctttcctttttcaagcgagttattagaaacttcattaaaaacttttaactgtatccgcatgtccttcgcagattgcatctgaaacaaatccatatcagggtccttttttactctatacaggcacaccaaggtccttgtaacttcattttagcagtggtttttactatttcgcttgtctttgtaacattgcaatctgcaaaagcaacctcctgttaagccggatgatcgtcataatgagtattatgcagaggaggaataactgggaactaatttgggtcaagtgggcgtgtgtgcgtgtcttctgagttgtacgcgttcaacaagattaatttggagacaagatatgagaggtgattaaatccatttcactagtgtgcaatgagcaccctcttctctttataaattctgtaacggttgattttaacaataaaataaacttctacggttctacatctgctttcactgcaaacatctagtcatacaaaggaatattttgagccgcaatattaaaaaaatagggataaatataacaaaacacaaaattctgacatgaatataaatgtaaaataaatgattgcaaaatattaaaaaaacacatgaatgaatgtttaattgaac

SEQ ID NO: 106094 - DNA, 639 bp, Oryza sativa
aaaatcccttatattgtgggacggagggagtagtacctaagaccaaatacaaacatattactcataatacaaggttagtataaccgttcgcaactctctcgtcttgcagtatatatgctccctctagtcatatagtagtaatactttagactatgttcggttagtcccgagagaaagattaaaagggatttatttcacacctattatggtgtggaattactccccctcaaacccctccaatccgctttaaccccctccaaaccaaacaagggcttatgttttgaaaataaaataatcaaactttataacttttgtttctaaaatacgaagaccatacgtaaaattagttttgtataaattagttttaagaagtacttcaacatccataaaatcatatatctattggcatttttatttatacctatagtagaaaataaaggcttttgattttttatatttatactgtagtagaaaataaaaaggtacaggtgttctttttaaggccgtttcggtatcaaccggaggagtagcacacaatccaagccaaccgaaaaacgccccacgcagaaacccggccctataaggttattgcaggcttgcagttattacaattgacaagaacgatcactaaatcctggg

SEQ ID NO: 106095 - DNA, 682 bp, Oryza sativa
atgactttcaattctgtgatagatttgaagctatacaatatctttttatagattgtccttaattgattcatggggtgttttgctgacctcaatggaaagacaagtcacaagtgagattttcaaatcaagatttggttagggggcacccctacgaaggattcaagattgaactaccagaagtccctttttttttgccgtcatcactgttgtccttgctttcacttgttagtttttcagatatgtgataccgagatgtttcgcaaaggttcagttggatgtaaagtagcagcacaaaacttcagtgggttatgagatgtcggtatgactgagagactaatactattgttggtttttttgcttggagctgacctggacccttgcttgcaagcaaggccttgaacttattcatcgatggatgcattttaccttgtatacgcagcacggcgacagcggcggggtcagagcacggcaacgacggtggtgtgcaaggtttccagatctgtgtggaaggtatctgcactgcaacgacaggttatagcatttcattttgcaggttagcagctggtgaactgcaatctatcaagatttcacgcctgccttcagttttatctgttagctaatgacagctagtgcacctttgtgttttttctgctctgtgtattctgctggtttgtgaatagat

SEQ ID NO: 106096 - DNA, 1021 bp, Oryza sativa
atttggggtcgtcgtgcgccgtctccatccaccttgtgctaccgtgcttgccctcagccaccgtgcgcccccgtgttccccattagccgccatgcgccgccgtgctcgccctcagccgttgtgccccgggatgggaaggaggggagcgacagtgaaaggggaagcccatgcgccggctatttccagccggtgcgtcgttaccgccggccgcttcctcctccaccgtgcgccgtctgctgcttcgcctcctcgctcccgcgagctggaggtcggggaagacggggtgaagcggtacgggagagagggatggggggtagggcgatggcatttgcgggtaatttcatcgaaaatatatgggcaattctataacgcggttggagttggagttcaggagcgaccaaaatgccgctccaacccgccagttcaatttctcagagcgattccatgcgctccgctccagctttgaacatatttggaccgtttggttggactccagctccaggtaagttgaatctgggagctgagccctgccaaacaggccctaaatgcccttcgaaatgtagaagggttgatagttgattgatcgactagaagatcgataaaatatgaaagctttcacatgcctttctaataaaatatagaagtgtgttgcacatttcaaggttttcaatttacactgacatttttcgaaaatattgtttatgttttatgctaatataagtatcttttgttgatgttcttttatgtaaaccatctttcacgtgctatgcaatacacaattatttttcatatgcatctatctttggttcctacatatattgtataaaaaggctatgtaaaaactttcgcattttttggaacttatagtgggtttataaattgtcaacccttctatgatttgaaggatatttgaagtttttttttaagtattcacccccaatgcatattgtaaaaaaaactgacagagtcatggtatataatagagagaggcaaaatcgatgacaaatcattgaattagagt

SEQ ID NO: 106097 - DNA, 1393 bp, Oryza sativa
tgccaaggtcacccatcccccagcatgtagctggtaccttggccttgcaaggtcaagaacattataaccaattacataaggattttcccacccttgtgcaagaggaaaatgataatggtggcataggcttgatctcagcccaaggaggatacctaaactaaagatgatgtactacatggaatgctaacagtctgacataaccaaagatgaaacgagacctgaaagtttaggaactgggaagctgaaggtgatcaatgtgtatcctcctttcagccaaaatgccaatttatagtaatagaaaggcaccaataatggcaatggttatctacttgttcagaaagagctattttaactaggccaactgttaagagcttaccaattagcagataatattgccggtgaatctttgtcacatccaaaaggaaagtgacactttgtcacatccaaaaggaaagtgacaggctattccactgcaccctacagaattctatttatcagaggaaggctaccctagctgatagaggatgtctgacgcatattctgtatacagcattaccagtttgccacttagaccaaacctacaagttaagcacagtgcagcgtactgtatatatttattaataatgataaactccatgccttcatcagttttgctctacagaaatgatcagtatatatgatgccttcccatcaatagaactactactccagattatttctagtttatcatggaaatcttgtcagaaaattatcaaacttctcaggtatcaggatacctgtaaaaatctcatccaggactgtagtctgcgatatcttactttcccctagcaggatttgcaaggcctatatggccataccatttgttgaatatattgctacaaaagcatatttttatttaagggataagaatcaaacttttagattgtataaattatgcaaagctaaacctcattgtattcataaggcaagtctggacagtgggaaagttccaattatacagctcacggtttattaaaagcaacaaccttttaaaataaaaaccaaccttttaggtcatgtcaacattgctaaagactaccttcaagttagtgctgcagatagggagaacttattaaaaacttattgataattcaagttctacctacaacagtacttacaaggtctcataaagaaagtatctgcatacatttccatcactaatcaagacatcactaatcatcttgcaaagaaacaaaatcagctcagtgagggggtgattggattatatttaatcccaatactgtttgctatttggaaataggagagagattcagtatgcaagctacaaaaatagatatgacaatgtgaccaataagatgtaaaataggagaacctatctaatctttatagaaaa

SEQ ID NO: 106098 - DNA, 1191 bp, Oryza sativa
ccgggaaggacgttaatgacacttcctaacgaacactacatgcatctgattggttaggctatacggcatgtagaactgattaggagccgctgcatgcatcgatttaatacgctcacaactgattggccagccacccggcatgtaaaattgatggcgttacattcacggatacgaaacgctaatgtatgtttttgatgctgattaagtgctccacatgattgtcttggtattgatgcacaaatcatatatgaagatcgattaggaatggagcgagtatgacactaataagcagactgcgacaagcgaaactaagcaaagttacgtgcctgcctcctgacaagataggcgtaagcatagtgagagaatttttcaccacgcatacaactcaagcgcaatttcaattcaacaagcaagcatatttcatttgccaggccgactggccgagtatttgggctgtacgggcggcggccgagcaagtcagcctaggacgatatgccaggaggctaggacgaaaggaaatggctgaaagatgcggggagccaaggacatgaaaggactgaaagatgggggcgtgtgatgtgactcgtgtgctcacgtttttctttcacaagctcaaagaaagctgaaccaaatagaccaaaagaccaaaagacgaacaaatctgtgactctcgcacagtatagagacaaggaactaagtaatatcttactaggtgacctatctgcttacgtctatttttctcccacatctatacccatgcaattgagatcctctgtggtactgcatgtgcagtactgcttactgacatctgggcccgaggggctgtggggcccacatgtcagtgagcagtactgcatgtactgcacatgcagtactgcagaggacctgcatccataccaatgctactaaattggagtagcactttgcgggagcttgcaccagtgttcacaatctttattaattccaaacgatttttgtgaattttgaacatctcgagcatgcttagatatcgaatgggggttttgttttgactttttaaaattcatttggaaactgtgaaaatcaacgtatcgatacagctcgaaattcgctaaccaatcaagattataaatcatagcttccatattaacaaaaaagatcattgttgattggattgatcgagcttatattctacgaagtatgtcatattaa

SEQ ID NO: 106099 - DNA, 689 bp, Oryza sativa
  unsure (1)..(689): unsure at all n locations
ttgttatcnccaaacnngttaaaggnncggttattagctcacctcattttttaantcaatcagtctcaagtggtagagcaaaaatgagtcaatgcagctacttatccatcaatagattaaacaacagaaaatgtgaccaatgcacaagattataattttcctggaatcaacatcataatagaggaggaatagtcaaatagaggagccaattagacaacaacagtcacaaagtaccaatcaacctacgcttgcaagaattgtccaagaagaaagctaatccagtatctaccagttaacacattcccacagcacccagttggttttcttatcagcaaacaaaaatgatagaacatacgaacttcagtatcctatatgtgaatcaaattgtcccctcaagaattaacacattcgtaaatccatgaaaacatcagagatcagagttaacgaattcgtcaaatcagcacaataacaactagaaatgtcatagcatatctgaatatgcttaacaagaacaggcacaaattggggttaacatggttccacggtcaagaagaaattaagtatatgtccagaagctttattccattcaggattcagctcatcatttcataaaaaaaaatggaaaactgcaagggacctggccaagaggcgaggtcccgccgcgcgcacgcagcacagatcgagcgaat

SEQ ID NO: 106100 - DNA, 611 bp, Oryza sativa
atgtcgcgccaccgcaccgcccgtcgccagctgcccttttccacatcaccccaccgcctggcccgtatgaggagaaaactgggaaagagagagagagaaggaagggagagaagagaggaaagagatgatgatgacgtggtcaccctgacgtatggggcccacatgggtactatactaagtcagctgtcacgtcagacaaaactagagtcaaaactatcgagggttctagtttgcactggttttataagttgagggatgcgttgtatccgattttacggttggaggacgattttgtaactcgatgacaaattgagggaacttcggtgcacttttttcgtccgcgattcgcaatctcccatgggccaaaggtagtgggtcgtgatgggagcgttgggctataatccctacctggctgttctctcgtgtgggcttaccatcgcataaggccggcttgtttcctttggtttgcgttgtcaatggtagccggcccagttattgcccggttggccggttatcgacgacgacgaatagcgtaaaagtcaagccataattcgatagattttgatgaaatttctgtgaaatttgttgataaccaatcccgttatcgtgat

SEQ ID NO: 106101 - DNA, 1720 bp, Oryza sativa
ttttaagtttcctcaagggttaaaaattagcacattctttgtttttttttcaaagaaaaagaaaaggaaaaggaaatagcacctgggctctactaggggctataatgaaagaaataacacagatatggagttttttttttaaaaaaaacattttattgtttgttttctttgggcttaccacatcttaaacgattggaaccaaggtctaacttatttggactttaaagggttgtgcaaaatagatgatacgtaatagaagacattgaatgctttacattggaagaggtttcgattgcgagactttaacaatatgagtgtccgttttacatattatcggtgtatttttcttttctcaaaattgaacaaaaatgcacataggtcgagttcctaaataggaggatttttttaaaaactttttacatatatagttatcattataagatgctatttcaaatccattctttttaatcttgtaataatagttaaattattgtttgtatgttccattacattgaactcaaaagaacacacctatctccctagaaagtaggagcaatggagcaccagctatatgaatacaaattaaagatccttttgtgaatacattatctaaaaatacaattaaagatcctccaacttttcctcgagaagaaactctctcgtgtaattttcttattcgagtcaaccagctttcgtgtgctcatgttctcaaaaagcaaccaagaaaaccaaaatttgtccggcacctgtttacccggagctcgagcggatcttgctgctcatgccgacaaatcttgttgcccttgccataatttttcgtggggtttttatcccctgccgaaagcgtcgtcgccacgggcctcttctttggcgtgttccgacgtgccactgttcacagccagaacaaaccaaacacctcttacctgtacaacacatacccccccccccccccccccaatcccgtgctcccgccgaacgtgaacccgtcacgcaaacacgcttgcgcgtaccttgggcacacgtactgcacacagggcgcatttatccgcaaagctatcgaaatattcaggtctccaggatgattcaatgcagaaaagagctcattctctaaaccgaagtactagtaatccagtattgaattaatcaggttgtgtttagattggcccaaagtttaaagtttggttgaaattggagacgatgtgactgaaaagttataaaaagttacgtgtgtatgaaaggtttgatgtgatgaaaagttagaagttttaaaaaaaactttgaaactaaacacatccgaagtatggcattttctggccgaacggttcgacaacgtgatgcatcgaatcgaagaccctgggaagcatcgacgagttcgtacggagccgagctgacaccggagctcctccactgtcctgcactgtcgttccagcttcctggttaatgccgttttccgaaagcgccagatcgccaggcttgcagcgcgccaacacacaataactcaacaaggacggctaaattccacgcacgttatttccatcggcatccaaagcgatagcacgacaaacacagcgcgccgcggggggaaagctggacgaatccttcgccagtgcgcacatcggttgcttgttatttggcgcggatccgatcgccggcgatgtgacggcgtacgggggaaaaaaaaaaggaaaacacggagttgagaccgatcacgcatgcccag

SEQ ID NO: 106102 - DNA, 570 bp, Oryza sativa
  unsure (1)..(570): unsure at all n locations
agcccgggggcaaaaagagaataagggggttttaattccctcagctcggctctgtccgctctcatcaccagaggcaaaatgctaagcaagggagtggactagtggcgccgacgtgagcgtcacgacctgcgcgcaacggcagtggtaaactgtagcgcgttagttaagccaatgccagtatgccaccaccaacttcttttcttttctttgcatatatgcttagcacagataatgtctgaatgatcattggggttggtccagtaattaatccatttttttaaaaagtggtattaactatcctgtctggctgtctgtctcaattcttcagtggcaaactggcaagcagcaagcgttnaaagtcaaaatggagatccacatctactaagccatggatgtaagaatggtctgggtttactacctgcttctgctttctgtgtgttactgatcgggtaggtgaagatctgagtgggtacctgcccagccagtccgtttttgtcccaggtgatgtcggcttgtcccgttgaatcgggcccgtccatcacggcccaatcatagatctgcgcgcagggc

SEQ ID NO: 106103 - DNA, 697 bp, Oryza sativa
gcccgagtcaattttcttttgtttcctaagcctcattgtaattaattgtttcgtcgttgtgcttttgcttcgtcagttaagcagttagtactagctaatttcagatttatacctctttgtatgatgaaagaaaatgctcttagcatatttcaattatcattcattcgttgctggtgatcgataaaaaacacaagaacaactttaaaaaggattttgcattaatcgagagaacaaaaaaatgatctacctagtcttttagttaaatcaaaattatagcggtgttcatttagatacaggaattctgctctcgaatatcataaaagtgtagagttgttattaggctacgttcattcacaagccaaagagaggagatcactcgtttttcatgcatacgttttttagactgctgaacggtgtatattttttcaaaaaaattctttatttttttaaaaaaaaatcatattaatacattttctaaatttaaaataactaatacttaattaattttgtgctaatgataaactcattttgcatgtcttctttaatcttcttcttttccattctgtcaaaagctttaagttgatgaccccggtggcctttaatcctgactccgcccctgtctgtgggggctaaaaattcccacattaatcggagaaaaagaaaaggagagtccaggtagaactacaattcgggtacc

SEQ ID NO: 106104 - DNA, 553 bp, Oryza sativa
taaaatgaataacagatcagagctttccaaatttgaataaataaagggtaacatggaagtatatgttgtgatagcactgttcaaaatgaaacattggagaaagcagatttgacccttattgcaactctgttaagacattttttttcccaaaacagaccagaagaacttggtgtaaattagcaataatgcatggtaatgatagaccgcatactacatttcacagacaatggcacttggaaggcaaaccaacagattccataaaatgaaatttaagtatggtagacattcacagcatgtaacaaaaaaaaatctcacggccctttgtgtatatataacatggaattcaatcaccttctacgtatgtggaatgctaaaataatgacgttaaaatttctgacaaatttaagatgtgattcagactaaagtagagaacagcaattgcctagctagctcccaaggctgttacatgaaaataaaagggatttcctaaaactatatctatcagtcccaaatcatgccagtgatcaaagtatcttgaaactaatggtcataa

SEQ ID NO: 106105 - DNA, 544 bp, Oryza sativa
ataaaatccaataaaattcctatgaaatgcctattcccatgcaaattttagaggacatttttatcatgaggtagaatctcatggaaaaaaaatccctttgagtcttttatctcttctcaaattctggtgtttttcttgcggcctaataaaacggttattcctacgttttcctgtattttacaatcatctgttttagagctcttttgaaacaaaggagcaccgaaggaaaaccagaagatgtgagtccctatgaattcattcactgtagcagcctttgatttgtaggaataggtcataggaaaactgaaggaaatattccttcattgctgattctatgggagaaacacatgaaactttccatccagtctgagctcatttttcacttgctttgcgtaggctcgaggcaatcaagctcctaatctcttttttcactgcaggagaacaagcaattaatggatataatttgtgttagttattagaaatggaaagtgggccaagttcttaagtaaaaatattcttgtgtttttttataccccattcaaac

SEQ ID NO: 106106 - DNA, 761 bp, Oryza sativa
tttccatagagtccaagatcataaaaaacggactcctgagcgaaaagttatagtcgttttactctgtgcttttcggaagttccgaaaattatcggaagttccaaaaatggttgcaaaactgagtttagcttatgtaaattttcgtaagtttcgaaaattccagtcttttgcctccaacggctagtttttgaggggctcgggtatataaactcctccacccctcctatgagtggctgctgttcttgggcaacattagatacatccaaacccaaatagctatccccatttcccatcctttgtggtgcctttttgtgagggggatttgagaagggaagagagttggattgagagattgagaagttaagagctagtgagcttcactccatactttgagcactcgagttcatagcaagcaaatcttcgattgtgtttgttactcttggggactaaggtctcctagacggctaggcgtcgccggtgagcacccaaggttgtggtgtaccacggaaagtttgtgaaggcttcgctttcgcctccgcaagagaagaaaatcaagagtgaaaccaatgagtgcatttgtgcaacctcgtgaggaaagggttgaaatagacccggcccttgtggcccctcaacagagacgtaggatccgtggatccgaacttcaggaaacaaatcaacgtgtctcctctcttggtttgctcgttcttgccatctctcatattgtgcttgagcttgtttttgcctgatctacttgcatgctt

SEQ ID NO: 106107 - DNA, 641 bp, Oryza sativa
agcctgtagcaagacaggacaattttagataaagaaatattattcatcaaaagacatgcattttgtgttcggactcattttctaggataggcgggaaaatgaggtgtttcctttatccccaatcttattcatgaccttaggtcatgacacacatgacgcgcgaggttgcccctcccctctcctacgtggtcgtgccccaattcctgctttttttcccctgcactgcctcctaggtacactttttgtctgctcttcaattgctttcatatgtataaacaaggtgttattttatcttttttttttaaggataggtgttattttatcttattcgcgtaactattttttcctcagtttgaaggaggaacatactcgaactataatcgagggacgaacgacagactttcttttcatttgtttcttccgtctagccgcgttgaggaatgagccgagaaaacgaaaacagcccaactcaagcgtatatcagtctgtacacgcctacaccagagtccagtggtcctaaatcctaatcccggattcccttcccctcttcccctcgcttcttcgtcggtcgacctgcgcacgaaccaccggcaagggcgggtgattggcgcgatccgtgcgcttgccgtctttccggcgtt

SEQ ID NO: 106108 - DNA, 657 bp, Oryza sativa
agttctcatgagtcatgatccagccgaaccagggccgtgctgtcaaatttgtagaccctgtacaaggctctaagtgaggcctaaatcaagtaccaaatatagctaaaataatatatatactgcaaaacaaatgtgatatatcaagaatagtatattttttaactcttgttttgtataattagaaactgtcaaactgaaaacggagaatgtttgttgatgttgctggcttgctgcctagtgccttgcttgttggttgcttgctaagttgctattcgctagttgaatgaaaatgtgaaattggatgagccggctggcggcctggtgctcggaggagacgagacgtcgagactcgagacaaattgaataagtcacagatacgaaaacgaaagagaatacaaaacgttgtggggcctcggggctcgaagttgagaatacgaagcgccacgcacgcgaagtcgccacgcggagatacgcgcggactcgaacggggttctggcgctctagcctcatacaaatacatgtgccttctttggttgggctgattttttgaggccctagaaatttgcaggccctgtacggtcgcacggaccgcacacccctgtgcacggccctgagccaaacgttgagtgctccactccgttactacgatacgatgct

SEQ ID NO: 106109 - DNA, 606 bp, Oryza sativa
gtcaaccttttgggatatatactccatgctatcgtgctgtgaacaaggatcactcttaagcttaaaaaaatgtctgttggatgctggtattgattttttgcttgaatttgctcacatccttttctgctaccatcggcttcattggttcacatcatttgttgagaggatagtttgttgtgaaggtcgtaacggttcagctattgtaatgcgtccgccatccagtgatctgatttgctgagttctattcgtgcgtatgctatttttcttgacggtaagggttcagctatgctaatgcgtccgccatccagagatctgatttgctgagtttctatgcgtacgtgtgctatttttcttgacggtgagtgaaccgtcgagacgggccaccaagttccttgtcgcgcctataatgttagggcgcctcacttttaacggagaatatatgaaggaacttcatgaaaaactcatctaagcaaaagtaggaacatgttattgtaatttcattctcaaagcttagcttcttttgaaataaattatatagctccaagggcagttctcaatggtacaagctgttgtgcccggctaaaaaatacaagttgttgtcaaaaa

SEQ ID NO: 106110 - DNA, 592 bp, Oryza sativa
tggatatgaaagtggagtgtgtgagaggtgattcccgggcttcatatgagttgagatagaatcattcattgatggtggacctaaatcacaaggatgaaatgtatgaagatcaagctatgtgtatcactctttctctccatatacatattgatatgttcatatataatatttccacgtgattgacatatgcatgtgagactaatgttttgtttgagtcttttctcttgtttagtctctttatattgagaacatgaagatgatgaaggtatacctttattttaatgcctatatttgacaaatgccttctattcttatataggattagctcctaatgtttccttctttttatgcatactcttgattgacacaaacattttgtatgcatacatcttgggggagcaaatcctatactttagttatgcatgtaattgatccaagttattaaatttcatttaattgagatctttacatgtgagcatatgtttgagatatgacacttggggggttgattgatactcatcatttatttatatccttttatacatgcgatcggttgggcaacatgtggatgttgacaaccggatcattggga

SEQ ID NO: 106111 - DNA, 649 bp, Oryza sativa
tgcattggtataacaagaactattgattacgggccgtggcaatgaaggagcggccttgtggatccatgcatgtagtggttagctttcttgccttagtaaacaggcagtacgcttgatgacaacaatggcgattgtagatatagaacactaaaaatacaaggtatttgctagaggacaatttaaaaaacaagggttttctaatggatactttaacctcttgtttctttgccatgagacaccgcccttaatagtttgtcatttattgccattttggatagtcaaatgacacaaagtgcccttcgaaaagggctagctttacaatagcaatgtgaagtgggctatgtccggacaaagaagaaaacgagaaggagcatcacgggagcatcaagtgcagtgagaaagaatggacggtagtgagaaaaagtgccaactagcgaatggacgaaatgaagggaattttggttatttagcaaagtttctctcttcgaatcagtaagaaatgataaacataatactcgcgatatctaatgggaaataaccaataaactagattgtcatatgtttttttaagtgtactccaataaagaccatgtttcttttgtgtcccatatcattttttggcttttatattttactaacaaactaccct

SEQ ID NO: 106112 - DNA, 1088 bp, Oryza sativa
  unsure (1)..(1088): unsure at all n locations
cacgtncttgatttgcaattcgagctcggtacccctggtacatccgtgtgttacccttcgtttgcttgtgcaagtgttttttaattgatttgaagaagctgtggttctgtgttacattaaaagaaaccaatgaagcaggacaagccatgcattacaattagtagcaacatagccatgtgctatgatggatacccataaatatgctataatctctagagttaaaaatacagaaacatatttatcctcaactctgatattatacaaatggctatatgtgatcaaccaaaaatctaaatacaaaaatatgcaaggaatgtgtttttatgtaaaagataccacaaacaactcacacattccctcatatatctagccacaaaagatcttgatggtgggatggttgtagaacataccatcacccccaattcctctaaggagtaaacattttaagatgattgcctggagtcatacttgttcttttttttacttgcaacaatctttatgtaactctttgacccagagtgaatgtttagaatgtggattaatgaatacctagtactccctccgtcctagattataaacatttttagagttggacacggttattaagaaagttgatagaattaaatgagggagtgttgtgattggaggagacgtggaggtaggtgggaaaattgaatggtggaggtatctgaccgactgggcagagcttgacctgataggaagagaaacggctaccggaagtggattaaaaaggtgaggggagggggcctgacaggggttgggggggtttaccaaccgggcccctttttaatttttttttttccacgcaggcacggacatatgcaaagtgagaaataggttagaactcacactntttcnnnnnnccnnnnnnaancnnnnnaagtannngncnnnntgggtnnnnngnnnnnnnnnnnnnataaaatnnttaaatggcactcnccctctgtnggnngntatattttggnnngnntcatnnnnnnnnnnnncccannnnntccccnntgttcnnnnnnttnnnccannntncaccnanccaantnnntttcaggggcctggtcaatttt

SEQ ID NO: 106113 - DNA, 624 bp, Oryza sativa
  unsure (1)..(624): unsure at all n locations
atgtaaanggtagatcttactcttgctgcacgccngcaggtcgactctagaggatcccctggcggcgctggcggcaacggcttcttctttttcgcggcgcgcacgctcttcggtttccttcttctcgcgttccgcacgctgttccgcttcaatgcgctggcgttcagccagctctgcacgtgctttctcttcagcttcacggcgcgctgcggcttcaatctccgctttgtgcttcgcttcggcatctcggcgggcttgttctgctgcttcgcgcttaatgcgctcttcgtgctcacgccgagcctgttccgccaggcggcgctgctcttcgcggtcacggtcgaaatccttgttcatcagcagagccatttcgtggtctgttcgaacttggccgccaactcctgatcgaacttgatgttcatttcagcgcttcggcgtgcagcgcgttcatggcttcttcagccttaatgcgttcctgctcggcttcccattcngtgagtgggcggcgggttgcgtcgcgaagctcgtcacatgcatcaacgaaacgcttaatttcggcctcagcaggtcgcacagcctctttcaggcgcttcaggtactctcggcccggcttttcaattgccg

SEQ ID NO: 106114 - DNA, 745 bp, Oryza sativa
  unsure (1)..(745): unsure at all n locations
tgtggtaaaaaaaaagggtaggggggaaggagaaaatggggaaaatgaaggagagggtggttgaaaaagaaggagatttggatttagagagtgaaggagggcggacggggaggatgtgtgagtttttaataagaagtttttaagaaaggagggagaggattggaaggaagaagaagaggagaggttgaaaaaggaggagaagaaggaaaagaggacggggaaagaagcaaagaaaggagtattggagagattgaaggaggaagatgtagggaaattgaaagggagaagaaaagtgagggggctgaggaataaagtgatgaagaaggggttgagaagagtacttgattctggagttggtagtgtaaagaactttgtgaaggagttcgagagaattttttgaatttttggagtaacttttgaaagggaaagggagggtgaggggtttggggggttcaaggggttagagggatggaagaaagattggaagggtaagatagggatgccgagggtgtgggtgtaattttatgattgagttattgaatgaaggagagaaaaggatttgtttttgagttgatgggaaaagcgaaaggttggtaaaattgacacagtgggggatatggattgtgtttaggaaaatgcaaatggaatagtttgataaaaaattgtgcattttttaaggttgagttgggagggggtttntanagtnnnnnggngggntttntacgagtaacctcgcatgagagtg

SEQ ID NO: 106115 - DNA, 2122 bp, Oryza sativa
  unsure (1)..(2122): unsure at all n locations
tatgtctcctgatctgctctgctatcttgctttgctcaggagcaatgccagagcatgcttctatcggcctatagggagatggtaagggcgtaaggctgtgcttggtcgaaactctcattgactgttcaatccaaagattggataccgcaaagcatggccggttcatgtgatagttcttcttgtttcacctgttaacaggtccttgctacggccgagttggttagagcttctcactctatgcgttgtttttccaaagtagccgcgaatagtccgttgatacggtttactgagcgccaagatgatatgaatgattcgggggacggaggaggatcccctgtattcaaatggttctccgtattagaattcggtgggttattcattttgtttcaatgcaaaacctgatttaagttagcatgcccccttcttttactctctggtcgatatgacatccaaccaactaagcgcgtataatctctgaagaacatttcctcgaagtcatgttgctgcgtaccaggtacatgccgggcgtagattatatttagcaaactgattcttagtttgcatataatattcagtttaacagtatcccatggatcagtatctagttttttatgtttttcctggttttttttattggacgatcctctttcagatcctcccagtgaaaatacattgcttttaatcaaacaagataaactcctgaatttaaattcgtttatttgtggtttatcacagagaatcttgctcaagaacttgtcgatatgttcatttcagaactgcaattgaaggtatatcgagagttctttttctattgttctatggtgatgcttattgattccagaaacagcatgtgcatttacttttagctttttttagccagtacaaatattggttttattatacttgcctgcttccttgttactttgggaaccttcctgacaatggaaattgtttccatatcacagagattgcttgtcttggaactcctctcggtaaccttcaaggaaggtgtacaacatgacgcatcattagaatggtccaatgagctatttgatggggagttcaatgagtttcagagtattggccttctgtcaggagatagctacgcactgcccaaaaattggagtgctggtgtctcaaaggcatggcaacctgatcaaaccccatcccatgaggttttacaggtacaggttgatgttttgagatttttttttttttttgaaaccttatgttttgagaattttggcatttaagacagaagaaagctcaattgatcctgtcttgattcatatattttacatcttctgtctggttgtcttcatagtaaagacaaagttgtcttatgtatataaagagttaattaatagtccatcttttgattggatttttttgtgcaaaagttagcatattgggtttatatcttttaactgctccagagtttcttttgcaggtttatttgacttcttggcttgctaatgtgaacatcaagacaagcaggtaatcatattattgtattattttatcttatggatttcataaactaagaactatagttattgaatcttgaaaataaaacatatctttttttcctcaaccttttgttatcatgaagttttcgcttctggcttgatgtcataacttgtgtgatagtaacagtgactttgcactatttcagaattgatgaaatatttgagcttgtcggggaggagatgcagataaaattgtcttgaggattctgatgcgtatgacttataagtaagaaaagttgatctatcctcctgtttgtggtttcgtttccttagaagtcctaaatgctaaaaccttatgtaatctgctcgaaccccaagggagaaaaccattctctcataatttagattttacaaacagaaagtttaacactaaaacagaattacttatctacccaaggttcactgaggaatcacgtttgagggagagcactgatcattatctgaaaagtcttaagccatcatccgctatcgaattaaacaaggttttgaagttctaaagtatattacccttagcttcaagtctgttctggctcatcatatatgtacataatcaatttgggtaccgagctcgaatntcaaaatcaatggacatg

SEQ ID NO: 106116 - DNA, 1875 bp, Oryza sativa
  unsure (1)..(1875): unsure at all n locations
attgagtctggaaacccttccccatttgcgggtccacagagaggaacccctaacccaatccgcacgggccgtcaaagtagtcccccggggggcgtcccgggggagggagggggggacgcgcgcgcgcaacagatccgatccgcttctccgccctaaagttccgaagccgatcgaggtaggtctccgcccgaatcggctccccggaattcgcggggggtgtggtcttggggtgtgcctgcgtgggggggctgcggggatgggtgtgaatcgggtgggggtgggagggggtcgtggcgtgaccgggggcttggggattttttttttgggaggggggaaaagtttgggggttcgtttgtttcatgggggatctgtgtgagtggggaaattgggagctatgtggcgctcgatcttgggtttttgtggctgggtttgcttgattgggtgctaaattttaggtttccgaggggtaatttgtgtgggatggtcgagggtttggctggattcaagctttagctcacttcagctgagttcatctacttgcttaaaagtgtaggctcgtgctaagcagcgcgggagcgtagctttgggttgctcttggttgcatgctccgggattcgggcgtctcctggcggcggagaaacgtgggggatttggggtctgcttcagtagatgcgttctctttatttcgtgtggccacctttttatggttcctttgagcatcgaggtctgagttgatgatgcagagttcgagctaattcgttgttgtctcctctgcatctttggagatttacaggctgcatcccttttctaatggtatataagtgggccaaaatggcatctttgagcttagcaaatagatcgtatggtgtgtctgctggtatcgacattttcagctttattttctcctgcagatatgcttgctttggtgccctgcttaaggggaatggagtntgtctttgtgatttcaagctggctgcctaattatagtgatagtatttatgaatctgctgacatagttgtgatgatgtgttcaagttcaagtttctttgttttgaattcatggttctactctgttcgcttttcctgnctcatagcttccgaatacagcatgagtttagagatgccatttcggtcgtgctaactaatagtgtttcctgggagatacgcttaacttagctgagcttttgtgtttattttttcgtctccatgccagtttcggtcaagtatggcactctagcaagtgagcttaagtagtgtgttgtttcatgagctgttgtgtctcctgtgcattgatctgcagcactcgtagctttcttcacttgccaccaacaaactttgaactctatttacataattcaaaccggaaatgcaacaatgtcttctttgaagattgttggtgcacaaattgaatccctccttgctacatttatcgacaacgtttcttaactctaatacagatgtagatccacttttgttgttgattacttatccaggaatgtaaaatactaatcttggtaaattgtctcatcaccattcaaacatgactacatatttttaattcaagtagcatagttcctatcaggcggtgcattgtgatgatttcaattaagtattgcttaaggttctaatcttaaattaacacaagaataatgattctgtagtctaaaatactgcagacacaattctaattggatcaaccataccgctgaatgttaggtgcaatcctttacaaaagcttacaaatgatgcacgtctatgcagatccatccacaaaagatattttgatgagaagagtatgggggtagattgcacaatcacaaccaactccttgttttaaatgggagataatttacacctgcttaatggatacttact

SEQ ID NO: 106117 - DNA, 731 bp, Oryza sativa
tgacaatgtagagtataatggtacctactagtccaccaaaattcatgttcaaattcgatctacaaatcaagaaacaaaaaaaaacaaatttagatataaacagtacgctactattcatacgctgaatttgtcttttttatatctcgacgtttgagttgagtttggacttaagattttgtaaagttatatatatgtgttgtatgaatgttgtcaaatttttccagaatttttcataaccgtttagatggtttttgagtaaacgagggaacatcccctcgagggattagaatagtttccccgcatacattgcctccatacttgtgagaggcactattgcatcatatatgcagttctctatatatcaatataattgtctgttagcttatttctttatatctcgctttgctttggctgcctccacccaatcatttgatttcgcgtcttagtttgccagctcaaatcaatctccatggtgcatgtacacatgcacagatcatcagtgctgaactgctgatacaattagtaatgtactgtaccagtatagaagtttctttttcagatatatgcgaacctatcgatatataatatcggtgtcatgtccatgctcgtctcgatcgatcatacagatactacaccggaggccagctggctggcgctatctgaaccatttcatattcttgtgttcattctgaatatatattctgaatggactcgatgatgatctgaaccct

SEQ ID NO: 106118 - DNA, 1061 bp, Oryza sativa
cgactaggagcgacgaggtacgtagtagcatgagaacggagcagattcagagtcataagagatgggagtagtagtaggagggggttttaaaagaaagcggtcataacggcttcccctcttcttccttggcttccggaaggtgacccccgttcctccctccttggatcccgctttgccccggttcaccattctctcccaaaatacgccggcgggcgcgcccaggtccgaaacccggtggggccggttcgacgcccgattgtctggcgccttcgggcccagggtaagtaagtcgccgtggttgtgcgcatcgcctcgcacgcggaatcgttgctctcgtttctcgcccctgctataacactcgcacagatgcaatgcaatgcaaacaccctcgaggaattgatcatgttcaactactactactactactactactactactactactactactactactactactactactactactactactactactaccaacacgcgacttgattgattgctttgtcctcttcgtgtcaatggcgaccatgggcaaagcatgtgattaaggccggtgtctgatggaatttactgccgtggagtcttctccattttcacactttgaaaattgttggtaactcacgagcgagagctgcctctctgtctgcagggctttcctgggagcgtcactccggattacgtcccgttccagatgtgggataccttgcaggtgaattttttttcttgtggcaatgaactgtgtgtcacaatgtctattaccttcgtttttaataactgctttgggctaagttcttagccaagttggtattatgctttgcttatttgcagggtctctcgacttacatccgtgcaatgctgtctactcaagtaagcttgacgctgcccaatcttcgctcatcttgcactcatgtcctgtcatattttgcactgttctagatggaatgccatattaatttttgaatggactccaggctcttttaggcgctattggagtaggtgagaaatctggcacggttataggtgccacttttcaggttaaatttcgattt

SEQ ID NO: 106119 - DNA, 740 bp, Oryza sativa
  unsure (1)..(740): unsure at all n locations
agattaatatggaattgatggggcttgttggaaagagaggcctcttttagaagatggacattggtataagttgtttttaaaatattgaattgaactatggaggtaaggtcactatgtccttcaaagtttacttttgttttggagggctaaacttgtaaaatccaaaccgaaggcattgtttaactaatttagtgaggtggttagtatatatggtttttaaaaatgtggtgttaagaagttgtagttgcctggaaaagaaggtttactggggttattcaatgatgaatcatggaaacttgaggaatgccataaaaaatttttggtgatatatataagttaactgaattggagaactcttgtgtttcattagtttaaatttgcaatttcactaagattggtaattgtgtttgtgatattttgtgaacctaaatatgaaattgtttaatatttatagtgcataagaaatggagagaagctatgactgagaaaatgcagggtaaagattaaagagaattactgtttttgatatttgttttactaaagttaaatgcattgatggntgtgcctttttgtagttgggttgttttattaaagttggtcaccaaatcgttgcaaattttgaatgaaaaaaggggagaaaatggagaaaatgaaattgcaatagtgaactttccacacttgtgggggatcctctanagtcnncnncnggnnnnnnggagngcctagtccttaatacaatt

SEQ ID NO: 106120 - DNA, 737 bp, Oryza sativa
  unsure (1)..(737): unsure at all n locations
ccttctccaaactcggttgnctanacncnnnannnnantctananatcccctttgtctctttacatacaaactgtactcataataaatttnttcaatcaacaacttttcacttactcatccaaaaatncgcagagaaaattttttttttaatgatcaataatttcattcaaaaattaaaaaatattattccaacctaattcaataatcaatattccaacccaaataattttctaccatatcccaatctattttattttataatttctacaaaataataattcattaaaacaaaaacttcccctccactataaataaataaaacccactatcaataaccataggcattctagcaacaaacaaacaattccaatacccttcataaaatcccttcataccattatctttccacataaaacaaccagcatgtaacattccattatagtagttatacatccgacccccttaaatttcataaatatttccttttgtgccacttaaaacccaaaatttcctttccccctttgacttacattctctttttcattacttcacattgcacatatataaaacacccaactctatcttcttcaattaacacaataaagccccataaaaatttttcctcaattccattctttccaatcataacccaaatttcccaccaccaaattccaatgataacccaaaattccatcaaccacaaatatttacatttcgtttaaaaaacatgcctact

SEQ ID NO: 106121 - DNA, 729 bp, Oryza sativa
  unsure (1)..(729): unsure at all n locations
acgttactgatcaggcctcnccncacncnccangncnactctanaggatcccctgacgttgtcttcatgaacatgtgcccctctcttcaatcccttcttcgcaaatgtatttttgaatgtggtctttggctaaaacggctgaaattttaacatcgctctgtaataacttctttgaagcttatcttttccgctccacttcaaactctgaccaatgtgtaacaaactttgtatccctcctttttaatgaaaattcacgtggggaatcccccccccccccccccccgtgacttattctaaaaaaataccctggtcaccaagccttcttttcccggccccaccatctcaccatggcctcgcctttcccaccagaaaccgccaaaaaattccttataaacttgtcgcccgcgccccccccagtgccgtgttgattttttacttggcagttgttttctccacccgaaaccatcaacctccaatgcgcccccaactactccttgtcccctcgcccctttcaatcaaattcttatatagcccaacttggccactgccccataccacctccccccattctttctttattttcctccaagcaactccttacttgaaccccttcatctgccgaagcgttcccatcatttccccggtattttcaccgacccacgccaaaacctcctttccaatgctagccaccatcttacccatccaccccctcccccttttcacaatttc

SEQ ID NO: 106122 - DNA, 742 bp, Oryza sativa
  unsure (1)..(742): unsure at all n locations
acttcttttgatntgcagatcccacacnccnccaagtcnactctagaagatccccaaatatgaaattttttgtgttgcctttttatacaacatggaggcccgcatataatttttatttttctgttccgaaattatcattggctaaaacaatatattttggggtggaattaaagaaaaaaatttcttacacaaaacataatctcataaaaataacttatatatcatatcaaaaatgatttatattaaaaattacaacccaaaaaagttttttatatatcctattactcataatttatattacaaaaaaaatataacctaaaaaaatttttaaactttttttacaaactttcatatcttgtaatgaggccaaatataaaatttcatatttttttcaaacttctaatgaaataaatcaatttttaacattttatgattattagggtattttatgttttcttgaaaaagatctccccccaaatgctctttttagactatattttaaactcccccctattttctataatgaaataatgttactggcatatttctgaaactggataaacccattttgcacacctatcttctctttttattaaaccttacatgaaaatatttgcttttcttcaaaaacctaccatttatccttcttctttaaaaattgcacatcttcctctataaaataaaaatcccaaccttcttttaatttttaacccaaataatttttccttattttaaaccccct

SEQ ID NO: 106123 - DNA, 729 bp, Oryza sativa
  unsure (1)..(729): unsure at all n locations
cacattcaaaagcnatacctancnncncnnnnnnnnnnntanaaaaccccagttgacaggtcntgnaatgcgctcctctctcttctataccaacctnaaggtatttttttttacaagccatgtttacatgtttgggtgtttaatttttttatggataccgactcacatttaaagtattaaatgtacattaataaaatttcctttgtaaactacgatactaatctcttaagcctaattaattcctcattaataaatgtttattgtaatatcacattttaaaataatggcctaattagccttaaaaaattcttctcacaatttacatacaaactgtgtaattggtttttttttcacatttaatgttccattcataaattctccattcatttgttcaaacattttatgttatggaaaagttttaaattgtagtaaacacaaccttttgctactggggtgcccttgtcacgcatgtttctttttccccaacgtcaaatcttcttaacaagaaacaatactcacaatttttgacttgattttttatacaaataatttaaacattcaaaaaccattaacccttaaactttcaaccattttcttcctttcaaaatataccaacagcaaaaattagaaagatttttaactaattacacccctttaatacagataaattgattggattggaacttattccacccttctcattaaccaaatccgactttcaattgaacg

SEQ ID NO: 106124 - DNA, 746 bp, Oryza sativa
  unsure (1)..(746): unsure at all n locations
aatattnggtactgtttagctttaannncnacnnnnannnnaanatccccttagtatcgttcattataactgccgttataaaaaaatataaattnaaaatttacattattttttttattttaactatacaaatacgagtgctttttttattcctatgattaagcactaattcatcttctcttttcctattttcctctaactattccttttttttttctatcaattaatacttttaccaaataaaatactttatttatctttcctaatattaagtactattaaattcattatcctatctttcttaaatattaggccttacaaagtcttatatccacacatttctaacccattttcacttccccttatcactaaaacatctatttattcttttcttaaataatttatcctaccacaaaattctaaacatattttcaatttcttttttataccaaaatttttctttaaaaatatattgttctcttccacctccccaacaattatttgattgtttacaaacctcattaacaattccaaattacacccctactttaacccctaatcttttaaccccaacatcacattccttttcatctactttaactaattcttccttaaattctccttcaattacatctcaatctttttccccctcttattctttcctttcaacacccaaaaaaccctaatatttcctaatcaaccaccaaaatttttaaccatttattttcccttattacccaatttac

SEQ ID NO: 106125 - DNA, 730 bp, Oryza sativa
  unsure (1)..(730): unsure at all n locations
catgatttgggagcggtgagcaacnnnnnnnnncnnnnnnntanannanccccttttttttgaagagaaagtattaatctctctcaaaantacattgttcaatggcccaaatcacattaataaaaattaaanaacactggctgggtatctttcaatttcatgcttatttntcttnnaaataaaaatcattaattttacccttcaaccaaaaaaaaaaaaaacacacattattattatacttttncccaaactttcactaatatttttttttaagctaaaaaactatcaattttatctttttccccaaaantttcattantattaacattttcaccaaaaaccctttaatcttaacatttttccaaaaaatcattaacatttaatattttaaaattaccattaatattaaaaaataattaatatttccattccattaaaattttcattattattaacctttcgcacaaaaatgcattcattttataattttttttaaaactttccaatattaaccttcaaccaaaattttattaattttacctcttccaaaaaaattaatnatantttttattccataattttttaaatattaatcttacacccaaaaatgcattaatattaacattactattaacctttnnaacaaaaattaataaattttacccttattcctcaaaaccaattaatattaacattttttattaactcctcatttaaactattctttttt

SEQ ID NO: 106126 - DNA, 938 bp, Oryza sativa
attctgtatgcacacatttcacacacagttaaacacaagcagaaaatgagagcccaggccataaattcacaagaaatacacatactttacactttagctgttctcacgttctatacttctaaaatagttgtccctgtgtgattcaaattttatctcaaaatagtaggattcaattttatttcaaaatagttatcacttcatattactccctccgtcccaaatataacaacttttagcactcagaatttgctccaaaatataataatttcttaactataattctcttcctaaccaatcacaactatccactatctacttttcccacctacctctttctgaaccaatcacaatatctttctatttaattttacctactttcttatattctgggacggagggagtaccctatcaattaccttccattcaaatatctcgttattataccctcaacaagggcggatccaggaacaaaaaaaattagggggggctcaattatgcagtttctttaacctctagccatttaaggacctttagtttatcatttatggtgaaaaaatcgaaggagtgctccgggaggtatccatgggtatagagttccccctgcacccacgttggatccgcccctccctcaactacctaaccatacaccattcaattcaaatttctctttattctatctccaatctccaactactctctcacacctaaacatacaccattcaatgacgggcactataatcttctctttaaatcataatctacactaaacaacctagaatagtaactgtatgggaacggaagagtaacagtgctcatatacctcgtagactgggcaagttctctcgtagccatggacatggccgtacattgcgatgtcgaccttgtacttctgccaaagcggctggaagctcttccttcccatgggcttctcggttgtg

SEQ ID NO: 106127 - DNA, 735 bp, Oryza sativa
  unsure (1)..(735): unsure at all n locations
atcttacgttaccgatgncatnncnnnncnnnnnnnnnactntanaagatcccctcaatcttttcttctccccataactgaactaaaataaaagctcacttatattttccttatccttatttcaatactctccggatcgaaaagtaattttctaaccttgctttctattccaaacttactttttaataatcttaaatagtaaaccaatttgtcctgtgtcccgataataattccttcgccacttttttcaaacttcggtcgtccaccacgccccaaaatctaataaaaaataaaattaacattataaacatagactttaactaactaaaaatgaatatatcacctcagaatcaatgcaagttcaaaaccgtaccttcatcacatcaaacatccccaaatcttcccatccaccagctttaggatcatataattttcttccctttttttgggaaatcaccccatttattaatgtttcctttactaaacttgaggaaattaattctaacactttacatattaacaatatattacaatttaccaatacagtcacaaaaataatcataatagatgcccataaaccttgtgtttcccatacacattttttttttacccaaaaaccaatacttacctttataaccactttattaaccccgtaatttcacttccccaaccaaatttttcctttcaaacaaagacctttaacacaaattttttaccaccctttcaaaacttttg

SEQ ID NO: 106128 - DNA, 742 bp, Oryza sativa
  unsure (1)..(742): unsure at all n locations
cacatcttgtcnaaaactagttngtcaannnnccnnnnnnannnnanaananccccattggttgtatttttttatactacgttaatttttcaacccctaaatttaattatctttttacattcttcttcttctaaagaggatgtacttcttttactatctttttactaaccctttctcttcaatctttttatccccacaaaaagacttcctaaaagacttcatttttaccattcctttaatttcaaattttctattttcttaataagtttatgtacaatttgctcaaattttttccttccttttcactttgaaaaatatgttcaaccattaaactttttcaccttaaaaaaatctcactcaatgacatttacaaataatcctaaaaaaacataaactttttatcctaattaaacaataatattaattcaatacctttttctttatttctttttaaacaccttttattaaattttccttattctctttaattattttaactttaaaaaaatttaaattaatctctataactcttcattgttaacttatatccatttattattcttaccaatcataatgctttcaatttattgatttgtgctttttatgcaacaaattttcttaatttcatcctttatttggttttcatttggtcctatttacctttatatcaaaacaattttaattgaacaattcttttttttttttttttttcaaaactcacaacacaaatctcaatattttt

SEQ ID NO: 106129 - DNA, 1204 bp, Oryza sativa
ttgcatgtcttgtcctttacttgtttaaagaagatactgttacatgttctgcgctaatcatcgtcggcacatccaggtatcaaaatgtaacaatgtaaattttggtcaaattgaaggacaaaagactgttggagttgtggaggtaggcaacatcttgagcttgcaaaactttggaatatgaccttttcatattatgtaacttatatgtaatatctagcaagttcgtttcatgatggtaaactcctgtagtccttgtgattctcagccatcaaaattaggccaacacagaactttcactctccccatgtccttcagtacttgagtgttgacttgcacacctcattcttaatggctttattgaaatgaatttcaccttaggtaatggatattgaggagatggcctgggctccaagatatggtttgaaagggattattgatgcttctattagatcaagggtttcatgcaatggtagttcatacgacagagtaatgcctctggagttcaaaactggtaaaggaactagtggtcaggtaagcatatgctcctggatagtggatccacttgaagatatattatatctttttctggcatgagatatttttgtcaccggggttctggaaactatttatgcaataaattagtgaagtattgcaacaaccaggcttcttgaaagattgtgctgattccataatccatattaattcttacaagtagtcatgctctcaattttttaatcaaaacctgacgagttcattgaggtttatattgcacaggccagaactgttgttttctgtctgttttccataatgtaattactggttgcttacttgaattagattccctgctctattttatccaaaactttaagctttagttacaattgactagaaacctgtcaaccacctagtcatgtccattctgtggcaacaaccaatcaataataatgtcctacaacaactaatcgtaccttaaaaaaacccaatcatagttcattacaaaataataattaatcaataatccggagcctcagttccattctactttcacaaggtcaacatccttcagtagttttgataattaatacatgtcacatgtagcggcatccaaatatatattttgataccttttttgaaatgtgattgtgactattagtgttatctttactttatgtccatttctgaaaagaatattgtgttatttttg

SEQ ID NO: 106130 - DNA, 1168 bp, Oryza sativa
attttccccagccaagtttggtttttttttaaccacccaaaaaatgtggcccccccctctctttttttttaatttaaggggccaaaccaacgtgtttattaattgaataaaaaggggcgaaagacttcccttagtccgaaggcttgtttccaaagtttccccgatgaccggggaaataaaaactggacaaaataattcctttgtagaaccaccaaatctttcttcaagagtcatcacatgaatggatgccacacggttttctgcacataaccacaggttcaaaaccttattcttttataaaatgggtttttaaacagtctggtgggcccatttgttcaatccatataatacagtggaaaaccaacttaattttttttcccaacgggcgaagaggccattccgcaatataggggccgggagtttattgaatattctggggaacacatgaccagtgccacataatcttttttttaaccttggaccagttgttccgtcttaaagtaagtgtttctaaggtactttaaccttttctcacgcccggggaattgaattggccttctctggtccccatcccacgcaaattcaggtcaaagaagaaggaaattttccagcccatccattcaaatattggaacaagccattcttccccatcttatttgtccttggatgttccaaatggccatcatatagattcatttggaaaaagcaaaagatccatatatctttttttgcgcaagaagttgcagcttgagacagctgatcagccaggagaacatgttgaaagtgtagattttagcctcaaatgcggtgattctgtggtaaaccttgtacactttctgtattcaatattcagcaacattactatgttagctatttcaagttcccagcaacattgatatttttattgcatatatttggcacaccatattgcaaatttgtaatgtatggctccatctcattttgtttggagtgtagggttctttccgtttgaactgttatgtgcttaatgttggtaaggaagtagaactataggttcatagaatatgctcagtgcatataaggaggttaaatggcaaatatcataccagttgaaaacttctgcagctactgctaaccgatcaatcagcaacagccagctaacactttggagtattgtagcgttatatta

SEQ ID NO: 106131 - DNA, 564 bp, Oryza sativa
tttcagaactttaaccaaattttgttctaaacatataatacttatgaccagagggagagttttagtttgtgcttgtgtcgatgattggattttgacagtgaaattttagtggtgcttgtttgaaagcataccaattttggatttttagaacttaattaattttacaattctcaaggacatgaactaatattgtggccagcatcagaacattctttttttttccaggttcatgtagaaatcacatttagtttatatgaaaatgctacaaaatccacatggaatgaaaaattttgtgttctatagaaggcatgaaattaaataatagggagtataggcaatgattttctcatgtctagtactccatccatcccaaaatataagaggcctataattttaggaaaatccatagtttgcaattttgactaataattaaactgacaatatactacgtgcttagtactaaggagtattatgtatgtggcatcgttatattcgtcatattatgccaattttgttgtgctaattttgtggttgttgataatatattatgaaataaactaaggg

SEQ ID NO: 106132 - DNA, 570 bp, Oryza sativa
ttctatgtccctaagcgtgaaaaaaatatcaaaaaaataaaaaaaaattaaaaaaaaattttttggggggggggggcgccagccactctggcgcgctccccctagccacctcagcattgccccgccacgtcggcagggggacggcgccagagaggctgcagttggacgacggcgccagccactctggcgccccaaaaaggaccatttttgggataagtttttccaggggtctatctgcgaaataagttttttaaaaggaccaaaatgtaaatcatatccatcctgtacccacactcgatgagaccgcgcggctgcctggtgcgcgcgagatccctgagcgacacgaacacgtgccgccccacgccttcctccacctcgtccccctccgagtagtagtagcaatactcgggccccggcacgcacggttgctctagaggcaaacccagcagcaaatccttggccatcttggtcgccgacgcggaacgccccggcaagaagggcattatcgcggtgtggaagcccctccgtgtgcttcacccacgggaggcttcacttccggcacaaaaacct

SEQ ID NO: 106133 - DNA, 817 bp, Oryza sativa
tttttttttactttatagaagtcccggcaaccgccttactcatttgcttcacagcctgcctgacgtccctccctttaatcgtcatttaggattctatttggtgttttattaacaatttttgtatggcgtattaataccgttttgtgttcttttaatgcttttattttttattttcaatttcagttgttttaaaattgtattcctactttaactctctttttatttttctattttagatattattttattttttattctaaattttaattaatctcgtattgggttcttatatggatttttctttcaatattgtttatttttaattccaaatttcagctaattttaaattgtattcctacttgaactcttcttttattttcttttgctaatttcggatttatttatttttttctgatgtttaattaatctcgtattgggttcttatatggactcttcttttaatattccttatttttaattccgaatttcagctattcttaaattgtattcctacttggactctcatttccttttctaattttggattttattttatttttatttcgaattttgattaatctcgtattgggtccttatatggaaatttctttcaatattgcttatttttaattccgaatttcagctatttttaaattgtatttctacctggactctctttttcttttctaattttgaattttattttatttttatttttatttttgattaatatcgtattgggttcttatatggaaacttctttcaatattgcttatttttaattcccaatttcagcattttttaaattgtactccta

SEQ ID NO: 106134 - DNA, 1195 bp, Oryza sativa
  unsure (1)..(1195): unsure at all n locations
attccccttttaaatggcccccgggcctttttttttttttctttttcccataaagggaatttaacccccacgaaaggggggcctttttgaaattgttaaaaaaaaaaatccctcccaaggacacattcccctgggcctttaactccgaggtgggcacccttggccacaccatttttaatgctaacgcatgttaaaaaaggccggacactattccgattttagtatccacgcatcccaagtttggttgtcacataaaaaaaatcaagccttggtcctacttccaacactgttgaagctcatgatgcatccattggtggtttatgcattggagctttgaatttattgtaagtccaaaatcagattgcttttgctctactactaaagaagnnccatatattccccattaagtgatatcgaaatctatgatcatccactactcctggctgatgtgaaagcatgcttcgacttggatctacgggtgctcttggttaatgacaatgccaaagaagtgttgacaagccgataattttctttgtccaaggactggcatttgttggaaacctcattgagtcaaatttctctcctgagcaattaaccaatattattctaatttcttatggggtcaagaatatcggggatagaatttctgccgaacttgaaaattggaacaatggatttaccagtttgaagggttccccagaattggaaagagagaggtttatttgggcaagcataaattatattaatgaagtcattgtgatggaaaattttaatgcccacttctggggagtctctgatatgagatttgagttccttgatgttgctgctgatgtggacatgaactcaaatttgccaagtatgtgtttttgcttccgaacatcttcgatttataccaatttacctcatttttttttgttttcattacttttgtttgatggtggagctgactttgcaaggccgactcttaaggaaaagtttttacttaacttcaaattggagctggaatataattctttctttgcttttgagtacgccttcttgagacttatgggcaatatcttgttacttagtagcattcattgtctagtgttgttacatgctgaatcatgtactgttattgtctctgtattttcagccatgtgtcttattttcgtatgtgcttggaagaaagaatgtcgcgtccatttcaagacga

SEQ ID NO: 106135 - DNA, 539 bp, Oryza sativa
tgatgaaattaatcgttttttgtggctttctggtttgctattcgatatgtaattgtattctagaagcattcctcggtcgagtctataaagaaatggcattcatcactgctgggcatgtcaagatgtactgcttcagcacgcaatttggatatgtgtggaactggtccaggtggctgtgacggtgtggaggacacccaaagcccatttcggactcctccatcactgtcctataggtgcagtgaggtacatacagttatacgatgaattgttgtgtgaatgctagctaatgtagttccaaatcgtgttgatggagtaatggttttgtgcatgaagcagcagcttaatgggggtgtggtttctgatggaggacctgagcagttgggggcaggggagcacaaaaaggtgaactaagataacactaaatgtcctgggtgccattggtttcatgatattattacatgtaagaactaagttgccaaagaattgatcgacaaaactatgccatttctttttaccaggcactacttgatcttttagat

SEQ ID NO: 106136 - DNA, 1732 bp, Oryza sativa
ttaaagtgtgatagtatgtatgcacctttgttctcaggtagcttggcaaaatggcaggtcagacggatcaagctgctcccaggtattgtgttctatatatcattttcttcttgtgataatgttgtattgaaatgctccatcaaggagcgcctttataattcctacgtgtaggttaatcttatgcagtattattgattctattgtgtcccaaaaaatactatctattcaacttgctggttctaccgtatctttgtggggacatagtgaaatggttgtgatctgctccggaaggtaggaattccttccaaagtatttataaatgactaggaataattatttgaaaaacttctatttcagtagaaagcacacgataaagcaagattccattcacatgagcatgacaaaaattagcatgaatcttacctgattgatttgcagtttctttgtacaccatgttgaagccgttggcttcagctactgtttcgactagagattgtccttagctgctgaacagtaacattagtgtaaatcagcttacaacttagcacgggggactgccttgctagtagtttccattaggttatatacttagatgtcgtacttggattagtacagtcattaagtgcttaagtgcgtgtaaagtatgcgccctctaatgctcgattacttggctaacttttctggctcgacgcgtgtaaagacagtatcgtatgattcggatccaaccttgaggctcagatcaatgacagatcggcaccggtgtaccaatctgaatctgtgttgtggtggatgatcaaacgatcgagtataaatattccgttatctaatgtgatagctctgctttcattcgctacatgcaaccttttcttcataacaagtttttgtaaacttataaagctataacatatgtctacataaactagttcatggttaaaaaaatctacgctacagtggtatttacaactctgtttacatggtcactcacttcaggtcgacatgaaaaagatcgatttatcaagccggttaaaataattgcctaccatagtacttaaataactcaaactatcaaagttcaaagataatggtgtcttagttcgctcgcacgataggtaggccccaagttgatttgtgagaattgatagacatgtgtgcgcacctagagtagtggaatggcatggaagaatccggacacatacttgtttggtgccggaacaagttttagtttaggcaatttgtaaaaggttagtaaaaaaaaagttcatcgatccagtctacgaacgtggttgcatacaagtgtgataagcactggtggagaaaggggctttactcccggttttcaaaccgggactaccaatccgggactaaagatcactatctttagttccgggtgaaaaaaccgggagtaaaaatacatctgttaccaaccgggactaaagatagagctagcctagctagctagatccggttgctctattatttttttttcttcattatgtttttaatatattgattttactatatccccatcccaaaatcccaaataaattatccccaatcctcaaattcccaaatcggccatattcaaatagatcacaaaatcttaaaacaaaattacatcacaacttctacaaaattcatcataaatacatcacatattcacggacatcatacacaaatcaaatacacagatccgaatcacaaattcttaaaaaaaaaaagaaaaaaaaccccg

SEQ ID NO: 106137 - DNA, 2047 bp, Oryza sativa
caagactgcccgtgccaccaccgccatctgggagcccgccggccgccgatgggatgatggggagggaaggagaggagttagaggagaagttagagaggaggaagaggaaggggtgatgggggagggaaggaaaggagttagagcacagaaggagtaggaagagcaagagatgggatgaagagataaggtcagtgcaggaagaggtgaagagataaggctgcccgtctcctcctcctcgatctctcagatggcagatgcctcgtactctccgccacaatcttttgttccggttggtattaccaaccgtgactaaaaatagatctttagtctcggttagtaacaccaaccggaactaaagatagtaggcatcttttttcccggttagtgttaccaatcgggactaaaaatagatctttagtcccgattggtgttagattaaaaagcagctctaaacttttgaactgggactaaagataatatttaatcccggtttttattgcaaccgggactattgtggattttggctaaccgagcaaagatcgtttctccaccagtgaaagttactctcaaaactaattcaataacatgtggtgagcaatgtttgttatcataaagtgataaaccattgccgtgacaatgaccacactcgtgacggtaagcagggaaattctgtatggtggcttcccaaaataaatcaaacaattattccctctatactaaaacataaggatttctagaacagtgtttgtattgtttgtgatatttaaacacacattgtattgtttgcactcacaaatacactgtaaagtataaatttactagcttaaaaggtaataggattagtttcgtatggaacgcaccgtttgaaaaaagtgctaaagaaaccgaggtaaactctataccttaatgagagaagaacagtgcctaccatttgtaatttttatccatagttcttcgtatattttatattatgagacgttttgaattttttttaaaattaatcttctctgagttttattaaatttgtaaaaaaaaagcaacatctataatactaattggcttcattaaattcaatgttggatactttgtctgtttcatacgtaagtcattctaacatttcccacattcatatatatgtatatatatctagatttattaacatatatataaatatggaaaatgctaaaaagtcttacattatgaaatggagggagtatattttaataatatatttgttttatctttaaaatgttacttttttatataaatttagttaaaacgtcttaaaaaagagagggtagcaaactatacctggttaccatgcgggagtcatacggcctcatcttttcgtttatgcttatacttattagctaaattttgaattttcaacattaaatttggagttgaatttagggttttttcagcctttgcttttagatcactaagaatacgtatataaagtctttattcacatattattttccgtttgtaaatatgcagtttcgtttattccgcgaataagcgaaacgatggggccagtatactcgtatcattcgttgttaagggaactagctgttgttgcaccgtaacgccgtagcggccggctgctgcagaaaaccaagccccaactttttctgaatggcaaccacatctagcattactaccgagcgaagctgaatcaacaacaacaaaaaaacacacacacacacacagacaccactaccacatatacgcgcgtatcgtccttgtagaaatcagaatcggccgacatgatcgcgactttttcctgcgctgtatggtgtgtgagtgtgagccacattggctaataaaaaaaacgagatttgaaatgagaaatgtccctccaacattttttaaaaagaaattacgatttgaaggaagatgtttccctccaagtattttttaagagaaagttgtgaatgtgttaagaattgaacatgaaatcttgaagttaaaactacaccccttgcaactgcattattaccaatgtgagatacattgctaataagaaactgttatactgctaaaa

SEQ ID NO: 106138 - DNA, 1537 bp, Oryza sativa
caagccccaactttttctgaatggcaaccacatctagcattactaccgagcgaagctgaatcaacaacaacaaaaaaacacacacgcgcacacagacaccactaccacatatacgcgcgtatcgtccttgtagaaatcagaatcggccgacatgatcgcgactttttcctgcgctgtatggtgtgtgagtgtgagccacattggctaataaaaaaaacgagatttgaaatgagaaatgtccctccaacattttttaaaaagaaattacgatttgaaggaagatgtttccctccaagtattttttaagagaaagttgtgaatgtgttaagaattgaacatgaaatcttgaagttaaaactacaccccttgcaactgcattattaacaatgtgagctacattgctaataagaaactgttatactgctaaaacactgttgtggcaataagctaagccaaccacacacaatgaaccataccacagttaccacagttaagttaacgtgacaaaggccatgttcggaactataaattctcacttttactcgcatgtttcgctatgcacatgtttttcgaaccgtaaacgatatgttttataataaaataaaagttattttaaaaaatcatattaatattttctctaaaagaaaaactaaaactttattaattatattatgagttaatggactacctcgtttttcgtgcgagcataagcttctttcgcaaacacagccacgaagttatacaaattttgacaatttgaccctttgcaaaaattaattatacaaatgaaccgtggccaaaacttattttaaaaatgacccttttgttcagtgcgaaatcccatggcgctgaaattagacacctcagcgccaaatagcacggcgctgaatacacattggcgcgccgactcagactcccatccacggtggcacgacattcaattccagttgacgtggcgctgaggtgtctaagttcagcgccataggatttggcgatgaacaaaagggttattttttaaataagttttggccatggttcatttgtataattagtttttgtaagagcaagtttaatagtatagccaactactaattccaaattatctatagccaatgtaatagccaattcatacaatacttgcttactatgtatactattaatacctgatccacctgtcatacacaccgtacgttcttggagtccgggctatggttacagatctgtagtccgtactcttctttctctcctttatctttttaaaaatcaccttccctctcttccttatcctttaaaaaaaggtatggttgcttataagcgggttttgcactcctttaagggcaaatggccaaaatgtggccaaagttagcctgaacaaacccttgtttactgggaccgccagtttttttaaagagaaaaatttcatattggcatgggtggccagcggtaaataaaaaggggaatcccaatttgcccctctggggtatacggggaaaccaaattttgtgcggcccggtgtctttacgcgcgaacctggggt

SEQ ID NO: 106139 - DNA, 1000 bp, Oryza sativa
  unsure (1)..(1000): unsure at all n locations
ggcgtcggagaaaagccacncgaagagcttcgcaagagcgcgaacgtcccggcgagctccgtggcganccgcagaagcaccaganccgcgcgtggtcgcccatcacgaactcctccatgatcaggcctggccacgggaccgccgcgtgaagagaaagaagccgcagcaaatcaaaaaagttggagaggagaaggtaaaaccctcaccatgtggaccagaagggagtactcgtcgatcttggccaggttcttccgtctccgccatctcccccgtcaccctgaagagatctggagccgcgagaacgaaagagctgatcagtagtatcaagtatgcagcgaagaggagaaggaggcgatgaggcggttactactactgcgaggaggaggaggaggagccagttaagcggaagttgccatgggcaaagtgggctttgtgggcgggcgtttgcgtctctcctgggcttcctttgtgtcgcggccgtctctcccgtctcgcgcagtggactgtgggaagaaaatggtcttggcacgggggttgcgttttcagttccattgactgtcaagtctgtcacagtttcagagtgtgtcagagatattttgttgcttccttgcggcaaaaaggaaaagggaaaaaggatttgtgtatgaatcacacagatttgatttgcttggaggctgaacgctgaaagcatgtctcgaatcacgcgattatggcaagcgagtactgcttttgatccacgctcatctcatttttatttgtgtagcagagaataaagttggggggaaataactttggtgtttatcattaaatgagatgagcggtagttgaagataaaacgaaaaagaaaattatcatctgattgatacccttattattatggttgtgcttattagtccatcacccagttacagatagggtgccgttaaatatttaaatgtagtgctgcggatctttagagtcgacctgcgcgcatacnagattatgtcaatatcaatgccat

SEQ ID NO: 106140 - DNA, 577 bp, Oryza sativa
acccagccgtataaaaaataaactcaaacggacaaaatatgtgacatgtagaattttccaaaactctatcgaaacggacaaaatatgtcatctattaaaataggcgtaactttctcatacggacttgaaatcaggaaaataatatatgcacggacatctacagaaaaagttacatccaattctccctagctttgccgggttcggtgatattaaatcccccaaattccgcttgcaagattgtgttttcgaggagagaagtttttcggtggagctttggaaaattccacatgccacatatttcgtccgtttgagtttattttttacatggttggttcctgtgagttcctaagggtgaaaaaaatatcaaaaaataaaataaaaataaaaaagttgcacatctctctcctctgcactagttcggagagaagagaggagaggaaaaattctacatgtcacatattacgtctatttgagttcaatttttctatggttggttcttgtgtgtccctaagcgtgaaaaaatatcaaacaaataaaacaaaaataaagggtaccgagctacggtaatcaatgcaaa

SEQ ID NO: 106141 - DNA, 2360 bp, Oryza sativa
  unsure (1)..(2360): unsure at all n locations
tgaggcncnncnnattgaaaatcgatctcggtacccttgttctaaaggacttgataggaattttgccgtaagtattcaaatcctgtaaaattcattcactttacttttttttccaaaagagcctaaaggttttgattcctaagaaaaatttcaccatgtaaccgtttagatcaaaggaaattaaaacaaatgaaagtttccctcaagttaaaaaaaaagaaataaaaagtttcctgttgtaaagaatcctgcatcctgatctgcaacatgtctatatttcttcttttttttttcagttctccgggtaaattgctcatgctatgcttagcacaaatcctatttctttcccaaacacaaaacattcctttttttgtccattcttctagaggcgctccgatcaaatcatccggattattttggggttgtttggttcggtctcaaactttgccaaaaattgacacacctcatgttagacacatttgaccaagttaactcatcgtttggtttatggtcacacttatggtaatattctctttcatttctcatggtcccacgtgtcatcaactaaaaaatgtgtgccacactctttttttctagctaaagtgtggcttacattttgttggccataactaagataaagtgtggcacacaagtatggtaaatgattgttgtatagcatgcaaacagcccctttattttgcaatatagtttgtttattttttttggtttgttaatattagctctttttctagagacatgtggggaccgatgtatatattgacatttgacacgtttctctagaggtgcatgatgtgttgtttgttcggttttttttttggaagccattggtttcatcggagaaacatgggtggaaggcgtgcgggtggtgcgaggagggcatagaaggaggatgatttcggttttacaatagtaggaatatagatagttcgatttttctggggcggttaatattggtatttttaagacgtgttgggatgcataccgtcattttaatgaaacgcagtatatattgatctatttttctcaagatgcaagatgtgctgtatgttttgcttttttggaagtcgctggctttttgggagaaaccttggggtgataagcgttcccagtggtgggaggaggaattgcaagacaacaacttctttttatgttactaaagatattttccagttgtactcctttttttctactaagattttagtcttatattttgttttagtgtaccgcgatatatatttacactgtttactgtgcatgatgtgtcgcgtgtttttttttaaagccgccgctttttcctaagaaacttgggtgttaggtgtggggcggtaggaggaggaatcgcaagatgataggtccgcttttatagtagcagacttgttttctagtcatactcctatattttttctcttttctactaattttttattcctatatgttgtttttcagcattcccagggtcctactgtacataaaacccctgcagcacaaggaagcctaggagagagagcagagagtagaggatgacattcccctcacaacatgagggaatgccaacatgagggaatgccatctcgaacccctgaagttgtagctggtcgagctagtagaggatgtcatcatgtcaatgtcctccctatgtcgggcaagatcatgctgccattgacagcagcgtccagtggcagtgtggcactaccatgcgatgcgccggtctttactgagaagtaggctgcctctcgtatagaaaaatgtcgaaagtttcaagcacatcgccattactgcaaggccaagtaaatggtaaaaaaaagtctttagtacaattccaagggaattttcaaagaaattgccaggaactttgngaatgtaggatttttgaaacataaaagccttgaaaagatataattagaaatatcttgccaagccaattcctaaagattagacacactcaaagtttcaaaatatagtttggatggtccataggattaggaagattaaataatgtggcaccagaatggaacaccccgggaggaaacttaattggattccccataacttntaacatcaaaccttggtattaatgactggtagaattttaccgtagntttaaacccgtaaaaatctttcctttttttttttttcccaaaaggctcttgggttttatcctaaaaaaattccttttttaccctttatcaagggaataaaacaaaagaaattccctcttccaaaacgattgtgggggttcttttcacccggggaaaaaaggtgcctctttgagagacaccccccccacacacgggatctttttggcgttttttaccccggggaagggtgtctgcgctcaa

SEQ ID NO: 106142 - DNA, 577 bp, Oryza sativa
aatcgggtggcgtggtgcaaaaagcgagggatcaggagagggatgcgagaaatggaccaaatgggagcttgacttgaagcctgcctgcctatatactaagcggaaggcaatagctcgaatcctagtcggattcgggaagtcaacagcggaaaatgacaggtcgaatcctagtcggattcgcatggaaaaaaagctcgtacggaaacgcgaaaagctcgcatattttgccattgtggtaatgtggtcatttggattagaggtaaacaaactgaagcaaaagtacaaattagttcatcactaaacaagaaaaagaaatgactaagacatcagcatctcgtgactttgcagcaattatgcattcaatttgtaggtttgacacacaatcatccaaatcacatataaatatctatttttaatattacaccgttaactttttaaaatacgtttgatcattcttcttattaaattttttttataattattatttattttagtgtgacttgatttatcattatatattctataaacatgacttactttttatatgtttatacaaaaaattttaaataagacaaat

SEQ ID NO: 106143 - DNA, 1200 bp, Oryza sativa
  unsure (1)..(1200): unsure at all n locations
atgccattatttttgaagcaacatcctgccaaaaagaagaggtgatgcatgcatgctcatcagcttggacttcaggtagaaacatagaagaggagaataggctaaaaggtgtccaatccgtagtagattggcgctaaaaaaacaaccaagtggcaagtgtatgatgatcaaagccaggaaggacactcattggccaagacagaatcaagtcaacaaataatgacataaatatatgcaatctcctgaattgtaaaattactaattcagaaacaaatgaaaggtttatacggagtattctgtaaatggcattgacaactcaaataaactcaaaaagggaacaagtttaaagatgctgaagaatacattatatgttagtttggtatttattataggaagcttatgctacacatctctcttcttagctctcacttatgtatttggttgtattacttgagatcccaccagcagacagatgtaatatgtaaggcacaaagacttattacaatttacaaaccacaagcaagaaatcaaaaacttaagttctccaaaagtaactttgtcacaacaagacaacataagcagacaaataatgaatttcagctcgtactagatagcagagaggggagcattttcaggtacctcattaggcttcactgttattatgtggggagtaaaagatgtccngggaagatcctgaaatcagcacataaaagaacatatatatcagatctggcatataattattgatccacacanagtggtcaagttcagttgaggtaaaagagacccaaaaaaaaactacgaaatctgacaaatgcattatattatcattctgaccgtgcacatggtaaagactatggacaggacaaactacctcctaatgtaaaccgagttgacactgcctgtcttgcaggggcagnggtagaagtttgtattnaaaacatgcaaaaaggacatcggcaaaattttggcatttgcagatatgcccctaaattgctcttnattgaaagaacctttttaaagaaccaatcccccatgatggtcattttcaagactaaactcaatttggaaaaatcccacttcccgttaacacggccctgcaaccccggaggggttaaggggctgggcttcttaaatttaaaaattgcgggcctttggcctatttattcttcaaaatgtggggtcttaaaaatattcccc

SEQ ID NO: 106144 - DNA, 2069 bp, Oryza sativa
  unsure (1)..(2069): unsure at all n locations
cttctccggcgagctggggccgtcaccgctccaccgcctctcctccggctcctcgctcccccactgccggtcatggaagctcgccgacggcggccgcttccggtgatcctatcctttattaatttttttcccgcgctccgacattatttatcccttttgggaggcttttcttttttcctttttacctttacgtgtaaactggaaaagaagaattcatcctggccaaccacgagctggcaagctgtcccactgacatgtaggcaccgacgtttgtcaaaggttactgtttgtcagttgaacatgttgcaagccactgtaaaaaaaaaagcttcttgcattatctatgtacaggattactcctagcttttaaattattttcaagatattatttctttcttgtgtttgagattcccaagccaatagatttagttgtgtgtctggcatggagggaatgaagccatgtgagcggaattgaatgtgagcgttatgaattgaagatctgaactctgagaactaagtactcctacttactccctccgtcccaaaaaaaaaaaacaaaccttgggttttcatatccaattttgactgttcgtcttatatgaaatttttttataattcgtatttttattgttgttagatgataaaatatgattaatattttatgcgtgacttatctttttaatttttttcataatttttttaaataagacggacggtcaaatgttgggtacggaaaccagagtttgtctttttttggacgaagggagtacttcagtagtgctgaactgctaatgtcaacttggagtaactctgtactcatgcatccatgaagtcatgaacctccnacgatctgatgtctgatgagtgggcactgtggatggatcgtggctgatggttgtagaatcgtaatcaactttatgataaggtcataaggataatttatccattttaccatctagtcagagaccttgtccccttttttctctttttctgaaggcagaggttgacatgatcaagaaattcaagatctcttcctgttgtttcttcattgcttttgccggtacactgcgcaccaagcgattgtttccattttcgtccgggaaactataattgtggtatggctcttccagtcgagcactgtttcaaccacacgacgacagttgccggattcagtacacagtccgttggcaacatttactagttcgttgacgttatcgcgttgcatgtaatgtacaggatgaggtactcgaacaggtatgaagttttggtcaacaaatccagcaaatcttcagactggtcctccaacagacgtaggttggctctcccgttctcccagctgcaggttttcgtaacttctgaaactgcatatcctccactgccaccttgatctgaaattctgaatctacatcggtgacagttcttttgatctcgtttgatggctgttgccatcacctctcagtctcaggctctcaccggcgcgccactaaggtcaaccggcttcatcattctcatcgatgcatttaaaaagtcaaactcgatacattaacggctgcagatttggcgaataaacttgctgatgaaaagctcgcaatcatggggcatgcttagctagaaaccaccatcgacatgggcagttgagttgggaggtgattgcctcgacagagattggccggggtttgttgcgtgcgagctcgctttctcatcatctcggatggactcccatcatggcaggtgctctcgctctggtcgagaaaggtcgctacctttccggttaatcagaggttagctccgctagtgcggtggtggtggccgtggccgtcgtcgttgtcgtcctgccaaaagcttgcgatttcaccgaatcgcggtgagctgtgatgcgcgcgcgcgggcgtgttatgggtggatgcaccaacctctgcttgccttgtgaacgagcttactctctgcctgccggttgctgcatctgttgaaaaaaaagaaacatcatgatattagttttgaaaaagcgtttttttttgttcaattttcccaactattcccagagctttttttacacttccgggggggtg

SEQ ID NO: 106145 - DNA, 1775 bp, Oryza sativa
  unsure (1)..(1775): unsure at all n locations
tgtgttttttatggattaaaaatgttgtcacgaatcttacctccacatgcatataaactctcaatatttttcaaaagaacttctttggcttgctgctctaagaattgcgttgaaccgtggccgtcgtcgttgtcgtcctgccaaaagcttgcgatttcaccgaatcgcggtgagctgtgatgcgcgcgcgcgggcgtgtgatgggtggatgcacgaacctctgctcgccttgtgatcgatcgtgcgctctgcctgccggttgctgcatctcttgagaaaaaagaagcagcatgatatcactatggaaaaggcgtattttttgttcgattttcgcagtaatcccagagcttttctacactccgctgggtattactatatgtttattaaggacaggagtatatgaaaagtggattttgattttttttagataatggaataaataaatatcccggcctttactcaaaagagctacagccaattattatatagaagccaattatatgaaaagtggattttgatgaggaacataaagctttaatgctgactgtctgacggccgttggtttgctagtacacattgcttcgctgtatgaactccgaagccacatgccattgtcaaccgggtcaagtacgcgtattattggctttgggggagtgaacactaggttagtccagtacccgagttcttgttacagtattgatgaggccaacagaaaactcctactcgttgacggtatcgaatgaactaatgcccatccgagggagacgattgccagtgcagtactgatttgtttcggttagctgcaataactcttttcagtgaaagcttgacaagaaactgcataagttctgaatccttatattagattatgacaacaatttgcaagcagggacaagtgacaacagtggcttggttgctgcttcaattcagcacagcaagcaacaggatcaaccttcccaatcttgttctttttccgcgtcagaactcaaaagtctcagaataagcaacgaccagccgaagattttctaaaccacgccattttcagcacagcaagtggtattgggccaattaattaggcattctgaatccatctgcagtccatataagattatgcatgtgaccaaggagttgcgtgtcagcttcagttgaggcctttgtggatcaaaatcatcttgctctatagtctagaccaaacatttttcccttttcttcttggtaatttggaaccatgacattataattttgtaacgtttgagatatgtcatcggtatctcaatgacacgtagaacccacatgagtcaatggcatgtgggtcaggatggtatagctcaaatttttcaaaattataatggcatggttcaaattttcccttttcttttatgcctgtcacacacgtacaacagaggcctggctgagtggtaggtcgaattataccgttgaggtccttaatttctgactatacatttctcagttgaggccattaatttctgaccatacattcctgtcggattactttagttttgttgcatgaatttgacaaaacttcaacttacacgggaaaacttggagcgatcaataattggaaaattcctcgcgaaaaaagagagagaagagaaggtgtagcaatgatacgcttctttgctaggtcaaactgagcaaacaaatacttcatccgtcccgaaatataagaatctaaaaccgatgggacatagtattagaaaatatcctatccgattttaaattattatattttggtttatatcctatnccagttt

SEQ ID NO: 106146 - DNA, 1203 bp, Oryza sativa
  unsure (1)..(1203): unsure at all n locations
aattcagaaacaaatgaaaggtttatacggggtattctgtaaatggcattgacaactcaaataaactcaaaaaaggaacaagtttgaagatgcttaaaaatacattatatgttaatttggtatttattataggaagcttatgctacacatcttttttcttaactctcacttatgtatttgggtgtattacttgagatcccaccagcagacagatgttatatgttaggcacaaagacttattacaatttacaaaccacaagcaagaaatcaaaaacttaagttctccaaaagtaactttgtcacaacaagacaacataagccgacaaataatgaatttcagctcgtactagatagcagagaggggagcattttcaggtacctcattaggcttcacttgtattatgtggggaagtaaagatggtccggaagatcctgaaaatcagcccattaaaagacatatatatcagatcttgcatataattattgatccacacaaaagtggtcaagttcaagtgaggtttaaaagagacccaaaaaaaaacctacgaaatctgacacattggcattatcatttatcattcttgaccgtgccacattggttaaggactatggaacacgacanactactacttatatgttaaaccgagttgacactgcccttgtcttgcaggggcaagtgttagaagttattgtatttaaaacatgcaaaaagacaatcaccaaattttgccatttgtaggatttgcacataaatgggttttatttgaagtcctttttaaaagaagcccttccccatggagggtcattttcaaggctcaacccaaattggaaaattccaccttttctgttagacggggccccggggccacccgaaaagggtaaagagggttgtctttttttttatttaaaaaaatgtgcggggctttttgcgctatttttttttctttaagggagaaggggcccttaaaaaaatttttccacaccccccttttattgcgccccgccgccccctggattttttttttttttcaaaataactcttttcccgccaaaagtgtggatatattttcaaaactcccgcgccacaaaaatgccttttataaatttatagcctctttttttgaggttgatattaaccgcgcgggaaaatgtggcgtgttcccacaaaaatttttggtttttttttccaaccggggggcccct

SEQ ID NO: 106147 - DNA, 1014 bp, Oryza sativa
aagtcgaagcatgctttgacatcagcaggagagagtgctggatcatatatttcaatgtcaccaattgggaatatattatctgcctttagaagaagagcgaaggcaagctgatattgagacttcacatcaaattcaaagctcccaaggccataaataaccaattggatgcattcatgagctcccaacatgcttgaaatgtgagaagaaacgctctcatctttcttcacatgatcaataaactttgtgtacagtgcagaactcctaacatcagaaatagtttcatgcatttctttaactatgcttttagcttcctgtaagtgcttgtcctcaatgtatgcatcactaggatttaaatgccacctggtcgattaattcatttagaaaaggaattaatttgtgaagtcaacaatagcgaacgacaaaatacatcccacaaaattattagcgcacgtgaaaaatcataaaacagatggcctagaaacatagtcgatgattgataaaacaacaaacaggtgctgcaggctgcagcaatctgccaatactataatcactgaagtaaaagaagaacatgcattgtagcaatactataattaatgcaaatctcacttaaacggtaaaatagcccattttacataagaaaccctttttttagggtacacgcaagaaagctgcctaaaatggtgtaatcatctttgcttgagttatccttcattaaatatttctttaaaccaaagcatcattttgtttacttaaaattcacagaattcagcaagcaaataatcatgggaaactggtccaaattaattgttttgtcagtatgcagtcttacccttctaactgagcatcacaattcatttggacattgacataactccagacctttgtagcacaattatctgcatcaaacaaagcagcaacaagtcatcagacaacatagtccatgtaggcaccacgttaagcttttacaaaaagggaaatgggctgcaaaagaacctggtatcaagtgttcaatat

SEQ ID NO: 106148 - DNA, 989 bp, Oryza sativa
  unsure (1)..(989): unsure at all n locations
ccacgaatgaggtcgcgggatccggcatcggcggcgggcagggtggcaagatccggcgtcggcgtccgttcccgcggcgtcggcgtccgttcccgcggcatcggcttctcccgtggggacggtgagcttctcccgtggagttgtgaaaaaatttagtgaaaaaggaattgatggctgtgattgatgttggtgaatagtttttgtgatcggtgaattgatgaatagtttttgtgattgatgaatgtttctgtgattcgagatttgtgattgatgaatgtttggttcacggggtgatttgtgatttgtgaatgagatttgtgattcgggttgattcacgggatagatgcgctcaatgcatcggctcgattcgagcctttttttttttttgctcggagtggtctcaaaggtgctagttttaaaaacgggattggtgccagctctctcaaaggtgctagtttttaaaaccctcttgggtgtccgttttcccaaccggcacttttcaactgttctgtggtagtgtcaacttctcaatagtgatcattgccggtcggtcagcgtccgtggtttttacccgcaaaggtttttcacacaaaattcgtgtctccgttatgcatctattttcttaacatctctcctaccataacctagaaacattacacattaattgtcttgaagaagccatgcatgttgcctgttctatatgcttgcaagatataataaatgaaaatttatgtgctatcgaaactgcacagttgtactggttgtcttctcgttcttggtgaaatgaaaatatgctcggttgtgacagccatcctaaaaacataacanagacgttcggaaagtctggctcgtgccgcatggaacggactcgctgtctgcatgcgttgagctcaaatcacgcatagccgaaaaaagactaccatgggcttttgaccaaaaaaatggattggaaagcatgttgaagaacaaatgcatggacaagatatatg

SEQ ID NO: 106149 - DNA, 714 bp, Oryza sativa
  unsure (1)..(714): unsure at all n locations
gatgtnccngtttgaatcatgacatcgctccccacccctgactgtcgagttccttatgacagcccgtcatgaccatccaaccggggctaaatatggaggaataccctccccaggaaattaacttaggattatatataggcgcggaggaatacccgtactgagctgtcaccatcagcggcccacctctcatccgcaatatataaccccaaataatgatatcccgtaatttaaacaccatctatactgattgattgattggttagtggatggttgaattgcatatccaaaagtgataataacgagaatgacatcggcgaaattgatggtgtagtggtggttcagtcagagcaaagtagcagtatagtagttgcgttgggattattgcatggaaagttactgggctgtggatggggtacacaggtctcttactgtcctcttgtgtttttccatgaaatcaatcgaactggtgcaatgcaatttggagttgatgtgacatttgctcaatttggataatcggccgtattatatactcgtccgtttattcaggacatcagaatcatgggctcatggcagcgggtacctgtactatgcaagtaacgagatggattctaatatgaataaaaagagcaatggcatggtgattatgttttttttttctagcagtacaaaattggtgtgcatgttgtgctctttacgtaagctctgataatagcc

SEQ ID NO: 106150 - DNA, 954 bp, Oryza sativa
agaatatgcctgggatgcatttgggattgctaatattgagctggctctcgcaaatcttttgtttcattttgattggactctccctgagggcactctccatagtgatttggatatgacgaaaacgatggggatcactgctaggaggaaggaagacctttatgtgcacgctattccatttgtacaactcccctaatcctagttgtttcgtgtcattagcttgttggttctcctcgcactactgtacttcgactcttggagaagaagaataaaaacacacatgccattttaatcctacagttttctttgtgtgtttagtggatttttttataggtcgtgcaccctctatcttataatataagagattatgccttttttttccaatgattaagaaagtatcaaaatgacaaatgaaagtacaaaagctaataattgatgaaataacactactacagaaaatggttttagtgccggttttcccaactgtcacaagggaggcggcactgatttgaaaatcaaaaaggtgttggttccttagaaccggcaccttttaggttcgatgaataaaaaaaaagccggctcgagctgacgcatctagccgagttgtccctccttctacatccgcaagaactcctcccacatccacaataactcctcccacatccacaagaacagaacaaattttgatccacaacattcatcccacaacattagaagatggatccatcccacaacattcatatcacaacacaaatttatgcaataaaaaaaaatcacaccgccgccgaagaagtgagagggggagggtagggagaggaggggtttgcttggcttggtggcttgccttgttgaagaagatccggccaccatttgaatcgttgtacgccttttgtttgtcgcttcgagccgttgaccatttcccgttgtaacgtttcttcgaagcctgtcggcccttcc

SEQ ID NO: 106151 - DNA, 1626 bp, Oryza sativa
taaaagggatttttttccaaaaagaaaaaatgcattatttttaagtgttaccaatgtttcgtaaacaaactaagtctactttcctttttacaagatcaagaagattaaagaaaattgcttatagggatgcattaaatattatatattatagatctagcaacaaacaatttagaaaaactagtgagcaatgctgagaatgaaaatttatagagatatcgtattgttttttaagagtgacaggtgttatccagtcaatattttactcttatgtttttcatatacttgtctatgatgcatgcccatgcatcaccgttgcgtgggattttttcgaagttgttatttaaatgttcagggaagaagagttaaaagctatatatatatatatgtatatatatatatatatatatgtatatatatatatgtatatatatatatgtatatatatatgtatatatgtatatatgtatatatgtatatatatatatgtatatatatatatatgtatatatatgtatatatatgtatatatatatatacatatatatatccatatatatacatatacatatacatataccggatactaaaaaaaagaacatacttcttaaccgactgagttagtatatatactgaatacttgataaaaaacagtacatacacctaattaacagatcgagtatacactggattcttgaaaacacagtacatactccttaaaacggtacataatactgaaaatataagtacatactacttatatactacttgaaaaaaagagagagcagtatataccaccgatctaggaaaaaatggtatataggagtgatctatatacgaccaattctaaatgttggtaaatactgttctaaatggtgataaatactggtactactaaggatagttagataggtacattattaaattcggaaccaaatgcatggcctcgttcaattgtgaaccaaatccggtgtggagttgtgtatcaacaaaaaataaagttgtttactagtagctaaaagaacagtatatactgaaaaatattagtacgtttttccgctaaacagaacagaccattactgaaaaaatagtttatactactagtttttgaaaagagtatatacttcgatcgactaactactaaggaaatagtatatctcaaattttgaatctggccattaattcctcacggtccggtgtgcatgcatgcaaaaatttgaaaagaaaaacaatagaatagcagctcgcatatgcagaattttaaaaataaaatgaatattactattttttaattcttaaccagactatccattatcaactaatggatatccaacaagaaggagggagtacgtacacccgggtgtacagatttgctatatatatataaaggagagtcaagggacgacatagaagaggacgtaggcaccatgtggaggaccgtccatcagagatcgatctctctcggcttctccttcgccgccactgcctagggcatccccgcgccgacgctgccgccgtatctcgccgtcgtctcgcgctcgtcatcgtcaccgccgcctccgcctcctccgccgccgccgcatctctggggtgagagccgccgcgcgccgcctccctctcgatctctct

SEQ ID NO: 106152 - DNA, 761 bp, Oryza sativa
  unsure (1)..(761): unsure at all n locations
aagaggttatttgtatattctattgttcatgccgcagtctagtcttattatccccgatgcatcatgcatggtactcatttatttttctagcacgttggtgtagtactccttccatcctataagacattatcacactaaaatttgtcctaaaatataatgtatttatgatcccaagacaatactttattccccacatatctacttttgtactaggttattactcacccactcacatttgtactaatttacactactccaaaacatcaaataggtgtcgccactataagtgccggtagtgttaaaaccggcacctataggcccttttccacctccatgaattgaaatcgcaaaaaaccagtacctttaagtaattacatgtgcttctaaataaaaaccgacacctattatatttagtgtccctttttttaaaaaaggcacatataatatattataggtgtcggttaattaaaaaaacgacaccctataaatcgagccgaaccggcgggccctaccaccatgaggcgacctgaggagatgtggtctcactctctcgctctttcttcggcttttctctgtctcgctctcttctctcgtctctctccttcccttctctcccgccgncggcggcttgcccgcggangcaacannggngaccgngcccttcccttcggcagatccnacnngaagggaagcngtggcngaaagaagggaagcntcaacggccggttgggtccgcggtaagtggggcttatcgggtccgc

SEQ ID NO: 106153 - DNA, 3064 bp, Oryza sativa
  unsure (1)..(3064): unsure at all n locations
gcggcttgatgacanncagctcggnacccgncangaaactctatgccatatgccagccaaaccaagagtgcacattcctggtgccacccatacccaacctgtagggtgtactataagggacatggccggttcattgtaaaaaaataatctactatcaatcaatcgaatcgtgttttcatattgcttttagtttttctcttagtttgtccatctttactggtttgcgctgtaaaccgtccgtcgccgttgcgagagtgcgacatctctttgtaggtttgtcctgaaaatcttccgttttgcccacgagacgggtagttatctagaaatcggctccgctagacggtttagttatcaaaacccatctaggtttagccctttgctagatcgaggtggttgacgactctaggatcaccgcaaggcttaagctgctgtgatcgtgcttgtcaacttgtcaaaaaagttgccaacagcccgattctgaattgcgtccaaaaaagccacattgcaattgtggaaaaaaatgatagtcatattctgataagtcagcatctattctagaatgcaaacacataaatatagtagcacatgtaagaaaatacataaaatcactagttttgaccttgaggcttaggtagctgcattcttccatctctcatgttttggaaccgctttttatggcattaggatcaagtttcttgaataaatctcgctcaatgtagcacaagcacaacatcaagttattaagctagttgttggatagtctgttgacgccgagaacaccctttcgacagatgccattgcaataggtagaagcaataatactaacagataagacggtagacaaatggaaatacaacgtgtctttcagtttgaaccatcttttcagctagactagtaagatctaggcaatcagtgaaatcttcaatttttcgcacattaagaataaaagtttcaggttgatgcacagtcacaaattgagaaatatatcttgattatatatctctgtaagtcaaacaatcttatccatgtcgaacttggaaaataaatcaatcttatccgctagcagccgccgcagcacgagatgagctggctatcacaggctgagcgccgccacctcgccggcgcgctcgtcgtccccgtagccgcgccagcattcaccgttgagccgccggccgccattttctgccagcccaccggccgccaacaagcgccaatcgcagggcagaatcgatcaagcagtcactcctagccccagtgtcaaatggggaacgattaattcttagggagaaaaataggtgggctgcactctatgggccaggcccagtactcatcttggaggcccatgtcaagctctaaagcccccccattccaggccatagcaacacaacatcttcgactgttatcttcgtctacctcgcgatgctgctcgagacgctgaatctcggctgccgctcggggctagaatggaccctgggaaagtggggggtggagggtgttcgtgtcaccagctagctatggcgcacgccactgcatgccatagtggtagatccctctctggtcgggagaggctctccctcctgattgagagtggcacggagagatcgtgtatggggaaaggatcggtgaagcgatttctgttcatgtttctgttggtagtaaaggtaggtcgtctttttattattgaaagttgattttaagatatctcttggagataaaaaaaatatttaaacattacaattaaatcaggaatttcaaaaatagaattttaagagatggatttggggcatttgttgagcttgctcttatataatcccgtttctctcaacctatttagttctggccctagcgccgaagtcacaaaactactgactatactccctacgtttcaaaataagttctatttactggtatagattaaggtttccgagaaaaagactttcatgatgtcattacataaggaatggtgttagaagtaggagggtggttgagagtaagatggaaataaaatattggaagtgatttataggacaaatagtacttaaatctcacattgtaatagaagtgcttaaattctagtacaaatatcacattcattttcatatgtatgatcctctaaaaggctctagtggtggtcaaagtaaatttgcagtccactattgcttttaatttaatatttcttgatattataggatagtccaatatttgattcaaacaaattgaatattaaataagaaaataataatgatactaatatacggtagcgctattccactctctacagcgcggaatattagttcgagcgccgcacaatgccctctccttccagttttccccttttttaccaccccaccttttctgtgaatcccaccttctctcggttcgtttttttcgttttttaccactcaaccttccgtgtttttttttctcttttccatctcattcgtgcttcatcaatagccccagtaaaatattaaccatctagatttttctgtttttcgttccttctatgtagtttttctgttttcgcgttttagtaaaatatttaccgtctaatttttcattccgagttttccgtttttatctccgcacgcttcaaaagtaacgaatttactccgtggaatttttcatttactcccagcctcccacatctgctcatccaaaagtaacaaatttactcgcatgaatgcctccacatcgtatgacgccataactggatggtcataaaagaattactaccagcttacaacgctagtaattgttttaccaatattataaatattgtttagatttcgtggtctgtgagtaaaacaattactaccttcctctcgatatagcccatgatctcataggcaccgtgtaataatatgtttactgatgtgttcaatacacacagtacaagagtaaaaattgagatttcgtggtctacaagtaaaacaattaccaccttcctctcgtagtcaccgtgatctcgtagtcaccgtgtagtaatatgtttactgatgtgatgtgttcaatggggatcctctagagtcgacctcaggcagcagaatagatcatagctcct

SEQ ID NO: 106154 - DNA, 970 bp, Oryza sativa
  unsure (1)..(970): unsure at all n locations
cgtcttttattgtgttggtaaggaccaaagataattcaaaaaaaatcttttctacaaactccttaatcagaaatatctgattattaattaggtgaatcgtgttatcttatccatagatttatttttcaaacatgtctttaaagttgggggcctaataaatcccaacaaaatagcagtttaatatgtatatatattgccaatcccgttgcgtgcaaacttatgtcacacgtacgtacattgtcttcagcaacttgttgctgtaggtacatgcatatttcttgagattatacggaccccttcaaataaacgtgatgtgttatttttaggtcttgcatcaatcgataaatatttgatcttgaactcagttgctcattaattgttttttaactcttacacacccatttgtattgaacatgtgtgttaaaagttacataggactcgggtctatttatacccaagaattaaaatatacgtccataacggacacgactactatctctaacaaactctaagataccataagtctttgcggcagacttttgcccaaacgtatctctaaggaaattacataaaacatcctaattaatagatacaattgcctcccccaaaaggggggggaaaaccccttttccctttaaaaattcccccccaaattgggtggccggcgcaatcaccttgaagccaccacgatccaacccgacatcacacatcaagttgtattgtcgggatcggctacatcggcttacctagcccgactcagactcagccgatcttatcgtagccgatctggactccagccgattcctgctntgttatagaacccgatctatgcccccgacttccttnagatctgatcttctttcccaatgccaatgttaccaaattttgttgttaacacatgccccccaggggctggtntagagtcgaaatgcaggcggacagtacgacgactatcaatnnnnnnncccac

SEQ ID NO: 106155 - DNA, 1287 bp, Oryza sativa
  unsure (1)..(1287): unsure at all n locations
ccgttgaannntctaaatggaaattcgtcatggtcgcangcctgcaggtctactctagaggatcccctggatatatacatatatatatatatatgtctatatatatatatatatgattgctctattctacaccctcctatgggcccgcccggcgaggcccaccaagtgaccccgcccccctatttgtgtagagctctcttccatctcccctctactggcgccccttacttcgtttgatttctctctcgatctttctcccatctacaatggatagaaaattttaaaactaatttagagtgacaaaacccaggcttgaacccatgactcatgggtcaaagaaacgctggattaactaattcaccttatgacatctagcgattagaggttgaaggttcagtcttaaatatctatattcaaactttgcgagagcaaatcacttatattggcgcggaacaaataatctggtagaatgtttcaatcgtaacattattgcaaaagtgcattatcatgtaacggtactgtggaaatataaatatatagatcgcaactgcaaaaatatataggctgtcactgcaacttggacagaaaaaccccgggaaaattattggccacagaccttgtatggacagtaaccggacttctacagactatcggatgttgtgactacaagaaagaaaacatgtcccttttataatggccatcttgttaccggacatttccttacgagacaagtgcaccaaagaggcggggcgtatagggaaaggagcaacacagatcaatccatcggtccagacttaaccacaaatgggacggttggaaatcctaatctttaaaccaatctacctcttgcatcaaataatatatttttggaaccggtttaaccataatgcttaaaaaaagagccttataaaacttgatccatcgtcgtaaaattcgccaacggtataaaatgggactgggaagaagcacccctttaccttacgaagggccccttcctctgtataaatacggtgaaacaaggccacaaaaaagtgaacttgggggaattgagagggcgagcttcaccggggcgggaggttaaccgcccttggacataaatggaggagaatccgggccctagtaggtggcgaaaaggatcatacctttaaggggctccccacggtaaacaaaccacaaaacggggaaagctaccaaaggttttaaacaaaggaaacggagagaagaaaccctttgctcgtatttacccaatcgtaccgccaacaggggcctgctttcttctgtcggact

SEQ ID NO: 106156 - DNA, 1291 bp, Oryza sativa
  unsure (1)..(1291): unsure at all n locations
atgtgncnatgtanaatgcatagcgccatgctgcangcccgcacgtcgacattatatgattctctacacacatcgcatagttgtatatcacaagcagacattgttatacgggttgactatacattataatacaagggtagcccaaatgggacccaaatagaccgaacatggtcatgtacattacaagataccaacgtagtccacaggcatcgactgatgaacctaggtcctgactccacagtctttgatatctcttcatcagcatagttcccatatggtcgacatccaacttctaaaagatttagtttagcaagggtgagtattaaccgtactcatcaagccaccactatacataatgcatttaatgtacacaggggttcaaggatggttatgtatatttgcataaagctagatttcacctatgacctatcagttttaactgaaaacagcgctaagttgaagttgtcattaatccgtgagggttcattcaccttccccaaacctcgcttggtcgggtttaccctcgcatctagtttttcacactttcaacattacaatgacctttccacccattcggcaaggtctcacctcattcctaatataagcaagattaaaatctatgacgcttgtcaagaataatacaagtcccggcgctcattaacctggagcacgactatttcaaatagatggttactcaagcttgaatggatgtaccctttttaatccaacattcgtgacttgcccacacatgaccttatcccacacatgagacccgcttttcggcattttgtattttggaccccgctccaggactttaaattctcaatgtattcttaataaaacacaccctctggaaccacccatgaggggagccttgcccttaccggatcataaaaagtacattacatatccgcttatttagcgcttttagatttctgggggcaaaacaacacaccttttattagattctcttttcctaataagatccacctgtcaggggtgccgccccaggagattttttattcaccggttttaccccggcgaagaggaggggccctgatcatttcttgctaatgtttgtatggctcttaacaaagaggccaaagacaccttttttcagaccaacctttttcttatatggcctctttagaaaatattttttaaatatttcgttttttaaagatttttctgtgngtgttctttgtttccaccactctcataaattcttctgagggggcctcacatatctctttaaacacttggtgtttgttttccataataaaaatataaa

SEQ ID NO: 106157 - DNA, 549 bp, Oryza sativa
ggagggagttttttctttaaggatttgggcgggagttaaaaaccggataatggggcacatccaaggacaaacagcctttggtggccgtttaattataaaaaggccctggaacccgccaaaaaacctttgggctgctcttacagagttgtgtggttcccggaatccctctttacaacaagtgtgcgcgcggttcctggagagcccattgtataaaagatgtttaccgccttactcacaatgcgccaaggacaaaagagccctccgaaaaaccttatttgttataagttatattgttttgttatacacggggttttatatacaacgcgggcgcttcttttggaaatattggcggcccccccccccctcttggctatttttctaaaagagtgcatatatgatgtgtaacactgtgagaacaacaaacgcgtgcttatgtgctgtatatatttcatataaagagagagcagagtggagggcctccactcctccgggcggcttctcatctcttctgtggcgcgacttctgcctctcattaatatcatcaacacg

SEQ ID NO: 106158 - DNA, 1165 bp, Oryza sativa
cgtatggattaatgttttaagagagtggcttattgtaaggaggatgggggttgggggtacaataaaaaagtagttgtgagatggggcaaaccgtaggcattattatgagttattgccaaatagagtcaaattagtaaaagggtaggtcaaaagcaggttagatttttttaaaagggcaaaagttgggcttgtgaattaatttccatggggtataacttatttttggaagggggaacatcgcttggcgtaatagctggcggcgccggtgtgtaagaaacgtctcatagcgtgaagtaggacgtggtcgggaagggacaagaggtggaggagcatgagccctaccaggtccgccgagagcccgccacggtgatgatggttgctgcacaaccgccatcctcctcgttgtcgttggaagcaacggcggcggcatggagcgcgagcaggagttgaccgtgcgcaaggtggttgcggcgctccgtgtcaggggcaatctcgctatttcaaaaaatttctcacctcttttgtgtcctatagccaattacacaaattttgtagtgtacatcagccgtgtcacgtttttgtggtgtctcacagccaattatacattttttgagtgtcctgtagcaaattttgccttacctaaatatgttcggagaacttcgaaaaaagtaagaaaaagaggaggttagtcactaccccaaacacatgagggtggttgctcgcatccatggtatggtacatactcacattaatcgataatatattaatattattaaaattgttctttatagtaaatgatgtgaaactaaaaattttaaccttatattcttctattgttccatcttcttattttctcattcttatttattttttgataataatattgctacagccagcactattacttgcacatgaatactactccctccatccctaaatataagggattttggttggatgtgacacattctaatataatgaatctagatatagagcctgtccaaattcgctgtgctaggatgtatcacatccaacgaaaatcccttatatttagggacggagggagtagcgggtagctcacgtgtgtgtgctccgtaatatatattatctatatttttacacgaggaaacaataactattatctttgttaatcagccccaaatgt

SEQ ID NO: 106159 - DNA, 1231 bp, Oryza sativa
  unsure (1)..(1231): unsure at all n locations
caggagttgctactatgttatatatctagaatgtacaagtgcaaagtttgagtactctctctcgtattaaacaaggagacatgggggcttacccacacacccaatctcatgtcgtaacacatgcttctcttcaccttgggtgggtgagagacaacatagatcatagagtacaattatctcatccattgcctaactcttattccggaagttttcaaatgattttgcaaataaaaccaagttcctcaagtgattctctaaatcactcaatgtgtatgaatattgttcctcaccaagattatgcctttttgtctcctacactaaagctgaatatgtgcggtttgttagggattaagaacaaggcatacttgcaatcacatttattactaagtcaaaaaatctagataagcagatagcaaatcatacttaagatcaagatcgtgcatcgtgtttggaatatatggtggaaatgaaatgaacataattactccttttgtatacctcttcctcattttttaaagcttttgagagagtctttttggctaaatatantttttctcaagaatatttttgagagagntcatgcccccatatgagagagaatatttctctctctctcttctctagccaatctcctctnttattttcttttggaaaagaggtataaatatcatggagtcctaattagtggatgacatatatggtatatgatggattggaatanatgctacctttcaatgtaaaaacttaacaccatgggcacatatgtgggggcatgaacttgaacactaaggttaaaaagcctctacattaatcattaaggttgacaaaaattaatgggcttcccagcaaccacaaggataaagggttaaccatgcgcaaacattttggcattggtgggattctaatcaaagaggaacctttaaaattatattttgaaaccaaaatattgggagtaaagcaaacttggggaagggttataaacctatttacttatttttttttcaaacaccccacattaaaaaggcggggggcactattcttttaggggccgcaaaaaattgggttgcctctcttacacgggggaaacctcctctttggctatcaatcgaaaattagagacagagatttttttttatttcatccgcgcatagatggggtcacaaccaacaaaagacacctttttgggtttttttttgagaatattatttggtaacatattagcgcggcgggg

SEQ ID NO: 106160 - DNA, 1185 bp, Oryza sativa
  unsure (1)..(1185): unsure at all n locations
ctgtgcctatctacttgatctattcatctcggagttgtgaatggcataagtatatatatggagatgcttgcgtantggggtgtacgttggcatctgttgaagtgtatcgatcggcctaccatatcaaagtgttaattcaacacccaaaagtacatgaagcatcaatttatatagatggcaaaaaaagttactggtagggcttgatacacagtactaaaaggcaagtattccttccgatcacaaatacttacatttcttaggagaataaccgatcgaaattagaatatttgactataaagtaattttaaaatacatagtttgaaaacataaaaatggtatgtgcaaatttataacgagaggtacttttataatctcataaatttattggaaaagaaatttgaggtcagagtcataccttaattaaagagacccagaaaaaagacgacttcatgcttggttctcacgagcagggagcagaaatagatcttatctgcatatatgattgtatgaattttcgcttattgttaacacagccaattaggcaaactcgcagtccattcaagataaagcattgtaacatgtctatattggtaccatataacatcttctcttatctataaaggataaaaaatcctactgtagttacccatggtactcatctaccgctttcacagctggtgtgtatgtaggatcgaatcataagaacttaaccaaccagagggggggtgatgattggtataccaaaaaccggaaacttttagcggaantaaagttacccttctaatcgacggaagtcgtctgaacgagattgatctgcgtcttgacggtgttgatctcggctgacggcgaattcctgcccgcctgtgcacccgccgtttacggccggttctgcggtngaccgcgcatggcggcgttttaaccgcggagttgccggttaaccttnaaaccgggaaacaaaatgggaaccttaaaggggtgcgaccttttggttctttgggtacaagggccacagcttcttcaaaatttgctaactcgaacctaataaaataacttttgtttttagaggcccggagaccaccttccctttttttcagagtngcggcttgagcccaccaacttttctgggctaacctgaaaactcttccgaagaattttaacaagggcaattgcctctccaagctcccc

SEQ ID NO: 106161 - DNA, 2175 bp, Oryza sativa
  unsure (1)..(2175): unsure at all n locations
gaggggnnnatganatcatgctcggcactcctagattttcgcatgcggacatcaaatttcaccctgacttatatttttgtaggccgttatttggctctaagcgtcatgtccgcctgcgaaaataagacccctatgttgggaaaaatgctttttctagtagtgtaggccaaacataacgcattttggtgcatatgtctagctgcataaatattcgcccactagaagtactccacatgtcacaattgttaaaactacggtgttctccatgacgggcgttttgatagtgggtgccatatggcaggccatgcactgtgccatgacatgtcattacttgccgtaacgtggtaaaatctttaatctgaaagctcagaattccatttacagttaagattttcctttggtatatcagatgagtactcttaacagaagacattttgattaaaaggagaaggaaaggaagtttctataactctaaagaaacaattcaacatctctttttttattgtcatgctgcacatttggtttggaatgctcttttcatggttctagctagaatacaagtgcccacttatgttgctaatcttctaggtggttggtcgacggacttagtacctaagcttagagatcaactcttcgtgggagttgcggctatctgttgggcactttggcttgctagtaatgatgtagttatcaatggctcaagtataaactttttcttgcaggttattttttgggggacgcactggagtcgccagtggtccttgcttcttaaagaaggtgacaaggaagctgtgaagatggggtgccaaaaatcgaaagttatcgttatggaattctactcaaagtctcgacggaattgtagaggaagattgaattgttagctgaaatttttttgttgtgagacttgttctggatgtttttgtcatctatttgccttctatggtggcgtttgcttttgaacttgtttgtcagcctaagtgtgtggtgatgtaatactgcggctgcgtacatccttcgggatgtataaggcaggttttatttaatccattatcttaaaaaaaaaagtcgttacttcccttggcccagtcactgtcccagcagcacaagatttgcagataaaatcatcgattgtcttgaaaaccactgagaaattagggctaattattctggacggttgcgtcaacatttatctgggcttccagtgtgcctgctatcaaagcttgtttgacttgaaggatgaagtgaagctgatcaactgggaaatttgagtcagctaatgtttcgtgtactacataagacttgacgcaaccgagctaactggataaacgtggataaatcatatgtgttggcaacttttttatgataagttgacaacaacgatcgcagcacctaatgctttgaggtgatcctagagtcgccaatcaccttaacctagcaaaaactagaccaagatgggttttgataactaaactagctagcggagccgattactagataactacccgtctcgtgggtaaaacggaaggttttcaggataaacctataaagaggtgtcgcactctcacagcggcgccggacgatttacggtgcaaatcgacaaagatggacaaactaagagaaaactaaaaacaatatgaaaaacgattcgattgattgattgtagattggttagttacagttgaaccggccatgtcccttatataggggttggtcttgacctctacagtcccctccttcatgtctaactcgagatagaatccaaagaaaacccgaaacatatcttcccaagcaaggaaacctcgagacccgacgaaacacactcggacttagacctgctggtcagaccggccacacaccgccggtctgaccggccctcaaccggcggtctgaccggtcaacacatggcggtcagaccggcccactcaaaggaaaccggtagatttttaaattttggcaattcttcctattttaatcttagatgtcaaatttaggtgtaaacaatatgtacctgcaaaatactcttgtttgaaacagcatggtttaagatatattgccgcgattaatttgcccattgtagttatcaccacgagtcttaattttcgttaccacactactagaacaaaattagattgtttggaaagaaaaatcctctgtcttgaagtgcccgtcaaagat

SEQ ID NO: 106162 - DNA, 3119 bp, Oryza sativa
  unsure (1)..(3119): unsure at all n locations
cggcgtggttgtttttgacatgcagctcggcacccttacaatcttcccttgggattaaagaaatacgataccttgtaatactcccgagtgaaatgctacaatgctacatccgtgcgcttgcggattctttctataaaccatatatatactaggacaatttctagcgcatttactgggaatttatatttctagtaatgtcggtaagaaataccaacaacgtcctcgtcgcattcgatggaggccgacatctcggtggagatcgggatcatcggcaccttggtggacaatggccccagcgaggatgaggggcgacgggtggacgatggccccgaggacacggtactctacgcaaagcggccaaactcgtcgtgctcctgacgccgggagtggtggttggggtgaccacccatcgtcgcacctccacctattgttgcgatctgtacatgattcctattgctgcgatctgcagatgatgggggcgaagaatatgttgcgccggttgatgggagaagttggggagaaggcgaggggtgtgaagtggggagaagacgagtggaaagggggcaggcatctaaaatactaatttttaacgattagggccactgacttgtggggctgccaaggacaacagagtgatcctctgtcatgttggacccattgtagtcaacacgaagtcaaggtgggttgaatccaatgtgccactgaaatgcggctcctacatgtcggcgttagtttctttccgagttatagattattttttgctgatcttcttattaattattttgtattttgatttataacaaaaactttaaacatgtatagattttgcatatgttgtctagatcaggtggttctttttttctaaattcttacgaaacttttttctaactcatgcattcatttgcatcacatggattcattttcttgctcaacaatagatgtcgattccagtaaaaaaacaatagatgtcgattctcacatcacgtggattcatattgcatcatgttacacgagtttacaaatccgtttttctatgtttaattagagtttaaccattaataaaaaaatattctaggattatgatgcaataatgaattaatattgcataggaaaatcggatttattgcgtcatcaaggattggtcccccatagacttggttcaccgagagagtccatagctgtccatgggaatggtcgactgagatagatcttgactgggaattgaccgagatcatacggccaagattgaatccagatggatgccacacgggcaaaacacgcaagcggcaatgcaagcgaagggctgaggtggcagctgaagaggcagacaatgtggcgctgatgtcacctcacttgcaatgaccgacgtcgaaccggaaggacgctggcgttccacgccacgacggcagaaacgaaggacaccggaaggacaagcgtgactcaaggaactcacaaggggtgcagcaaggatggatgacgacggccaacttttggtggtgaggttggtcggcgatggtggtgacgctctggcaattgacgatggcaacgaagaggtggcgatgatgacctctggtggcaacggaaacggcggtggggctcaactagagttcaacaaacgatggtggcggcgctacgaacgacgagagcctagggcaaagagtggaaacaagagaggagattaggggattctatttaaaggcgggggaggaagagagcaacactaggacaagagaatttgttgtcggatttttcggggggaaagaaaaggaggaaaagggaaagatttccccttaacaattttgcaaaatctttacgggttcgaggggatttcgtggttgaagacactgttgtgggaggaaatgtataatttttcttccttctttgagcccgtgggaggacgaaacttatattttggccggaaagaaaaagaggttggccggcgggcgtggtgagagagagaagggtatgggctgaaacaaattgaagatttattttcatttatataagtaccaaaaaaaatctttgtattattaaaattagtaatatgagctctcaaaaatccgagaaaattcgagagtgtaattaatcatggagaatttaataaaaattaaatcaaaccatgttttaataaggaaattttatttctcacattttacttcatttgtaattaaagaacatttaatataaattctaaaaatgaaaatcagggtgtgacctttttctaccataaggttgtagggttatttttctagaagatttcccctataatgatatctatggtttcataatatctcaaaccaagggtttgggtaaatggtgttagtttatacctgtttttatatacacaaattaatcgaccaggttttaaacacaaatagatttaaaatatccatctattactaagaacgtacaagatttcgacttaaattgtttattaaaactacaggatgttacatgggccgagtggactaggctcatgtggcatgatgtaatttgataaaggtggcaggtacctgcattataagatgaaccgttttcactagtttgttgtgtaaaataagccgaaaattaatttagggggttaagcgctgtggcaaaatagttcggtgggagtaaaagggatttttttccaaaaagaaaaaatgcattatttttaagtgttaccaatgtttcgtaaacaaactaagtctactttcctttttacaagatcaagaagattaaagaaaattgcttatagggatgcattaaatattatatattatagatctagcaacaaacaatttagaaaaactagtgagcaatgctgagaatgaaaatttatagagatatcgtattgttttttaagagtgacaggtgttatccagtcaatattttactcttatgtttttcatatacttgtctatgatgcatgcccatnngcatcaccgttgnncgtgggnaatttnttttnttnttttcccggnaaanaaaggggttttttttggggttttttttaaaattttttaaatgttcagggaagaagagttaaaagctatatnatatatatatgnatatatatatatatatatannnnnatannntannnnnttgccttgtagntgnatatnnnnnnncattat

SEQ ID NO: 106163 - DNA, 876 bp, Oryza sativa
  unsure (1)..(876): unsure at all n locations
aatgcttggtactgatgttgttgttttatcnctcttctctcaattgtaagantatatttttgtctttttttcttctatttntttnnnnnnnnnnnnggcgtgttgttgatcgactccctcacganagcgcgaanncnagctcggnacccgaccacaccacggggcaccatctgatggaagtcgatcgagccgtgtcgacgccttcttctgcgcgccaggtgcatgatggtagtgtcatcctccgagctggcatcccggaaggtggcgtaatcgcgggctccttcgcgacaagggtggtagcggtagggcgagtgctgtagctcgtccgggtagcgctggtgaagagtgcccatggcgaagagagcggcgctctggcaagcggcggagaaagaatctccacccgcggtgactgccaacgaagtcctctcgggtgagccagtgaggatcactacagtaacctcccaagcagcgtggggctctgcatcgtcaccctcctgctccgggagcgttctgccctggtagtccactccatgcgaataccccaagacaacgcacatgccccgcagctccaagacgaaaccagtcaggtccagaccacgacggctgacgctgccggccatctacaaacaaaaacaaaaagaaaagcaacatttaaaagtcagattttggcgataaatgaagcagcaggacagagagagactagagagttttcacaaatagcaaaggatttttatttttgataatattgctaaggcttgggatctacggctcgtcctagggtcaagggggctctgataccaacttgtcacgaccggaattaacccaacgggcgttcctttcgtgcgtgtattattccttgtcccaggaggcaaggta

SEQ ID NO: 106164 - DNA, 560 bp, Oryza sativa
cgggtgggtaatcggtctcactatcgggcgaattcgagctcggtacccttttctatcccgcagtctaaaactataggtacctaaatctgcacagaacctatctagatttgaagtataagtggtgtctaatcgcagaattaggtacctatagttttagactgcgggatagaaaatatggtcgacaaatatatattattcacaaatggcctaatgttatgttccgtgcttaatatagggattcgaggtcgttaacttcacaacgccggtgtcgagtgtcaaggttttatctctcgtcatgaaaaatctcagcttggacagggttatcatgttaatgatttgctttccatgcttggagaaattgtacatcaaaggaaaaattcttttattttcaagtattgtgttacaatacttcttttgtcagtttaaataattagaaggtatttaatttgaagaacttaaattattccccatttcttatttcaggggttcaagtgtggggaaactaattattgacgccgcaagtatctgaaaactatcaaaagccataacatatctctaaa

SEQ ID NO: 106165 - DNA, 1064 bp, Oryza sativa
  unsure (1)..(1064): unsure at all n locations
ctacgaatccgaaactatttatagctatctttagtccgggtgaaataaccggggtgtaactttaaccggtactataaatacagtagagtcatcaccaatttgttttctttttttttcatttgttttttgtttgcatattaatttcgcgtcaaaatcacaaatcaaataaacattcacattcacagatcaacgctaaattcacaaatcaaataaacattcacagatctttgatatcacaaattcacatactcaacaataaaattaatcgtccacaaattcacaaaaaataatcataaacaacaccatgcatttacacaacaaaaaatcaacacaacacagatccgccgccgacccctccgagccgtagtcggccaccccttcgnccgtncgnccacccgncacctgccgttatcttccactccacctgccgccacccttcacggccttcatggcgtgctgccatgcaccaccgccggccaccacctgccaccaagagagaagcccgtgaagagaagaagaaatcgagaggagaggggagatgagtctggcgaagggataagacgtgcgcggtggacgagaagatagtgtctcgagagtgaaggtgtgcggctatattttttttcaaatgtggtcctagttggtataaacaaccgggactaaatatatatctttaaaccggactaaagatagtggggccggatgactttttaaactgggactaaaaatgatctttagtcctggttataaagatcaaaaagttcccttgggttttttaactgggactaaaaagaatctttaatcccggttcctatttgaaccggggctattgttccactagtgattacgtgtctataaaatgcatgctatagcggtatagcccaagtctcagagctatgtattcttacacgcgtacaacctcatgttgaaatggtggttgaattaccgactaatttcttcctgtatatgttgatagttgcgtcgattagttttaaattacgactgaaaatttaaagagatacacatccataattgaagaattgaagataaaaattacggtacggtca

SEQ ID NO: 106166 - DNA, 1815 bp, Oryza sativa
  unsure (1)..(1815): unsure at all n locations
gacttttatggcggatggtacaccgaccgttcttttggcctctgtgttcgaatcctgcgctgtgatgtcaccgttatcatacatacatgcatattctcaactttagcaaaggttgcgttcttgcagctttaaaagaaaatgctttaattaatactttctccatattttaatgtatgacgccattaactttttaaccaatgtttgactactcgttttattccaaatttgtatgcaaatataaaaatacttatgtcgtgcttaaagaacatttgatgataaatcaagtcataataaaataaattataattacataaattttttaaataagacgaaagttcaaacgtttgtcaaaaagtcaacagcgtcatacattaaaatacgaagggagtatataaattgaatggcttaaaccgaaacagcatccatgatatgcaaaacttcacatattaaaatctgtagtacaactaattaaagtacttacataacatcccgattgggtattaaattttctggcgttttggcgtgggcatctaattccaattccgagctaacaaaagaagatcgaacaaaatgtgacagaccactcataaactctagtggatggaacccgcgtattgctgcggagttttgtgcagacaaaagcaaaaaagaatatatagggagacggcactaaataagaaagaaattcatcaaaactaaaacatatactaatagctagggagatcgattcgttcgagtataagtcgatgcccgcattttctcattaattagattaaactttttgggttaaattggttgatgtatctaactcaatatatggtttagtcaaaagatctcgagttcaatttccggctgacatgtaattaaataaaaatttgcagcccatcactattctatactagttgataccccgcgcgttgctgcgggcataaaagagcatttttttctatgtgcaatatcagtgcaaaaatcctaaataaacttgcttacaatttgctgagaatgtcttatgataatatgatccacggacgctatgcctgcctgagtactacagagatgggctgagagaaaaagacgtgggaggctaggagcccatcagcccagctgctttacattgatcttgggcctcctgtctatctacggataagcagacggattgatcggacggctgaaaaacactgatgacgtggatgaatgtaacgccccgattttcgttcgggattaaaaatcattaaataatgcattttctagaaattaaataaaagttaaatcaatttaatcaagtgaaattatggaggaaattaaaattttcctttaaaaatcattggccgagaatattttgtaatattctttgtgccctaaaatactctccagatttttcccgtgaattttcggagctcaagaaataattttaaagttacaaagttcattaactcaatttagaataaaaagaaaacaaataaaaatctccttcttctctttgggctgctttcggcccaatccccctccctccttctttcctctccggcccagccgcctccctcctcccctcttctctctcgggtcggcccagcctagctctcctctctttaagtccacataacacccttcctcggccctctctctctctccgaccaacatgtgggacccgaggccccacatgtcaggaccgtccccaaccttcggccggcctccatggccgccgaaaccaccccacgacgccgcttcctccgcgcgcctccacgctcccgcgcgcgtgcagacgtggtccaccccacggggtaccgagatcgaatcncaatnnanangggcgcc

SEQ ID NO: 106167 - DNA, 769 bp, Oryza sativa
ccgtttgattagcactccgcaccctgatatgttttattttcaaagaaaaagaacacttattttagataaaagtaactttggttttagatagaagtaacttcagttctaaatagaagtaattttggtttcaaaaatagatgtaactttgtttctaaatagaattaactttgttttaatataaaagtaacttaatttggttttacatagaagtaactttagttttaaatagatgaaactttgttttagcataaaagtaactttggtgtttagatagaaataactatgttttcagatataaataattttgattttatatagaagtaactttgtttccagatataagtaacttcggtacagatagaagaaacttaatttggttttagatacaagcaactttgtttttacatgcatggtctaagatagaagtaacttaggtattcctaataaaagtaacttcagtactatttattttctgatttaacgatgtttaaagttgtttatacaaattttggaactaattaatggcaagccggacacaaattttggcaatatgattatggatgtaatataacctatttagtagtaacatatacataatacagatataactatatgtatattggtcctttctgccattctccttttatgtaggattaaaaaataaatacatggaagtatcggcggaagatagatatatatatagtttatgaactgaaatgatcgaagtgtcaagatgtttttcggcttaaaagcatgtttgtgttttttt

SEQ ID NO: 106168 - DNA, 753 bp, Oryza sativa
cgaggctttggttgacgttcgactgcaagtagctcatcaaatcggcggcgttacaaatgtaccccccttacaggaatctggtcccaagattttgggatggcttgaaagaaagctggtgctggcgggctgtctgactgatctgctgacacatgctgactctttctgattcaactgactgattgctgcatgaaccaaacctcgcttagcttgctgatgctgtgcttgccatacactgaatagaccgacttccattagtgtgaccttgaccaaaattgctagtgctgatagaatatcttttatttggactgaaccactaacattgtataccttagtgacctgtgagctcaccaagcatactacaaacttgcaaagctttcatgaaaacttggatgttgacttgcatgaatgacagattctgactttattttaacctacttctgacgggaaccacaggtatgctaagaggctggttgaatggtctttcagaaggactagaactggtcttggcactggttgcctaagctggacaggtgagttggcctcacggggttaccctggaattcaatcacataacctgagaccggtgttattattgtgacgccctataattggcttctttaagatatacccaaatggctgcactgggctggaccttccaatagaacgacgacgaggtgagcccacactcatctcttgagactaccccccatacagagagtagtgtacttttggccgactgggacaaatgtactt

SEQ ID NO: 106169 - DNA, 812 bp, Oryza sativa
  unsure (1)..(812): unsure at all n locations
ttccagatcatcaagggtgtcagactttcatnactatttgaatttgaagtgttgagattgatancccttttgctccaagctttaagaccccttctaagatttttgagcttagcattcaaagataatagctggtgctttcctctcactggtattgaccacagcatcacaaggttttgatctcgaatcttttgaaagatttattgtaccagaggttagttgtactttgtcctactctttttgtcaacttttttttcatttttattggttgtatgttgagatttttcatcgcaaaaaatacttgacatggaggaagaaaaacattttttatttgttatttggagctcaaaatggcaaaatttgcaagaaatattgtgcatgatcgatgttccatatatatatctagttttcgataggtttatttttagcagatttatatattagttaactgcaaaagaatgagctagctaggaagagaagaagagaaagaagggtagtttggtaattcgtctgagggatgtatgttttatatatgcagatttttggctagctttaattatcttgttcaaaatatttgaactaactaaagttgtattattttttccgcaattaattaattaatgcatagatggcagacagggcacggatgaataaagagagatatcgtgcgtcatacattgaatgagtcgacatattcatgaaagcagctaagaagaatgctgcatctaagaagaccaaagatattagatgtccatgcgtgcactgcaaaaatcatgatgaactacttgcagtagaacgaatgcaaatcaagctct

SEQ ID NO: 106170 - DNA, 722 bp, Oryza sativa
agaggtttgaattgcgttctactgcaataggtcatcacaataagtggccggtaagtacatatatatggatgccaaacaggactacttaattttcataaatgcttgagtgtttccatgtaataacctattataccttataattatttcgatgttgaaagtgtcacaagcaaccggtgggaacaggactatgtggatattaatgttgtgagttcctaagggttaatgggaaatattgcgcgaattacgacaaggtgagtaatacacacttgttaaattagtggctaacttgcattattgtgaatagttaatttccttaattctgacatgatctgatgtagcttccaaaatttcccaagtatgaaagagagctcaatgatacatgcattcagaacattgaggcggacatgtgctactctatgcaccgggagtgcgcacatcatcttgggctgttttttgacaacgaatgaatgttagccctgccggagaacaaatacctggttaactggaccaggcgtataatataggtagaggtttgtaattcattcaaaatacttcgtaatggtatggccgcagtcaaaattaattttgtgacgtacatatatatgggagcttccgcatattgaatatatgcagagcatcccggctcacatatacctcatgcgttgctctgagatacgcgcaagagaacatactctatcgatagctggattaagtatatcaac

SEQ ID NO: 106171 - DNA, 737 bp, Oryza sativa
  unsure (1)..(737): unsure at all n locations
acacttccatggaactataattgtgctaaacacaccacagaagaggctcacctggctgtgagaacacatgatggaagaatttgaccagaacagaaaggttggggacagcgtccctgaagaaacaatgactgatctgaggtctctaaacgagttggagttcattaggcaaggagcctaactggacagtaggagcattccaggcagtgggaacagtatgtgcaaatgccctgtggccaaagctatgctagacaatgagatggactggagggagacataggtggccatgtgatgtaagatgggctatgacggtgggcagtggctgcactgggtaagacactatatcattttctctttgtctgcaggttcctcaaaggattttaagtcatatgattaggtttgtattttgaaaaaattactctggctgcctacaaaataaagatttacaatttatttatagatttataatttataagaaaaagattccacagtcctactagaagaggaatggcaaatatatgccatacttgtcacaattccctattgtcatgcccagagcagacagcactaatcaattacagcagaggttctcaaagtgtgggcctcagaccagcagcatcagcatcacatgagaatttcttaggaatgcaaatcatcagacttcacaccagaccccttgaatgggaaactctaggggtaaaagcctgatganctncgaagcgcgtntcacctgcacatct

SEQ ID NO: 106172 - DNA, 795 bp, Oryza sativa
  unsure (1)..(795): unsure at all n locations
cgtgggnnttgannttgnttaatgccttcacattggtacagtcgttcattagaacttttaacacttntacatcattcatgtgcttattatatattatccacttaatttactgtggacaacaatatattttgaaggctttgtcattaattttgtgactttaaatcattttaatgcattatttactattttagaaacccatatgtaatgaaatgtaatatgcagtgcttttatctttagtcccggttcttaatcttaaccgggttcaaaaagaatttggaaatagtgggaaaagatctttagtcccgggtgnggntcagaaccgttcctnacgttgcnggtccagcaatttacaccaggtacataaaggtggtcctcacaaggctgtgttgtttcttcaggtccatatgtcacaaaggaatcgaccctgtagagttaggtcctttccgggctttggctgtacagacagtgtgcgagcttgagatgtgtttacctccatcatttttctaattgatgccacaacttaaaggttatatccggcctcaccaaaaagcccttgtgtccctgtccctgcattacgacgtgtccttttgggcgattcttgtacattctaaaaggcttcgtaccgaagcgggccctccccccgggaagccctcctgaaggattgataaacaatttcggcggggcgtgggggctttgttatcctttctcaaagaagggcaatgggatggccttcccttccctccccaccgaaagttattttttttgtaacggaaccaaagggaagaaaaaattctc

SEQ ID NO: 106173 - DNA, 718 bp, Oryza sativa
ccgcgtttgaatgcgctaccagttgatcaccgggtcttcactgtcagcttccacaggggtttgagatgacgtcaacaacccccaatcccagggcctggccagctctgcttcccaacacccccaccatccagttctaggtgggctcctccagggagctgggtgtgttgatgatgacaacaggtggtgtggtttggttgtatctgaatgttgggagaagacattcagtgtggctccatggatgggttaggttggattagagctgagtaagagacaatccctcagatcatgggaaagaaaaagagatgaagacgctaaaggaataggagaaagacggaaggaatgccataaaggacagaaaaggaagagaaagaatgggaggtcaggagttgctggagatcacgatatggttagatctcactttcccaggccccactcctccaaggacccaaggagtttttactttgggggccccccagggcattgggggaatttgtggatggaatcaaaggagagagctggagccttggtcctcttgggagtgtctcaagcctctttagtcaccatggagataggttgcctctggcctcagagactcactcagggtctgaggccccttagcaccatttagccttccttcactcaggcacaaccagagacagggcagacccaggagagccagaatgagaaattggaagagagagaatgcaagctagcctct

SEQ ID NO: 106174 - DNA, 733 bp, Oryza sativa
  unsure (1)..(733): unsure at all n locations
gggggnnatgaccctcctgctcattgggacagncgnncatcacataattccctatgcattttgtattctgtgatagtttgataacctaggaactacattacatctgcggccaatctatcaattcttccatttgaactaaatttgaaaccctaaacctaattaagttccttaattatcaaagaatgacataatacaaaatgcatggagaatnnttgtgggggccacaggtccctctgtntgggcgcctggtcatagctggttcccagctaataaaaaacaattccttacatcatggcaaacaaaaagatataaacactcttaaagaatacgagaaagacggacggaatgccagaatggacagaaaatgaagagaaaaaatgggaggtcaggacttgctggagatcacaatctggttagatctcacttccccaggcccaactccttcacggccccacgagtttttaatttcgggggccccagggaatgggggaaatacgtggtcggactacacgaagacaacttgaggcttggtccttttggcaggtgctaaagcctttctaaggaccatggataggtggtgcctgttgccttaaagacttccctatgctttgaggcccttaacccttgtttgaaccttttcctaattgggccaaaccaaaaaactggtcttcccgtgaattcaaaatttgaaagttggacacagaaatattccacctacccacccactggggcg

SEQ ID NO: 106175 - DNA, 650 bp, Oryza sativa
caacatgcacatattgtgggcgggctattttgaggctgcttgcctgtaacaagacgccattcgagaacatcttgggcgcgggttcttgtgcactggcctgagtgtagcatggagacatgccagagctgcttattcagactttcttgagcgagccacaaagcgttctacggagacctatctcgagaactcattcagacattacgtgatgctcggactgactctctccttggagctgtcacgagaactcgattatgaattattgggaactgggacaagatgtcggcttttgttgggctcatggaaaggatcatggtgagactggaacggtaacgcgcttgcccaatttcatgatgctagggaagcaaatacctggagactgtctgacaacaagacatgcatactcgcagtatgctagacagccaatatgcgtgtggaactttgatctagcagtgattcattagtgaattactcacacagcatgtaccatttaggcctctcagagtgcatagttgacactggcaatatcgtcacagataagtgcttgtaaggtatcatagctcatctttgggcctgtctacatgacgtggctaaatgacgtggtgaataataaccttctttgtgttatttgcgatgccggaggaaataactag

SEQ ID NO: 106176 - DNA, 760 bp, Oryza sativa
  unsure (1)..(760): unsure at all n locations
cgtgtgcntttggactacttgttgtgcacgttcgtgcagaacctcatcattgtgttatattcgcatgatgagcttaacgagttacaatggaatcactttatcacgagacatgatacttgtgatacgcgtgccttccatagcttttgggacgtgggaaccaaacattcgttaatcttaatactatattcatccttacaattgtgtgttctatgctcaatactattgactgtggaacacgcctaacttagcctccattgatgctatgctatgcctgtacggactacgacttactactgtttacaatcatgattgatggttcttgcccctaacttttaattagatctacaagattataagggtgaacaatatgatacaaaacctttaagtttgtgtagtactatattatttgaattatttttttcccgcgataacgcgcagattacgagctggtaaattatatttcttgaggagtgcttcagatatccaaattccaaagtatgacatctggtatacgtcatgtttgaacgcaaggggaaaaactaataggggtggtttgatgcaacaactgcattggagctcagatggtcaaattcttaggctaccacccacccatccaaatgcaagtttggtgctttcaggagaattagaaactgccatgaacatgcagcccatgtgaataacaatggggatattttacccagtaaacagttcaccggaacaaactcttgttggcctaaaaacccatccactctatgtgcat

SEQ ID NO: 106177 - DNA, 750 bp, Oryza sativa
  unsure (1)..(750): unsure at all n locations
cgtggcccatgaccccgtgttctacaagttgtgcagnagttcatcatgagggaataatattaatactggacactcacttctgcaggggtgtattgcttgtgcctatacaccggttggccacttgccaaccacctatttttccatgcaacgggagcaggttgtgtacaaaactaagcatacgacgactaattgcatcccaagagaaaatccaagatcgggttgtgtgccaaggctcaacttaagtacgtgcatcgcagctagcttgacatgctttagtcacagtatgggttgactgactcaacacaaaatgacattacactcaaacattttacagctctccaatggtgatcaagcaccaaccttacaaattatacactatcatgaagggccaccttggtctatattgctcacaagacatctccatatagtacaattctgcagatctcgagtaagtgtagaccgctaatttaccagcaggttgattcttttgatactgtaggggtagattaatttttgagaggatgcacgcgaaacatactttacaccaaattaataccaccgatcatcttaacacgaatagcactagaatatatttacaggaatgacaaatgagctgggatgcatatgacaagacttgagaagagaaaacatacgagaagtcctgcgagcgagatgggtggtacccaacagatgctgacgggcttattgctacttcatccgaggagacattcagatgctaccacgactaat

SEQ ID NO: 106178 - DNA, 724 bp, Oryza sativa
cccgtgtggtgtcgccatcttatgcagtagttcatcattaggatgagataagcaatatgccaattattctgggtgattacaccactatgtgactacagatatcacttgaaagaaaattggtaacatgatgacatatgtgaaacattctaaataagaatgaacagatatcacacctgaaaataaacttacactaataaatttaaaacatgccttatcatttgtcgtgtaagatatcaaacttagtatgaaatgtaattctcaacacgagacctaaatgtgtccattgtactaacacaatcagatgtctacgatctcattacagaacgagtgagtacatataccatactaattcttaacatgagaaatacgagcgtatatatagcactatgtatagagctataaatgcttctactacttgtcacgaggaaatcaccatcagaggatccatagcatgtctagtgccttgacaacgctaataacttgaacaaacccggttagcacaaatcctacatgatatcgagggcattaagtggaaatactttatgttaaactgtgaaatcaactagatattgagaggatttaccacatgacattgaataaagttggaattcttatcatgaaaccgcttgtagtattgacaaatgcgttggagaatgcacatgatatgaaaaacgttaagaggatagaacatcaactgagatggccaatacaaatgcataaaacg

SEQ ID NO: 106179 - DNA, 760 bp, Oryza sativa
  unsure (1)..(760): unsure at all n locations
acggcccatgacnacttgatggtccagtagttcatcacggcaaaaagggctgctagtttgcaaattcctactgttgctgttcaatcatatgtttaaccgactgatttttctgttatagccgccggcaaaaatgatggtgaggcagagatcttaaaagaatagctgtggatgtagtacacagtactgcagacggtgagattcatgccggggggggagggtttctaacacctttattgcgaacacacccgtatcgttgcatagaaaagtaagctcaagagctacttgtttgaacttcaaaaattgggctgttgctgataacctcccagtggaatctatggaccttctctttccgtgtagatagatctacttgtatagctaaaccgaaaccaccattttgtcctatagatcaaccaggacaagcgttgtgtttgtgcaagagatgaactgatagatgtaaccggtagttgacaatagcaacaagagcaactaacaccaacatttggtgggttcgatcgttctcctccctacacattgaacggcaggtacgtagcatagtgacactgtgtgatatgccgatagcttcatatcacttatctagagcttataattggtgttagattcagttttagaaaatgaaaattggagaaagagacgtctctaaaaaaaattatagaaaaaaatgtgaatgtatggggaacgggtatgtaccctggaagtagaatcacacatctcttatcaatgcactatggaggatattgta

SEQ ID NO: 106180 - DNA, 760 bp, Oryza sativa
  unsure (1)..(760): unsure at all n locations
ccgccattgtattaagactctgcagtagttcatcagataaaggatcagatgatatcattctctgacatgatacatgactgagacaacgatgtgtcattttacaacaacacagcgagcacctcttcagttccatctcacataagaattgatgctcatctatctatcacaatcttatccgtgaccctcattctttatggaatgttatataaacacgacagatcaagtcaactgttaaaaagagatagctgtaggcaatatgcaacgatgatgacacgtcacgcgagaatacatcatgcaacggtgatgaggcatgctcgaagaagacctttgagaccttggcaaacttggggagcggcatatgtactttcgtcgaactaaaattgacatttttcgctggctaagttctttagttgaggtttctcaattcacatctttcgttttcttcacacaagtttccaaaatgctaaacaatactttttttaaaagttataccctaaagttactttcaacagtcatattaatctatttctgatagaaaaagatagtacttaattaattacgctaataaattatttccgtttacgtgtgcgagggataaaaaaggcaatcacagccaaaaatgggaaactaggcactttggcgcgtgtaaattgtcgcctattactacgtgtgtgaaaattggaaatggaagaggagatgcaagaggacccatgttggtgtangggtactactaattaattttctgaaaacgactggagtc

SEQ ID NO: 106181 - DNA, 748 bp, Oryza sativa
  unsure (1)..(748): unsure at all n locations
cgcacgggaataagcacagcacttctgcaagcagnacattcatcacttatggcacgcagaggtcagggaaaaggcttacggggtggcacatgtactgtgatggggacagcacatggtgaaaaacgtgacagatgcaaacttcagaatatgagacggatagagatgtgccactagaaagcatgagggaagggactgaggatgctgagcactccactgtttggccccaagccatgggatgcatatgttttggcctagcaaacacgtagccaacatggtaaaaaatgtgggcacaccagcaccagatcgaattaagccaccaccctaaagttacttgcgagaacatgaaaaagagttaagtgcacaggcgcgtcttatactggcggaggcgctgaaaatactttcactgaacttaagaatgtaaaaccgactaccagagctcgagctagtgagcgaaacatggtcgaataaaaaaaaccatatacaaacatgtgagattgcgataaaaagcaattgtaactatatagcagctcatccctcatgcggagagagagataatggggagaggggtgtttataataaggatgagtatgcattcatgataatcttaacaacactaaacaaccttgactaaccttgccaacagttcttgtgtgcacaatccagaggaaggcactaaatcactacatgccaatcgatagaagagacaaatacttggatgagcccctacaatatgtccacaggcaaaaag

SEQ ID NO: 106182 - DNA, 723 bp, Oryza sativa
  unsure (1)..(723): unsure at all n locations
agatganntccgtaaaccnatgcgnctnncnnatnannnggnccccatccccgtggtgatcgaagcttatgggagaggtcaaagccatagccagtatccaacaagggagagaaacggtggggtggcagcggagatgggtctagaataggtccctagctacaggacacgcaggtcaccgcggaagacggggagtggagcaccatgcctgccccaccatccccgatggtgatgagttttgcaccattagattccccgtgaatggcaggtaccatccatccccattccttaggccttgttcggttaatccccttgagggagggattggaggggatttattgcccccggcctatggcttgggaacggtttcgcaaaatgccgtctcattgtttcccgtgttgttgggcagggacctaaactaaattatttcttttcacggagaaatcgactgaaaactcaccgtctgcctaagaacgtgccaggtcctaattaaaccaaaacccacgcgtccggttccactttgattccagccatgcgcttaaggacaaacgttgacaccgtcggctacaatttggtcttgatcagtacccgtttgatcattttggccaagtctcacctatagagaacggtcccctcgtttttttgctactatgctcgttggtgcatccgtttgcttcacattgcgacagagtaaaccgtgtactattgccttcgtccactgcgtcg

SEQ ID NO: 106183 - DNA, 730 bp, Oryza sativa
cgggctttgactgcatttctgcagtagttcatcacagcctttatctatgcttagtgtacgccttttgcgggcgacttgctcgatttacaccgcggtaactgcatatatcatatcagaatgattgattgttgaacatgtgggctgtatgctttcttgcgtatatgaacacatgcggcggttgaatgacattcatttgatgtgttcagtttacatggacgaatctctctcacgagaataatgtttgacttcttatgatgttccaagatcattttgatgctcatcagttgcattcaagtcttttaaggcgccaccaggaaatgaccttgcgaacaagtcgaagacttatggcacgagaaaacgatgactgttgctgccaatgttctagttgagctaggagttactgatggtaggtcttagaacttagattgttcattgtatgaagttaagcaatgcttctgcatctgcaaaaagaatgtggactgcgtgctcccgatgagcaggttaaaccctttggaaatgtcttccgctgtgagtgtgtacatcagtacatggcactgcatgagctgggggtgatgggtgtgtttttctccacaaaatgggatggataccaaatggtggcatgcgtgtgttgctctttgctagattaatcgatctgaaccctttttctgggctgccattcgattaaacaggacttgctttgcaagcgaaatcggtttgtgcgcttcgtatt

SEQ ID NO: 106184 - DNA, 714 bp, Oryza sativa
  unsure (1)..(714): unsure at all n locations
atgcccnnnnattgtgcagtagttcatcaatctaacctcttattcattggcatattgaatcaaccatatgaatggaatcctctctcatcaaaggactctacaaaacaatccttaaaaatttcactgctaatactccatttctaaggggccatacatttccatttgggcaccattttttaacaacggttgactttcaagtctttgcgctattatacacaatatattttatataataaagctaacaggttttacatatttcactttgaaccactctgtaatgagccgattacctttgtaagtaacctgtgagccaaaagattatcaggcccacatggtagtaagaaaggcaatccctaacgactaagactaagtataatagtgggctataacaacgctcaatgctgaggtggttgggcaaacagatgagagagatgacaactcggctgtaactttggggagattatgggtaccccatacacacacagcatgggtatcctactaggtctagcggataacttatatctctgaaatatgtcacaaattatgacttgggtattacagtttcctgtctcatatggaacggcctaatatgcctgtctgataagattgtgcagtaaatttaggaaaccgatgccgcgctgcttaaaagttctatactgccatcactggcggcatctatataaagtcggcangacgacttctcgaggcatgaaa

SEQ ID NO: 106185 - DNA, 613 bp, Oryza sativa
ttacttggaaaaagttcgtgttttggggggtaagtttccagcatatattaactttcttgtgtatgtattgccaaaattaatgtactctgattaggatccccataacctattgtatgtacaatattatggtttccattcattttgtttgttttgcaaggctgtatccctaaaggaagggctggaatgaacatgtgtatcattaaagatttcaatcaacaggtagcttgccaatcccagtagatttgcgcagaccgggatattttattccattatctaaaaaaataaaaataaagtaaagatgggctgagatgctcaatgaagataacggaacgcaatacatgttgtattgtatttatattgcattcacataaaaataaagtaaaataattaatacataagaacatccaagatatagaatagggtacatatttccagagctgcctaaccctagccgggtacaggatgggcagagcaccgagcaaccgcgcattgcatcacatgctgcagggaaaatcgacaaaagtttgaccgtgtgcctgtgtacaatacggcgtcgacattggcactgccatagtcaccgatgtggcaaatgggtcgagcgtcaagcgacaag

SEQ ID NO: 106186 - DNA, 523 bp, Oryza sativa
aagattaagttggcgcacgtaaaacgagaaagtcattaacatatgattaattaagttttaattattacaaacttgataaatagatatatttgatatttcaaagcaacttctatatagaaagatttcgcacggaacgtaccgtatagtagttttaaaaagcgtgctaatagaaattaaaccgagataaaatctaaatcttaatcagaaaacaacaggtgtgttcccgtcatacagtgaatcgagtaatccattaaccaactaattcttcaaactaagcatgcattttgatcattggggaccattggatgtacttggtgttcatggtgacgatgatatattggttagtgtcctttcctatgttgccatatactccctccctccgtttcgaaatatttgacaccgttgacttttaccacatgtttgaccgttcgtcttattcaaaaacttttatgaaatatgtaaaattatatgtctacataaaaatatatttaataatgaatcaaatgataggaaaaaaattaat

SEQ ID NO: 106187 - DNA, 2300 bp, Oryza sativa
ctggatgcaatctctgtgaacaaggaattaacagtgcacagaatttagtgcaacttcctgcccaatggaaaaataaaaaaccggtgcatgttagttgaaccacaaaggccatctattgctccaatagtgcgctactggatttcaacagcacagaagtgaggatagctagcgtgtgaccttggacatgatggctcaattcatggtgatggacactagagtgaaacctacaaggcagagtcctccatatcttaaaatctctcttgtaccgtctgaccatcatacttctacacctacaccattaactacgttgtaatcatgaactgcttcttgtgggtgagcattcatggcttttgcaccctaactctaattctcataaagaagaagcagggggagtgaggggcgctgatgcataataaaaactgaagtctaaccatccaagccccatgcagtaaataggccaaggcattaggaaggaataaataaggcttgttgggccttctactcctcaccagtgccaaccacgacaataaatagaggcgcctctctctttggttgttggaggcatgaatccatttaagttttggtgttctatctttcgctattaattcgaccggacgtcctgttgatttgatgtcgtctattcttctttgacaggctgatcatgagttaatggagcaccatcaagtgttttgacagttttctggagcaggatcttttgcaaacgatgtgtgtaaattggttgtgaccagcaaaaacttgtgcttctccatggtatgcttgtcatgcactcatcatctggcaattaaacttcattgtacttctcaataaatatataagttcaccaatgtagtgtttgtatctgctaaatcttttgttcacctttcttgttggaagctattctatagtttattagtgctagtttgtaattaatagactgcgtaaagcaaaattatttttcaggaagtcattgcatacctgtaagaactgttggttgctcgttgtgaagattagagggatgaattagtacaacagccagacctatgtgcctacctacatttataatttgaagaccataccgatataggtatctttttggttcggagtttgatgattcttttgataactcttatgtggataagaattaagacattatacaaccatatcattgtcgatacagcattctaaattattcctctatacctcggttataaaatatttaagggttgttcagattgtagccaaaataacctttaccaatgccaaaattttggcaatttgacaatattgataaaatttcggcaggatttcttatatatttactaaagtttggcaagaaactaaatagatgcacatatttagcaactctagcaaaatatagtatggtttgaaatagcatcaatctgaacaagcccttactctactgtcatgggatacgtggtttcacaatcctcttagtgaattaaaagtgtagctattgaaatatgttcactccgcgcccctgcttcaatgttgcaaaaaaaaaaagttgtaacatgccatttagtaggggaatatatgattcaacatcattatgtttttgttctgtgtgtgtgatttgctcagactatgttgcataactgattcacctaaataagcataaatgatgatggtatgcgaaataaataattttagtttgaccttaacaaaataagcatgatatgcagaataaataattttaggttgaccttcaaaataattgtgataaggatatctacttcacatatctttcattgaatgcccctccatatttttatttcagacaataaattgaggatgaacccatgaggtatgtgcgcttagtcaaggatgcatgctggttattcttgacttgccagtcggttttcatcagttattgtcatattaatcatgcgcctgaagtggccattagatacgagctctgcagcacataataaaccactgcaggtaggggtggacaaaaaaaactcgaaactcgtggctcggatcggctcgtagcaagctcggctcggatcgactcgaactcgtagtcttaatgagttgagtcgagctagccttttagctcgtgagcttgacgagctagctcgcgagctgctcgtttagctcgttagtataaaatatcaccaaatcttcatgaacttaatgtttattgactagtgcttagtcttttatttacataaaactattcatatttagtatgtactatattagttagtgtttattattatgttaatacataataaaatggtaaatttgaaattattaatatgatattaataagatat

SEQ ID NO: 106188 - DNA, 597 bp, Oryza sativa
tctcatttgatgccactgtggagcgttttctccttcctacatcccactccgattaatctctacaaataatactatggttatactcctccttccaaaaatattagatttattgatattttagttttttttcaaatgagttagttatatctgtagtttttatgtacttaaaacttaaataaagagataaattaaatgtttaattagaacctaagaagttatctgattgtttacatgcatattcatcttagatgagttaattttttattggtcttatcgaaataatatgtataactcttttggatggacggagtatatacttacagtatgcatttttcatatgatatactactataaaaacaatagtgatattggtggttctgtcactggttcactctcaccaacttttacatactccctccatttcatattataagattttctagcattgtccacatttatatagatgctaatgaatctatgtatatagattcattagcatctatatgtatgtgggcaatgctagaaagtcatataatatgaaacggatgaagtatttacaattagtgaatatattttttatcaagtgatacatatatt

SEQ ID NO: 106189 - DNA, 672 bp, Oryza sativa
caataattgaattaattattcatacaattaatcattattattaaattcattgtacatatttttcatgttttaattacattataaacaaatatttaatatgtttttcttattttaatattaaattagcttagttttataatttcatacaaaattatatgtaattattcaaacaagtatttataatcttctttattccctacacacactttctctctcatcatcttccatcacattttctagagggaaaaatatgtaaaaaaaatagctccaaatgtagatggtaagcaaaacaaagagtaggatgaagttgctaaccatttgaagacctcaaatttatatattaccaccaaaaaaatttgcttaaaattttgacagcacctccctccctcaaagcttaattttgaagcaatggctcgggcgggaggaggaagaaggggtatataaagctatgcaactttagtcccggttggtgttaccaaccaggcataaagatctcaaatcactttagtcccggtttgtattaccaaccaggactaaagatatgatctttagtcccggttgactaaagatcccaagccccccgacagaggtctgacatgccctgtcaggaggcgaaccgggactaaagatgatctttagtttccgttggtaccgggactaaaaatccttcgt

SEQ ID NO: 106190 - DNA, 4191 bp, Oryza sativa
cccagatcgatcaatatctgtttttgctcaaattaagtaccattcaaaactgttcagaatgcagaggttggtctgtctgtctgtctgtctcttgtgaaaagaatatgaatcagcagtggtggaggtgagctcagattggaagtggccaaatactatgcatgaattcggcaactggtaaattttcttgttctttcccctcctttccctattcatctccttcgtttttgacacgcgctctttccaaacttctaaatagtgttttttataaaagaaatttctaaacgaaagttgctttaaaaatcatattaatttatttttcaaaaaatagttaatacataatgaatttatgtgctaatgagtcactttgttttgcgtgcgtgagggattatttcctaacaccaacaaaagaacacagtctaagtgttgttgcttagggcaagttttatagtagagatgattaccacatttaatttcgtgcatgacatacaccattaaattaagatgtgtaataagttacatctactatacaattttcaatatctctaacactcacatcctgtttatttactgtgcaattgcacaactgttgaccaaccattttcaagcttgttaaccagtaagcactgctgcttatactgtgcaatttggacaatcatatccatagcgtttcgtcgggacaatagagcagagctctctccatactgattggacgtttcagacatgatgaactcttcttgttctcacattttaccaggagttccttaattacacccatggacttcaagaccattaatttatataatatgcgccatactattacacatgcatgcccaatcatcgcagtgcatgctactgcttccgatttggttccaagattcgtcatgcttcctgtcggtgaagtacaggaggaacttattatcttccactgctcatgcacatcatttgcgtagaccaacatatcaatagggttacgtgtgcacaaatgcagcctccagtggattataatccaaaaaatggagtaatatttttgatttttaagaataattttagatagattgttttcttgccttagcaatagaagtgatgaagataaacccgtaaacttgggctctgtttggataatgggttaaaaggggtgggattgggatagggatgagtggagggttgagatgaaacgagatacgtagaatgaacagttagaattaaaaattacccttccagaaggtgagataaggtttctccatcccattatccaaacatggccttaattctaaaataactttctaagatttcaaaattaggattatagctgagggctgatgccaaggtcctgtttgactaagatgataactgatggctgaaattgagtttatgataattctttgaggaaagttgaaaacatgttttaaaaaaaatttctaaggaacattaatggggaataacatgctagtttggtttgaaactaaattttgtccttataaaatattgctacctaaataaacaatattgatagtgtcaaacacttggcaaatttttcgtactaccatatttggtagagtagaactctctactacaaaattgaaaccaaaccattatttatataatactattataatgctaaaattttagtagggtaaaagttggcttcaataaaaaaaaaagggcccagcatccataggcggtgagaagaaaaaggaccgaatataataaatagtgcagcagtagcattacagatgaaccattaacatatatgcaaactagcaaaatactcatgcttatttgaatatatgttattcacttgattaaaaaatattattcactaatttgtaaaatacttcatccgtttcatattatatgactttctagcattgcccacatacatatagatgctaatgaatctatatacatagattcattagcatctatataaatgtggacaatgctagaaaatcttataatatgaaatggagggagtatgtaaaagttggtgagagtgaaccagtgacagaaacaacaatatcactattgtttttatagtagtatatcatatgaaaaatgcatactgtaagtatatactccgtccatccaaaagagttatacatattatttcgataagaccaataaaaaattaactcatctaagatgaatatgcatgtaaacaatcagataacttcttaggttctaattaaacatttaatttatctctttatttaagttttaagtacataaaaactacagatataactaactcatttgaaaaaaaactaaaatatcaataaatctaatatttttggaaggaggagtataaccatagtattatttgtagagattaatcggagtgggatgtaggaaggagaaaacgctccacagtggcatcaaatgagagtcataaatgtgggttaaaggtaattaacgtacttatgttggtcggcttcatggtaattaagtcggtaaaataaccttaattatgttttgtcagctctttggtcgctgttaataccagtactagttttgttgtaacagaagatcttgatttgtaaggggagacggatcaaagtttagtaattgctgggcctatgggccccagctgtacttctattttgcacttgacaaagacacatcggttgggaaactctgttgatagccattaatagatctctccctctcatgccacggacaaacaacacaaacaaactactccctccgtcccgtaatataagagattttgacattttatttgtactatttgaccattcgtcttattcaaaaaattttagatttattatttattttatttgtgacttactttattatttaaagtactttaagcacaactttttattttttatatttacacaaattttttgaacaagacgagtgatcaaatagtacaagaaaaatatcaaaatcccttatattagggacggagggagtataaaacatgaggacaatctcaatggtagtttcataggagtttcattctcaataaatgagacaacattgaagtaaattattgataaatgagataacattgaagtaaattatttcatttatcaattcaaaactttttaaataacatggcactcttggtaaccataaaatgaaactccccacgagaaatggcctgataaacacaagtattttttagataatggaatataatatcccggcttttactcaaataagcacaagtaggacagaactctcattaagatgtccagtgtgaaactaaatggtaagaaaatagatccaaatgaataaaaggaaaatgaggtatactagaacttaagaaaagggtgatccaaactaaaatttacaatattatttactacatgcatataaaactataggaaaaaaaacttactaggatactttttctaattttgcttgagttcctctaattcatagaaaatcaaagggaagacaactactatggcagatacattttttcccaatgtggcttatccgtatgacggggcgtacgaatctcaaaacaattaaccaacaacatatataaataattactgcgatagctagtgcagcattagacacttgtttttcctgttgtgtagaaaattactcaataaaatcaagaacaacctgatgttggcatttggtagcaaccatcttcagatatcgatcgtgactttagaaagataagatagcgaaagtacaatgggaattaattaatgtttccaaatgttgatcgtcgatcgcaatcatgaattcattcatatctgccgatcgaactaacgacagatcgacctgcacaacatttgagtgtcttaaaggtgacaggccaagtcagcattcaacagttcgtcacacgctgttcttattcggtcttctaggagcaatttctttcactgattagaatcaactgtacgtagtaattaattgtgaaacattttcattgtgccattcagatcgaaattttcagatatctccctttaattattaggcgctacatgctcatcactaaataatcaacttcaggtaattctacatgcatggtttcgagttatttcatgttcgcaccaaattataattaattcatgtactaacttcaaaggtctagaagtctatagtagtatagtagatatacatgcattttttttaaagttaattaatggatacaacccaatctctatatccacagggcaaaagatacacagagttataagactcgtg

SEQ ID NO: 106191 - DNA, 1564 bp, Oryza sativa
gtcttacaaggaaatcattatacccaaaagtcaacttctaaaggagtaatctatttaaagaaaaatatgaatcacttctatctgaacagaactacgaatcactgtaccacaaagtaaacaaaatttctgtagtactatggttgagtttatacaagtctcttggagcatcgcaacctgatgcttgttttgaaacaccatgatgagtattgtcaagataatgtagcctgggagattacgttgcggtgttcctgaaaaaaagctaatctcagggaaattagaaaatgtcatggactggatcacatatataaaatgttcgtattcactactatgctgatctggtcgatcctctaatcctgtcttcttcaaaattgttaatgatgaacttatttcataggaatgaagtttcaatttagttgcaactttaagatgcatggactatgggaaacattgctaaaatttaattgaaaaaaattcagaacagtgctatgactacagtagagttttaatagaaacaggacataaaaagtcgattggaaaatttatagaattccagcgtatacattagagattcaattcaaacatgaatttatagaaacagtactacatgcatgctcaagtttccatatggtttgggcaatcaatttctagtagtaatacctcctaatcaaagatcttcaaaatcatgatctccttgacattccatctgaaaccagtgaacctatcaaataaatttaacaaaagttaattagcatttctatgtattataacactatattctgcttttcttttagaagaaaaaaaatgttgcataccggatccatcaattgaagttgtggttgtgtgggatggtcctaaggcatcattatcatccatagcaggaggtggaataccagcaagtttggacacgacactgcgcaaccaatcaagttgcttttgttgagattcaagctgattttgttgtactgcaagctggttttgttgaactgccacagtttgttttgtataagccaattcttcttccatttgttgataggtgtttgctgaagttgatgaagctcttctattaggtttcggaccatgacatctccctctaatatatccatatgccttcccaagcaccttctcacaaatttgttgctctgtcagctggattgcaccttcttgctcattttcatgctgcatctgtaacattgtttcctttatacaaaaaaaaaatcaaaagtttttgttagcacaagaagacacttaactatagtgaaaatgactcgttagaatgatacttacatagttctgtctagcatctcttgacgcccatcctttgtcactacaatagcattccttgtacaatgagatttgatcacaactctgccaagacataatatttacttaaacagatgcttacgaaaaataaatcataaggaaaatagatgaaatttagcttactaattcatgctgaagtgccacaaatggtttggttccctttttatgaacatttgccagtttcatccgattagctttccctataactgattttttctgcatatggcaagaatagccaaaggaa

SEQ ID NO: 106192 - DNA, 623 bp, Oryza sativa
  unsure (1)..(623): unsure at all n locations
tttcctccctttcactcgcagatctngcagtcttctgaaacttcggcaaacaactgacgatgtcctctttttcactgacctgaccatctagtactagttgaaaattcttagaaggaagaacggagtaaaccttttgcaaaaagcattgggggaaggagaaaagaggaactttcgcaaataatttttatttataaaatatgtccttaggttttatccacttggcttttcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacctctcctccaaagcttctcttactgaagggggaaaagattgagcaagaatgagtacaaccacagtactcagcaagccannnnnnnnnnnnnnnnnnnnnnnnnagaggccaaaatgccagc

SEQ ID NO: 106193 - DNA, 650 bp, Oryza sativa
  unsure (1)..(650): unsure at all n locations
tgcggactgncnattgagnactgagcctcattagcatggnacacgtagttcatcaggcggaggcggcggcgaggacgatgagctcgagacgacggcgagatacggcggcgtcggcgcggggatttgccctaggcagtggcggcgaatgagagaggccgagagagatcgatcggccgaaaacgtctaagtgttagtgaagaagacgagggcgcaccgggaatatatatacccccggatctttactcccggttggggggaatttctcgtagttagtgtattttccttgtgtatctacttcttttttcttcctgtcctggtttttaatattatgggttaagtttatttcattgtagctaggttttactcacctttgttttttttggttttagtgtaaatgccttgcttaagtttaagcgacctttttgttattacttctctctcaccttttttctcttattttttctctttatcgggtttttatttcttatctctattgcttttctgtatgtttccatttttcatgtgttttctaccatattttggtattatctttttattttagtgcaatgttgcctcttacattgggattttcatcctgtatgttttaattttacttacgatttgctcttttgcttgggttctatgatgtc

SEQ ID NO: 106194 - DNA, 716 bp, Oryza sativa
  unsure (1)..(716): unsure at all n locations
gtgcttacnaatggtcctatgagtatggtacagnagntcatcaacaaagctattcatatgatgcgtacattatgaaacttaacaacttgagagaaatttatgaagtatattcctaggaattgactgaaatattattctaaacaatttcctttaccagtacggatgaagaatttaaagagagtcttcatttaataagacatatttctgaacgcgtgtctcatataatcagcggtaatcattccgaggtgaacacgtcgtcaaaaaaacgggaccattaccaaccgacggttatatattacacacattggtgcagggcttgagctaacttttgccatactttttccgaacacatgaacttgcctgccgtgcgggcatatctatctatcaatctcatgcgtgttggcctaatcatggtcgatgagacgatctattcacaatactcgtcagaggtcgatccatccatccatccatgcatcgatctgactctctgaataattggtgtgtattgtacaccgctgcctgttattagccagtctatgtctaacgagctagcaacaaaagtgtttcgactccacaccgtacctaccggtaaaaagcaaagtccgttgcagtgctagatagatagaccttagcttatcagcaactgctctgtactaatcattgtcttgcattaaagcaagctgtttctatatgtcatctttctaaatatatgtagg

SEQ ID NO: 106195 - DNA, 747 bp, Oryza sativa
tgcccccatgcatgaaccgctggtacagtacagtcatcaacatacatttatccatacattcctagcaaaagcaccttgcaggtcaacatacagtaaaaattttctcactagaacggaaaagcgtaaaaaataatccgaagatttggtataatttgaaattaacagttaaagcccgtttttaggaaggtttgtgtcgcagcgaataaaaggcttatgcatatttcatctttcatctttttaatcgctcgctcacaagaagtatatttcaagaattgctcgctccaataaaagtcttacgcatatttcaactttttaatttcaaatgagattatcatatttgtaatgtatatataataaattaaaatgcatttatatttggaaaaagcacaccgaaggtccctacactcataatactatatcaccaagtcatcacactgtcctacaaatagtatatgggtccatgctctctgtggaaagtggcgaattcagcacatgaaaacatattcacaggggaacattaacttgtgagcaaattgcaatgtactggtacattgcatacatatcggaactatctactggcgaaaacatgggaatgcacatatagctctccccataccattacaaattatgaaattgatacccatgatcacaatctagaatgtaaaatctaaagttacggaagaatacgccctaccatagaaaggccttgcattatattttttctcgaatccaagccatttgcatttt

SEQ ID NO: 106196 - DNA, 1000 bp, Oryza sativa
  unsure (1)..(1000): unsure at all n locations
cctgttnnagttagattcnnnnnnnnnnnnnnnnnnnnnnnaaatcatgtatatgctagttatatgtgatacttacaatttttaaaagttttaaatcacgcaggtggcaatttcatatgttaattagagtttttaacatttaatttactatcattcatatgctaattataattgactagagaatttttaaaagtttcaaatcatgcatgtggcatttacatatgttaattagagtttttcacaatttaatttactatcattcatatgctaattatatatgactattcgaatttttaaaatttttaaatcatgcatgtggcatttacatgtgttaattagagtttttcacaatttaatttaatataattcctatgctaagtatatatgatgattacaatttttattaattttaaatcatgtcgtatgtatatacatatgttaattagagtttttaccaatttaataatatcattcatatgctaagtatatatgattattagaatttttattaattttaaatcatatatttgcttattacgttttatccacttaatttattacagacaacaataatttttcgaagtaattgtcattaatctttatactttaaataattgtaatgcattatcttctattttagaaaaacatatgtaatggaaaataatattcagtgcgcttatcagtagtcccggttcttaaccctaaccaagtttaaaaagaatttagaaatagcgggaaaatatctttagtcccggtcgatgagaacaaacggnagataagatatagtgacctccggttgttcctaacaaacaagagtagggatcctattctatgttgctatattctgggaacggcggaaggtacatatatcttcttactagactttatttatttcattggaaaaacacttacgggagtactattttgacttaattttattatttccaacaatacgaaccatcactcaactgtgatttttctttgagattgcgtccggcct

SEQ ID NO: 106197 - DNA, 776 bp, Oryza sativa
  unsure (1)..(776): unsure at all n locations
cttaatataaatggtagatttagtatagcaagttaacatatatgaaccaaaataactaaatcaggtaagatcggctgaaaccctgatactatctctattgaaaatcataaaacaagtgtaacataccaggaatttcacctagggaaaattttttgtggaaaatttaaaactttctgaattctaaagttttcggtgaacatagaagcatactagagcatataactcccttaaataaaataaacacatagtctagttgggaaaaatcaaaccaaagaccaaaataaaagtttacaaatcttgtggtaataaatttcaaaataaaatattttgctttgaccttaaactgaaaacctaatcttcttggttttgaattgctaacctaactaaaaataattaagtcatatataaaacaaatggaaaggtaggtttcaaaataagcacatctgaattgagataaaatgaacttgcttggttgtgcatattattgttttaagattgtttttggatcttcttggtgcatctcataatagattgcatatgcatgtcatgtctaaagaaaattcttaaaaatagatgaatcaacaattaatcccacaaaaattctcataaatactacacaacaccctaatctcccagtaattttagtttgaatttatcacatcaactagtaccacaaataaattcttcaactcagcaataaatctgaaaccagcataccaattagcctactttgcataattgatgggctnctgtaccatctagtaggtcaatgcaca

SEQ ID NO: 106198 - DNA, 679 bp, Oryza sativa
ccctacttcaaaattctgtgagatagacctaaattaagtgaggtaaagaaaaagaaagaaatatgactgaaaaacacaaaaggacctatctaccccccaaggcacttcgtccacccaccatgtgttgactcgcgctaccctgcatttttctaattttgttttcatttctccttttcttttcctgataatatgttcagcaatagcattaagtggtaattgtagatccatcaactcttgttctttataacgtgacaaggaatttaaaaagttaaagagaaaatgagtttcatttagatgaaaccatgcctatattgtttcccatacaatttatctctttcatgtattgtctataaaacaagaaaaataaaaccacattttgaaacataaaaacgataccacccattggaaatggccttatgcgattgtccttgctcaggattttgatcgaacaatcaaaggttattatttggaaacacattacattatttgcatttaaaatataaatatatcacattcctggaagaagtaagaaaataaggtgacaactttaagatggatatgtagtggtttttataatacgaagtagatcaagtggtaaaaaaagaatgtacttttatagaaaaaaaccattcaaacaatccaagaacaacgatttccttttagattcggctaaaatgga

SEQ ID NO: 106199 - DNA, 632 bp, Oryza sativa
atcatgtgaagatcctctaatccaaatatatgttcggaagcaggggttaaaaacctctcctatatgcaagaaaaaagaggaatggtttattagtatatgattaattaaatgttagctaaaagactttaaaatatattaatatgtctgtagagcaacttttatgtttttttttgcaccgtttagtagtctgggaagcgtatacccgaaaaaagaggaagtagaagataagaatatgtagattcaaactcacgctaaagtaaattttataaaactctgatattgtgactcgagttacacaaaatcacagttgttttagcatgtggcataggtattatgattttagagtttcacaaaactatactgcttaccaattataatgtgatccactgcatacgaaagttctaaaatcaaatctcaaatttacaaaatctttgatctccaagcatacatgctttagctatccaagtaataaatcatttcttattttttggtaaggtagtaagccaaattggtcaatggcatggttttgcaaagctatgtaaccgtcaatgatgtgccatatgttaaagtcgtggtgattttgtgtaacttaaataatataatatcggtgggtttatatatggagcattacc

SEQ ID NO: 106200 - DNA, 757 bp, Oryza sativa
ttaatgctattgctgaacatattatcaggaaaagaaaaggagaaatgaaaacaaaattagaaaaatgcagggtagcgcgagtcaacacatggtgggtggacgaagtgccttggggggtagataggtccttttgtgtttttcagtcatatttctttctttttcttacctcacttaatttaggtctatctcacagaattttgaagtaggggtaaatcggagcttcaattttaaaaagaaaggacaaagacacataattagaaaattaggtgtaaaagtataattgcagttgaaaatatattaccccagaggaaaaggagaggaaaaaaagagagggaagcttcgcaggaatgcttctcccgccaccatctttcttccaaggctcccttgcacaaaaccgagaaaatcaaaagaggcttctggtgtggtgactgtgaacaagcggctggtcgctttcaccttcatctagcgaacgctcgtccagttctcttcctgccgaaataagttcactgtgaattatatcgatgtgctaacgtgtgacggtgtgagaacaacgattgggggtcttttgggtttcgatcgattgtgctgcaagccatcaccattattttatttttgacttagccatcgcaatggaacaaacgggggtagtactaattactaatccagattcccgttttgatttggataagttaatggaaactaaatgttggtaatatgaattaatttttcacctatcacgtcagtacctgaacatagg

SEQ ID NO: 106201 - DNA, 595 bp, Oryza sativa
tgcatgttgctttctgtgttgcatggaggttgtccaaatactactgttaaagtgtcaatatcgttaggaagataagaggttagtagctggtgaaattaatgcgggtggccacagctctggaagtctggatgatggtgcttatacttgtcaattggtgataactgattcatgatgtgtggctgcctggtattgataggccgtaggttcaatgcaagaatgtgacattcaaccgtgctgagctgagcaagacagtgttgattgttgaatagttttcgcttaagcgaaatatctcattttcgtgtaattactgctctcctgttggaatttctctagttagtgcagtcagtataactcgtgtgctctggcaaaggttctctagttattttggagtagtctgcactgtttctcgtcatttgtcgtgttctgttctgtttctctgcactgtacttcatagaaggaaaagaaggaaacattggccgggcacattcagttctgttaggaataaggatttttttttgcacgaaaaggaataagtatttgtttttctcaatgtgcctaataccaatatcatgaaaacttatgctgcaatttattt

SEQ ID NO: 106202 - DNA, 3119 bp, Oryza sativa
aaatagttattcttgccaaaatttgacaatattactaaccttactaaaattttattattgctttggtaaggtttgaaatggcatcaaagttaatacgccctaagccaaactaattgtcaaatggacctcttggcctcattcctcattttagcaatatacctggagagacgtgttagaggcatcagcatataaaaaataataataatgtatgacatgatgtgaaaaaaaatcattagtcaactatttcaccgaactctagaaagaacctttgcataattcaacatattataattattggcgtggtacagccgtacagactacaagattcacagaaaaaaaagggccattccaatgagtaactgaaaaaaaacgtgtctaactccgtgaagaaaagctgttccaatggattttttttctctagaacatatagtagtataatccaaccaatctactcgaaaaaaaggctacatttgtagcacaattatgtttctgcacaacttattagtttgctatgtcaatagaaaaatagtagaagccaagaacacagatctttccaggggaaaaaacaaatgaacataagcaagctgagaacgatgttaataacaacgtagggtggttttttacaactcgtgtatctctacaacagttatttttttctttaactaacatactgcgatatccaagtgcatatataatttatatatgacaaggacaataatatatttagtcgattatgtcatgtaaaatagcaagcctaatcaacccgtttttaaagttgtttataatgtggttggagacaacgtacaaccgatacatatacttcattttctcgaaaaccagccaactaactgaataatcatccctacatctgccatctactacattgtatcataagggcacccacaatggttatctataagctctctacaagagatccatgtcagcatattttcctacttggaagagattaaatgaagagagagagcaaagctatctactaacatggagatagtctatagagaaaaacgaggcaatggattagagagctatagatacccatgtagacataccattgaagtggtttactattaatctagtctattgttgaggtgtacatgttttatagatagcatcttactttaccattgcgggtgctctaggagcaaggtcaatagtagtgctcgctaccggcggcaaaaataccatgtcagcatgttgcagttaatattcaaaactagctcgtacagtagtgagctgcactccatctctacacagcttccaatgacagttttcctatttttttaatcacagtttccctgctcagtcgattttggccccacgtaaaacattattttattgtcacctgtgctactcgcgcataaaaacttgtgctggcgccaggccgtagattagtcgccggctttattctctttgcttgtttctcttcctttcacctagagattaaatgacgtggcatattttagagtctgctgagtcatcctattgtacttgctctaaccagtccctttccacataatgtcaagctacttgcattgacattgaaatttcctaatcaatcgtgaacacgcataaggatatatgacgtcccaacggagctaagagatcccactcagcccgagttttattcgtagtactccctccaggggcgtgcctaggttatactacccggtgtcacagtacaccggatagattattcaaatcctatataaattacactatattaattaatatgttagtcaataattagataattagtatgtattggacccctggtaacttttcttctgggttcgccactgagtctccctccatttaattttgatagttatattttatcttggcacacacaccaatgataagtaattctacttatcatccatttaaacatattactccctccatatacttttgatagtcatatttcatcttgacacacagaccaaggataagtgattctacttatcatccatttaaatatgctactagtcattcctcgtaaacaagcgattcattaatatttacatttctcgatgctcatgcaaccaatcttgtgtggaagaatgaagagccatgcattaaatccaagaaagtcattaagataataagttgttggattgaaatatgcctatcaaaaataaaattttcagatttggaagtatgactatcaaaagtagatggagggagtattagtcattcctcgtaaacaagcgattcataaatatttacatttctcgatgcccaggtagccaatcttgtgtagagaaatggagagtcacgtattaaatccgagaaagtcattaagaggataggttgttggattgaaatatgcctatcaaaaataaattttttaaatttgaaaatataactgtcaaaagtagatagagagagtaactcatatacggtcggtgcatttatctccggcttaattagtagatcaaagtatacgggactttgtcattgtcattcaaagagaaaattaagcaaggcacagacgcgacatcgtgcgtcataatcttggttagtcacacgctaggacgactgcgcagcaacacatcataacgctaaacgctccccggaattacgcaagtacgcattgattagtcaggcacgccgggagcccgggacagagttggggcaacacacgaaccgacgcacccaaccaacccgccctccgttccacgcacgcgcgcgccacacgccacacgccacgggagaaacgaacggccggtgcgatgcgacgcacggtcgcaccacacgcgcttcccttccactgctcgctccgatggcgtgtggctgcgcgcctgcgcccccggggccactccggcgtttcgcgtgggcaactgggcaaccgcaccgttcgacgggccgaggggcgacgaggactcggaggcgggagcgctggtgcgctgcgcgcctgcgcgtgcggaggcgggagcgctgccgaggcgacggaccggcgttgggtgagagatcgcaggcacctgtcccacgggccaggggtgcatgtgtagcggaggtgtgtcatgtgtgtggtttggctggttgcttcgcgcgagctttttatttatttatttatttatttattgtatatttttggg

SEQ ID NO: 106203 - DNA, 640 bp, Oryza sativa
agcgcgagtcaacacatggtgggtggaccaagtgccttggggggtaaataggtccttttggggttttcaagtcatatttctttcttttttttacctcacttaatttaggtctatctcacagaattttaagtaggggtaaatccgagcttcaatttttaaaagaaaggacaaagacacataattagaaaattaggtgtaaaagtataattgcagttgaaaatataattaccccagaggaaaaggagaggaaaaaaaagagagggaagcttcgcaggaatgcttctcccgccaccatcctttcttccaaggctcccttgcacaaaaccgagaaaatcaaaagaggcttctggtgtggtgactgtgaacaagcggctggtcgctttcaccttcatctagcgaacgctcgtcaagttctcttcctgccgaattaagttcactgtgaattatatcgatgtgctaacgtgtgacggtgtgagaacaacgattgggggtctcttgggtctcgatcgatcgtgctgcagccatcacaataattttatttctgactaagccatcgcaatgggaacaaacgggggtagtactaattactaatccagattcccgttttgattgggatagttgatgggaactaaatggtccg

SEQ ID NO: 106204 - DNA, 680 bp, Oryza sativa
ctggagaaacccggcgaaaaatcccgtcgccgctgggaatatctcgatggaataccaaacccagcgacggaattggactgggaccggactggacggtcacgatggagtctcgtcgctcccacgtgaccgccgccgccgccatcgcggccgtccaataccagcagcggccgtagtaataaaaaaaacaaaattggtggatcccgtcccccgtttggaactttggatccaccaaatcagacggagccacctatccgcgccgtcagatctctccatttctctccacgtggcgtcgagaggaccgtccgatggtaacgcgaccatcctaaacaaggtattcgcgtggaccctacacgtcgccgtcgcgctgcttattaatatcgcgccgcccacttcgtcatcctcctcgcgtactccgctctcgaaaaagaaaagaaaggctttcgtctcggtgggcaaaagcgcgagggcaaagcgaaggtaagggcctctctgatcttcctcatcgatggatgcgtcgttggttttgagcgcggtagcttgtttgtggttcggttgttcgccgatcgatcggtagatccgcctgtgcgaatctgatctgaggctcgaaatctgataaaattggcgagatttacagcgttgcttagtgttaattatgctcgattaggccacgagttggttcg

SEQ ID NO: 106205 - DNA, 1148 bp, Oryza sativa
caattgcaatctgagtttactattattttgtgcagaaaaagattttcttgtacgtgttgggttatctcatttgctgaactgtgcgatagcatttcatgtgctaacttatggattaccaaatcctggtctagcaccaaataaagattactcattggttcccccaaaacatgggttaagaatcgacctatggagggtgggccctaggggcctcaaatcacgggttaaggcctgatctgtagggggcgactccttgtgtaggggggaccgtctattgtgacctttctcggcccctgttgatcagcgtataacgttgctgcaccgagaccaagaaaccaaatcaactctgcatgcacatcatttatagctaattctccctaattagcatgcagctcaacggatttattctgcatgcatctcaacgcatgagacttcaaaagactctgcatgtacatgcatagcatgcgaggcatttactacaacctgagaaaacgctagtacctagtttatacgctgatcaatttggaatatttgaaatttggttaggcgctgatcaaaagggaatggagggagtataatacattagggaggtctttccctttggggccgagttctttctcatctttttattattattattatattagaaccatagaaaatactgttatatattaagaaggtttgtgaaaatattgttgaagtatttggagatgggtacctgagatctccaaagaataatgacacagctagattacttgccattgcagagcaagggggttttctcggaatgctttggtgcattgattgtatcacatattaataattggaggatagggggagatagaataaatgaatcattgatacaatcaatgctccctagcattcctggaaaacctctctactctccaattggaagtaatctatctatgccattatcatttggagatctcaagtactcatctccgaatacttcaacaatagttttcattcacaaacattttaagcttatgacagtattttctccaatttcaatattgattatccatagcatctcttggtactacataagttcgcattcaaaagctgctgtacacttgtgcaaaagatataacccaagacctccaacaatatatctttttttgcataagata

SEQ ID NO: 106206 - DNA, 1136 bp, Oryza sativa
aacagactggaccagcacagagcggccagccagagtggcgagtcgtcccttccagggtggaagacgatgggaaactttatccacaagcggttgcagggttgccttcggcaacttgtgaacggacagcggaatgctgaaataggagcagggaaaaaccgaatcttgtgtggaagaatgaagagtcgtgcattaaatcctcataaacaagcgattcattgatatttacatttctcgatgcgcatgtagccaatcttgtgtggaagaatggagagtcacgtattaaatccgagaaagtcattaatatgatacgtggttggattgaaatatgtctatcaaaagtaaattttttagatttggaaatatgcctatcaaaaatagatggaagggagtattaatgattaaatggtctagataaatattttgttaaatactttgagtgtccaattattttcatgttttttttgaaattatttaagcattggaagtgtttttgaaaattcaaagatcatttcagtgattaacattgacgacgggtgaggagacgcgatggcgcatgtcgaaaagagctacgtccacgtacgctagctctctggagaatcgagggtccagagtcggactgcttgcacgtatccatgccccagccgcaagcaatataatcggacaaatactactacgtctctatctctatttctactattaagatgtttttactggtggtttagtaagtcatccgtatccgaatctaattgccatatgctatcttcgattcaaaaactactgacgtgatccgtgggaagcagtgccatgtccacgtccgattcccacgtacatcgccatcgaatccaaatatgctcccgttgcctttttttttttcttaagcatgtccaaagcaccccctccgattcggttttaccattgccacgagcccacgatcaagcgagatggacttggctctgtactccgtagagattggagagatgtgcgcctggttagattggaaggaaataccgatggtgatggcctgcatgtgcatggctgcatagttgcttttttgcctaatctataactaatataaatattcgtattttttcgtttgtcacatctaattttcgtccgtgttttcgtccatacacaat

SEQ ID NO: 106207 - DNA, 591 bp, Oryza sativa
ctctgaaagctgcagctgcaagatggttgtgtgatttagctatatatgtcatttttggttctaatgattaactaatcaactgatctgagatgattgtgagatgattaggtccctagatatatatagcctttttttttcggattaattcaacaaggactaccgatgacaccttgagttaattaacgacgcttgtggcgtgcagccgtgcatatgcatgtgcgtgcccgtgcagccgcagcgtggcttgcggtttaatccaacgatttgtgtaagcgcagacacgtattatggcccaaactatatattattctcttatctgtgtactttttcgtcgatctttgcttgaacttttgcttgattatattcgattagaggactatctcttaatttgcttgacttcagattgtgaaatggacggcttaattatttgcagagattattcatgttccggtacttccttgtttaagaaagggatggcgtctgttcctttaatagtacgggtgattctgcatctggccagcaattgtaatcgtgtccaaccgcgtgcaatggataattcgccggaaaagtattttttattgtcgggatgac

SEQ ID NO: 106208 - DNA, 644 bp, Oryza sativa
agcgctcaggtacttgatatatttatctatcctcctatttaaaattcttaacgattaggcacttgagccacctccagcgctgacaaaattgctctcacagtgatctagtggtaccttcatttccacttgcctagtgccaaaagttgctattgcctcagcgacacctggttggcactgcaaagcgaagctacgagatttcagccatgatcaccctgatgtccaacgacaggtgttgagatggaaaccagtgcagaatcgggcctgttctggcatataactgttgtagtgatttatccctgcaaactggcaaatccgcaaatgtcgtgtaaaaatcccgttcttgtcaagcttgtcaaatcatcatatgtatgaaccagggatcacgaaacatcagttaactgcacaacgacgttggcaagctaaggctgtttcgcatttggcaatgattggacggtttgttgcaagcgattcagcacctgaaatagttatacgggacaaacatgatactagtatatatcattagcagctcgcatataatgattgactgagggagaagattgatcagatgttttgtattaccagcggctgcttacatctcaacagcagttatacacttgatgtttcatgttttgtcatcaatagat

SEQ ID NO: 106209 - DNA, 1163 bp, Oryza sativa
caaatataataatatttataatattaaattagtttcatcaaatcaataattgaatatattttcataatattttttcttgggttgaaaatgttactactttttctataaacttgatcaaatttatcaaagtcaaaatgttaacctgaaacggagggaatagtataaaaggacatgtttactgaccctgtgtcaagcactcttgttacagaatttcggtaaagagaataatatagtgtgccttcctccaaattttattttacggattttatgtccaaagttagcaattccgttacatatagtctgtaacgctccgcttttcgtgaggcgttaaaaactaattcggcaaaatcctaattgcgaaaattttcgttctttgtgtgcgagtctaagttgtgccaatatctcaattcaaatcccgttgttccctctcatcgaaatcgaaatcctccacctcaaatttccaatcccgattcaagtcaccgagatcaaatcccgaaattcaattcctctctttgaattctcgccaaatacttgtaccgactcgaaagatatccaaattccattcccaatccaaattctctccaactcaaattctaagcaaaagtctaatttgcatccctcgggttcgtgggccgaatcccctccctaggcccatctctcccctctgcccttctctctcacgtgcgctgcacgtggtcactcagcagagctgagggaggaagagagctcccgcctctctgccttttctccccctctccgttcactctctctctccccggcgccgattcccgccgacgccgctcaaatccgcaccgccttcgctcgttcctgcgcgctcgcgcgtggctgaccgcccggttgccgccgcgtcagccctgacgccgcctgtccccgcgcctgcgccgcgcagccgcccggccccgctcgcctttagccgtcatcgccgctgtcatcgctcggccccgatgcccccatgccgcatccttccaaaaccaagagacagagctcgtgctcctctccctcgttctctctccctccttcctccttcctcccaaagtggcaagggagccaagctcttttcccttcccttttcgcctttttccccgaccacacccgctgtcaccacctgccgctccttgaccgcaagcgccgcgccagccgag

SEQ ID NO: 106210 - DNA, 629 bp, Oryza sativa
cctgagcttggtactgggaatggtacacacatattacttgtttcagaggcagaagctggatatgtgtccataaggaatttgcttgaactgacaaggaatgctaggcagtggcataattccatggttgagtatttgtcatggtttgtggatgcatggatggttgccaaacatgcaagtaattttggttggtatcttagttgggcttcccaaattaaaaatatggtgaagaatttgttgcgacaggcaaatagggccagcaattttgacacttctatacttgagatgaacacacatgttcagaaacattcagcttatactcaagtgcatagcagagctgaggtagttactgttaaacctgaaacaaaggagctattgaacgctgaactctagtcctttgctatgcttgtcagcaacaagattgaggacaatgattttgtattgctgcttctgaaacatctcactttcttaagattgatagctaagattgcattgatcatgccatgggatctagctgaaagcgaagacaaatttataaagcttttgggacagtacaagtgtgcaatataaatcaagagtggagctttgcaagttcaaaagtttatttgatatcgacttgcggacaagtcgaa

SEQ ID NO: 106211 - DNA, 585 bp, Oryza sativa
aaaaataatcaagtgattcttaaacactccaatttttttatttgatgtactaaaatagtatcatccttccagttttatcgaattcaatcatttatcaagagtgcacaaaaagactatgtaacattacatgaacgagtaaatgtgccacaaaagggcatcaaaccaaacaaaaaggaaaggggaaaggagaaaaacatagaaaattaattataaaaatcgttttttagcgcatatgcttacccaacatattttttggatgaatgtttttgtaacaaaagattttcgatgaaaattttaatatcaaagcattactgatgaaagtcttcaaaggctatcgaaaagacttttgatagaagtcaatagggcaccctttccaattttatcaaatttaaccatttatcaagagcacacaaaaggactaagtacgagactactaaatgtgccacaaaagggcaacaaaccaaacaaaagggaaagggaaaaggagaaaaaaaagaaaattaatcataaaaattccttttgttttttggatgaatgttttcgtaacaaaaattttcgaatgaaaattttcatatgaaagttttc

SEQ ID NO: 106212 - DNA, 1014 bp, Oryza sativa
cccccccccccccccccgagggggttaggccacgtgggtgatcgtgtctgcctcaagtctctaagtcatgatactcccggtcccatgtcaccgacactattatattattaaaagaatagaaaaaggagcctccacgtttgctctcatggcctagaaattctcacattaataggagaaaaagaaaaagcagagtccatatagaaatacaatttaaggaatattagaagaggagactagagtccacatagaaatacaattaggaaataactgaaattcagaattaaaaaataaggaatattagaagaggagactagagtccatatagaaatacaattagaaaataactgaaatttagaattaaaaataaggaatattaaaagtagagtatagagtccatatagaaatacaattaggaaataactgaaattcggaattaaaaataagcaatattagaagtagagtatagagtccatatagaaatacaattagctaggaaaataatggaaatttggaattaaaaataaggaatattagaagtagagtgaaatacaattaagaaaaaaatagaaatttggaattaaaaaataagcaatatttgaagtagagtatagagtccctataggaatttaaaactaactaaaatttggaataaacataataaaattaaaagtagagtttagagtccgtataaaaatacaatttacaaataactaaaattcgaaatttagaaaaacatgggaagaagagtttaaagtcaatataggaatacaatttagagataactgaaattcgaaattaaaaattaaagaatattgaaagatgagtttagagtccacatagaaatacaattagaaataattaaaatttagaaataaaaataaatagaataatattgaaacaagagtatagagtctatatagaaatacaatttacagaaaattcgggactaaaaaatatattaaaagacgagactagggggatcctctagagtcttgatattaaaaataattaata

SEQ ID NO: 106213 - DNA, 1035 bp, Oryza sativa
cagagtcttttgaaggctcatgcattgagatgcatgcagaataaatccgttgagctgcatgctattagggagaattagctataaatgatgtgcatgcagagttgatttggtttcttggtctcggtgcagcaacgttatacgctgatcaacaggggccgagaaaggtcacaatagacggtcccccctacacaaggagtcgccccctacagatcaggccttaacccgtgatttgaggcccctagggcccaccctccataggtcgattcttaacccatgttttgggggaaccaatgagtaatctttatttggtgctagaccaggatttggtaatccataagttagcacatgaaatgctatcgtacagttcagcaaatgagataacccaacacgtacaagaaaatctttttctgcacaaaataatagtaaactcagattgcaattgtgcctatgtgctacgtaagaattactagttcgctatcgtcatcatcagatggctatgtcgatgaatctaagagagatcaatgacttatttcaagcatagaaaaatatatgtatgtatatgtaagcatctttgatctggaaaggaagtataaaatgtccatattaattttcaattcagactttggaccagacttgggtgaactttgaacaggtccttagggcttgttttcatttcaagttgattgggcttccaatcaacaacagtaatatttaccaaaaaaattacacacaagagaaataaaaacttaaggatgtaagcagtacacatgcacatcaactagaaggaaccttgcaggggatggtacggatgtagtctatgagcaattgagcagatctaccacggagtggcctatgcctttgtgaaacaaactacaatggagaaaaaaatgaatcaatgtcccgtggcaataaggtgtctaagatcttcaaacttcagaatatttttttctcccaaaagacgtacctgtaatacatatgctaaatatcgtgaaaaaaaagatcatcaacgttatgtgggtcaagtttttccaggtc

SEQ ID NO: 106214 - DNA, 653 bp, Oryza sativa
aacaaaacaaaatattcattatttttcttcttgaacatgccggagagctatgtatcatttcatataagaaaagtggcaaataaacccatacaacacacgcctacacaacccacagttcaaaatactaacatatgtgccctcttaagtataacaaacaactaaatctaatgccttaagtgccggtaaagagaagggaaagccccttaactcctaacactttgtgcaagtaaatggtctacacaaatttcatacaaagttgttagtaggtgaggtacattttttttcagatatccatacagcatgcatgtaagttttggaaatcgatgagacataaaaaaaattggccatatcaaccacaaatactaagtttgcagaaaatcaaattgttcagatagcattatccttgacaagtagtgaaccatggcagagggagacgcacacctcatttcacgggcagcttcttgaatatgccccagctttggtcgcccattcggccattcacatgtagcaatctcacaaacaacacctacaacaaaattgtggcacctcaaaatgtctattttgtggatcaagtcgcattaaaaaaaacagttcaaaagaaaaggtcccattcaaatgcaactcaaggagcagacctaacggaagccaatcat

SEQ ID NO: 106215 - DNA, 1026 bp, Oryza sativa
gaagaaaaagaaaagttcattttaggacttttttttccagaagcatttacgattatagttattgaatgtgtttatttctgagcaaacctaaaagaaaggattttctttctttttccaattaaataattgttaaataatatttgtattattaaaattagcaattaagctttgaaaattccaaagagcgtaactaattctagagaatttaataaaattaaatttaactatgtcattttatttctcaacttgctttacttgtaaatttatttaattatacacttacctaattaacaataccaaatatttcagcgaatttgtagtttaattaattgcatatttttttatctgtacgcttcccgttgcaacgcacgggcacttttgctagtccctcataaagtataatttatactactaggatactacagggaaacggttttaacagctcgtggatgtccactagtttattgcatatcatttaaatagttatgaaaaaaattaaaaaaatatgaataagatagatcaatatgtaatatgtaatatgtaatatgtaatgtatcaatccacaaacatgcaagctaaaattcaacttctacatattgtaacaaaaataacaaacaaaactcaaattaatatatgtatgttgacagttaaatttgttgttttttttacaacttgtagaagttgaatttgaactttgatgtttgtggagtgatatattacatattgatttatcttatcaattgttttaaaaaattttcgtaaccatctagttgatatgcaataaataaacaggtggacgtccaatcaagttattagaatccatcccgtttacgtttagtttcttgtattttggtacgatgagagtatgaccaattacatactaggacgattggtacgtaggcacgcgcgtgtacgtctttgatcgagatcgagttgctgttcccgggagatcgatcgatcgatacacatcatgacgttaatctcagaccttccaccggagctggttccctgcatcgccggccacct

SEQ ID NO: 106216 - DNA, 660 bp, Oryza sativa
aagttatctccatcatattttagattaggcgcaaacaactgagatacaaaggctgtaccagcaagccccaaaacaccactgttgcgagatagtctcagaacaaagagttcggcttgcatttataagcctaaattcactcagagaaaacatataatctgcatctgcagtaactataatggcataaaatcataacatagaatggtagaaagatgtcagtatacattagattcagtaatctttaattcaataccacattggatactacgacaattagaaggtaaccatgtctaaattcaaggatcagtgcaaggtccactaaatccgatatcagatattcatgtgacaatgtatgttagcctagagagtaaatgcacaaacaaagatacagtaatacatgaaggcacaatagtatcatatctaataatagttccctatatgcaagttgtcaagtccacaaaaacttaaaatataagagaaaaaaattagcaccgcttatttgacgatgataacaggtgtcatttggctcaatgcttttacataacaaggattttatgtgttaactcacaattccataagtggggcaacactcattcaaaaccaagggaaaaaggaaaaatacatctctcaatttaacagacctggtcatcagagtggtgtgcg

SEQ ID NO: 106217 - DNA, 536 bp, Oryza sativa
atgtgcagtcgtatgcaggtcatacagacacagtcgtacgtacagtcattccgttgtaattaatctcgttctatattctatactcttgcaaaatttcgggtctatcagcccaccccccattcccaagtacgaaattatttaacccgaacttttttttatttttcattttttatgaatttagccattgtgttaaaatattcaaataatttaggatcaaaattaccgaaattttagtcggtacccccatacaactagcaaaaaagggatttagaaaacattgaaggctgaatacacaaaatatattggacaaagcaataccaaattgttacgagttttctaatcagagtggcgcatcggaagcgtggtgggcccataacccacaggtcccaggatcgaaacctggctctgataattttttccataatttttggcgctacgcaatttcatttaatccttttttttggctcaatttcatttaattcattttttggcgcagtttcatttaatacatttttggcgctacgacgatttctttt

SEQ ID NO: 106218 - DNA, 591 bp, Oryza sativa
tccttcagagaaaggctttactcctattgtgctaatattctctcttttttcccttcttgttaagagtattggcttccgatgttgcccaagcctattaattgaagcagtattcagtccaagagtaccacttggtggaggatacacttcatatttgtaagtggttgatatctattgatgacaaaacatgaaacatcaagtgtataactgctgttgagatgtaagcagccgctggtaatacaaaacatctgatcaatcttctccctcagtcaatcattatatgcgagctgctaatgatatatactagtatcatgtttgtcccgtataactatttcaggtgctgaatcgcttgcaacaaaccgtccaatcattgccaaatgcgaaacagccttagcttgccaacgtcgttgtgcagttaactgatgtttcgtgatccctggttcatacatatgatgatttgacaagcttgacaagaacgggatttttacacgacatttgcggatttgccagtttgcagggataaatcactacaacagttatatgccagaacaggcccgattctgcactggtttccatctcaacacctgtcgttgg

SEQ ID NO: 106219 - DNA, 679 bp, Oryza sativa
ttatacacttacctaattaacaataccaaatatttcagcgaatttgtagtttaattaattgcatatttttttatctgtacgcttcccgttgcaacgcacgggcacttttgctagtccctcataaagtataatttatactactaggatactacagggaaacggttttaacagctcgtggatgtccactagtttattgcatatcatttaaatagttatgaaaaaaattaaaaaaatatgaataagatagatcaatatgtaatatgtaatatgtaatatgtaatgtatcaatccacaaacatgcaagctaaaattcaacttctacatattgtaacaaaaataacaaacaaaactcaaattaatatatgtatgttgacagttaaatttgttgttttttttacaacttgtagaagttgaatttgaactttgatgtttgtggagtgatatattacatattgatttatcttatcaattgttttaaaaaattttcgtaaccatctagttgatatgcaataaataaacaggtggacgtccaatcaagttattagaatccatcccgtttacgtttagtttcttgtattttggtacgatgagagtatgaccaattacatactaggacgattggtacgtaggcacgcgcgtgtacgtctttgatcgagatcgagttgctgttcccgggaga

SEQ ID NO: 106220 - DNA, 625 bp, Oryza sativa
atatagatgagaccgtgttatggcagtttacataaaaagattggggcaattccaaatttaccactcctttgaatcgttattacgagactgtcactagaaaattgcaaaaataccactagaactatcattcgagtggcatccttgcaaaattaaaaaaaccggtggcaaatttgcaaatgccccaaaaagatttgcccataccagatacatctcaaagaagatttgatgcaaagtataacttgttaatgctatattttaatctcggaattattataaacagaaaaagaaatgcttattatctaaaaggaaaatatggcgtgtttcccctaaaaaaaaggaaaatatggcatgtggcctagttacgtaataacatataaggaccgattccttggagaatcttatccaagcatcttataatgggaccatatgaatatttgattcccctggctaagctatatgacaataagttgtgtgtttggctgggacacttgtgtaaggaaggaagacgataggccttgaatacctagaatttttttaggggcccccttgagtacccgaagtcttgcatatatattgactagatgtgtatatatattgggtaccatgctggatggggaaaataggt

SEQ ID NO: 106221 - DNA, 782 bp, Oryza sativa
atatgtttttagaagaagaagggcccttgaggaaaataatagcagtattgtacaggccaattcaattaagatacaaacaagttaatagtaagtaacatgggaaaatcagcagagagtattaccacacatgtgaatcataactgttgtttcggttatctcccattacaaaaactgagttctcaggtacttgctgtcatgaaaaacatagtatcaacaaacacaaaaatataacccagaaaagaatcatgttcatttttcttctacaaggattgaaacataaatcaagtatgaagtgttgttgacaacttcatgttcatgcatatgtacagaatatgcacacagcacacaacacaagaaaccatacacaataatgtatctataaatagtggtaaccatatctatatccacctaggtgtggctagtgagcactattcaatagattctatagaaattttatgtcttcagcttacttggaggtataccacacgcaaaatgcaagtttttatatgtaattcgtcatgatatacgtctgattattaatgcagataaagtatttaaaaatcagtaacagtaagggatctaatcaagattgtttcttcaaatgtctccattcattccactgacacatccacatatgtagtgtcagtgaatcaaaactaataaaccatttgtgttttcttaatcctcttattgctcatcagccttaactggggaatgtggttcaaactatatttggttggttgttacattattgagctcatgtatcattcatgggtggctca

SEQ ID NO: 106222 - DNA, 649 bp, Oryza sativa
ctatagattataacaatctagcttatagcttatagtaatctgactcaataatttagattataataatcctaaactgaaagaaacattgcctcaatgtagctatgctagcccaaaattaatccaatcttatgcgtagatctacgctatcctcaagctaaattatgctggctgtacaattacattattgtgctggtcttgtttggtactagtactagaggttttgatatgtgattttgtccttgaaaaactgattacttttaagggcacgttcagatttatgatattttaaaccataccattatttgataaaattaacaaatgcatgataatatttagtttattatcaaatatttgtcatacttagagaattgacaataatatatttaacctatcctaccaaaacttagtaatgttgctaacttgctaagattttggcaataccaaattttggaaagattgaaaatggctataaaatgaacaagccctaaatcagactcggaagaataacaaattgcattgtattattgcgtttacaaaatacaaataattgggagaagctatagatgtctcgagtacagacacgcaaaacgaaatattcattagcacataattaattaagttttaattatttcaaacttcgaaaatagat

SEQ ID NO: 106223 - DNA, 1071 bp, Oryza sativa
tgcgatgcactggcgactgcgagcagcaccaacacgaacgctcgagctggggccatgtctgtcgtcatgatcggataactctgtaactaggcccttgagacttgatgaccgagttaattatctggagctatctatctctgaaagcaacactgctctgttgctttgtgttgatcttctatgtgatgtctgtttgcttggtgatctcctgatgattggatgggtatatatagccatcgctcggtcattgttggattgctgcattagtggctaatgaaatcccaataatgaagtagtgtgaactctggaaagccacgggacgaagctagcgcgcggcgacgcgcatgtgcatgcatcgccggccggcgcagccgcagtactactataacttgctcgccaattaatccgaagaaatgtgtgtccgccggccgccgcagacgtaagtatgtcgcgcttgtattgctttctgttttcctccttgattggtgcgagataatactatataacaaatgaacgccttttgacgtttctctgctcttgttctctcctgcctaagcaacacgtataagtattgagtaatattgaacaatattatagaacttacctagatatgagtacagcatgttctgcaagaagaaaaattctagggtgtaaaaggtttacatgctttgatatcttcatttatatatctgctctcatttttaaattatttatcgttttatatttgtaccaagttaaacatttctaatgttgaccataaatttatattgttaaacaccataaggtttttttattcaccgtgggaaatatttttactagtttatttattgttaaattttatataaattgatgacaggacaaagctaaatctaaaaagataaagtaattccaaaccgaagaagaatatttggttgctactggcatcaatccgaacataggtgcgtgtttgcaattgcacccatttgccatggcggacaaggattttctatacttggtacaatggtattcattatttgcatacgacttagaacggtcaaagaaaatttacattaattgaaatcttataattctaaa

SEQ ID NO: 106224 - DNA, 560 bp, Oryza sativa
aaaatcatggaacatgaagaaaatgatgttttaaatggcacgttgaaaaaaaaagtgaatatgaagaaataggaaaaatgaaaaaacacgttttgatttccacaaaattcctatggaatagattgttccgtatgctttcaggtatctttcatgagctaatcatttgtttcaaaaggacttgatattcattttatccatatgatttaaatcataatttacttttctttgttcataaggggaaaaataatcaagtgattcttaaacactccaatttttttatttgatgtactaaaatagtatcatccttccagttttatcgaattcaatcatttatcaagagtgcacaaaaagactatgtagcattacatgaacgagtaaatgtgccacaaaagggcaacaaaccaaacaaaaaggaaaggggaaaggagaaaaacatagaaaattaattataaaaattgttttttagcgcatctgcttacccaacatattttttggatgaatgtttttgtaacaaagattttcaaatgaaaattttcatatgaaagttttcttgatgaaag

SEQ ID NO: 106225 - DNA, 870 bp, Oryza sativa
ttatgtttattccaaattttagttagttttaaattcctatagggactctatactctacttcaaatattgcttattttttaattccaaatttctatttttttcttaattgtatttcactctacttctaatattccttatttttaattccaaatttccattattttcctagctaattgtatttctatatggactctatactctacttctaatattgcttatttttaattccgaatttcagttatttcctaattgtatttctatatggactctatactctacttttaatattccttatttttaattctaaatttcagttattttctaattgtatttctatatggactctagtctcctcttctaatattccttattttttaattctgaatttcagttatttcctaattgtatttctatgtggactctagtctcctcttctaatattccttaaattgtatttctatatggactctgctttttctttttctcctattaatgtgagaatttctaggccatgagagcaaacgtggaggctcctttttctattcttttaataatataatagtgtcggtgacatgggcccgggagtatcatgacttagagacttgaggcagacacgatcacccacgtggcctaaccccctcgggggggggggggggggttgggcccgagggtgatacggccgcccttctctttgtctccccgaggggtcggaccgctcctgtctcggccccgagggccgatgcgccccgattccttgtgggttttgcgccgcgtatatggggtaggtgagcatagcggggctcacctaaccacatttattgcggtttggacgagcgcgtcacgccgcatgggggatcctctagagtcgac

SEQ ID NO: 106226 - DNA, 551 bp, Oryza sativa
tttttcataactatttaaatgatatgcaataaactagtggacatccacgagctgttaaaaccgtttccctgtagtatcctagtagtataaattatactttatgagggactagcaaaagtgcccgtgcgttgcaacgggaagcgtacagataaaaaaatatgcaattaattaaactacaaattcgctgaaatatttggtattgttaattaggtaagtgtataattaaataaatttacaagtaaagcaagttgagaaataaaatgacatagttaaatttaattttattaaattctctagaattagttacgctctttggaattttcagagcttaattgctaattttaataatacaaatattatttaacaattatttaattggaaaaagaaagaaaatcctttcttttaggtttgctcagaaataaacacattcaataactataatcgtaaatgcttctggaaaaaaaagtactaaaatgacttttttttttttttggtccgagggacctaaaatagaattttttcaggccttgctagttggcccatggcttttg

SEQ ID NO: 106227 - DNA, 955 bp, Oryza sativa
agatatacaccctatgactcatggatgacatgtcttgcgctttaggggtaaaacaaacaatgcttgttggtaaatgtatatccaaagccttaagatgttcctttgccttatggataaatttccttttgtgcaataaagtttctctagtatgttatcattttgtgcggtatgtcataaatgataagttaggcgctccttaaatttgttggtttgttgtcagttttgcgtggcacactatgcttgataagttagcggaacttttaaaataagaaacttgtaagcttgttgtcattttctttgacatactatcctctcccatatgtaaagtaaacaaattgatgaaatatatggaggttagatgattttgcatatccaactagtacttccaagtttataccaaaaaatagaaaatgttggatttaatttttaaaaaagtagaagcaatggacttatgtatcttttcttttttttatcattatattttctggcgtgcatttattaggcagtttattactgtgacataaatttatttaactcgccggtaataaaatatgccatatgtttgttagtcctcactgtcgaccatatcatacaagacattaatcaaatcgtcttgtctaaaatgaccacaatgtccctgcgtggtgtggactatgatttcttttcattcatggttagaactactgccggtccatgaaaggttaaactataaaatgccatctgaaaaaaaaaaggtaaacagacaagtactcgccctcgcaattaaattgttcaataataatagaaatggaaggatttgtcgtgtgtgtgtacatatatacaagaaaatatcaggaaagcatgtatgttattttacacaccgaaagaataaacgcacaacgaaacttatatacaatcatatgtttgctaggcaaccagagatgttactcccaaaagaaacgctccggtatcaatt

SEQ ID NO: 106228 - DNA, 591 bp, Oryza sativa
attgctgcattagtggctaatgaaatcccaataatgaagtagtgtgaactctggaaagccacgggacgaagctagcgcgcggcgacgcgcatgtgcatgcatcgccggccggcgcagccgagtactactataacttgctcgccaattaatccgaagaaattttcggtttttccctgattggcgcagaatgacgcaaaacacaagcgcggcgacgtccaggctcccgcaatcgcaagcaagcgcatgaaggcaacgttcaacggcggcgccatgaagaatggggtggcgtgtgttgtgtgtggccggcgatcgagtgaggcatctctgaagtctgaactgaagcatctcgagtgttttggactcgtttcttttcctggtgacgttatgaggtgtttttttttccggggagacgttttgatgaggtgttgatcagaattcatcaccttgttagaatgtcaacaagaacaattgacggaagaaacaaataatcgttttaaaagttgacaaaatcatcgagggaaaaaacgttttcaattagccattccaattgacgaaattccgttggcaagtaaacaaaacaatccacggaaa

SEQ ID NO: 106229 - DNA, 515 bp, Oryza sativa
ttttagtactttcatggaatttctccctcctatccaactaaaaatgaatattccaatgcgcgcgggctccacgagctaatttccacatttacagagtgctttcccccaaaactcacttcgtgcagtgcctacagctaaaaccgtaaagtcgcgatgtcctatagcaaaattttcctcgattcatttgttctatcaatatagatgagaccgtgttatggcagtttacataaaaagattggggcaattccaaatttaccactcctttgaatcgttattacgagactgtcactagaaaattgcaaaaataccactagaactatcattcgagtggcatccttgcaaaattaaaaaaaccggtggcaaatttgcaaatgccccaaaaagatttgcccataccagatacatctcaaagaagatttgatgcaaagtataacttgttaatgctatattttaatctcggaattattataaacagaaaaagaaatgcttattatctaaaaggaaaatatggcgtg

SEQ ID NO: 106230 - DNA, 518 bp, Oryza sativa
aaatgatggccttatgctgcgtaatttgctgctgggccatgttgcagtgactgtttattcactcggagtagtgcgtttgcgaaccaaccaagcatttgccaattgctgcgtgaggagggaatctaatctgactaaatatgggttttacttccatgccaacgcgactaaactaaagcaagcaagcgatttcagtcagtagagggaaactaacacccaccaatttgtttgttattcttctgtgcgactgtgtattgtgcacgccaccgtgttgatattgaagggacgtgccgcgtggatggattgatatatatataggttgcacagatttcagatttctcccgtctgaaaaatatgcaggatccctgctcatagaatcatcatatatagtttgggaaattgtattgttgataaccaatatatatttttcaatccacttctttaaacctaaatatttatatgccatccatgagtacaccgacacgggggagcaattgttcatacagaccaaaaggatggca

SEQ ID NO: 106231 - DNA, 662 bp, Oryza sativa
tggaagaattgtcaatttcgtctgataccatgaagttaatcaatcttgagccacatagcctgcctttacttagagagctcgagttagtatgccctaacttgcagaattgtgatgcacttgccagcctcagttccctcgagatactatgcgtaaatcgttgttctccccaacttcgggtgcctaattcacttcaaagccagctggaaaaactctacagtccttgatctttgtaataacagtcctctttttaaatgtactattttagttggtacttctgcctttacatggccacatatcttaattctccttttgctatcgactctgtagaagcagaacatcaattcaaagactgcaatttttcggaaggggattggagggagaatgcaaaacagcttctggtgtcccactcccaccttaacactgggacacggttttctttttcttgatggaactgtgggactagaacaataaaggaaaagcgaataattacacaattactaaagaaaaggattgttactgcgataatcatcgcatagattgattgagagatcaatgttagtacaactagaaaggtggcctgcgcgcatgacaaggtaagatttttattgtttgtaaaaaaatttgtctcatagattaagggaaaactaaaggttggatactat

SEQ ID NO: 106232 - DNA, 637 bp, Oryza sativa
aacaataataaactcaatgagatatggacacgtaataaaaaagtaagaaatgttttaggccttttagcagtaaataaattcagaaagaagcattgcggcttatagtgatgaactagcgcactagctatattccaaccgaccattgcctggcatgtcttggtttttagtctgtgatataaactatatgtgccccagtttcgtaggatattattccggggccgagaatctccaggaacaacggatggtccaacctgtgtgatagtacttgtttaagggtaattattacggtggtctctattagaagtactctgctactagtattgtcaccagtagaaacgatctcaattgttattgatttataagtcatactactgtaagaaacaatattctactatcaatgaggtggtcctacctctgtttttatggataacactgttgacttttggattaatatttcaccatccaaattaatcatttgggttaatatagtccttagacccacaaaaagtgccacgtgagtatgccaagtcatcctcgcatgtagcagtataaatgaaatgaccattctactcttatataccatataaaaaagaaggaaaaaaagaagataaatatttcgcacatgtatgatcatttt

SEQ ID NO: 106233 - DNA, 644 bp, Oryza sativa
  unsure (1)..(644): unsure at all n locations
acccgtgcactttgcaggtcatccaaatagtaacgaaatactataaataattatcaacacaaattacgacattatacatccaagtataaaacaatatttttttgacggacaacatccctgcccttttacatatcgtccaaataataaaataactatgaaataattcagcaacataggatgcaccatcatatattattttgtaaacataaaaactaaattaaatatacaatgcctaagaaaaatatatcaaatataaaaaatcggtgggacatantaccccattggcttttacatgtatccgaattgccataaaagaattatgaaataattcaacaatacaagtggcgccaccatacgttgttttgcacacatgaatagctaaattaaaaaaaaagctttaactcaaatacaaatagtccaagtcactacataaaaaaatccagtggctttagtagtagaaaaaaaaatccaattacttcatgttttctgaaattaatgcggtcaaataatccgagtaccgaaagcgctctaaacaatctaatagatttttttagaataccatctaattgattttagatggtgtttaatgcactttggaaaatctgtagatattcaaccaggtattcataataagtcccattaaa

SEQ ID NO: 106234 - DNA, 700 bp, Oryza sativa
gggcgggcagacaaagaataggatgggaacaagaggggctttttactatttggcactcttacggatgttgcttaacgatttgccactaggcccacatgtcatagacacatgagggcccacatgtcattgacagggtgtggcaaatcgttaattgccatgtcacaagagtggcaaatagttaaatttcccggaaacggaggcaggctaaactgatggcgaggagtttgaagacgacgatggaaacctgtgttttgatgcttgaaatgccaatgttttagtcctgtaataactgtttgttttccttttttttttctctcgtcttatctgtaagaacttgatgtttctggaactgttgtaatcatgagcgttttctttaatgaaaacgggggagataccctccctttctcaaaaaaaaaatcccaaatttgcacatttgcttcccgatttaattttatttgcaggtagtcgagaagttggaattccatgcaattaatcctaagaattattgaattccagagcatgccttctgaaattagcccattgcttgtccaaactacaagttgaaacatatgtttgcactgaggcaatgcacaagaacgaaaacaatgcataactggatgttcatgcccctcttggaaacctccatatatgcactccttatgtagctcctactgctcattgttccaaggtctaaaaccat

SEQ ID NO: 106235 - DNA, 1254 bp, Oryza sativa
aatatctacagttatgaccaaatggagagggcgaaaaccttttatatttatgaacagagggaatacgtactatatatggtgttgtgtccatgtttttccaatcagatctaaatactacgacgatgattatagtagaggtgatatgatagtcactctaattttgttcacatcatttacacattattactcagtagatataagataatatacacagtacacaccaccagcacacttgctctaatagtccacaatctgagttatattatttgttttgttcttaatccatttgtctatatatttcttcactcattattgccttgcatctcctctctcctctgttgccttatcggcttgtcttgtgagcttacatggtatcctaaggccaggacgacttagaggcctacttgctctacaagaggacaggtcttaaaaaatgacggcaatttgtagctcttgagtcgtgtgctcgttagtgcgagcgttcatagtggccttcctttcaggcttaattattttgttgtcgctgtattatatgtaaactttgtttctttatcaaggaacgctttcttaaagtcttaaaagaaatgcttttctaaagtgcggtggtaaataaaatcatatatccatttcttctatactacctccattttttaatatatgacaccgttgaattttataaacatatcaccattcgtcttattcaaaatttcaatggaagtataaaaaaaactaagtcatgcttaaaaaaacatttgataataaatcaaatcaaaataaaataaataataattatatattttttttgaatcagacaaatcactactagaaaaagtatttttgcaggcggccaaaagtgattttttcaggcagaggagaggatcgcctgtagcccaacgactgtgaaaatcgatgattttcgcagtcggggcaatggcccgcctgcgaaaatgcattgaaaaagcaaaaaaaaatcgccacacgccctcgccgtcgtcgccctccccagccggatctaggagggaaggggaagggagctgcgccgggcggcatcgtcgccgccgccgtcccgcgccgtcgtcgccgccgccgtcccgcgccgtcgttgtcgccgccgtcggcgcccgccccgccggccttccccttccttcttccggcagatctgggagggaggggagaggggagctgccgcccgctgtcccctgccgggcttcccctttgcttcttcagccatatttgggagggaggggggagccg

SEQ ID NO: 106236 - DNA, 608 bp, Oryza sativa
atgcgaaaagcagctccgacatccaacaatggacatcagccaagccaccgaggagcctcttccttcacatggccagcaccataactccttggaaaagactgcaacatgtcatgttgccaagcttcactgcaccccattagcgagcagcttcgacttcatcagcagaaacaaccgaagagcatgtcacccaccacaagaatgaagcagacccaagaaggtgaaggcctcaccgaacacaaggtatgaaatcttttgaactgaaaaagaccatcaacagtcgtcgatgcgttggaacttctccgaagtgacacccacaaggaggacacgaagcgtaacgccgtcaccgctcattcgaaaatcggaacaaggttttcacctggagattttggggggggggggatatgaaagaacgccatgacaacgcctccaagaagggaaacagcgcccgcgggcgccgtcgtcatcgaaccggccaaaggcatggcaaggctttcgccagcatattcacatcacccacacaagcacccccacattgatggccacgaaatagtccttgacatctcacaagcagtcataacttgaccgtaaccaacggcaaaacaggccct

SEQ ID NO: 106237 - DNA, 551 bp, Oryza sativa
cggtcctttttggacggtggtagtatatagcactcttcatcagagaaaatctaaaaagaatgaaacattcgaccatcgatttacattattttagcttataagatatatctttttcttaagaaaaacatcccaaacctccttccacgctcccatgcggcgttaaagcccattaaccatccttataaatgtttctaaaccactctatgacacttataaattagaaaaatcataaaaaattaagaacaaaacatccaatcactggtttcgacttaaattgatggacatattatttaggctgttattagatttttatttaaaaaaactgtcaaacctcctttcgtccctccccgcccctgcaatgttaaagattttaagtactttaaacatcctataaatatttctaagccactacgggtctctcttaagttaaaaaaaatcgtacaaaattacgagaaaaaaaacatctcactgtcggtttcgacttaaacatccaacatattattttaggtcattagatcaatcattttcttcaaagaaaaacatcctgccct

SEQ ID NO: 106238 - DNA, 607 bp, Oryza sativa
agttcatcattaaccaactaccttgtacggttcccatctgccgccattttccaactaactcgagctactacaactaataatcatcagtaacacgagctaattaaaagcatcttccagcacggcaggaggagcacacatccctcatcctctgacaccgacatgtggccccacaccacaggcacttgacctgtgtcggatccggacccgccaacccgccaggtgttccctccaatgggaggcgagctctccctcccaagagaatttaagaacagagagaggaagtggagagactacttcccccacctccgcctctctctcgatccatctaccccctctctcctctcctctctctctccgttcccaatctgcggaggcggaggcggagctagggcgcggcgtcgccggcgaggagttccgcaggcgcggtgtggacggggctcctctgcttccgcacacggcgggcggcgacggcgagcaaggttggaggggcggcgcggcgacctcctcgttcctgccttgcctgcctacatctgggtatgaatcggacatcagtttttgtgtttccgaaatttcaaaaaatatatgcatgtcgggttggggggttcaa

SEQ ID NO: 106239 - DNA, 830 bp, Oryza sativa
agcccagtttaatgatatttttggggccttgacatattcactagcccagtttaaggatattttttggaccttgacttacataattttgagcataccgagcaggccaaatccttgtggggcttggtcaggttggaccacttgtgttatatttggtccatcgctacattcgtaacctagcataatttattagttagtttcagttgtcgcttgtcagaaaaaattgctcaggtcacaagtcccctgtgaaccaaaatgtttgagtcacgaaattgtcgatgccaaatttttatcctctgaaaaggtctagaaagtacaaaaaaaagaaagtggacccatatctttaattactgccatatcaataccaaatcatgcttatccgataactgcgactttcccatcatcgagttatatatatacccttttgttgattgagacttgtataaattgaaaaggagaaattcaggtgcataaggaatctacgttgcatgcataagacggtaagtactagcttgtttgccaactttctacttaaatccagttgtgcaatagcgtggctttagataagtttaatgatttggtctagcgaaacttgtttcagatgatcagatatatttcttgtagtgtttatatctgtgcgtgtgcgaaataaatgcatagatcgaggggggtgagcagttcaatgtacaatcaggaacatccttcagatatgaatttggcctgtttgattaaaattttctgtttcctacatacatttgactttgattgcctatctaacaaatatcacaaataccaaggtttttaaaattgttagctatgatgaactacttgca

SEQ ID NO: 106240 - DNA, 693 bp, Oryza sativa
tttacgtgcactaaaaatttatcttcaaaaggatagatcaaacgaggccttaaaagaagagagaaaatcataaaaactctcgagatcaaggtcttacaactcgaaaactaggtcatcacccaaatgccaggtataaaactccttaaccacttgctccaaatataaataagctgaagtgataataccatataaaccgagcttctggagaaataatcaagaaaacaacctgcaaaggaaaataaaccgttttcccataaaaaacaacatcattatttgagagccaaaattgctcggcacgttgttatcgtctctagtaaaaaaactggtctaaactttttgttatgtcgcaaaatccattacccaaagatattggacgcgtttatggatgatcaaatacgactacgagtatactccctccgattctatattaattgacgttttagacacgggtgaggtcaaacttttataactttgatcatcgataactttaaaaatatttagtttaaaggaactagaacaacatgtatagatttgtctttcaaagcactataataaaagtcaacatgtttttatgcactataatatcataagagaaacatgtatttatttattatttatattataatagaaaaataaggttaaagatatattttgtagaccgtgtcattgtctaaaatattaattaaaatgata

SEQ ID NO: 106241 - DNA, 808 bp, Oryza sativa
tggagaaaatattctctcaacataagctggtaataaattgatgtacctaaaagtttaggttagggactacaaattacaggtgggttatttctgaatttctttcagttgacttgtgctaattaactaactgcttatacatacattcctcgcaaaagatactcaatctattcacttgtttttctttttttttttcaggggtagttacttggcttggttgcatcgtgccaacggtaagagtaactgagtacgctccccacgcccaatgcacgtatactgcctccgttaaaagaaaaaatccaatacgagatgttatgtttaaattcatagtatcaacacatttcgcgctagttttttttttccctgacaaagaaagatacccttgtacacgccctaataagccagcgtaatgggttaggagacatcatggcatcatgcatttgtacactactttctgttatttgtaatgtttattccgaattttttttctatttaacttgtacacacttttctgttatttacgaagacaccacacaatgaataaagtgccttgacgacactccaaggccatactaatcagccctcaccatgaacagtaccgtttcatttttttttctttgacccgattgcattagattagcaatcaagcacgaagctataagcgactaaaacacaatgcaaaattgcaaatatcccagcgcaccaccgataaatcattcaaatggtggaaaaaaacaaacaaaatggttagattaatataggcctgcatgtgaatcccacaagaccagtttaaccaaaccattgtaggctt

SEQ ID NO: 106242 - DNA, 653 bp, Oryza sativa
ctaggctctatatgaggtgggttctaatttgggggtggtcatggaagtgtttatgcctttgctagctgctaaggatattgtcagaatgaaaatagggatgatggatatcaagcaatttccatttaggctgatattatctactcctgaggctttgatgtatgaggcatgttttactatggagaatgtggtggaaatgggctggtttaaaggacaacagcttgaaaaacagcatgacataaaggcaaacattgaagacaaggaagatcagaagtctgataccaaaggcaagcgagggatggagagttggagacaaaagagacagctgggcagctagcaatgtttcagcaaaggggagaatgcagtcaaatccaatgtcccagtatagagcaggttgagttgttggctgaggaggataagaacaaggctttgcagattatacaagacagggagttggcactggtgctgcaagagaaggaagcaagaggtcaggtcagtggggataaagctgctgaagataacatacctgaacacctcatgtggagtttgagaaggccttcaagtctgctccacatgacgtgtcagtagctcgagagacacaaagaggacaagttgctagcaattgtgaggatggtgtggaaatggaaagtgattag

SEQ ID NO: 106243 - DNA, 891 bp, Oryza sativa
tggattgcttgacaataaaatgtcgttagtatagagtaccggtgaatgaaatttcccacctttaattttcatgcaactgtccacctcacttgaattgttcgaaaatttccattagagtcaggcttaattttattaacccacttaaatggcctatttttgactcatttagaaacttttactaaattctttattacatggttcgaaaaaacatttagatgaacactttaatgtcttattttgttcatcaatctcaatttattcttacatggttcgaaaaccatttggatgaacgcttatttttaatgtcttcatcgggtgaacaagctttatttagtgtttaccaccataatccgatctcataacttcattttattttagcattagtatcttcaatcttaaatttcttgaaggaaatcggaggttgcttatgagtaaacatagccttatgggtaaacatagccaaaagttatttattggctaaattcttaacttagtgaagcttcccttaaagcttaaattacttaaaattaatccaagggaaagaaaatctccaacttatgagacgttctaacctcccctagaaatgtgacatcaatgacaatgtcacaatttcaatgacgtctcatcttttgtcattacaaacaattattataatagtcacatggtcatccaaaagaacaaatatgactgtcgtgcacaaggacaagaccaatcactttattatcacacttaatatatcatgttctatttggaaaaataacagacatgacccgtttctcacatgactttaaataataaactagtaaagtttctcttaatagagtgaacaaatgagacattattgcaactgctggagaaacctagtgtgaggtctccaacaacccttcactt

SEQ ID NO: 106244 - DNA, 705 bp, Oryza sativa
atgtaaaaagtacagccaaaatatttttctatgtaatgttaataaaaaataaagaagtatttgttggtaaaacttgttaatattgttataaaaatgtattgaagttggttgttgcgcaatttcatatgttaagtgagatattattttgtaccttattcgacgtattagtactcggataattaatataggcctatcgcagtctcggtcgtagaaacattatatggacttaaacaaggagaattatgtaacatgaagaaatagtagtacaatttgaacatgatacaactatttcgattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcgagcaaagttagtcaatgttgtgagaaaataaggattaatgtaatcaaaatattcttaccatgaaatcgtcgtcaagaatatttggacaaacaaagaa

SEQ ID NO: 106245 - DNA, 695 bp, Oryza sativa
  unsure (1)..(695): unsure at all n locations
aaaaggctagtgccgtccctggtcaattaaggaccgagccatgaagttaagcatgaaacgacccccgtacaaccgcatttctcgtatgggtatagacctagcagagtagatagctgagcggaggcagtatccatgcatagggggttcttgatgtgtgaggcaggggctcacggtggggcagccattggtaggaccgcgaggcgggtgtctacaatggtgtcgccatcggtaggactgccatgtgagaatctaaaacataattataacttaatgcatgtgtgagtcttgccttcccgggtgcgccagaactcctctcactgctagaaaccgcgtacgcctagagtgtatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgcttgcgggtattgagcaccgggacatgtattacacttggctagactctaaattcttaactngtgtgggatgggatattgcatgatgaaatttatgctgatggaggcacatcccgagagaagggaaggtggacattctcagaaaaccatgacgaatcaatggcgccgagctatcctt

SEQ ID NO: 106246 - DNA, 635 bp, Oryza sativa
tcatcagttcctagcacggtcttaggtttgagaagatagatcccttgttcggtctttttgtttactacaccgggtgtctgaactaccaacattatacttatctcctctttattttgttccttatctagtcataccattctcttcgatctctcattcgccagcgccgtttgtagtctccgggtctttcatccagccgcaccctatctgctatatatatagaagacccctcttctccctcgttatcttccatctcccatctcctcccgcctcagattgccgttgcttgttcaccaaacagcactcccctagctctctgtatggctggcccatggccgccgcctgcctggcgcttactctaggttggtccgtccattcctatcacatgtgctccgggttccacgcatatcgtccagcgtggtcactttcactatggccgaagaaggagaatgaaagatatcaattttttttatcaagtttgattgtcattttcgaaggattgaattacccggatcaatatctcagtcatgactgaatgcccaccactagcgctgcgtgggggtttgggggcgtgccatatagtagtcatactaataagatagtaactataatcaaaatttgacatttatagcccgtac

SEQ ID NO: 106247 - DNA, 633 bp, Oryza sativa
ctgtccgtcttatttaaaaaaattataataaaattaaaaagaattagtcatacataaagtactattcatgttttatcatttaataacaacaaatatactaatcataacaaattatgacggtcaaatgttacacataaacaatacaaaactacggtcctttttggacggtggtagtatatagcactcttcatcagagaaaatctaaaaagaatgaaacattcgaccatcgatttacattattttagcttataagatatatctttttcttaagaaaaacatcccaaacctccttccacgctcccatgcggcgttaaagcccattaaccatccttataaatgtttctaaaccactctatgacacttataaattagaaaaatcataaaaaattaagaacaaaacatccaatcactggtttcgacttaaattgatggacatattatttaggctgttattagatttttatttaaaaaaactgtcaaacctcctttcgtccctcccggccctgcaatgttaaagattttaagtactttaaacatcctataaatatttctaagccactacgggtctctcttaagttaaaaaaaaacggtcaaaaatacgagaaaaaaaacatctcacttgccgtttcgact

SEQ ID NO: 106248 - DNA, 5065 bp, Oryza sativa
cgggcacgtgcgtgcacccgctggttgcgcgcacggccgtcgaggggctccttgacgacgccctgtgccctcccccattccccctttgccggcgttgacgatggccagcgacgaggtaaggatttagggttaggttttttggtttcttttatttctttttctttggatttctttccccgaaccgatctaatcgctagggtttggctctgataccatcgttagagttcactttaggatcatcgagcttttgatctagtcgggtagtcctcttgggtgtttgaacaaatatagagatggaaagagagggtttaaagactgatgggtagagatggaggaggaggaagtgccggccatcgtcgttgtcatcgctcgcttgtcgtggacggcggcaacagtgggcttgacagcgatggtggtcgtggcagcggcggtcgtaggtgcgacgacgaggcgtggcgcggcggtgatgcttcccgtcactggctgcgccccctcgatcggttagggttttgtgggtggagttggcggcggcagcgaacctcgtatcatgtgccgtcccggcctccaccctctatttatatggcgcagggtgacgggggcccaccagccaatgggctgggcgcccccgatcaggacgcgggtcaaggtccccttgtgccgttgggctcaagaggagggagatctatctaacatgatctggctttctccaagacccaagccaaaaaccgattcaggctctttttccaagtcaaaccacataatctagttctgcttttatattcttttagcgtgcgttctacacatagcatcacaaattttatctaacatacatagtagtatagtactacttaaatagtcggagactcgcattagtaataataaatctctgaacttgctaaacttttatgaaaagcccaactactgatcacatgccagtaatattcataggcataacagtttttttttaattatgcataggaaggagaggaagaagaaaatagctagtactaattaagacgatgcagccgatagagaatcattgtgtataaaactagaaaaccgtagtgtttggtaacctactacgcgttcttctcatcccaccgatcgatcgcgcgagcttgctatgccgcaacatgcaccgtccgatcgaagtgtttcctgcatgcttcactgcgatccggccgtccacgagcacaatcaagcttgattaatttctgctggtttgtttgcggcaatgaggctgacgacgcgttaatcattttgggtgacgttaccagctgacgtatgtgatcttcatcttgtgttccaagtttcaaaagcttcgctcgatcttgagcttttgatatatcgtggctctcaattagctcttgctgactggcagctctaaatcaacgagcacaagcttgttggctatagctcttatcctcttggcctcttggcgagcaaaatatatctaatcttagccgtttagtgataaaatcctttcaaaagtagtagatgtaaatcctcaatcaagaaaaagtaacgaaaattaacccaaaatcaaggcaaatcgatcgatttgtaggcaacgcaaaaacagatactccgctctaagtagtaggagaatcttctagtatagggcgtggagctagcatggaacaattcgaagaaattaatcaagaaaccggaaactaaccaattatgtaattaacaacaaaatccatcacaagaagagcaaaaaaaaaagctgcagaagcagcaaaagtaattcatataattggttgaggaattattagagaatactactcacatattgttgagtacccagctgcgcacggcgtgcctcgcctgatatgatccagcaaacgatccgccgccgccgccatcggaagcgagaacgacgacagagcaagaggtcgagctagcgtgcaaatggccgcagtgttgctggcacgcggcaatagtcgaggcggcggagtcaacctactaggtaggtagtgtggtctcaactctctctagggcagacgatagctgtggttgcagagctggtggtcgtggtgggcgagatagatgactaatttgcagctagccgcgcgtgtgggccgccgcgcgaccaccccgcgttttccatttcggcccaggtgacgccggaccgtgcgcctccactttccgtcttgggttttcttatttcagcccagctcgcgcgatcagttcagcccatctgtctaaattttgtatacatatggatataaactttgaatttataagtatacaaactttgcatatgtctttacattttttatacatcaaaagtatgcgtatacataaaatacactcacacacacatatacacgtatgatatgtgcatatgcttcctccgcacgccaccaccttaatttgctccctgtacagtgtcaccaccgcatactcccttcgcacaagcaccgccccttctacctccgcgccgtcgctccctttatctctcgacatgtcagttgctttatctctcgacatgtcagttgctgcttctccctcaacgtgcctccatccttgctccctccgtatgtgtcgtcgctttcgctgctccctctgcgtgccgccacccctgctacctccgcacacactgcctccgcgccgctctctccgctcaccgccaccccttctcgctccgtgcgccaacggcaccgctccctcctcctgacctattcattgctacttctcccttcgcacacatcgttgtcgctcctactctctccacgtgtgccgccgcccccttctccctccacatgcaggtgacgtcgctccctcgttccccgcccgtccgctacaccagcctcccaatatgaaaggggatgagaagaaagttggagataggattgttgtgtactcatgggcattttggtacttttggctaataaatacatgctttttttttgtttttttatatacaaaaccttaacgtgtaatggaaacacggtcaaatgataacttcaattttaaaaaataggatcaaatgcaaacatgaaaatgtgaggttagattggtagaataaggtcaaataagcaattatcctaatttattattcttcttagagaaaggtacctgaactaatttaatggttcacttagcccactaaagttttttttttgccttatcttacccctaaactgttaaaaatgtttcactttgctccttaataacatgtacattttcttacccgtcatacaagttgcattttaagctaaaatgtaccagcggtattttaagctaaaatttgttaggagccatagatggcaccattaacgaagttcaaaagtattttcaaattttttttcatcgatgtttgcttgaacttaattttgatgtttgaatcactttcaacctaagtaaacagtgagaattctttttttacaaaaaatgttgaaacctaaattgtgaacgcatctatgttctaccaaatttccagagcaaaattgacttagatagagagagtaaaaaatactgctaggggggttcgaggtgtaaaatgagaaaaaaaagtttaggtggttaagtgctatgatgaaatggttacttttttttcttactctttattacgagccacctatcttgtcgtcatctagtccaccactgttctcacaaattaaggattattaaagcctattagaaacatatattgtttgtatggactttgggattaattagttagtaaacaaatgttaaaaaataatgtaaggttatactctctccgtcccaaaatataataagtggctattaaggagagaggtaaaagaataatgcatggttgcctctccttgggatgaatggagtatagccgtataggcctggacaaattggggctataacaaagggataatatggttaatttagtggtaaaagtcacattttataatactgggttgctttatttgggataaggtttaaactattttatgatgcaaggagcagtatttttccaatgccctagctaagctagggcctattctttttagatgacgcagcatattctgataatataagataacttacttataacaatgaattaaatattacattatagagttaacaaatagcttcaaaaagttaccaagcaaggctaatgaataattatttttctggagcattgtactttgaagcatggcaccaataatgatgtattgataatcagccccagttaattagctcattccaacagggcagtcattcagagccacaggcaaatcttcccaaaatataagaccatgaaacgtcaggacaacaacaatgaaggaatagaagtaaaaggaaaaaaaaaaggatcgatatttgaaccttggagccctagactttaattagtaatccatataagagctaagtgtataggttgacaaggaattaaaatacttaaaaagaaacataaaaaatatgtgaaaaaacaaatttccaaaaactatgtcgaattcaagctgatagtgctaaaattgacaaaaatggttcctatcgtccgtttaacgagaagcccaaatcccaaatgcttcaactaggtgggtcccaccgaatccttctccttcatctttatctactcaccaaacaccatcaacccatctatttctccacaccacactccaatcgtatcctctctctctctcccttatctctctccactacaacactacctcatcacgagcagcgacggggctcttgtcctcgatgataatctccttagcttactcaagggcagctcggtcagcctcggcttcctcaatgacaacgtgtcacaacatcagcggccacttgtttacaacggcaacacgacgagcttgaacttggcatccacgatgatccttgctttcatcaagtgtggcgccgcatggttgtaccaaactagtatcgattctggcgtcggtctgttactggagaggagaaataagtagttcagactttttttttatgcttcagccaatatgttttcgatgttccttggtattggatcagaatcttgcagtgagttttttttttcatattctatgtctttgaagagtgagattcgtggatgcaggggcggatgcaacgtgggtgcagg

SEQ ID NO: 106249 - DNA, 1183 bp, Oryza sativa
ctggtgaggaggttgacgtgggctcggggacggcggtcttgggcggcaccgggctcggggacggcgtggagggaggcgccgggctcggggacggcggtcttgggcggcgccgggctcggggacggcgtggaggaaggtggtggccgttggggaggccggatcttgagtggccccggcctcggggacggcggtcttgcacaacggcggcggtcggcaatcgatagagggaggcaacggcgtggaggaggtcgacgtggcggctagcacgaggtcgacggccactgggcatagatctggagaggaggatgtgggacgcccgtggttggtgaggccggatcttcgagagaggaggaggcgacagcgttgaggacgaggaggtagcggtcttgaggactaggcggagaggaagccggcggtggcggtcttgggcgtggaggacacggacttggaggaggaggaggcggcgtcaacggtggtggaggaggacaaggtggcggcggcggtggatctgagagagtgagagtgtgagagagtgagaggcggcgtcggcggtggataaggacccgtggatgaggattgactaaataaaccctagtcaatcctcatctctatcaggcagactattatgcccgatgcggatgacacttatccgtgacgggcgttagtaatctacccgatacggatgatacctatccgtgacgggcattagaactaagcccgatagagatgtaataatctctatcgggcatagtactaaagcccgtcacagatgacttattaaaatatttttaagttataaaaatcatttataattatcttctgcccgatttaaaattgctattacatttgatttatcacatataattaacaaatgtcttatttacatagttcaaaattcctattaattttttaaaatcatataattgacaattgcctttctcacatatagtttaaaattcctattaattttttaaaatcatataattaacaattggctctctgacatatagtttaaaattcctattaattttttaaaaccacataattaacaaatccatttcttcaaagagttttaactggaatggcatgaaacatatgcaattcattcattaaggctccaatacaaattaaatacatcattcacagtgatatgccttccgaatggtctaaacaaacgtaagcc

SEQ ID NO: 106250 - DNA, 588 bp, Oryza sativa
gtcccctgtgaaccaaaatgtttgagtcacgaaattgtcgatggcaaatttttatcctctgaaaaggtctagaaagtaacaaaaaaaggaagtggacccatatctttaattactgccatatcaataccaaatcatgcttatccgataactgcgactttcccatcatcgagttatatatatacccttttgttgattgagacttgtataaattgaaaaggagaaattcaggtgcataaggaatctacgttgcatgcataagacggtaagtactagcttgtttgccaactttctacttaaatccagttgtgcaatagcctggctttagataagtttaatgatttggtctagcgaaacttgtttcagatgatcagatatatttcttgtagtgtttatatctgtgcgtgtgcgaaataaatgcatagatcgaggggggtgagcagttcaatgtacaatcaggaacatccttcagatatgaatttggcctgtttgattaaaattttctgtttcctacatacatttgactttgattgcctatctaacaaatatcacaaataccaaggtttttaaaattgttagctatgatgagct

SEQ ID NO: 106251 - DNA, 658 bp, Oryza sativa
aaggaatatcatcccaagctaagtgcaagctagccagcgcagtacactgccgagtgggccatcctacgccgaaattgagccggagtttggttgcctggaccgagataggcaagaaacaggattgccctggtttaggactttggcccaattagaggagaaaatgaataagacaatttttttttgtggaattcgcaatattcgaaatctctatctctactgttataaaaattaaagatatttttaccggtactttggtacgtcatccgtgtatgagtcggtttttaagttcgttcgcttttgaaaatacatgtccatatttgagtcagtttttaaattcgttcgtttttgaaaatacagaaggagtcgtataagaaatctctttaaaaaaactcgtatgcttatttgtaacgatcagactcctaaccacagctcatgatttaaaaaaaatacatcaaagcgaattgccacaatgaatttcaccttagttaaaccatttaccaataataaaattaaaatagccttcacccgttgcaacgcacgtgcattttttctagtagaaataaaatatttgtgaaatgtgtcaggtttaaacttccatgaaaaattatatttgttttgcagaaaatagaaggaactcttcataaataatgttagcatt

SEQ ID NO: 106252 - DNA, 1294 bp, Oryza sativa
cccgtctgctccgaccctaaggaatatggatgctacatatctgctgacgaggcgaatgcagatagaacacacaggcaaccaaaacccttcctatccaagatttctagacttatctctaacgtaatcatcagcaaactcctagatttctagaaatgttgtatttgaacgaaatgttctgtttaccaatttgtcttggtcggtaccgtgcaggcagtaacgtgaccaaaccagatttggcaaccaggacacttcgtattctcctaaatgccataatttcagtaacttcatttaataacagatttctatgcatatccatcccatttcctatgacccatttaatattattcttgtacctaaaaaaacacaagtcatgacatataataagtttggcctcagttttgctcagaaattatgcttcaattatcatcatttgcaactgccccacccccaaaagaaattaagaataagtgtagagggtctgtccttatgcaaaaaagaaacaagtgtagaaacccacatttaaacctaaacaagaacaagagtgaggccggcccaacaatgcatccattttgcaaaacatcccatactgccactcccccccaaataaaatgaacaagtgtagatacaaaacagccataaaaaacatacaaaaactcacaattcccccaaaataattcaaccatcacagcccacatcaattcatccatcccattggacccaaaatatcccaaaaatggtatgttcttgagcaatcatcactggccattcatccatcatagcccacaatatttcatcatcacagcccacatctaaacaattttcccaacatcccattctcccccaaattcacaaattcatccatcacagccatataaaaatttatcactagctaacacatatagaaatgcacaagtcatcacagccatataaaaattcaccactaggtaacacatataaaaatgcacaagtatcacagccatataaaaattcatcactagctaacacatataaaaatgcacatgtcatcacagccatataaaaattcattattagctaacacatataaaaatgcacaagtcatcacagccatataaaaattcatcactagctaacacatataaaaatgcacaagtcatcacagccatacaaaaattcatcactagcacaagtcatcatatgtagacattagcatctaaacattgaatcaacaaataattgcactatcacattatcgaattaaacattatcatcgaatcatcaaatcatcacatataacatgtacacaacaaatcat

SEQ ID NO: 106253 - DNA, 1417 bp, Oryza sativa
atggcccctttgaatttcatttcggcctgccgcacatcaaacaacttggatgccaagagattatatgcaacttcattttgcgcttccaagccgcgtaatgtgtaccatcaaattgtggatctcgcccggtaagcacggatacgatgttgggtgaaggaattgaaaggttcttgtaatcaaaaggtataatagctgccttgggtggtgaagttcccttgctgctcgctccatcttgatttccattttccccgtttttttccactaagtccgacatcgtggatcactcaaagcggcgaagcttgaatcaagagcaccctgctctgataccaattgaacgcgctgatgaagcctagaggggggggtgaataggctgtctctggatacttaaaaaccaatcgcagctgtaaaattcaagcagacccggaacttcctggtaaggaagtccggaacattcggcctgccaggcccggaacttccggtgttctaggacaggaacttctgggtaacagaatagagatgaaattcaaatttcgaaacaggagactaagccaatcttcacaagatggtgcacaggtattcttagcagaggatagatcacagaatcatccacagaaacatcacagaaagagacaagagcgattttttcctgaagttcggatctttcgatcctactctctgttgaggggctccaaagagctgggtctcgattaaccccttgcctcacttgtgcaaaaaccccagaggaaatccacagccttcaatcccaaacactcctaggcaaatttctagaattgagtgaccaccaagatccaactcaacctgcttctagaaatccaccacaagtgtaggttgctctacttggaaaacctctagaatctcagcacaagaacttcattcacttaccttgttccctttcggaggagaggagatccttcacaaacttacccgggacatccacaatatgcaacggattctcgcgggcgacacctaaccgtctaggagatcatctccaagagtaataagcaccgagatgacagcccacgagatattccaagagctcatccaagatcctagtcttcactcctctccaaatcttcttctctccctctcaatctctctttctcacaagaattaggctctagattgagtggagaaggcaagaaacacttgtgagagtctagcaacagctctaggtttgaaaagtgaaagtggaatggccaaagaacgagctggaaacgagctgtatatgtataacggctaggtgacgtcatctagctgttactcacaaatttgaactggagactagacaggaagttccggacctgtaggataaatattaaaaatctaacaatcatattatttacatcactttgcctgccgaatcccttcgagggctagcttaccacttcaggctgga

SEQ ID NO: 106254 - DNA, 783 bp, Oryza sativa
agtgtcactgcactggaagtagttcatcagagattttaggaaaaaaccatactattaagaggggttccaggtgatgctctgagatatctcaagtgctcttagtgtgaaccaagtttcaaatttccctaggagtcatatttgcaaatactccatctgtccagaactgcaagtccggaacttcctctcgtctaggtccggaaattccggtcttgtgaataagattttcctaagtatagtccggaagttcctgtcctacaggtccggaacttcctatctagtctccagttcaaatttgtgagcaacggttagatgacgtcacctagccgttatacatatacagctcatttccagctcattctttggccattccactttcacttttcaaacctagagctgttgctagcctctcccaagtgtttcttgctttctccactcaatctagagcctaattcttgtgagaaagagagattgagagggagagaagaagatctggaaaggtgtgaagactaggatcttggatgagctcttgggatatctcaagagctgtcatctcggtgcttattactcttggagatgatctcctagacggttaggtgttgcccgcgagaatccgttgaatattgtggatgtccgcggtaagtttgtgaaggatctcctctcttctgaaagggaacgaggtaagtgaatgaagttcttgtgctgagaatctagaggttttccaagtaaagcacctacaattggggtggattttagaaagtaggtgagatggatcttggtggacac

SEQ ID NO: 106255 - DNA, 595 bp, Oryza sativa
ctcttgatgttgattctagtgatgaggaaagtgataatgaattagatgatgtgcttaagagctttagcaaacccgctatgcaacatttggctaagttaatgagagctttggatagtaaagaacaatcactcgaaaggcaagaagaattgtttattcttgagaagaaaagaaacattgccttagaggagagcctagctaaagaatgtgctaaaaatgaacaactagctaatgagcttaatttggctaatggttctctagctagccttagggatgtcaatgaaactcttcaagagaaatttgctaatttagacaaaagtcataaagatcttgaagttcaatttgacactctttggaatagctcttctcaaccaaatgtgttttctaattcttctaagccatctactagcaatggttgtgctaggtgttacaacattgatttgaactctaatgctactaatgttgatgctatgtaagctcttaagaaagagaatgagaggttgggcactttggtgaaatatggatgcatgaagacataccattcaaaggatgccatttacaagaccatcactgctcatcctaacaaggatggacacgg

SEQ ID NO: 106256 - DNA, 790 bp, Oryza sativa
  unsure (1)..(790): unsure at all n locations
aggtttttgaatgcgcctatgcgatggtacagnagntcatcataaatcaatgtcgaaatgagcaataacgtggttttgtgaaactttttggtcataatacctgaggttatgtgccacgtgctagaactcctgaggttttgtgcaacttagaccataatacctgatgtcacgtgaaatttactcttaaattaatagggatctaaattgagaatccaagattggtactccatatatatgaattcaaaattatttacaaattatagggttttggatgaaaaaagattccatacatgtcagttgcaatttacaattatcagtttggtatttagaaattaaattgataaagtccaaacggatacaactctatatctattaattctgagttttagaaaaaaaacaaatcctgaatagtcctcggtatcttctggctatggcatgttctgtttaacatgaattcttaatacaatataccgtcgcaataaatcttataaaaatccaacgacattaatatcaacaatatgcatgctatggactgtatacagtatgcatatggataatatggtcaacacatctgaaaattagttattaattgttagtttttatttaaaaaaaatattctttggtttaagactaagatcaaataaccaaatttttatagtgagcataagatttaggatgttaatcgactgattgctttgacaatgcacttatgagttatgacaaaacagatattcaataggtatatagtaaaatgatgagctnctgcaccagatataggagcgaatccccg

SEQ ID NO: 106257 - DNA, 788 bp, Oryza sativa
ccctgcggtagatttagcatcgtactgcaagtagttcatcaagctgactcagcattggacccacgtgggtcccacatgtcagccccttcttccccttccctctcttcctccctcctcttctttttctctccctttgctcctcagttcggcagtgggcagggcagctggccggtgggggaggccggagtccggtggcggtgccgcacgtccttccacgtagccgacaccggtggagaagctcctcctgatctttcgtggattatgatacctgcgaggatgtactctaaaaaggtaatcgttctctgccttttctgaccataattatcccatataatacactacagaggccgagtttagttccaaacttattctttaaacttccagcttttccatcacatcgaaactttcctacatacacaaactttcaacttttccgtcacatcgttccaatttcaatcaaacttccaattttagcgtgaactaaacacacctagagttgatgatactatacctatttaactaggctaccacatgttaatctttcagaacccacgatatatgataagtcaaactattagcactttctggatgtactgttggttacagtcgccaggaccactttttcgaaaaatacagtccgaaaagagacgaagtaatccgattcaaaccatatgacaagtgcggcacaagttctctggatttttttagcgcttatagcacccgtgacatttgcagctgccttcaccttgcctggaggtacagagcaaataaccacactgatggttgcg

SEQ ID NO: 106258 - DNA, 779 bp, Oryza sativa
  unsure (1)..(779): unsure at all n locations
tttgagtagattcgcttctactgcaagtagttcatcaatatatacaagtcaaaaatatgtggaatgtgggattccaactcacgatctctcatctcagcccttaagagcgttaccatcgcacatactacacacatctgagttctctagtagtggactcttaaggaaggggtcattgtaccagcccaattcatttaaagcccctgtattagtggtgtggttttggcccaagtgactgaggtgtagatcgattagtgacatacttttgctagtttcatgagtcgtgtgggcatgaattctagcaaacattatcagcctcatcttttggcttatgcttatgcttactaggacttgaaccactttgtacatagtgccccagacctctaccttaatttatctcccggtctccttcgaagccccgtccaatttcttccactcaacttgagtttgccaaggacgacgaaggaatattattaatcagctcatgttgctgattggcacattaaccacttggaggttgcttgactggcagcatggtgaaaccagcgtgcaaaaccacccttgggttaagtaaaccggggtttcaatacatcgagataaaaaatacttggtttattactttgggggctaagcaacacaaacagttttggggtttatatatagacattttacttgagcanacagtcagccaatcaacaattaatatagntagccgtcagctcatatttcgtcacattcaatttgcnnccgttcagattttcaatttcaaaaagagactttta

SEQ ID NO: 106259 - DNA, 753 bp, Oryza sativa
  unsure (1)..(753): unsure at all n locations
agcgcattgttgatgacctccncagtggnacagnagttcatcaacctaaaaccaaataaaacacaagagtgagtataaaaaatactcagcaagtacaatatggaactagaaaacacacgtacacaacattggcaataaagcttgaacataaggctttctttcgttgataggaaacatattttcaaacaccaagtcaaagaagatagtagttcccatcccgggcaggcatgaattgaaatagtagtttccatcccggacaatagtgaatacatcctttgatattaatgtcgttggatttttataagatttattgcgacggtatattgtattaagaattcatgttaaacagaacatgccatagccagaagataccgaggactattcaggatttgttttttttctaaaactcagaattaatagatatagagttgtatccgtttggactttatcaatttaatttctaaataccaaactgataattgtaaattgcaactgacatgtatggaatcttttttcatccaaaaccctataatttgtaaataattttgaattcatatatatggagtaccaatcttggattctcaatttagatccctattaatttaagagtaaatttcacgtgacatcaggtattatggtctaagttgcacaaaacctcaggagttctagcacgtggcacataacctcaggtattatgaccaaaaagtttcacaaaaccacgttattgctcatttcgacattgatttacaatat

SEQ ID NO: 106260 - DNA, 696 bp, Oryza sativa
cattacacaatatgagcattttcgagacattgatttcaatccacggaaattcaggtattttcaacctatcatgtgcttagtaggggaatctgacaagtcaaaattcaaaatttaaccaatagatgtctgaaagggatatttttttcacttcattcttagtctttgctaattactccctctgtcccaaaatataaccacttctaacatttagaatttgtcccaaaatataacaacttctccgtcaatattctcttctcaactaatcacaatcctccaccattcaattttcacacctacctctaatttttctccaatcacaacactcccctcatttaatcataccaaatttcttaataactgtacccaaccctaaaaatgcttatacgtaagcaatagaaatgcaaacattttctgagagggaggagtgtcacagggagtacaaatcagagggaacaaatttggctcgacccaggtgggccccaggaatcatagactgatcaggcacagaggcgggccccaccctggagctgggttgctttgaattcaaacaagccgggaattgaattgaactgagctcgctactctttctgcttcacttccctccctatttataccggccccatggctcgcctcaccacactgatcacctcgacctcactttctcctcaacctcgagctcactcctcgctctcccgc

SEQ ID NO: 106261 - DNA, 655 bp, Oryza sativa
caaggaattttctggtgttattttttgctgccaatttcagcctttgtgagcagcatgtttggtaccaatgtttggattttccaacaataaagctgagtgttgttggtgggcgaccattttcctgcgggggtaataagatatttagaccaaaacttctgtcaaaatggttggtaagagacatgctaaccaatagatacacatgtttatcagttttctttggtatatacttctccttactaaggagtccttaattgtcctttctttttcatgaaacagtagaagaaggctctactgaaaaaatactactgctatttataatagatttatgtaaaatagacctaatgatccacagtatccaaaaaatagttacaaggttcatgtgaaacatgcagtaatttaggtaaggcataagagaaatgagttgcagcatacttttcctaaagatactagtttggtatatccttgtcattttggtctacaaggcatttttaccttcccttcttttcatattgaattaagaagcaaacgatgtatgtgaactcgtgaaatgatgggtgaaatggcacaataaacagtagagttaccaacttatacttcgttctcatctgtagcactactgtattaggtagtgaatattttagagttcgatgatata

SEQ ID NO: 106262 - DNA, 915 bp, Oryza sativa
acatttgacatttgtcaacgaactatcccatttgtcaactgaatggatggccacagtatcggcaaagcgaagtacaccacgtgcaaagggagaattcctggatgaatgatcatgttcttcaaggacgatatggaagaatttccaaggaatcgtgtggcgatctgctgtagcgaagtacaccatagaataattttgagatggatggctgtgaggcgttcacaatttcgcggaatctcgcttgaacagttgaacttaacaaatttcgagcgtctcaagcaggtcaaaacaatatctaaaaacgtgaatattaggaaagaacctaatatcaaataattaaaaggggtgatgcttcgaacccaggtcgtctagctcaccaccttgtggagctagttgcatgaccctgggcgtttcaaacgtcccaacaagatctcaactgcttgaggtgcatttcgaatggtttgtttgaaatttgttaaatttatttgaaattagcgaaaaatcgacctctcccaacggggctcgaatttcactattctaatgatattgtaaagattactcatgatcagcactttcagaataagtacaacaaagtttttcttttttttgaggaacagggtgtgtctgaatctgattcagaactcagaagtgtccggttcattcatgttagcattaaaccaaacaaaaaactgttgagcctgcaactctgcatgcagtaacctctctaataagcattcgttgatcaaggctggctcttgagttgaacaaacggaccaaaacaaatttttgccattaaaagaagcaagacaacgaacaaattagcaccgaaaatatatcatatggccgtgcaaagatagtggcaacatgatcagatcacttctcatgatagatgtatataccacacggatcatgcatgcg

SEQ ID NO: 106263 - DNA, 568 bp, Oryza sativa
agaaaaaaaatagcacgctacaacaggcctcaggtgcagaccaatggctgctcgacctggacctgccgcagcctcaggctggacaacggagctggtcagttagctaatcaatgtctagagtgcggtgcacaatgtgcaattcacagagaacgaagaggacaagataatgtggaagctcactagccacggtgaatttactgtgacatcggcctacaaggcgcagctcctaagtactacagccaccaacttcaacatcctaatatggaagccgtgggcaccacacaagtgcaagacctttgcctggttgatcatccataatagagtttggacctctgacaaactggcaaccaggggttggcagaacagctctttctgtcccttatgcagacaacacccaagaaacagctctccaccttctcgcagaatgaagatacaccaggaaaatctgggcggcgttatctgaatggactgggtgtggtcaactgaatcctggccaatggcaaccagcttcatcggtgttagagtggtgggaggccaccgctcccttgaacgaagccccaaagaaagc

SEQ ID NO: 106264 - DNA, 677 bp, Oryza sativa
  unsure (1)..(677): unsure at all n locations
aaaaaggctggctgttattatgatcttagcagctataatagctctgactgattaatgatccgtaaaaacataatgatccaagcagctacgagacgcgtgaaccggttaaagaatgttcggttctttgtcttgttgactggtaatctcagtccaaatatttccggtgcagagaggagagttaattactatagtactaattaatagtagtagtaatagtagattgtttttgcttggaccagctaatataattactatagtactaattaatagtagtagtaatagtagattgtttttgcttggaccagctatatagccgaccaggcatgcatatgcagtgatgcaccgaattaacctgggtgatctattggggaaacgccaagaggaactctctgcattcacagataatacagattgttctaatgctgtacgtgtgccttaattntgttttggcatgtcatgtcttaaaatgcagaggtcgtgtttggtatctttgatacagtctctaattcgcatatttcgtaattttatttcgcatatggtggcctttcatcgtttaccccgtggtttataagctatagcaaaattttaaattttaaaatgtttttgggcttttgtatcgtagtttacccaagaggctgttctgtggaagaaagctgggctcctcccggattagggtg

SEQ ID NO: 106265 - DNA, 739 bp, Oryza sativa
caaaagatgaagtgcaggcatcatgtgggacgtagcaaatcgacctgttcaagaagctggtagctacaattaatctaggaacaaatagtagttcaagagactgatagttacaatctaagaacaaatagttagacaggatagctcagttattaagcatttagtacaagaaatatatgaacagaaagccatcagttggccaagagcgattatatgccacacggcttattagcaacgtaaaacttttatacatgtattcttagcaacttaaaagacaatggtaaaaagaaactacgttgaaaataccctaaaatcaacttactttgaaattatgctgtaaatttcggcagctgctaatttgttataggggacaaaatattatagcaggcataagtctattggcggtccatgcttggtatggacaaccaacagggagtccaaatccaacctgaccataggcccatgattatcaatgcgggcaactgggaggcggcgcgaggagctggcaggagaaagtaattaaagatgtgattaaattgtgatcacatgattaaccgccgaataggaatggaatatgaaatcctgaatatggctgaactggcaccttaaagaaataaagcaaggttaacctgaattcccatggcttgcttgatattgacacatcactttggttttgggactcgatgcttctttccatagaaagacatgagcagctggaaaagtggcaacctgaaatccaaag

SEQ ID NO: 106266 - DNA, 505 bp, Oryza sativa
tttacacaacattagacgctgacgaggaggaggacgatggacgaacacatggcgtgcgtgcgtgcgtaccaggtcgacggagtcgtcgtagatgtcgtcgagggagagggaggacgccatggggggtttattgggaagatgatgaagacgatggtggccggtgcccggcggcggggtgggcggcgcgggcacggagggaggggcggcggcgggcgagctattgcctccctctctcctctcctctcctcctctccttctcagcgtgggtggaggggaagggcggcacgggccggaagacggcgagccaatggcggtcgcacggggcgtcttatagggtcttttccggtttccaccatgggcgtccgagcgagcttcacggggcgcctcagcctgcgcgcacgcaccggcgctcgaccgccgcacgtgtcgcccctcccccacgacgccgcgttgtgaggcccaggattccgcgggaaaatggggagataatccggcttacatgcaa

SEQ ID NO: 106267 - DNA, 857 bp, Oryza sativa
cagttttttttcgtctgaaaatcactctaatatgcatatatatatatatatatatatatatatatatatgaacttctgcaggtggacaaacctttagatgccaaggcaccgagtgatatttatggcgaaatgccgaagaccgacgatgtgacatggcaggtgcctgagttccagcatcaccatctcaagcatctgtagttcagtggcttcaatgaagaagaaatgcactggaggatagtggagcttgtcaaggagagagctgtgaacctgcagagcattgctctggatgacggatgccaagcctgcgatgttgtggcgaatgaatatgttctctccggtgggatcaaaaacaagaaaccggtgttgttatcagtgtcccagatcacaggatctcctcctattctcacccttgtatagagggtgtatccggtgcgttgtgctcgcaggcgagtatagggttgacgctgactcttttaaatatgttcctaaattattgacatcgttgactttttaaagcatgtttgatcgttcgtcttattaaaaaaattaagtaataattaattcttttcctattatattatgcattgtcacagatctgtttatgtatatacttatatatagagagagttcgtcatacgtctcaaaagtttttaactaaaacgaacggtcaaacatgtttacaatgaatcaccagtgtccaatatttaagagtggaatggagtcagatacagtcactcaccgcataagcatcacaatgttaggatgccttcacgggccgtatatttaaaatgcaaggcatggccaccttcggattacaattcgctgacgcgtctccaactacaggctcagatttgaaa

SEQ ID NO: 106268 - DNA, 516 bp, Oryza sativa
aaatttcaaaagtagtgtgtacatacattaagaatgttatattggaagattcatgaggtagatagaattctaccaaaacatttcacaaagtggtgactgaagtgatgtagcattaagcaaggatcactttacacagaagcaaatttcttaagcctaaattcatgcactgtttactataatattcatcaacgatacatatgcaggtataacgagtaaacaacatggcccattagatagctatcctgctaggattaatcaatattcattcaacagttactgacgaccattctggacagtgaattgggaccacacaattgaagaattcacattcaaatgacctttgaatacaacatgattgaatgatcatgtcaaccataaaaagaatataagcaatagctacagaagatggatattataagcaactactcctacatggaatgggtatttgataaactgttcaacctaagatggtaaagaacatagccaaactatttaaaaactcatgtagcacggtga

SEQ ID NO: 106269 - DNA, 526 bp, Oryza sativa
cctgctgatgtgccctgttcatctacctgttcttctatgctccatctcctgtttctttctctctctcttttttttctttcttttttttggtttttttagtttagtaagctatgtgaggaagaactctgatcgaggttagtttggtcacagtgagttctggagcagcttgtgtatacggtagcatcatttagagcataatagggttgcagttgagaccttcaatttttgttctgctactttaattagtgtcatgtgcttaatttcatcttcaagcttttcatgctcccatggtgataagttaggtttatattttttattactactgctcttatttgttagagttcgatgtgcacgtagggcttgtttggttaagtgccaaaggctaccgtgttaaaacttatgtgtgcctcaattatttttaacaagtcattagaggggagagattcccacctgaattttccattcatgcgaaaatatgtagtagggcgtgttaaaaaagtctggagttactcagttacatagattg

SEQ ID NO: 106270 - DNA, 582 bp, Oryza sativa
ttacaaatccctcctgcatcccagtgctcagaccaaggcagggaagtaaatgtgctacagaattgtcatcaataattttgcctcttgcaatgccattgggagctgttcctcgtggggggcatagaagcctgtggcattgcgggctcactactctaccttcttggcccaaatttaagcacaaccaaactgctcatctacctgcaaaccttttgcaggatctcttaatgcagaaaaatttaattgatgaatgccattataatccatgtatttatgcaagttccagttgatgaaggattgaaagccacatttgccagtgccactacattgatgaaatttgcaggcacataatttcttttttaggcagaaaatgggcatctgcccaacgaattcttgtgcagtgcggctaaaccataagaatgtaacctgaaatgttgtatacctaaagaaggcagtagcccagccacagtgaatctatgagcactgtctttttggtgcaaggaaaaatgcacagtaactaatgtgagttactcccttccctttctgaccatcacaaggaacgtatgaccagatggatgtggactg

SEQ ID NO: 106271 - DNA, 518 bp, Oryza sativa
ctgccaactcaacaccatctccttcttcagttgacccttttactaaccaaattttatgcgtggtatacttttttgaaactttatcagttctttttcatttctattaaggcaacctttctatttagatcagtcatgtactatgttcttgagatggcgttgagttggcagctcctattagaaaatgtaactgatcttttatttaatcgatggcaggcattttagactttgttctgaacttccctggtcatcataaatgcaagttccttgatgccatgagaaacattctgaagataatagctagtgctgcgtgggctgtgatccttccatttttctacattagcaccgcatctaaagtcaatttaccaattaaagatctggataaatggtttcaatatgttaaaggagttccacctctatatatcctagctgtggcagtgtacctgatacctaatatcctaagtgcagcactcttcctgttaccatgtttccggaggtggatagaaaactcagattggcgt

SEQ ID NO: 106272 - DNA, 624 bp, Oryza sativa
atacaaaaaaaaacatgggaagggctattaaaattacataaatttgagaagagataaagacttaaaggaaacttcccataagattctacctcttaaatttcctccaaaacttacatgaaatgagacattgtatagaatttcttagaatttaatgttctgattcggagggctatataagaaaaaagtcttataggaataaattctctaaaatttctatgattttcctttaaatcaaaggggtctaaatgtcccattctattttaacatgggatggagggactaagggtccctttgaatcgcatgaatggaaaaacggaggaatagaaaaaacgtaggattttgacaggaatgcaagtgtaaaacagaggattgaaaaatacaggaaaaacacagaaataaccgtttgattggaccacaagaaaaacgcaggaatcggatgagagagatagactcaaaggaatttttccaagaggttggacctcttgttaactttcctccaaaatctctataggattagtcattctataggaactcttaaggatagtattggatccaatcctttatttcaaaggctttcataggaatttttttaataggattaaaatccttcaaatttcctacact

SEQ ID NO: 106273 - DNA, 768 bp, Oryza sativa
  unsure (1)..(768): unsure at all n locations
gctggccattgatgttgantcccttnctatgcaagtagttcatcaggagcaacaagaacatgacgaaggtcgaatctagtggtgccaatagggagaaaggaagtgccacggcaaacaaccggaatggagtgaccattaccaacggtaatataagtttgtgagttggggaggcgagtaacgagtataccgtcggtggaggacatgtgcgaagtggcacccgtgttgagaacccatgagttggggttgtgaagcgtcattccattgagagcggcgacaaggccggcttggtcccaagccagctggacagaccctgcaggcggtggcgaggagtatggcccggcgaatgcagtgtgagcctgaggatacggcccaagtattccggcgctgggagaacgccagggttgctgctgtcctgcctagggcaagaacacccatggtacagcttggcgtggagcatggacggagaaagtgctggtgccgaagctgttgctgccgatggtctattcaccagggcggccgtcgaatccaccgccgccgttgtcgtcggagttgcggatgttgttgcgggcgtcgttcttgcccttggtactgacggcgttgccgccgccggcgcggttcttgtgctgcccaccgctgacagaggagatgcaagtgcccctcgtgcacatggagtgcgctcttattgcttggacgaaggcattctccgactgtacttgtaccgagttggcgttgcgaagcttcttgagaaccagcgtgtttctcgagaag

SEQ ID NO: 106274 - DNA, 1344 bp, Oryza sativa
  unsure (1)..(1344): unsure at all n locations
tgattttcgatgtctgcacgtgttcatcataaacgaggagcattttgggactacacaatactcccatggtctccaaactcagctcctgatcaagctctcatgagagtgatcttggttactttgtctgggtgaccatggacaatccgagggctgaacacaaagtggagcgatttctgagcatgttttataccagaaccaggtttcaggtgggagatggggggcaatcactgagctctggagatccaactgactcgaacagggttcattcgaacatgggatgcttccagatgaacatcaccaatcccatgggatgcttgatgcttccagctgatgaacatccggagatatccctgaacccagatgaagaagacactgtgtggtgggagttggagacacatggccatttcactgtatcattggcctaccagatgttcttcatggcaagccttgtccttaatcccctatgtttgttcttcatggcaagccttgtccttaattccctatgtttgatgttgtgacggatcatccagaaggagagaaacacaggagcagtgtttgattatctgggcaagtacatatttcggtatttatgtcatgatcatttgctttggtctagttttcatgcagagtaggattagaaatctcaggccgatgtgtccgaaatccccagtgaagggcattggcaagcgtctcaagcattttagattacttcagcttttgtctctatcaactctttggtgaaacattctaggccaattattcctcttaaccagggttttaaatttcgaaagcagcagttctgccgctggtgagcgaaagaaccgaaatttcgtacgaatttttttgaatttttgacggattttgaataaattcgaataaaatctgaccaaattcacaaaaattgcaaaaaaccgaaattttcgggtgagatgttagcatttcggtggggggggggggcgaaatttccgaaatttcgttccaaaatttcaaacactgctcttaacttgggtagctatggaattttaatagccttaataccagttgattggctgtgcctttttattgtcagcttcagacataacaaggaatcattcgagcaaccatacatatatatatccaattgctagaagcaatacctgagagatacaccgaatggcaagagacgaantnggtttcttgcccatttaccattcgtggttgaaatcaatggcgcctgtggattatgttgcctacatgaactaccctgtgggggattaggaggtcccaggattttcaggctacgggcttgaagatgatccagccctcgcacgtgataggctttatgctcggattgatccaaaaagg

SEQ ID NO: 106275 - DNA, 777 bp, Oryza sativa
  unsure (1)..(777): unsure at all n locations
aactcacaccacattgagttcacacaagaaagaagctttttcggtagcccgtgacttgcaaacccattgcttgcccatcaaggttagtttggtggcctaattagctaagcctgctaccccttaaacttgatatgatatgtccaagattatttaatacaaggatttgtaaaatcaagaagttgattagattctataatgaaaatattggtggttcgctaatgtaatctggagattttatagatggttgatttgtgaagtgtacagtttcggttagccctggcggcaagaccgatcgtgctatgccagtcaatatgcagctgatgagacgatcagacaggtcggccctacgatctgaccctcaggatcatatgtgatgtcggttctgtctcgtatgttgtggtggaacacatcctcagggaaattggagtctcaaccgattcaatgtgactgtacaccgatgtaattcaaaagtgagtcatgtttcttcatacttagacgcaaaatgggctttttcggaagaagcaagcgggctgctaacggtcaactagcggaaagggcatgcgagagatccaaactaaaatttaggggtatgtaagggattgagcaaaattcaggggtatagaagggattaggtgaactttcatagatacgtaggggattttctctatatgatattactgatcgagccacagatctgtacgagtagactctttcggctggaaacttgatgagctacttgcngagnnggcaganagcacgtcaaatcaacggggcgct

SEQ ID NO: 106276 - DNA, 895 bp, Oryza sativa
ttttgtaggggcccgggaaaattaaatcccgggcggagaagaacaaccccaagcggtttaaatgccaaagaaaacccttcataagtccggcatgggcaattaaattttttgggggtggttaaaaaaaaaaagggaaaaaaaaagggaaaaaaaaacaggaacccgtttcccgggaacccccgtgtttttttcccttgggaggcaaaccttggttatgggccgccgcccccgccccttgttggcccaaaccgttttggcttgggccggccacccttgggcctctggttggcttaatagccagcttaagaaaaggaaggggaaaaaaaagaaagaggaaggggcattttggtacttacacaactctttctctctccattttaacctgtaataataatataatgggagaagtgtccagcagctaattactgcttttaaacagtgtccgcaatcaaatacacgattttggggtgtctcacagcaaaatccacaatctttcggtgtactgtagcaaattttgcctttgtgaaaagttccctttctatagaacctcgaccggggctgctccactagctctcttcttcccctcaccttgctcttctctagcaaatccttgtagtcttgtgagcggtggtggcaggtgtatcctagtgacttgcaccaagttcttctcctgttatattttatagatgcaatttatgtttataatagacaaaacttagcaattctggacctcattaatgcacacacgtccgcgtaatagctaggtatgatttgcgcttcttaaattcattctttttcagttttacaaatactgtcatccttgatagccccatgtatttacattttacttcattttatttgtgtccttcatgtcgtacttagagttttatttata

SEQ ID NO: 106277 - DNA, 1498 bp, Oryza sativa
  unsure (1)..(1498): unsure at all n locations
ggctcgaaattatcatgtaatataatgtgtccatcaaaaaattgccctcaaatcgagcaccacataaaattttttatcatctgcaaaaatgtttataaaagtagctctatattgataagcccnggtcttggatctaattattttgagggccattctacttcacaaattcttattttaatctttctcaaaatattaaccctccatcaaaagcatacagtaaaattagtttaggctctcccaatgtcttctccgaatcaagcctgaaactttcgacaagtgtagagtggagatgacaaatattgcttgaatgaagcattttccctacctctataagcatacaatgaaattcacattgtacacatgggtaataagcatataatgggaatattgcttgaacatgagaaataaggcaataagcaatgtacagacattttctctttctcaataggcatacattgggaatttcaagtgtagggtggagacgccaaatattgcttatcccctatgaaaatttctatgaagactactagtcaaagaaataaaaacgccaataaatataattatgaaaacatactgataaattgataataagttaggtttggcacgaagcaatcctagtaaattgatggctaaagcctactgggaatttttcttaagaaaagtatgggatatcacagcccataaaattttctattctcatattattgtgcaggatattatccatcctattatttgtctcctcaaccatttttgtgcattgaatttctcatatcatagtgatgcgttctataaaaaaaaagtgcacctccaaataccaacaacacacagacatgcttttgcacaatcttgcaaaagtggtttacaactagtagctctattattgataatgcccttatctttgtatccatattctgaggcccattctacttcaaaaattatgtttttttaaatctttcttcaaatattgacctccatcaaaagcacacagtaagattggtaatgaatatgaataaagaaatcttccgatagtaacactaagtatagctatgttttacgctgttttctcaattgtttttgttcctcgaggaaattaacgtatgcaaagctattttgcataaagtttctcgtgtgtgcacaaaatctcgcataggtcctcgaaccacctgaagctaggtgcgatcttgtaaattaatttgaaagttgtgccaactagtgcgacaacttgtctagctgctatgcctttgatcttaactaagaggtaccacgcgggcaatatttgcacaccaacaatatttacaaaaccaatttaacaacttgtatgcatgtagttgaatcagctaaggaatatgttggttctttttactatattcacttttacagtataaataagtgctaattaacatgtttctgaaaaaaatattgtgcaaatcttatagagctgcaatagttactgatggttggtgtcatacattgtcggttcacattaaagtactcgagt

SEQ ID NO: 106278 - DNA, 3261 bp, Oryza sativa
acaccaaccgggactaaagatatctttagtcccggttggtgttaccaaccgggagtgaagatctgcgggggctgacgagggctgacagatttagaaccgggactaagatcatttttagtcccggatggtaacaccaaccgggactaaagatcaaatatacccgctgtagccaccaaccgggactaaagatcatttttagtcccggtttttagtggaaccgagactattgtggatttcgggcgaccgaccaaagacggtttctccaccagtggtattatgtcactcacaaagaaaaaagatgcgcatgagatgaataaatattttatatcaaaaccgttgtgaaatgttatgtgtgtcatagtgaaataaaaaacgacagttccttccataaaaaaaatataggtgcacgataatttatataactacacgtctctaaatacaatatagacgtataaaaaaaatactatctaccaatagtgatcttaaaagataagaaaaaaattatagaattattttctttttcttctcagtcccttccataggtgcatttcttaacaaaataacaaataatagaatgactctatacttctttaacatattttcatgcgtatattttccttttatattgtatacttaattgcttatatataattaagtcttgcaaagttttattgtgcccacgtaatatcataatattgcactttatataaaatatattttatacacgatatgaatttaattaaagtttaaatgcacaaatcatataaaaatattattttggtaacatgaaattttaaaaaataattaaagacatatagaattgcaccgtagcgtttagcacgggcatattactagtactgaagttgcacttttatataccgaaagtcgcacgtctttcaacaaatttatttacagagagctatacaacattttgatagaaaatctaacaaaaatgtttttcctagaatttatatcgaaataaatatagcatgccacttgcacaaatgtaagagcaaaatctgacggatttttccaagaaaatatgtcgaaagaaagatagccgtataagagcaaatataagggtacattatctgacagattctttcacaagaatttttgtcacaagaaatatagcaattctgatttatttaaggtacccattattataatctccaatgaaacgttgccataaaaaactgggtaatcaattctcaaaaaaaaaaaactgggtaatcgtgcttgaaaagaaaagcatcacacgtttccaaaacaacataaaaaaaccctatagcgccattgttacacaggctgcgttctttcttcttctcaacagtgattacggaaaacggagcgatccattagcacatgattaattaagtatctgctattcttttttaaaaaaatggactaatatgatttttttaagtaactttcgtatagaaactttttacagaaaaatgcaccgtttagtagtttgaaaagcgtgctaacggaaaacgaggaggactaccctgaaaagaacgcagccacagtagtgctggtacagctgggccgccgccgcagcaaagctggccccactcccctcccatctccttaaccccaaccttcaggtacgaccaaaaaaagatctcgctttctttcttgtctcacaagccaaaagacccgtctcgcgaacatcgcgccgtccacgtggacagcctcggacaaggtgcaccgctcgatcgtgtccaaggtgtgaacgcgttcgccgcgactgaacaaggaaggaaatgaaacgcagttattacgcagtacgaaactgtcatttgtctgtcttgctgatctccccctgtaaaacatttaattgttaatcgtatccctacccaacattccagagtcaaatctccggggtttaaaagcaaatcggtcaacctatgaggggttaaagtggaaaagctccacggcccacgcagacaaaattctctctctcctctcctgtggttttgtttataattaggcttttctccgggaggccaggaggcacgtcgccctcgtccgccgccgcgtgttcgcaagcgagcaaaccgctcctcctccgccgccgcctccgcgcctcgcctcgtctcctcctcctcctcctccctgctccgtcccacaccacccgtagtaggggccgtggccggatcgcaatgtcggcgtcggggggattgagcttggtgcgccgcgccgttgaggccgcgcgccgcacgccgcggtggcagaagaggctcctcgtcctcaccgccgggtacgtttccgcctctccccctcatgctccgcgcgcccctgatatacacctcacccccgttgatcgatctagttatacgcgtgcgcaaccgtgtccttgcgctggatatggtgcgttgggccgccgtacgtgcgcgcgtccgcgctttggtttgattgccgaactttgataccccgtgtaaatgttttcgtcgcgattttgcgctagttctatcaaggcggctgtataaacatgagagtagttaaagcctttcctccaaaacatgagattagtttaatcggggatgttcttttcaatggattttttttttcggtttaagaattaagtcggtggtgatctgtcaacctgcaacttttcttttgcccctgaagtccgtagcccgacgcttactttacacctagcccaacacttaaacaccgcactacgttgtttattaagatttgggtgaaaaagttgttcagaagttcgatcatttattggtaaaattactcatagatctaacaaatctggttcacgtttatattcataattggttatggtgaaatctaaaaaatattatctatgtcatcttgacacttgaaaaagaatgtgattgtgatgtgaaagtgaaacaacaaattatttgaagtgtgctggaaccatggtgcctacttggccaatcgtctaaatcggattgtattattcttgttcattgacattgtaatattgaaatcaccgcctcacgattctagggagacgagtatgtattgtgtcaccaaaagtccaaaacatgtcctacttgtttatttaacgtcataaataataaataataatatattcgtccaataaaaagtccaatcctgaagatgtatttagacacgcacgttgtcctggtacatcttcagatatattggggttttgtgggacagaggagtgggcatttaagcagattgtattctcacccttttgcttaagagaatgtgctatagctattaatccatgatgctagacatgtt

SEQ ID NO: 106279 - DNA, 1431 bp, Oryza sativa
  unsure (1)..(1431): unsure at all n locations
gggaaaaaaaaggggggggccccggggcccccccccccgggggncccggagcaacccggccgagctcgtaccggccttgcagtacctttgaatagccgtcgccggcgccgttggccgcggcgactttgtcgtcgccggccggtggcatctctagcctcgtgaagtggagaggaaaatacgtagctactccctccatccctaaatataagtgattttagttggatgtgatgtatcctagtactatgaatctggagaggatcatgtctagattggtagtactaggatatatcccatccacctaaaatcctttatattttgagcagaaggagtacaacactaatagactagttcattataaaagtttaagtagataggtaaagatgggtagtttacttactactccctccgtttcatattataatactttctaacattacccacattaatatagatgttaatgaatctagacacacatatgtgggtaatactaaaaagtcttataatatgaaacggatgaaatactatgttccaacattccccttgcaaggatactcaataacctctagctctaataccatattaacatatttataagttatatgtacttattagtccaattcaaaggcttaatacagatccgaaaatgcaggttatgtactgatatatattccctccgtactcgtaaaggaagtcgcttaggacaatgtttaagtcaaatcttgagaatataaatcatgaataactctcgagttgttgagtttgaaaatgtaaaaattatatgaatagatttgtctcgaaaaatattttcataaaagtatacatatatcactttttcaataaatatttttatagaaataagaagtcaaagttatgttttggagaccgtgtcgctgtccaaaatgacttactttacgagtacggagggagtattccgaaaacattaattaagcattaatgtataatcaagaagggtaatgatgctacacgatggtgcaaaaatatattagtttttttcttgtacctttcaagcaatgcttaactatttgatcaaatagttaagcattgcttgtctttgccttagttataagtataagccaattttgatttcagagttactttaaagttttcttcgtcgatttagtcactcagttgtggttttagaaatgctaaaaatgcaaaaggtttacctaaaatgatcatccgtggtaatgatatatttgttgttcctttaaaaaaaacatctttgttgttgaaactttctttctatataattagtatccactaagaaacattaactcatataaagcaacactttctaaccattacattgcaatattagagcaaagatagcagtcgttggataagaagatacataaccactagaataaccatgtcgttattttttaagagaacatgttgttattgtttttt

SEQ ID NO: 106280 - DNA, 1537 bp, Oryza sativa
  unsure (1)..(1537): unsure at all n locations
ggcgcnaggtaagatctacgactaaatatcngccgaattcgagctcggtacccacttattttattggtaacaataataagcacacatatttattgtgttgtatgcatttttttctacaacattgatacagttcgatctaaaagtttaagtagataggtaaagatgagcagtttacttatattccaacaacattccccttgcgcggattaatcaataacctctatctctgataccatattaacatattaacagcaatatcagttgggacatatttgcaaatgaaaaataatttattaataaaaatattacgtgtttttagcgatctaaaaacaaaggctaaaaaataaacttcgatgaaaaacctctaaatcaacttcaaatttaaagttgaaaatttaaatttttattaataagtataagcataaaaaaaaagatgaggttacttatcatttcaattcaaaagcttaataccgatccgaaaatacaggttatgtactgatatatattccgacaaacagtaattaagcattgctgccctataatcaagaagggtaatgatgctacacgatggtgcaaaaatatattactagtgttttttttttcttggtacctttcaagcaatacttattaataactacttgagcttgcttgtctttgccttagttataagtagcagccaattttgatttcagaagttactttaaagctgttttggtcgatttagtcactcaattgtgggttttgaaatgctaaaaatgcaaaaaggttacctaaaatgatcatccgttgcaatgatatctttgtttctatataattgatatccactaaggaacattaactcatataaagcaaacactttctaaccattagtttccaatattagagtaaagatagcagtcgttggataagaagatacatagccactagaatacccatgtcgttattttttaagagaacatgttgttattgtttttcattcattcctaagaattttcacatatcagctctaaatatataaaaaatatttatccacaattaatatttcagcttgattttttcttctcaaattctcacctcaagtgtaggcttttatctagttaaacaaaaatacctctcaaacatatataataataatgtgcacgaaaatggatttgtgtgtgtgtttcatttttccctttcggataaataattgaatagagaaacaaggtgctcaggccctggtttttctctggattttcttgtgaaagtcatgtgatgtcccgttggattggttgatttgatatgcaccagctggtacattgagatttcaaggcatggaagccacaacttgcaactgctgctaccctgcactaaattatcagtttgcctttttaatcataaaattaggaaattgattttgttgccatatctatagattgattggacttcttctaacgtgatatagaaatactttgtaataatggactgcggttttgttatctcagatgcagcaactagtttattcattatgtaaaaaaaaatcattttctgaatttca

SEQ ID NO: 106281 - DNA, 715 bp, Oryza sativa
tattatcattttaaacgaaaaccaaggttgaaccccgcctttgggttttttcaaaaaatttcgcgggaaagtaaccaaatcgcgccatttggcctcgctttttcaaaatgtcccccgggttgttcaattattcttcaaggcaaggaagccaccccccccagggttgtcctaacctacccgaaaaaaccatttccccattttaatccaaaggtaccaaaagttaagttgcccccaattggaattttggatagccatagttcaaccatataataaaaacctttgcaataatgaggtcctgctaatgttaaatcgcattcactaaacaagtctattcattctgcaaaaaattaactatatccataatgccatcattttaaacttttaatctgtatagcctagccttctttgtgatcaatcatcccgcgtctactcataatacatattttaaataataatgtctactatcaacaatattgggtctttcaaatctgaagcgtgtacccatccattattaaagtaaagttttatactctattaatcgccttaagacaaccagaatcatcgcacccaacttggttgtcaacttcttatgaacttatacagattgatcaggtccattccagtgttctaatgccctatgtatggtcatttgaagtatatactctcttattcttagtttattcagcgcatcatttagcgtgtcctgcccggcacc

SEQ ID NO: 106282 - DNA, 719 bp, Oryza sativa
  unsure (1)..(719): unsure at all n locations
aacacactaaacactttcattcaagcacatgatatctcaacatagggaattctaagttctaagttttagttaagtttatacaacttataacttagataagtatggccgattggccgaatagttaggttcgcggaagcatcttctacccaaaagatctttcctgcaaccgactagggtagaccctagtaagaaccatcctggaagaaagaaacatccccatcgaaatagagtgatctcacctgcaaccaattctaaacatgcaacaatacaacaatacacgcaagagtcagtacataaattgtactggcaagcaccaagcaagcctaatactctacatgcatggcgtattcaaagtaaagcttacatgggataattttagcataaagcaaatttagtttgcaaagaacatttcaaattcagatttattttcaattaaatttcagcaagcatacacttagcaaatgggcatcaaaatagatgttaaacacatataacatagctccttattgccttccatggcagcaaggatataatccataaatcacatcacattttgaagttcaaattcagctttagaagaaaaaaacacatgtctatactcatgacatattcacacgccgctcatgacagcgagcacggctaatcgattaggtttaactctgcagagtacgtacactttacccacatgatgcngaattataatcatgcaaaaagcatgc

SEQ ID NO: 106283 - DNA, 1481 bp, Oryza sativa
atggggctcattggattgcgacagcgtcgaggacttctctcgccggcgccggagatggcacctccgttcccgtcgaatccgaggcggggttcctcggttcttccgcgaaacgagacaagggcgagagagagaaggttggtcggccgatcggcttatatgcggtcgccggtggaggaggagaggaggagctcacacgcgtggcgcgcgggttctgagccgtgggcccgaatgtgaggctgacaatgggatcccacattgcagccctggcccacatggcagcgactagtgatagataaggagaggagattatataatattgatctgatactggtttctcccattgatttaagaataaaatatctatgtttgacaaggtgaagtactggccaacaccataaaaccaccactaatgacgaaaagctttggaaaattaagtgcatgacaggcaaacttagacgctaattaacctgtgaatttgccagtaaatattaaaaattttcgcacaaactacatcagttccattttatttttctattttgtctgcataagtataattcgtagttgacgttcaggtcggatatataagaatatttttgttttcttaatacgatatatttttatataatagaactgtaataatttattgctacggttattacatatgatttacaaaacatagtaaataatatgcaatattatttaaaaatagatttttattataagtagggaggtctgatgaataatttggttatgctttactgattaagactctagtatcatgaaattcagaaaatgattttttttttacataatgaataaactagttgctgcatctgagataacaaaaccgcagtcaattattacaatgtatttctatatcactttagaagaagtccagtcaatctatagatattgcaacaaaatcaatttcctaattttatgattaaaaaggcaaactaataatttagtgcaggatagcagcagttgcaagttgtggcttccatgccttcaaatctcaatggaccagctggtgtatatcaaatcaaccaatccaacgggacatcacatgactttcacaagaaaaaccagaaaaaccagggcctgagcaccttgtttctctattcaattttttatccaaaagggaaaaatgaaacacacacacaaatccagtttcctgcacattattatcatatatgtttgagaggtatttttgtttaactacataaaagcccacacactttgcggtgagattttgagaagaaaatcaagctaaaatatattaattgtggataaatatttttaatatatttagagctgatatgtgaaaattcttaggaatgaattgaacaaaaaacaataacaacatgttctcttaaaaaataacgacatggttattctagtggttatgtatcttcttatccaacgactgctatctttgctctaatattgcaatgtaatggttagaaagtgttgctttatat

SEQ ID NO: 106284 - DNA, 2084 bp, Oryza sativa
taagacattattagttaaaccattcactattttatttcattagaaaactattttttcgccccttgacaaaattgaaaaagctatacatactaacttttttttttactaaattcttactaacaataatgtgtcatgctataagtgtatctaattttttttatgatttttatctatataaatcaaacggttgagatgattattagtaaaatttagtaaggaaattttaatacgtgtagccgtgctcgataaaaaaatgtaaccactcttaacaccccgccccccggccctgcccgcgcgcgcatttaaacacaataatcctttcttacacacatgtaaagggttcaagtacgttgatctttttctagattaggcgtgaaataaattcacaaagtttgaaatatataaaattatcaaactagatttaaaaataaaagcatctgcattaacagaattacataaaaataaaccttgcattacataccattgcaatgtcaaataaccttagcaatttatattatttagataattaattattataaaggtctagagggctaaacaattctagcaaatttcttaatgttgtttattttgttttcatattgatgtgataagattttgaggtttaacaaaatgtcttatcaaaaaatgtttttcaatgcatggaaattaaaaagagactacttcctctatcctaaaaaacttcattgattttacctatgcatctgaacaattacttggccaaattcattggcagaaataataaaggtgggtttttggaccaaagttgcatcttgataagtacttggccaaatttggggttagaaataaagtcattttcttggacggagatatataagaatgtctgcctataatttgtatgtgctaatttcaagttaaaaagatacatggaggaattttcaactagtgatgcatctacgatctagtatatgggtggtccaacccaatttttttttctaatcacagtaaatctaactatcctaatatatacaacgcatgtataaatgatagaagagtaaattccctgtgtacccctgaaaactcactcgatccctttcatgcctctgaaatttacccgatcccttctatacccctaaaatttcaacttgatccctttcatgcccctaccggtacatttcccttcgtttcactattacgtttggttggaaatttctattttgcccttaatgctttaggtttgaatataagcttgaaaaacgattggaatttttgtttgagtgtatgggatgtgcattttatgaaactaatgagactaaataactagtgcagaaaattttgacataaattttgaaaaaaaacaagtggtataaattaaaatttttatttgaaattttagtagacaacggattttttatagtgagcattagtagtcctatcttttagaatgcttttcttttttatgacttttttaaaaaataaatacatattttttattttattatctaaaaataaattttgtgataaataatacatcacacaacaaccccataactataatagtctcatgcgacaaactttcatatttttagtaatttaattaataaatttccatgtttatccaaagggtaaaatagtcatctttatagtaattagacggtcaactgaccgcaggggtatggaagggatcaaattcaaattttggggatatacaaggaagcaaccaaaattcaagggcatagagtggattagcttaaaattcaggtatatacaacggtttttctcataatgaagaatggaccataagtgtaccatgatattttaataaagcatcttaaaacatataaaattagtaatatagctataaaagtttgaataagatcaccatattacttttaattcttatcggatgtacgtcttctaatggccatgaaagtgctcattatatcttcttcatccccatcttgttcttgagtgtgctcgtctaccataaccggggaagaaagcaatttagaagcattcttctttgctacatgttttccaaaaagagatgcaatcaacaatctactatataatactacaatttaatatcacaatgcaaccagagt

SEQ ID NO: 106285 - DNA, 1077 bp, Oryza sativa
acagaagcataacctagacgtaacttattcaatatagaagcaaaaagtgtagcagcaacagcgagggtggaaactagaaagaaggatttatgatgttctgtttattcagtcacgaaagagtgactttaaaaaaatgtacacatcttccacactatgagatgtcttacttatggaatgctcctacacgttgaggttgttcttgctgacaccctcgtttctatgagaagtttattctaacatagcaagtcgatagtttactgcaaacaaaatggataataaacttgatgtttcaacaaaactagaggaactcacgcatgatgtacccaaagaaaaccggttcttgacacactacaaatatgtggtagttcttttccatctcgaaaacgaatagggctgtgtttggaatcaactgttcccaacatgcaaagtgcgcacagaaaacggagcggttcattagagcttgattagttaagtattagctttttttacaaaaaatggattaatatgatttttttaagcaacttttgtatagaaactttttgcaaaaaaacacaccgtttagcagtttgaaaagcgtgcacgcggaatacgatggagatgggttgggaaccctggattccgaacacagcccaagtctatccaaaatgtttagacaagaaaacacgtaacaagttggtttacaagaatacgaattgcgtcaatcctgcactacaagtagagcaacatgttgatttctcgtaaatctctcgaatggtgatttaagaattcagtgcaaacctaattcttgctagaaaattgaatgttcggtaccgcatcaacggaacaataaaaagcacttggcgtaccataattttgtcattcttgttgaaattttataatataaaatgcatgaggccacacgactttaatgttcaacgtgtcatgcattagtgaaactagaatataccccgcgtgttgctgcggcacttttagttgtcactggagatgtcggcttatttaaaacaatggataaaaattatatgtgcagtatttacttgaaaaatacagtactcatagtgaaagttgggtcggctgctg

SEQ ID NO: 106286 - DNA, 749 bp, Oryza sativa
taaagtactgattgctatatttttatttttatcaagatatttacatcatcattttttggccatgcggtgtctacatactataaggttttaagccaacaaatgagatatattctgattttctctttggcagagtttgtttggaaaattttgccaaatgtttatatggatgcatttcctttgtctttaggtgcacatgtgcacatgtgctgtttgcttgcttttgtccaaaatatgatttggacttactggagtttgaattatcaattatgttaattggccacatacctatccatgtgcatgagtgcatcgctgttcctagcttttctttttcctgagtggatgctgcttctagctaggtgaattgttcacattcacacatcggcccagggcatgtgttggcccaacttgagattaggctttgccacacccctaagcccaaccttcattggacctgtaccttgcttcaaaggcttgaaaagtagcctcatcctgctagaccaagcttatagggaacagatagacacatctacacacacaaactgaccctggtaatccattaattgactccacatctaccttcatggctacaacatctgtctttcctttcatctgcatgtgcattttgtttctcaattagtttacgaagacagacatttttttccacccatcacttgtgtatctgcaatatttgctttcacttttgaaacattgtaatcacgctactttgtttctgccaaatagttaatcat

SEQ ID NO: 106287 - DNA, 670 bp, Oryza sativa
cggagcagattaagctggctgtttttcaccaattgggactcgctatccgatgggtttatattggataatattgccctcctatattagcatcaactgattgccttcaaaacaaaatatgcattggacatatagccgattgctcaaaaccctatcgacatcgcctggtatagccatcgggtggaatacaccatgggcttgataacagaccagctcatagagctgctatccgcatagctcagcaaaggcaggatcaaactgagatgggacgcccacatggtaccaaactttggacctgcactggagctaaacagatcttccaggccagagtgcgtttacgcgtcacaggttgttaacgattataaggggtttatcgagtatttcacttactatctagatgctatagagactagggtctctttctgagagtcttattaagtttattgctaaaccattggatatacataagacaagtggacctgttcgagcacgatatcagctataagtttttgaccccaaaaggtacttgttgcataactcttaagggtacccgagttttccttttttacggcgtgtctaagcgggtccaggggatataacactgcatattctttcatccagcccttcgggactgtttgtaagggccgaactattttaaaaggcctggctttcg

SEQ ID NO: 106288 - DNA, 1401 bp, Oryza sativa
  unsure (1)..(1401): unsure at all n locations
tgcatattagtttcaattgaaagccatcttgttgtccatccttcctgacaagatgtagtgtacaaggcattctttagttgagcctcgctcactttgtatcatagaagcataacctagacgtaactaatttagtatagaagcaaaaagtgtagcagaaacaacgagggtggaaactagaaagaaggatttatgatgtttcttagtttattcagtcatgaaagagtgactttaaaaaaactagtaatcatgcacgtgcaaggcacgtttttcatattacatatggcatcaacgtaatattttgctgtcgcaatatgtatataagacgatttatttcaatgtggtgataaaataaataaaccaagcttcatgttaatccccattcaagctaaaaaatgcaaaaaaaaaaagagagctcattgttgcatacgatcggaatacaatagcgcatgaaatctatgttggtaaaaaaataaatcactgaaacagagaaggaattaaagtttttatatagtcaagtcaaatttgaaagagagtaatgggttttgaaactaataagaatgtattattataaaaatgttgttattccatatatttccaaattgaagttggatcatccattaagatttctttgagttgattatatactacgggccctcagatcgaaaaaaaaactcttctcgaagttgaactccatttaacatacatggaacttccttagtattttgcgaacatcaatttcaaatattcattaataagaaacatacgtagtatttttctgatttttcaagtttacgacttattgtttaactgtcattcatttgttttgaaaaaaaaagcaattttcaattgatatagcacagccgcacaccccttctgagatgagttctgattagcatctcctgataacatggcatctcttctttacaagcatacaaaaggacatacatcagaactatttatgttaacaccaaataaatggcagagaaataactaattttgatttaattagattaagacagtcacaatatccagcttgcgcttgttgccggcgttgttgattgactgcttgctcatgctgaagtagcctatgaagatctgcacccaatgtccctacatcaggagcagactttcttgtgttaagttcatgagagcttgccaggcttgtgttaagttcatggcatctnctgaagtttatgcattcatcatctagctttatctcacattagatggagcaagctggggtcttccgatagcatcataagttggtgacccttcgcaccgtcgctgctatggaaccatgaagaagtgtctgtgtcacctattcatattggaactataattttggtataaagggtttttaaagttttttcccccagaggggaattattttttttttttttt

SEQ ID NO: 106289 - DNA, 682 bp, Oryza sativa
  unsure (1)..(682): unsure at all n locations
ttacactcagatttatgagtgatcagcancaaatatgtatacttatgattctgatgtatcagagatttcttgagagattgctccatcactcttttattatggcaaatatattctcacccttctctggacgnctccaataattgaagaataacatgcaccattgttatacatgtccattaattccctttaattttctccctattatctatgagaatctaccatgatttttggcatcaatgtgatctgtctgaataaggggcccttttaagatcatatgccaccaagccactattgagttcatcaatgaatataaatatttacataattattgcagttttatccaattagagtagataatttgtgccacaacttaactgagctatatacttaagacacctttggacatctacccttaacattgcaaagccccaaggtgacttgacaattccttccaaacaattgactgaataaacatctgaatatcagagacatgaagcaggaaataagagatttaacaagttgttatatcgttattgaattgttgataagtaccttgacaatctgacccctgcaaatatacaatagattcaaaagaattgcagagtgagaatctttctttgcaatagacatttgtgttattgtatatttttattccatgttatagcataagctggcagaaatt

SEQ ID NO: 106290 - DNA, 1582 bp, Oryza sativa
attgatttacataaaaaaacagagcgattgattgaatgatcatgaaacatacagattcttgactattaggctaattttttccttcactagaaaagcgacttagaatccattcttcaacaattgttggaaaattctattgtgcaccagccatatgttccaccacatcatcaacaaaggtatggaattacagagctcactccaccaatctgtgatggtttgcatggcttgctgttctggggcttggaagttcatccaattgcacactttatcctaactatttctacatttatattgtaaactatatctttagaaatgtgctatttgacttaacatgtcaatgtaggccatgtgatatttcattttaggttgtctggcactggcagcagccgacccaactttcactatgagtactgtatttttcaagtaaatactgcacatataatttttatccattgttttaaataagccgacatctccagtgacaactaaaagtgccgcagcaacacgcggggtatattctagtttcactaatgcatgacacgttgaacattaaagtcgtgtggcctcatgcattttatattataaaatttcaacaagaatgacaaaattatggtacgccaagtgctttttattgttccgttgatacggtaccgaacattcaattttatagcaagaattaggtttgcactgaattcttaaatcaccattcgagagatttacaagaaatcaccattttgctctacttgtagtgcaggattgacgtaattcgtattcttgtaaactaacttgttacgtgttttcttgtctaaactttttggatagacttggactgtgttcggaatccagggtacccaacccatctccattatattccacgcgcacgcttttcaaactgctaaacggtgtgtttttttgcaaaaagtttctatacaaaagttgcttaaaaaatcatattaatccattttttgaaaaaaaaaagctaatacttaactaatcaagctctaatggaccgctccgttttccatgcgcactttgcatgttgggaacagctgattccaaacacagccttgattcgttttcgagatagaaaagaactaccacagatttgtagtgtgtcaagaaccggtttcctttgggtacatcatgcgtgagttcctctagttttgttgaaacatcatgtttattatccattttgtttgcagtaaactatcgacttgctatgttagaatgaacttctcatagaatagctagtcccaagaaagggactagctagtgtgctgtcgacagttttttaggtccagaactgtcaaatttttcaaccataggatttgtcatcaacgattacaggaaaacagtctgcactagtacaaaccacgagtcttagtgcccaaattgataataactttcaattcaaaagtaatatgcatatatatgtccctgaaaaaaattacaaatcctaattttataccatgtaattaccctgtaactactctagttggtgtaagtgctttgcacttactagagctttgtactagagtattaggggtttgtacctaaggtgtaagtgatatattacttcaaa

SEQ ID NO: 106291 - DNA, 729 bp, Oryza sativa
tatttgacaacctctgcctcagtacacattgttaaccattcgacaacctctcgctgggagggctataaaataacatgaaatggtgtcagcacagacttttgagacaatgtgaataattgactatcgacatggacagcacacatttgtaagtaacataactctctttagctaatcgaatcaaatattgcatgaaacattgggtacacgcaggatgtcgccaaatacttacacagtacgaagttatctacagactacagcttggctatagcacccctgtacaggggaactgtatcacttgcaaagatgagaatggctattcgtcatcacctgaatggctgattcttgccataacaatcctacatcatacacaaagagtatgttcagcagaggataatccaaacaggcatcaagatctgatgggttatgttcacttttctgatgatatgacagagttcatgacgcctaatacacacaattgataggacaggcgttctcagtgaagatcgtgatttttgtctttctatggctaagagaagcagccgcacttaaacgttcaaagtgccgtagcagggcagatgcaccaaagcatactcttgttaacctgggtgagagagacagtgggtcctatacacccacaatggtttgcaaggcacttataacacatctacatttcggttaggccgtcgaattcaccaggcacaatcagtgtccacaaatttgattgttctt

SEQ ID NO: 106292 - DNA, 728 bp, Oryza sativa
ataaagagaaaagcagcggactatagacttatagacagctgcagtatggattccaagatacctgtgtgtatatgataggtggaatcaggtattaattttataatatatatttatagataactattgtataaattagctattaaattaactatagataatttagagtgctatattattaaactacttgctcttagtaaacttaactgttaggccgagtttagttccaaaatttttcttaaaactttcaacttttctatcacaccaaaacttttctacacatgaattttcaacttttttccgtcacattattctagttttaactaaactttcaattttaacgtaaactaaacaaacgctagtattttataatggtgcattcctttcacacgaagtacttggagtgttacagtgttgtcgcatcacgctgactcagcacagtactactatgcatgtggctttgggatccccacattgggcaatcgagcatatgccacgctagaacgtggtccaagtgaccatttctgggtgcggtagcaagtacgagtatacgactactcttttcgatcaacgacaaattaagttaattaatatattgtgatatagagttcctgtacatattactctatatccaacaaacaagcagtaatgaacaggcgaaataacgtgatgatcgctatatgctgcatgcacgtctgtatcatctagtactagtaacctacaccccacat

SEQ ID NO: 106293 - DNA, 724 bp, Oryza sativa
attcacgtcccgtttgcataacgggacaaataatgggtgccaccggccgcaaaatcggttgtgcagcagtaaaaggctcaacccaagcgatacaactccagcttcacaggacaactccatcttgaccccacagaactcagtcttgctgatgacagtgcagtgctgtagacgtcagttcttccgcacaatgttccagtttgatttgatcctcctggctttgtaaacctgaccaatataagagggaaacaaccagatgaaacaccccatatcaggagacttgatcttctttatccttcaaaacatattacgggccggcttcctagagggcccaacacatggcggccaatcccgcaatgtgattttttttttccatttggtatataaactatgccctgatcaaaaattgctcgaaagagttgggacgacatttgagctccaaacacataagccattagccatgaggctccaaatatatttggccaactcacagtgaaaaaaaaaaacaggtcgttgacagtctccttttccttgcaaaaggcacaagtttcattaccattccagtttcgtcttacgagattatcttttattaatattgcattgtgtacggctaactaaatttttttttatctttaatggtagtttagctttcaatgcaatttatatgatgtggccatatacagctgtgttgtcacatcctgattttttttcaggatttataaattat

SEQ ID NO: 106294 - DNA, 729 bp, Oryza sativa
ttagggcgacccaaacctagagatgaaaacgatcgatcgataatagactgttctttttatttttacaaaaatagatgaaatcttttatatatatgaatttaactatttaatgtaaacttcaatgtgatgctaatacgatagtagaaaaactaatatttggaaactgtacctgctgatcaagatattattattatactccctcggtttcatattataagtcggtttaacttttttctagtcaaaatactttaagtttgatcaaacctatagaaaaaattagcaacatctattacaccaaactagtttttattaaaactaaagattaatatattctaatagatctttcgtttcatgttaaaaatattgctataattttgtgtaaacttagggtgtgtgcggaatccccctttaccaactgaccattctcttttttcgcacgcacgtttttcaaactgctaaacggtgttgtttttccaaaaggtttctatacgaaagttgcttaaagactcatattgattgatttttgaaaaaaaaaagctaatacttatataatcacgttgtaatggaccgattcgttttctgtgccgagagattagatacaaacttcctagccgatacacagccctagtttaacttcaatttgaccattgaagagtcaaaacgttcgaatacgggggagtattgatttctagaagtggataatatggctggaaacatattcttactgtt

SEQ ID NO: 106295 - DNA, 729 bp, Oryza sativa
caaaggtctgcttatgtagaaccattgtgacaactttatataaaacattcttctcacctagagaaaaggtcacttcctcacagtgttaatttaatgttaaagaggcgtattgcataacaaggagaccattattggtactcataggtgcaacaaggggattgtcttaaaggtctacttcctatataaaaaatcaaactatggataaatctgctaacaggtaaatctgtgtacagattatcgttaaattcaatttggtttgcacacagcggtattgcagtatacttaaagtacgaggcatgtaatgctttttctagctgttcacgataaatatagcacctaccgatattttgatcaagattttaaaaatctgttccatataaaaaacaatagatttagtattaaatttatcacaaagctatataattaaagcaagtaaaaaaactatagatttctaaatataaaattagcacacaactatagattttagagtttaaattccttgtataaccattatgtcgaatctatcagtgttatagaattttgactaaattggtgctaaatttattttttatgataactttattattaaattagtagttttgtgacacgccatcttaaatttgtagttctgtgataaattaaatgctaaatatatagtttgtgataaaccaacttaaatttatagttttaggatgattaagtcaaagtattattttgtatcttgtattg

SEQ ID NO: 106296 - DNA, 1394 bp, Oryza sativa
aagtatcacaaaactattgatttagtaataaaattatcataaaaaacaaatttagcaccaatttaattgcaaaactataacgctcatagtttcaacataatagtagtacaagggatttaaactctaaaatatatagttttgtgctaattttatttttaaatctatacttttttatacttgctttaactatatagttttctgataaatttcatactaaatctatagtttttttatagaacatcttaattctacagttttgtaatatcttgatcaaaatatttgtagttttgctatttttatcatgaacggaccataagaagcattccatgcctgttacttcaagtatctgccatacctctctgcgtaaacaaaatcacgatattcacatgtggtcagatttatccctaatttgattttttacagaggaagtagctttaagagaatctcctgcttgacacctattcagtattcacacgttctcctgtttatgcattccatccctgtcaatcactactaaaaaatcatttttctagcgtaaccctttcgtttttcctgatgggttttatgcaaatacgcttgtgaaaataaatgatagggattccgggtaccaatcgtcagcaaaaatcaattttcgctaacgggtacttaaaagatccgcttgcaaaaatagaggtatttttaaaagcggacctcttaacttaccgctagcgaaaatcatatattttcgctcgtggctgctaatggccacctcccgcaaaacaaaaagaatgaaaaaaaaaaaaaaaaaaaaaacaaaaaaaaaaaaacttcactatattaaaatttcacccccacctttccccgctcccccatttttccatctcctaactccatctcctcgactccttctgctaaccccctttttcaccacgcctctcctcctcaccccggcccggccctctcccccctgtgcctttcctcctcctttcctcgacccccacgcacgcgcctttcctcctcctttcggcaaccaaggcagggacggcgacgacaacgggggacgtcctccttcctcgccaagccaccgccgtggagccgcatcgactggagcgggccagcggatccggcctgccggatggtcgcgggtggcggattcagtcacaggagaggcacatgtagagaagggaagcgtgcacacggtggattcggtagcggcaatggtcgggctcctccctctcagaccaaggggtggacacctccttttttgtggagcaccaacggggagccgtattgaccggtaccgaatggttggggagcttgcggacgacaaaagatctcaacccctgccttttctgtgatgaagggggtgaggcacctaatgaccgtgctcgtaggcaagacaacggaacacaggg

SEQ ID NO: 106297 - DNA, 2009 bp, Oryza sativa
cgccggcgaaaaaaaatttttttcatgaagttcgaaaagggaaaaaattaacaagttataattttaataagggtttttttaccaaaatggtaaaaaaaaggaaaaccatgaaaatttggtaaaaaacaaactttttaccttttcaaatttaataaatggcccaattttaaccttacgagatttatctccatattaaagtgatacattatcagccttagagtatgatgtctctaaaaatgatgtctcaacctcaaggttcaaaaaaccgtcctaaacttctgaagaaattaaatgataacttcatgaggaatacaattcagatccctagtttcgatcggttcatccagtacttgatcctcccattcatccatttgaattcaacttctatatcaaccaaaaagcttagagttgtatctgatttccagagaccaacttacctagtaaaactacacattctggtgaatgaaacccggtggcttcaattgttttacaactgaatgtactcttttgcacctttaatgcattttggacggccttgaaatagaaataagacgaaaaaccgtggttattcgtttggatgcatgagaggggttgctttgggaaatttcaggattcttttggcaatgttggcaaaatttgaagagctaaaaatgatagaagaaggtatttaaatagggaatatatcctatgcacacaagcttcccatgcacaccaactagcaaatgtcacagaaaattctagaagaaaaatggacacatactttgaatagtattacacctatgtatgaaatattatcttcaaattcattatattttagccgtaacaaaaaaagacaaatttctgacaaatttttacccttaaaattgttgttacagctaaaatataatgaatttgaatatgggactttgtagatatgtgtaatactattaggagtaaatgtctaatttttttttgtagaatttttcatgacatttgctagttggtatgcacggagtgtagatggaagcttatgcgcatagcgtatgttcccatttaaataggagtaaattactcacaatccaaaatatggagagtgagtaggatctacaaaaagcttgagggttgtataaaccatttttgcatggctattggacgtgctttcggactttaagaggtgccacatatatagacccttgtttgtacaagcttttggtagacgcaacttttttcaaaatctatagctctcccaagttgtctagattctcaactagattatgagaaattgtacttataccatctaaaaataaactagaagaagaagaagaagatggagaacacatcgttttcatatttagactagctgtctaaaactaaactagaagaagaagaagatggaaaacacatcgtttcatatttagactagctggctatccaccagccgcttattaaaatcttaagctcttctatacaaggccatatgtaacttaggccatgtcaccatgctagcaaagcaagacgtcaggcaacaacattagggatgcgggatctgctcagatttgttcttttggagtcttttcaattgcaaccaatgtatgttattcactctcggatgtctaacattcgaatggaaaattaattaaaattttaatgtgaaaaagccatgtatggccccaaccatcactaactactacagctctctaagatttgaacaatattcttttcaagaaacatattagttagcacttatctagactctaaaagtgaatataatagaaagaacctacatattccttagttgattcaactacatgcatacaagcatagtttaaccaatcagtggacgaaacacaattgaaagcattgctggtgtgcaaatattgcctgcatagtacctctcaattacgatcaaaattatagcaactagacaagtcgtggcactagtttgcacaaatttcaaattaatttacgagatcgaacctagcttcaggtggttcgaggacatatgtgagattatgtgcacgcacaagaag

SEQ ID NO: 106298 - DNA, 902 bp, Oryza sativa
aagttatgttttgaagaccgtgtcgctgtccaaaatgacttctttacgagtacgaagggagtattccgaaacatttaattaagcattaatgtataatcaagaaagggtaatgatgctacacgatggtgcaaaaatatattagtttttttcttgtacctttcaagcaatgcttaactatttgatcaaatagttaagcattgcttgtctttgccttagttataagtataagccaattttgatttcagagttactttaaagttttcttcgtcgatttagtcactcagttgtggttttagaaatgctaaaaatgcaaaaggtttacctaaaatgatcatccgtggtaatgatatatttgttgttcctttaaaaaaaacatctttgttgttgaaactttctttctatataattagtatccactaagaaacattaactcatataaagcaacactttctaaccattacattgcaatattagagcaaagatagcagtcgttggataagaagatacataaccactagaataaccatgtcgttattttttaagagaacatgttgttattgttttttgttcaattcattcctaagaattttcacatatcagctctaaatatattaaaaatatttatccacaattaatatattttagcttgattttcttctcaaaatctcaccgcaaagtgtgtgggcttttatgtagttaaacaaaaatacctctcaaacatatatgataataatgtgcaggaaactggatttgtgtgtgtggttcatttttcccttttggataaaaaattgatagagaaacaagtgctcggccctggttttctgtttttctttgaaagcatgtgatgtccttggattgttgattgattacaccactgtccatgagattgaggcatggagcac

SEQ ID NO: 106299 - DNA, 687 bp, Oryza sativa
  unsure (1)..(687): unsure at all n locations
tcaccaatttttgatcttgccgatatttctatgacacaatggaggttaaatgatttatacatcagtactttataatacagttcagtatcctagtaatttaaatgttgatgttatgtgttttttttacctcgtccttctcttctagcgagatgacgctaaccacagattcaattccctgtggaggccttcctttagttgtttaggaagattaccgttaattatcttcttgaattgttgctgatggagataataaaagcagaacagagcctagttccgcctttctcatccattccaatttcctgataaagtgaacgtacatcagtaccatttgaaggatacgtgcatcagcaaaataatgaaattcttgaaccaataaatattcccaaatcgaaatttgaatcctaatcctcgtccaaaaaaaaagaaaaaagaatcccaacatccggttttgagcaaaaaagcaacagaattttgatctgtttccaatgaaaaccttgttgagcagaaatttggaaaccgatgaaaacgtgagaacaaagatggcaaaccagtttgagtggaaaaccaatcggtgcagttaaatcgacgaaatcaaacaaaaatccagaacatctataggctcaacaaacgtatattacanatcgacgaaaaaagaaagagacccagcgcatgtgcaagccccagaag

SEQ ID NO: 106300 - DNA, 793 bp, Oryza sativa
  unsure (1)..(793): unsure at all n locations
ttattatcaatttatcagtatgttttcataattatatttattggcgtttttatttctttgactagtagtcttcatagaaattttcataggggataagcaatatttggcgtctccaccctacacttgaaattcccaatgtatgcctattgagaaagagaaaatgtctgtacattgcttattgccttatttctcatgttcaagcaatattcccattatatgcttattacccatgtgtacaatgtgaatttcattgtatgcttatagaggtagggaaaatgcttcattcaagcaatatttgtcatctccactctacacttgtcgaaagttccaggcttgattcggagaagacattggaagagcctaagctaattttactgtatgcttttgatggaggtttaatatttgaagaaagattaagataagaatttgtgaagtagaatgggcctcaaaataaattagatacaaagacaagggcattatcaataatagagctaccttttataaaccacttttgcaagattgataaaaatatttctatgtgttgctcgtatttggaggtgcaattttttttgatagaacacatcactataacatgataatttcgatgcacaaaaatggttgagaagacaaataataggatggataatattcttcacaataacatgagaaatggaaatttagagtctgtgatttgtcatacttatctaaaggaaacttccagtnngattagacatcaatttaccatgattgatttgtcccaacctaaatattatcaattatcaatatgtttgtg

SEQ ID NO: 106301 - DNA, 823 bp, Oryza sativa
ggaggtttaatatttgaagaaagattaagataagaatttgtgaagtagaatgggcctcaaaataaattagatacaaagacaagggcattatcaataatagagctaccttttataaaccacttttgcaagattgataaaaatatttctatgtgttgctcgtatttggaggtgcaatttttttgatagaacacatcactataacatgataatttcgatgcacaaaaatggttgagaagacaaataataggatggataatatcctccacaataacatgagaatggaaattttagagtctgtgatttgtcatacttatctaaaggaaaactcccagtaggattaagacatcaatttaccatgattgatttgtaccaaacctaaatattatcaatttatcagtatgtttgcttaattatctttatgggtgtttttatttctttggcgagtagccttcatagcaattctcataggggatatgcaatatttgacgtctccaccctacacttcccattgtatgcctattgaggaagggtaaatgtccgtacatagattattgtattatttgtcatgttcaagaaatattcccattgtgtgcttattccccatgtttacaatgtgaatttcattgtatgcttatcgatgtagggaaaatgcttcattgaagcaatatttgtggtctccaccctacacttttaaaaagtccacggttgattcaaaccaaatttcgaaagagctaaccttattggcatgggggagaagtattatattggtgcctatggttcttctggcacttgacaccccttcataaccctataaatattaccg

SEQ ID NO: 106302 - DNA, 724 bp, Oryza sativa
agtccactagatagccttggttgaacaagtcttggtagcccaactttttcaaaatcaatagctctcccaagttgtctagattctcaattagattatgaaaaattgtacttatcccttctaaaaataacctagaaaaagaagaggaagatgcagaccacatcgtttttcatatttagacaagctgtctaaaactgacctacaagaagaagaagatgaaaaccacatcgtttcatatttagactagcgggctatccaccagccgcttattaaaatcttaagctcttctatacaaggccatatgtatcttaggccatgtcaccatgctaccaaagcaagacggtcaggcaacaacattagggatgcgggatctgctcagatttgttcttttggagtcttttcaattgcaaccaatgtatgttattcactctcgaatgtctagcattcgaatggaaaattaattaaaattttaatgtgaaaaagccatgtatggccccaaccatcactaactactacagctctctaagatttgaacaatattcttttcaagaaacatattagttagcacttatctagactctaaaagtgaatataatagaaagaacctacatattccttagttgattcaactacatgcatacaagcatagtttaaccaatcagtggacgaaacacaattgaaagcattgctggtgtgcaaatattgcctgcatagtacctctcaatta

SEQ ID NO: 106303 - DNA, 746 bp, Oryza sativa
  unsure (1)..(746): unsure at all n locations
acgcccagataagaacccgctgcactataggccgaattcgagctcggtacccggacaacaagatggctttcaattgaaattaatatgcatatatgaaagtcattaatataccaatgtttaaaactttggaatcatatcttgatgtcgcttgaaacaacatatttgcatgaagtgacacgtttggtcgacaagggcatgtcatattcacaatgatcatgcatatgcggcctttcatatgcgcttattttagtagtggatgaagaatcaatgtggattgctacatctttacgtgctttgtatgttcttcgattttgttggagtggatttagtatttgccatatgtgcttcgtgtttgttcttattggaattaaaggatggacatcctttatacgctccatttatatcttaaagacaaagtagcttcggatcgaatataagcacacagtaaaattgtagagtaccaacgatggtaattagttacgacgatgtactaggatatatcaccccgagtttcacatgtcaaatatgatgatatctgagcctattttaacttccaaccactatattgtaaaactcagtacaataaccgccaagggtggtaatgctactaggtgcactatagtacctaaggtagataccatatctagatggcagttcaaagcccacagagcttgggctggagcttgagccagattccgatcaaagtagagatcatcaaacttgctgagtngtagctgctgcgctat

SEQ ID NO: 106304 - DNA, 677 bp, Oryza sativa
ttgtattaatttcctgtggacatgatcatctcgtggagtcgaagctaattgtcagatgggcttcttggaaatttcatcccatgcatggatggagatttgcaatagaatactctcaaactaattactcgtgctaaaatcgaaagagcacttgtgccaagggctttgcataattgcattttgggaatttcaattaattaaggatatatccagtgacaagctaaatattaaaaactcgtgaaagtcatacctaaaagtttcgtaaattcataaaaaaaatactagtgataggtgtagatatgaaatgcattttcaccaaatctcaaattcaaacttaatttcatttatgagtaacaaagaagaaaaaaaaggtgaatggtaacaagacactgttcatctgaaatttgtctttctttttctcttaaatgaagttgagtttagagttaaagattttgtgagaatgtattttatatctacacctatctctaatatttttttcatgattttaagaaacttttaggtatgattttcacgagtttctatcacttaactcgttttcaccggatatgtccccatttcaatttagctgtgatatattttctccatttctggtaagccatttattttgtccatttttccttcaatagtttatttctgccacagggtttatctcactgacc

SEQ ID NO: 106305 - DNA, 704 bp, Oryza sativa
ctgtccctttgtttgttcagtacgctattattctcttgggtactagaccttgtataaaccggttgtgaaatcctcaatcaaataaaagttaactcgaaatttgtggcctgttccaagtgtttggcaaaccaatatgtatattatccacccgattatctaatggcaatacagtgcctaaaattcctgcttccggagtcttaaactttacccgaatccaatctggaaaccgaaaagacagctgcttggctgatggcaagtcactgggtacattgatttgtgttaattttcagtccaataaaacagcgcaaaaattgtaagggtgatccctctttagtaaagccatgcattctgcaaactctgttgcaatgcaagctgtatcctatatccagtgccgatgaaccaattctggttgcaaactgtaccctatctttactttacaagccaaccaaaggaaagtggttgatctgcagcggaatactagcacgtattccaccatttcagggttgggagggtgaatgatatgcaagaaattgacattgtgcacaacatttgccgtcatgctggcgctgccggcgccggtgtgtcggtgagaaagccccgcggatggtggttgagcccgccggcaagaatggctgcaacaagaagggccggtgggcattggcggataaccggtgggctatggcggtggcaacctgtttacggca

SEQ ID NO: 106306 - DNA, 692 bp, Oryza sativa
aaaaactagtacctctactgatcatgagcccaatgtacaaaacatctcggcctcttcaataaaacaaaactccattgatcattatttccttacctcattcccactataagcacacgctttaaggcaggagagcgactctgatgccgcctcatataatctccatccgagaatgtaagaaaactatagcaccccgatggttgagattaaaatagtgcggccgtgtctttacccttacaacgggaagtaatacgtggaaagaaactaatggtttctcatgtggtttaggttaaaactcgcaagctgccaacgcttcttctcctcctgatcttattattttctatttgttgccttaatcttgccgccttagttaatatccattgtagaacgctgggaaattacagcaaactgatggttgagactgaaacggtgtggccgtgtctttacttttacagcgggaaggaatacgcagggagaaactgttggtttcgcatgtgatttaggttaaacattgctaaccgccaacacttctactccaccatgatcttattatatttttcttgtaacgttagattcccggccggtgaggatgggtaagtagggctaaaccattattacttttgtacttccataaaatctcattggcaaacatgttgtgttcgattagttattatttactaggttatgtagtggtt

SEQ ID NO: 106307 - DNA, 666 bp, Oryza sativa
ggaaagttacctcacagcccagccgttgaaggcctggtttgtggtaggaagataagttcttccagggcatcccgcgaagcggtctcatactgcgcagggtgcgacaagcaaaaccatgcaaccacagcccaccatgtggttcgttttatttatccaccacagagcggtggtattaactcatcatcaccattagagctaacagtctccgcactaatatgattttccccagtgtgatagagttgacctaagcaagggtaagcaattcctagtcctaactctagtcatgttagaacccaagctaacaaaggagcatggtatccaaaaagcatggctgtaactataggtaaccatgccatagtgatattatagtaacaatgcaatatttgaaaggaaccaattgagcatttgcaatataggatcaacatgttcaagtgacaagcatgacgtgccttgctatcctgatgggggaacgtcggcgagtatctgtaatgtacgccggagcgtcggagggatgcggaatatagcggcaagcaaagcaaacattgcaaacaggctaagagaagcttggttcagaaagctcgtcagtttttaatgcattccacacatttttcttgattaactgacacttgagtgcccgccacaagattggtaaaggatgcatcggta

SEQ ID NO: 106308 - DNA, 2216 bp, Oryza sativa
  unsure (1)..(2216): unsure at all n locations
ttgccaacaatagattttcagaaatataaacagtatcgagtctagaacgcaagatgatcagttgcagaaaatgatactgaagacagcataggcttgtcttagaatagttcaaggggttttgctgagatagccttcaaattagatgaaatagcaaatatttgagttactagtaggaatagtaactcaaatatttgctatcttccctgggaagcttaacagtttctgttgtacatatattttagaccttcacagtcggaaagataatcttctctcgaactagattactccaaagccgagtgcttcaatcatcctcgccatgatctcccgagtacttttaccaaatatgaagactgtggagggctgaaaaataaagtcaggtgcatcgagtagatgtacctaatagatgcaccaactgagtggttttgataatcgtagtcaaacaagtgacttaatattaatatatagcatatgcggtgtgaatccctgaataacatgatccgagtgatataccgactgctttgtaaaatatgatgcgtgcaacctaaagctgactacatcattgaaaattcacatagcaaaatagctataaagaagcttgtatgttgtgaaataaagaaatttccaaagtattgggcatacgccatgcgcacactgctttaacagatgtgcttaagtccctagaagacacatggtcccaccacacctgaaaatatatggcatatgtggtataaaatccgagtaaataaactcataaagaattcaccaaccgcttgaaaaatgaccacaatatataatcagcctaagccataatattggtcaataaaaatgcacacttacgtggcaaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttgagtaactgcggtataaaaggattttaaggtattgggcacttgattacgcgcactttggcctaagcgaaaagtgcctaagtccctaaaagaacgtgacaggccacacctgaaaatatgggctgcagacatattaggcctaggccaaaaaatatgccttcgacaccatttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaataactgacgcagtcggcatggagatgaaatgaccaacatgaagacgaaattgctcatcagaagtaacggaagatgtcagtggtagtaaagatgccaccaatcaaatgtaatgaaagagcataaccatggaggagaagaaaccaggcggtaacagtcacggccagtagaagagaagaagtatgcgcccaacaacaaccaaagaacaagcggcggtgacaaaagcaaaccaacgatgaagacgtagacgcgcatcaacggtgatggcgaaatcccccattatgaagatgaagaaaatagtcggcaatggcaaacgcatccgacggtaatgatgattagcggcaacagagatagccggctatgatgacgaagttgttttataacgtcgagcatagtagactatgttgtgagcctagtcagtatctttgatgaacatacccatgtcgttggtgaggtaatagtaggaggcagtcncagatagccatcagatcagttgcgacgcgtgaatgagtagtggcgcctgatacggtatattctcattcggcatttgtagggtgttacgcccagagtatggtgcgctcagagtgcagtcacctcttagcccggatagttaagccaggcccgataaagtaaaagagccggtgataagaccactgtccgccagcattgaatacaatttggaataatgtatgctagcatgcgttatgatcgattagat

SEQ ID NO: 106309 - DNA, 671 bp, Oryza sativa
cagactaattagatcagcatcaaattttttcatttgatatagttcactccataaagaagtccactagggcgagaagatataatttgcagtagtttatcccttgatccggtttgatcactccgtaaaaaagaaaaatacctgtagcctttaaatgcgatgaaacaatgtaattttctggtgtcatagaattaataactgatatacttgaccaaacaagttccaattctgttatttcatctacatggtttagaaacaaacttaataaaactctcaaaaaaaagctactaatcactgataccccccaagctagtagctgaactactaataaaacactttataatcgttaacaacttgttgacccgaaaaacacacaattgccctgggagacttgttagctccagtgcaggtccaaagtttggtgagaggtgtgcgtcccaacaatttgatccttgcacttgccagatttccaattagaaattcaatgggccgatcagttgacaggccattggggtatttcaggccgtgccgaaccccaccgttgcaataggggttcgggcaattcggctttttgcccaaggatattaaggtattgaaggcaatcacttggcgtattttattttggcatttaatcccattgaacccatcggttggaagtccaaatttggtcaaac

SEQ ID NO: 106310 - DNA, 1034 bp, Oryza sativa
  unsure (1)..(1034): unsure at all n locations
agagccaattaatatccataaagaaatttttcttccactgttttacagggcaattatgttctcccccagcgtcacaagttaaaaacgtaggagtccagcacagcagtaccttttctgcaatgccagagagatgtctccggttcctccttccctgaggcttaggagtaggagtagtagttattttttcgtttcgacttgtttaacattatcgttaacaccatcaagtgtcaatgccagtagcctgctgtatctgatcatttcttccatccctcttctaacgccattatcgttttatctcaccttgcatttatgttcaagtgaccatggttcttgacagaagcagcccttgttctttcctgtccctttgtttgttcagtacgctattattctcttgggtactagaccttgtataaaccggttgtgaaatcctcaatcaaataaaagttaactcgaaatttgtggcctgttccaagtgtttggcaaaccaatatgtatattatccacccgattatctaatggcaatacagtgcctaaaattcctgcttccggagtcttaaactttacccgaatccaatctggaaaccgaaaagacagctgcttggctgatggcaagtcactgggtacattgatttgtgttaattttcagtccaataaaacagcgcaaaaattgtaagggtgatccctctttagtaaagccatgcattctgcaaactctgttgcaatgcaagctgtatcctatatccagtgccgatgaaccaattctgtttgcagactgtaccctatctctactctacaagccaaccaaaggaaagtgtttgatctgcagtggaatactagcaggtattccaccatttcagggttgggagtgtgattgatatgcaggagaatgacattgtgcaaaacattggccgtcaggctgccgctgccgtcgccggtggtgtccgtgagaaaagcccgtggtggtgtntggcccgcggcnaagagttgcttcaacaagatgggcttgtgtgcatgggcggatcaccgggtggcta

SEQ ID NO: 106311 - DNA, 697 bp, Oryza sativa
cgcatcaagattggtgaaatcttcgatcacccttggctccaacaagatgggagttcatcatcattcggtatgatccaagctgcgtcctctcattctaaaccagaggtagagaaatgggaggctgaattggagcaagcaatggagctaaatgctttcgacataatcgggttcgcctcgggatgcgatctaagcgggttgatcggtccattgccagatcgagttcgattcgtcgtgccgggtggggattccaagtcagttctggacaaagttgagaagctagggcgagaggaagggcttgttgtgaggaggaaagaggaagaatggcgtggaggagttcatgtgaaggcaacaagtgggaaattcactgcatatgtgaaggttagtttattggccaaaaagatgctgatgatagaggctgaaaagtatatcggaaacgagatttctaaattttggcatcaacttcagatcgggtaattattcgtcagaaaatgagtatatgatgaacatgtttttatgcacgagatcgtcaatatatagaaaaaaatagtttagagtaatactccctccagattaaaaatactttggcgtttggatataacaacacgatcctcaaaaactaaattttacactatttttctatacaatagagatcatacaatattatagaagactaataatatatgatttataaaatacc

SEQ ID NO: 106312 - DNA, 664 bp, Oryza sativa
agaatacaatctgcttaaatgcccactcctctgtcccacaaaaccccaatatatctgaagatgtaccaggacaacgtgcgtgcctaaatacatcttcaggattggactttttattggacgaatatattattatttattatttatgacgttaaataaacaagtaggacatgttttggacttttggtgacacaatacatacttgtgtccctagaatcgtgaggcggggatttcaatattacaatgtcaatgaacaagaataatacaatccgctttagacgattggctcagtaggcaccatggttccagcacactttaaataattggttgtttaacttttacatcacaatcacattcttttttaagggtcaagatgacatagataatattttttagatttcaccataaccaattttgaatataaacgtgaaccagatttgttagatctatgagtaattttaccaataaatgatcgaacttctgaacaactttttcacccaaattttaataaacaacgtagggcggcgtttaagtgttgggcttaggtgaaagtaagcgtcgggctacggactttaagggcaaaaaaaaagttgaggttgacagataccaccgccttaatttttaacccaaaaaaaaatccattgaaagaacatcccctttaaactag

SEQ ID NO: 106313 - DNA, 657 bp, Oryza sativa
  unsure (1)..(657): unsure at all n locations
ttgtattttttttaaaaaaaaaacttgacccaccaaagacaaaatagaccctgtacatcctgtgtagaataaaaccttctcacgcaggtcaagaaagcccttgaacccatgccagcccttacacaatggcattggagaacgaccaacaaccgaggcctctagctgtaaaaattgttagcaatgtacattatagtaacttttatcaccaccaaaaaaatataattcaaattcgatttacatattgagaattaaaaaaagataaatccagagcactttgatttgattcttttattcctagatgggtgatttaagttttaacttgattttatatagagtattttatatatacattattaatgttgtcgtttttttataaaaagatttaccaactatttatatgatgtttaaacaaacaagattatattccctcaaatttaaaacacttgccacatactccctccgtttccaacatataagcatttttaactttgaccattaatagtnaaataataaaaaaagatccaatcatgtaaattgatggtactagatttattattaaacatactatcataatgtgcaactcttttaatttaaaaataactttatagatatngntagtcaaagtagcatctccgagactgtaccagagtccaaaaa

SEQ ID NO: 106314 - DNA, 725 bp, Oryza sativa
  unsure (1)..(725): unsure at all n locations
gacgctcatacacaaaacattagtttgtaaacctaattcattttcagtttttcatatattctataacacgttaccctttgagcactcgctcgggggatatttttatctaatgttcttttctgagtgttgatttcaggaaaattctattcaacattgtcgaagacttcatgtctctgtggttctacaccaagatcgactaaggcgagtacgacaaatgttgacaaggctccgtcgtagactctgcgccttctcgatcactcaagaatggttggtggatctcaacaaggaatacggaatgaagagatggtgtacccgccaagataaaatttcatgacttcaatccaaattctcgattacagcaagacgggagacttagtcgtatgctctgtactttcttggttgacgttggagattgactcagacaaaccctttaggtgcctgcacgaggctgataaaggaaatctaacgttatctctgaactcaccgaaaacggtcacatgagctcgataacagttccttcaaggtctgctgtggagaataggaactcggtcatttgcattgaagtcgggggctactgtcagggttatggataccacatacctaatagtaggtgactaaatcttagcaggacccaccacataccatgttctatacggaaacaacctgcggatattggaggagttatgggataaggaaagacacccggaggtctatantggatacct

SEQ ID NO: 106315 - DNA, 675 bp, Oryza sativa
caatagtatcactgccttgttactacaagaactgccccagttttcaataaaatctcgggccactataatgttctctggttaagcatctgtccctgtcgaatcaaataacaggtcaaagtgatgagaaagtgatgacttgagataaaaaaaggtttaatatataatatgcacaaatcattcatacaaaaacattatttgtctcctcgatatattcctaagaaaatgaatacataatagacattcttttatgcaagaggcaaatatatagaccagaaaaaatagtttagagtattaattgagagtggacattttcatatttatgtatcttgcaatgcgcaatacaagatacaaaataatactttgactaaatcatcctaaaactataaatttaagttggtatatcacaaattatatatttagcatttaatttatcacagaactacaaatttaagatggcgtatcacaaaactactaatttaataataaagttatcataaaaaataaatttagcaccaatttagtcaaaattctataacactcatagtttcgacataatggtaatacaaggaatttaaactctaaaatctatagttttgtgctaattttatatttagaaatctatagtttttttacttgctttaattatatagttttgtgataaatttaatactaaat

SEQ ID NO: 106316 - DNA, 1733 bp, Oryza sativa
cgacataatcgggttcgactcgttatgcgacctaagcgggttgatggggccatagccagatcgagttcgattcgacttgccgggtggggattccaagccagttctggacaaagttgagaagctagggcgagaggaagggcttgtagtgaggaggaaagaggaagaatggtgtggaggagttcatgtagaggcaactagtgggaaattcactgcatatgtgagggttaatctattgcccaagaaaatactgatgatagaggctgaaagggttattggaagcgagattcctaaattttggcatcaacttcagattggtaatctattagtaagaaaatgagtaaatgatgaacacgcttttatgcaagagattgtaaatatatataacagaaaattagtttagagtgttcaaaatacttggatataacacttggcatttaggatactccctccattttaaaaaattcttggcgtttcggacataacaacacgatctccgaaaactaatttttaccactattttctattacaatattatagaagtattagtaatatatgattttattgaagtacatctaatcaaaatactttagaagttattcagagttaaactttttaaagtttaacattagttatgtttaaaacgataattatttttaacctagagggggtaattgaccgtggacgtttttcacatatgtatatcttgtaaataaatacagaaatatggatacggaaatcatctcattttgccttgttaccgcaagtagctgccacagatcttcaatagaatctcccgcctgatactagtactgataatgttctcttgtttacgcattctgtccatgtcggatcaaataaacatgacaaagtgatgactttggatgagaaaaggtttcatatataatatgcacaaatcattcttacaaaaacattaattgtcctagctttcatcttcatccaaagtactcctcaatatattcctaagaaaatgaatacataataatatagacattcttttatgcaagaggcaaatatatagaacagaaaattagtttagagtattaattgagagtggacattttcatatttatgtatcttgcaatgtgcacaacaagatacaaaatgattgccgatttcatttttataagagtaaattttataaaagtatagatgctttgactaaattatcgtaaaactacatatttgagttagtatattacaaactatatatatagcattcaatttatcatggaactagacatttagaataaagtatcacaaaactattgatttagtaataaaattatcataaaaaacaaatttagcaccaatttaattgcaaaactataacgctcatagtttcaacataatagtagtacaagggatttaaactctaaaatatatagttttgtgctaattttatttttaaatctatacttttttatacttgctttaactatatagttttctgataaatttcatactaaatctatagtttttttatagaacatcttaattctacagttttgtaatatcttgatcaaaatatttgtagttttgctatttttatcatgaacggaccataagaagcattccatgcctgttacttcaagtatctgccatacctctctgcgtaaacaaaatcacgatattcacatgtggtcagatttatccctaatttgattttttacagaggaagtagctttaagagaatctcctgcttgacacctatt

SEQ ID NO: 106317 - DNA, 712 bp, Oryza sativa
aggatgaatagctatacacaattcttccatcaaacatattaagacattcgacgctccgagagaaagatatgtgagacattgctaggcctttagcctgccagtcaacttcagcctgagatgtgcctgtcaaaccactcgaagacggcaaccagatgtgttacacattcagaagacttaacaaaaatggctaaagatctacaacatctcaaatatctttaactcatactcatgtttaatatgtccctaacaaaaggaacacactaaacactttcattcaagcacatgatatctcaacatagggaattctaagttctaagttttagttaagtttatacaacttataacttagataagtatggccgattggccgaatagttaggttcgcggaagcatcttctacccaaaagatctttcctgcaaccgactagggtagaccctagtaagaaccatcctggaagaaagaaacatccccatcgaaatagagtgatctcacctgcaaccaattctaaacatgcaacaatacaacaatacacgcaagagtcagtacataaattgtactggcaagcaccaagcaagcctaatactctacatgcatggcgtattcaaagtaaagcttacatgggataatttagcataaagcaaatttagttttgcaaagacatttcaaattcagatttattttccattataattcagcaagcatacacttagc

SEQ ID NO: 106318 - DNA, 967 bp, Oryza sativa
  unsure (1)..(967): unsure at all n locations
cgcttgatgacnactggatgaatcaagccgaattcnagctcggnactcttgtttctctattcaattatttatccgaaagggaaaaatgaaacacacacacaaatccattttttttcacattattattatatatgtttgagaggtatttttgtttaactagataaaagcctacactttgaggtgagaatttgagaagaaaaaatcaagctgaaatattaattggggataaatatttttaatatatttagagctgatatgtgaaaattcttaggaatgaatgaaaaacaataacaacatgttctcttaaaaaataacgacatggttattctagtggctatgtatcttcttatccaacgactgctatctttactctaatattgcaatctaatggttagaaagtgtttgctttatatgagttaatgttccttagtggatatcaattatatagaaacaaagatatcattgcaacggatgatcattttaggtaaactttttgcatttttagcatttcaaaaaccacaactgagtgactaaatcgaccaaaacaactttaaagtaactctgaaatcaaaattggctgctacttataactaaggcaaagacaagcaagctcaagtagttattaataagtattgcttgaaaggtaccaagaaaaaaaaaacactagtaatatatttttgcaccatcgtgtagcatcattacccttcttgattatagggcagcaatgcttaattactgtttgtccgaatatatatcagtacataacctgtattttcggatcggtattaaacttttgaattgaaaagataagtaaccccttcaaacccttttttttttttttttttaaattggcccttttattttttcaacccttctttttattagtaaaaatttaaattttcaactttaaatttgaagttgatttaaaagttttttcatccaaagtttatttttaagcctttgtttt

SEQ ID NO: 106319 - DNA, 1582 bp, Oryza sativa
cgcttgatgactgcctcatcactatggccgaattcgagctcggtaccccgttggcagtcaactgcccgccagcacaaatgtattattttcactggcctttgattgctagcgttacagcaacctccagcgaaaacccatttcggccgcaagtaaaaatggttttttagtagtgaatcaaataaacatgatgaggaagtgacgttgactctagatgagaaaaacgtttactatacaaaatatacacaaatcattcatacaaaagcaattacaatttacaaaaacaacactaatgaacatgattattctagatgtaggaattattctggaatactcctcgtcggaaacatgtggaacgcatttctctcaaaacgcaaaaaccgtgcccagacaccaatccgccgctggatgtgaagccaacggcccagatggaggccaacggtgccaaggcgcaggccacgcgtgtagggctggacgaaaagctcgtggctcgttagctcgctcggctcggctcgtctcgtttggatttgttaacgagccgagctagagttagctcgttagctataacgagccggctcgagctagctcacgagctgctcgcgagccaaacgagccaaggcccagtacaaacagcgtgctcaaccacacaccataagtccaacaaggcccacgagacaaggtcacagctcaagcccacaagtagagtcaacggtgccaggtcatgaaacagcaagcccaactaagcccaatagtctaaccctaaaatccctccctacctgtccgttccttttctcaacgattcccagaagcgccgcttatcctcaagccgagtggccgacagcgccgcccaggagtcgaggagtcgtagctcgtagcgccacccttccttgcgcgcgcggttgtgccctttctcgccgccggtcttcccgcttcacctcgcatccctaacgttaacagcttgcatccgcttcttacgcttgctatcgggaaggtcagtaggtcacgccgtcttctttcctacttgccttccggcaccctaagaccccaaacttggctttttctctcgcgaattggctaaattcccgggcgggcgacacccctactcccctgtggcccggccgtcctccgcggttggcttggcctgctttttggcttacgaagccaaccagcccactgagcttacaacttagccagcctagcttgtttttaacttgtagggggatgagccagacttacttaacgggcccactgggttaattcaccctaacgccggtttttgccaatttatttccggagggtattcccttcccgatgttggaaacctccaacttggacagggcccttttttttttttttaatcccattctccctttttcggggccgggccaaattccaccaatccttaccttttttccgcccccctctcttttgtaaccccaaacaaggccccgctttttctctttccgttttaaaggttttttttttttccccccggtttttatttgggggggagccgcccaaaaaaaaaaaaacttttataccccccctgggcgcttccatataattgggcggggggcgcccaccc

SEQ ID NO: 106320 - DNA, 3194 bp, Oryza sativa
  unsure (1)..(3194): unsure at all n locations
agggacccgcgttaagattgggtaagggttttaaaaacacaaccctggccccaaagggcttcgcgcagcatgggttcccggcattgcgccgaatcctctaaaaggcggtcaagcaacaaaggggaaggtgttcttnggtttgttctttggtcttacgcgggttactgcgttaaagacgcaacctatggccatgaccgaagttttgcccgatagttcgggtgtcaaaatgtgctcgaaggagtcgtctccntatcggcgaatgcttgaccggaaacgcgatacggcatacagatggggaaatcttcgatcaccttgggctcaacaagatggnagttcatcatcattcggtatgatccaagctgcgtcctctcattctaaaccagaggttgaaaaattttttgctgaattggagcaagcaatggagctaaatgctttcgacataatcgggttcgcctcgggatgcgatctaagcgggttgatcggtccattgccagatcgagttcgattcgtcttgccgggtggggattccaagtcagttctggacaaagttgagaagctagggcgagaggaagggcttgtagtgaggaggaaagaggaagaatggtgtggaggagttcatgtagaggcaactagtgggaaattcactgcatatgtgagggttaatctattgcccaagaaaatactgatgatagaggctgaaagggttattggaagcgagattcctaaattttggcatcaacttcagattggtaatctattagtaagaaaatgagtaaatgatgaacacgcttttatgcaagagattgtaaatatatataacagaaaattagtttagagtgttcaaaatacttggatataacacttggcatttaggatactccctccattttaaaaaattcttggcgtttcggacataacaacacgatctccgaaaactaatttttaccactattttctattacaatattatagaagtattagtaatatatgattttattgaagtacatctaatcaaaatactttagaagttattcagagttaaactttttaaagtttaacattagttatgtttaaaacgataattatttttaacctagagggggtaattgaccgtggacgtttttcacatatgtatatcttgtaaataaatacagaaatatggatacggaaatcatctcattttgccttgttaccgcaagtagctgccacagatcttcaatagaatctcccgcctgatactagtactgataatgttctcttgtttacgcattctgtccatgtcggatcaaataaacatgacaaagtgatgactttggatgagaaaaggtttcatatataatatgcacaaatcattcttacaaaaacattaattgtcctagctttcatcttcatccaaagtactcctcaatatattcctaagaaaatgaatacataataatatagacattcttttatgcaagaggcaaatatatagaacagaaaattagtttagagtattaattgagagtggacattttcatatttatgtatcttgcaatgtgcacaacaagatacaaaatgattgccgatttcatttttataagagtaaattttataaaagtatagatgctttgactaaattatcgtaaaactacatatttgagttagtatattacaaactatatatatagcattcaatttatcatggaactagacatttagaataaagtatcacaaaactattgatttagtaataaaattatcataaaaaacaaatttagcaccaatttaattgcaaaactataacgctcatagtttcaacataatagtagtacaagggatttaaactctaaaatatatagttttgtgctaattttatttttaaatctatacttttttatacttgctttaactatatagttttctgataaatttcatactaaatctatagtttttttatagaacatcttaattctacagttttgtaatatcttgatcaaaatatttgtagttttgctatttttatcatgaacggaccataagaagcattccatgcctgttacttcaagtatctgccatacctctctgcgtaaacaaaatcacgatattcacatgtggtcagatttatccctaatttgattttttacagaggaagtagctttaagagaatctcctgcttgacacctattcagtattcacacgttctcctgtttatgcattccatccctgtcaatcactactaaaaaatcatttttctagcgtaaccctttcgtttttcctgatgggttttatgcaaatacgcttgtgaaaataaatgatagggattccggttaccaatcgtcagcaaaaatcaattttcgctaacggttacttaaaagatccgcttgcaaaaatagaggtatttttaaaagcggacctcttaacttaccgctagcgaaaatcatatattttcgctcgtggctgctaatggccacctcccgcaaaaaaaaaaaaaaaaaaaaaaaaaaaaaaaaaaaaaaaaaaaaaaaaccttcactttattaaaattttacccccacctttccccgctcccccatctttccatctcctaactccatctcctcgactccttctcctcaccccctctctcaccacgcctctcctcctcaccccggcccggccctctcccccctgtgcctttcctcctcctctcctcgacccccacgcacgcgcctttcctcctcctctcggcaaccaaggcagggacggcgacgacaacggtggacgtcctccttcctcgccaagccaccgccgtggagccgcatcgactggagcgggccagcggatccggcctgccggatggtcgcgggtggcggattcagtcacaggagaggcacatgtagagaaggaaagcgtgcagacggtggattcggtagcggcaatggtcggtctcctccctcttcagtccaggtggtggacaacctcttttcttgtcgagccaccaccgcggagccgcatcgaccggtcaccgaatggctgcgggagctgtcgggacgacgaaagatcctccaaccccctgccctctcctgatgatgcagtgggtcgaggccacctagtgaccgtggctcggtaggcagcgacaacggcaaccacggcagccacggtgaagcctgtagcgagctcgggtaccgagctcgaattcgccgtagagggatagtcactcaaaaggggacgcg

SEQ ID NO: 106321 - DNA, 2283 bp, Oryza sativa
tgttcaagtaaagttattaatcaagtttcagtccctgagtgcctgtccattttcggaggtaatataacaaaacaatcatcatttgaaaaaaaaaaatcgaccttttacaatagatgtcgagaacttgtaaaagatttgcacattattccatcgaaataacatggtgcgaaggtctaaatatacaacgaaccaaaattttctgacaagctgatctaaattcatttgtctgtccacttttaggtgaaataacttgctcgagtgtccatctgtttgtcattttttttgaaagaactaaaaagagaatggaactaacccttgtgagcgcctgagcgggctcctcatttattgatttttttaatcataaaacaaggtttagaaaaaataaactataatacccttattaaatgaaatatagctagggttggaagggtggttagggtaaaatgaaaaaaatgaatactaagacatgattagtactgtagatgttaattattttgagataaaatttgaatactaatgagacaattattttagaacggatatagtatttttaaggagaaaaaaatatgaaatgttatgagaaaagaaagggcaaacgatgccggcgaaagtcaagaattgcgtatcaagtaaacgggtatgaccttacatgatggtatctttaattaaatattgctaactgatgccaacttatgtgaattggcgtgatgggagcttttaagtggcactatcaatcagtcataacattttgacttgttgacatgaacatatatactgtagaaagctacgaatttgtattaatttcctgtggacatgaacatctcgtggagtcgaagctaattgtcagatgggcttcttggaaatttcatcccatgcatggatggagatttgcaatagaatactctcaaactaattactcgtgctaaaatcgaaagagcacttgtgccaagggctttgcataattgcattttgggaatttcaattaattaaggatatatccagtgacaagctaaatattaaaaactcgtgaaagtcatacctaaaagtttcgtaaattcataaaaaaaatactagtgataggtgtagatatgaaatgcattttcaccaaatctcaaattcaaacttaatttcatttatgagtaacaaagaagaaaaaaaaggtgaatggtaacaagacactgttcatctgaaatttgtctttctttttctcttaaatgaagttgagtttagagttaaagattttgtgagaatgtattttatatctacacctatctctaatatttttttcatgattttaagaaacttttaggtatgattttcacgagtttctatcacttaactcgttttcaccggatatgtccccatttcaatttagctgtgatatattttctccatttctggtaagccatttattttgtccatttttccttcaatagtttatttctgccacagggtttatctcactgaccttgaattcaaacagtgaagggggaaattaacgactccctccctttcatactataaggcactttaactttttttaattaattttttaagtgtgattaagtttattgaaaagtataacaatattttcgacatcaaacaaacatattatcaaaatatatcaaatgttatatttgtataactaatttgatgttataaaagttgctatatttttctataaatttgattaaatttataaaaaaattgacttaaaaaatcaaaacatcttataatataaatgaaaagaatagttgtcactccatacatatgactttaacaaaaaaaatctcaataagaggacgacttcaacaattcgccactttacagatgttagttaatattttttcatctaatatttcagtgctgttaataaaacatcaatgtagccatttttcacactaccatctaataggaggggaaaattgatatgaattaattaaaataggacccatgattagggggtaaagtgtgaaaacaaaggctaagatgatgtttttatttagagcagtcaaccattagatgagaaataattaattgagatctcttccatccccttctcctgtcgtgcacgtgcatacttagaaagtaaccatcggattcaatgtattaggccccgtttggtaggactctaaactctagctcccagctactaactccaactccaactgaagtgggtacgaaagtgtttggctagagtagttagctccactccaccacgtctcttgtaggcatttcgtcgaacacctggttggcgtcgcactgccgccgccatcgccatcg

SEQ ID NO: 106322 - DNA, 5497 bp, Oryza sativa
tccattcgaatgttagacatccgagagtgaataacatacattggttgcaattgaaaagactccaaaagaacaaatctgagcagatcccgcatccctaatgttgttgcctgacgtcttgctttgctagcatggtgacatggcctaagttacatatggccttgtatagaagagcttaagattttaataagcggctggtggatagccagctagtctaaatatgaaacgatgtgttttccatcttcttcttcttctagtttagttttagacagctagtctaaatatgaaaacgatgtgttctccatcttcttcttcttcttctagtttatttttagatggtataagtacaatttctcataatctagttgagaatctagacaacttgggagagctatagattttgaaaaaagttgcgtctaccaaaagcttgtacaaacaagggtctatatatgtggcacctcttaaagtccgaaagcacgtccaatagccatgcaaaaatggtttatacaaccctcaagcttttgtagatcctactcactctccatattttgtattgtgagtaatttactcctatttaaatgggaacatacgctatgcgcataagcttccatctacactccgtgcataccaactagcaaatgtcatgaaaaattctacaaaaaaaaattagacatttactcctaatagtattacacatatctacaaagtcccatattcaaattcattatattttagctgtaacaacaattttaagggtaaaaatttgtcagaaatttgtctttttttgttacggctaaaatataatgaatttgaagataatatttcatacataggtgtaatactattcaaagtatgtgtccatttttcttctagaattttctgtgacatttgctagttggtgtgcatgggaagcttgtgtgcataggatatattccctatttaaataccttcttctatcatttttagctcttcaaattttgccaacattgccaaaagaatcctgaaatttcccaaagcaacccctctcatgcatccaaacgaataaccacggtttttcgtcttatttctatttcaaggccgtccaaaatgcattaaaggtgcaaaagagtacattcagttgtaaaacaattgaagccaccgggtttcattcaccagaatgtgtagttttactaggtaagttggtctctggaaatcagatacaactctaagctttttggttgatatagaagttgaattcaaatggatgaatgggaggatcaagtactggatgaaccgatcgaaactagggatctgaattgtattcctcatgaagttatcatttaatttcttcagaagtttaggacggtttttggaaccttgaggttgagacatcatttttagagacatcatactctaaggctgataatgtatcactttaatatggagataaatctcgtaagggtaaaaatggacatatatgaaatttgtaaaagtaaaaaagttgattatataccaaatctccatgcgtttcccctctttctacacattttgataaagatacctaatctagacttatcacttgctactcttttcccttctcgtcactactgaaaaacgatttttctgtacagcgacccatttagattgtagatggaccataactggtcgcgtctaggaaaataagctcattttcacgtgtggtccatttaagaggaccgcaagaaaaaatcgatttttctgtgcagtcctcttaaatggaccgcacgcgaaaatatgcatttttgcgtgtggacctattaagagtgccgcatgcaaaaatacccactccctcttttccctcttacccactttaaattttcccctctatctctcctctcctctctatctctttttcttctatcagtcaacaatagtggcctcactcatctgtgccctctcctctccttccgatggcagcggcaggcgtaggtgacggcggcggcacggcggcggtggaagcgtgggatccggcgggcggcggccaacccccgcatggatccggcgggaggccgccctcgccccccccctgggggatccggcttccctccccttccctttctttccttcccaaattcggcgaaagggaggggcgttagtggtggtgcaaccagaagggagcacagatccgccgaagcgcagcgcggagcccgctgccaacgagggcatgagcggtgtcctcgagcgacgacggcaatgacaaggagaaggaggaggccgcaccgctgccggaggattatggggttttcatttttttttgaaattttgtttttttcagatttttgtttttccgtgtaggcgacataagcacccgcacgcgaaaatctgattttcgcgtgctggtgcgccacccgcacgccaaaatcgcgattttttgcagaccctgggtgctggtgggctgctcacccgcacgcgaaaaccggttttgaccgcacacgaaaatctttctcgtagtagtgcgttttcgaacagtttttacatagatctagtgcaacaaggaacaatttcacccattaatatccaaaaggaaatgcctttgcagtaacaaatgggaatatttacgttgcctggggtctctataatatatgtgtcgatcaggatattgcctttacaaaggtttcattctgccgcgaaaacacttttattgcaacataaactccattgtgtgaagtcaaacaagaaattaaactataatcccagaaattctctatgaagtaggcaagagaataattgaattgatcttgggtgccttaaagtggacacaagatttgctgtaaatcttttaagtggcttcaataagttaaattactcaatcgtggttacaccactatgtagtggtggcacaaactatatgtacagtgcaagcggtactatctcaaaagtttcagtacaaagtatttggagcttatttaaaggggttaaaaggtaaagtgagaacattttcttgttactaattcctttggattaacctttaactactgtaccgacaaatccaacttttgaactacacgaacctataaaagaggacatggatttttaccgtcgtctgccatttgactattcaaaatattgagacttagagtattgagatcaagacaataaaggagtatccaaatttgattgtgtgcctcttatttctattgaaggataaatgaattgtccgtcttttctcattacctcaaaagcttatatggtcagcctatattgtcaaatatgaaacagtaggttggacttgcaatactccgtattaaggaggcataagcaaggtgatggaaaaggcagcctacctacgaaagaaatgtctcgatcgaaagcaagtcagaagccaaaaactgaagccaatctcttttatcggttcaataattgcttggaccacatgaaattccccggatacttacacaagtcgaactattttccacgaaattcttgcaagcacttacttgagcaagcaaaaaagactagctattagcccatatcggcgatagtgaactccactgctcaaaacaaatgatccaaacaagccctgaaagctccttttccccaaggcaacagctaactgaaccagcaaaatctgtctgcctctgaaagaaacaaaacaaagagaaaaaaaaaaaccctttccctcccttctcacggcactggccaacttgcaagttgcaactgatgtgaagcactcactgagactccaagcacctatatgcaggtagctctcagcacgcttgagttggtgatgccttgattcccactgttttgtccgtcaaatactactgcgacgacgacgacgatgacgatgacgatgacgatgacgatgacgatgatgatgtggcccttgcagaaccatgttatgttgatgatcaatgcaatgccaatcaaagtagcttttgcaaacgatggagaaagtgacctccattttcttgaccattggtgggttttggaccagaggctcaaggccaatctcaagcagaagtttcacttattaaatgaaactctacagtgaacggcatatattgtcgacgttaggatttaatttgtagcaccttgggagatttaattcatacacttcacatatttcagttccgagtttcgaacaacactgacatactataattcaagtttgagcttctcaaaaggcatggatatctagagtatttgagccatatactaccaatagagactaccgtaaaggtactctaattaaacatgaagtgagttgtgagcttgctccaaggctcacggcctttagctcatgagaaccattcagaacaagaggatttcacaaaaaaaaaatcaattcctatatgaatcataaaaaaaagaaataatcccatgccccagacaaggctttaaagaccccaacaattttagtcctgagacaggattcctgttaatttgacattgaatggacaggtagggctctcttgtttgtccccttgccacatttcatgaagataagcattccctctgctactagtgtgatgtgcacaaatatctgcctctagagcataacattatagattccatgagcatatatataactttggtccactcacttctctctggatgatcccattacatcacatcactccatcagggtcaggggccagggtgatactctgaatgaatcagggttccagtctaaagcaaactacataacaaagataaggtttttgtaagccaaaataaaaggatgtctttgctatttgttccacaaggatgagtatgataaaagcagcttttctttacctactggcttggctactggttcctccaacaaaaagggagaataaaaagaaaaggactcgtagcatagcactatagcagtgctccctcatttgaagttacttaatttagttcattattagctgttgttcctttgcctttgttgattgatgactttttacagacaagtgacagcaattggaaattgacaaccagcaaagtcacactgatttttttttatatagcagctactaccgacaagcaaccaatttttccattgcttttggagtacaactactagtgtcaggatagaaatgtttttcattagtattttttataactagtgctagtgatctgtcaaggatgaaaaggatgcaatccttcaaaaaaaaaaaagataagtagtgcagtcctgaaaagaaaaggaggtagagttgagcaactaaatgactaatcatttgtccaacaggcaaaatgatgagaattaactgagtgcttcaaatttctgaaatcttgggcttttctaaacacaattaaatttctgaaatcctcggcttttctaaacacaattgcaactttcaaagattcacctgcaactctctgtaagtaccactgttgacactgtatgcctaatatcctgtaatcagcaatcacattacaaaaacatgtgaaagtactcaaatattaagtaggtgctatgttcatccagacgacgatgtgaggtagcttatcctttgatgtatttcaattacgaacactgaactgc

SEQ ID NO: 106323 - DNA, 1168 bp, Oryza sativa
  unsure (1)..(1168): unsure at all n locations
aacgtactttgtcttcccgtccctaaaacattgtgatatatctgtaatattttaatatttttaattttaaaaataatttagactaataatatagatatttaaattaggtgattagtaaattcaaatcaactatagtttggaataaaaaaacaaaatgatatatgccaagtacaatctaataacaatagaatgcacttttggttaatgtttactcctaatttcttaatttctagtttggctccccccaccgttatggtaaaaaatcgttatgttttaactatttatctgctagagcatatgtaatatttatgtaaactatgttctttattaccaatcaaaatagacaccttacctactttcatcaaaagaaataaaaaatgtagtaggtattattctggaatactcctcgtcggaaacatatggaacgcatttccctcaaaacgcaaaaaccggggccccgagccctcgacaccaaccccgtcggatgtgaagccgacggcccagatggaggccagcggtgccaatgcgtaggccacgcgtgcctctgcgcaaatcttatctcccgggaggctccgctccacttcccttcccgagtcactcaaaccatccaatccctccaccttcccttcccttgcccccatttcccaccgccggcgcgccttgcccccattccccaccgccgcggtgcgggcgccgacgaccttcacacctcgagcacgcgtgccgccgacgaggtgcccttctctttcttactctcgtctcccccattcctcccctcttcccgtgtcccgtcgtccacagcttcccgaccaaatccttagcctactatttcccacccacaagcctttctttcgtggtcacgcgcacgaacgggcccgacagtgccgccgctttttgcctactggcgcgggttttaaanagatggtgtcctgattgtttggacccacaaagggattggtatattttttgctgggaaattggccgcccaaaaaaaagttttaataccatgttgttaacccggcccttcatggggggtttttataccctttttaattgtttggatggtnaggggcttttcacccattcaattcccacctcccccgaaaaaagagcccaaaattacccaaaaaaccccctccctgcggctctttaaaaaattcaaagaccg

SEQ ID NO: 106324 - DNA, 1271 bp, Oryza sativa
  unsure (1)..(1271): unsure at all n locations
acggttttttgacgtgattttccgactgcactataggccgaattcgagctcggtacccatttgtgattcactgtgatgtacttttgtatggacaatattgtgattcattgtacatttgtatggatctgngatgtataagatttgtgatgttactttggtttgggtttgatttgggtatttggggtttgatttgggatatgtatcccacttgattcgagagaaaataaaaaagaaaaagaaagaaaaggaccatctcaccgccgctacctctctttggtctcggttggtgttaccaaccgggactaaagatcccctctctttagtcccggttggtaacaccaaccgggactaaagatcgatctttagtcccgggtatttgaaccgggactaaagataacgatctttagtcccggattggtagtcccggtttgaaaaccgggactacaggggggttacgaaccgggactaaaaagcacttctccaccagtgtacacaacaattaaccaaatgctcctatcttttaacatgtaaagacatgttcagaaagcaatttgggagatgttcagaatgtattctggaagaaaacatatgcatattgttttgcatgtggatgtgtcagaaaactcatcacatagttcaactgaggtgattgaattacactttggatcatattatcatactggtaaaaaattcaccagtaattgattcacattcagtttcagcaaaacaattccccatataaaggcacttttcagattttactgattcagtttcactcgaatgaacaacccaaaaaattttacaggttcccaaaatttattaaattccaacctatcctggattgaaacataaaacaaaatttattccaatttgtttggcatctcacaaccatattgtatatgccctgacacccattgtttaagaaatttttatgtaatttcaaagaatttttttttttttatgggcaaacacataagcaccaattttaaatctgggccgctcccgggggtaattggaacatggcattacaaattttttgtttctttcttgggaatacacagataattccctctccccctttttttcaccttggctttcatcctttggaccttgttctctagaacattacacctgtggctctcattgacataacatcttgtggggttaccgccattatattcccttttcttatcttagaaagtcacacaacactctaacattctctcctttgggcggcggggaaaatctcttcacaatggtgccgcttctcg

SEQ ID NO: 106325 - DNA, 3053 bp, Oryza sativa
tagtagcattaccacccttggcggtttattgtactgagttttaacaatatagtggtttggaagttaaaaataggctcagatatcatcatatttgacatgtgaaactcggggtgatatatcctagtacatcgtcgtcctaattaccatcgttggtactctacaattttactgtgtgcttatattcgatccgaagctactttgtctttaagatataaatggagcgtataaaggatgtccatcctttaattccaataagaacaaacacgaagcacatatggcaaatactaaatccactacaacaaaatcgaagaacatacaaagcacgtaaagatgtagcaatccacattgattcttcatccactactaaaataagcgcatatgaaaggccgcatatgcatgatcattgtgaatatgacatgcccttgtcgaccaaacgtgtcacttcatgcaaatatgttgtttcaagcgacatcaagatatgattccaaagttttaaacattggtatattaatgactttcatatatgcatattaatttcaattgaaagccatcttgttgtccatccttcctgacaagatgtagtgtacaaggcattctttagttgagcctcgctcactttgtatcacagaagcataacctagacgtaactaattcaatatagaagcaaaaagtgtagcagcaacagcgagggtggaaactagaaagaaggatttatgatgttctgtttattcagtcacgaaagagtgactttaaaaaaatgtacacatcttccacactatgagatgtcttacttatggaatgctcctacacgttgaggttgttcttgctgacaccctcgtttctatgagaagtttattctaacatagcaagtcgatagtttactgcaaacaaaatggataataaacttgatgtttcaacaaaactagaggaactcacgcatgatgtacccaaagaaaaccggttcttgacacactacaaatatgtggtagttcttttccatctcgaaaacgaatagggctgtgtttggaatcaactgttcccaacatgcaaagtgcgcacagaaaacggagcggttcattagagcttgattagttaagtattagctttttttacaaaaaatggattaatatgatttttttaagcaacttttgtatagaaactttttgcaaaaaaacacaccgtttagcagtttgaaaagcgtgcacgcggaatacgatggagatgggttgggaaccctggattccgaacacagcccaagtctatccaaaatgtttagacaagaaaacacgtaacaagttggtttacaagaatacgaattgcgtcaatcctgcactacaagtagagcaacatgttgatttctcgtaaatctctcgaatggtgatttaagaattcagtgcaaacctaattcttgctagaaaattgaaatgttcggtaccgcatcaacggaacaataaaaagcacttggcgtaccataattttgtcattcttgttgaaattttataatataaaatgcatgaggccacacgactttaatgttcaacgtgtcatgcattagtgaaactagaatataccccgcgtgttgctgcggcacttttagttgtcactggagatgtcggcttatttaaaacaatggataaaaattatatgtgcagtatttacttgaaaaatacagtactcatagtgaaagttgggtcggctgctgccagtgccagacaacctaaaatgaaatatcacatggcctacattgacatgttaagtcaaatagcacatttctaaagatatagtttacaatataaatgtagaaatagttaggataaagtgtgcaattggatgaacttccaagccccagaacagcaagccatgcaaaccatcacagattggtggagtgagctctgtaattccatacctttgttgatgatgtggtggaacatatggctggtacacaatagaattttccaacaattgttgaagaatggattctaagtcgcttttctagtgaaggaaaaaattagcctaatagtcaaggatctgtctgtttcatgatctttcaatcaatcgctctctttttttatgtaaatcaatcctcatatcttccctagatgtttttttccttttaacagacatatgtaaggctctggtttactacttcttttctcgttctaatatatccggcaaatcttctacagtttgaagtataaaaaaagaaatagtttgaatattacacccttcattttattctattcaatcaaataaaagaataaaataataaagataggagccgagactccaataaatataacatcagataggagttcagactccaataaatataacatcaatattgttgtcaagacaaccgaatatgcacaatgtgttgaactttcaaattgacagttcactttcaaattgacagttcaaattattgaaaaacttatgcaattcaactcgcttccttttcttgtctcactattaagttaagataatttcaaggttgcagcaaccgctactaaaattaatgcaaaacaacttagtcagtctacagtggcagatatgatcaaggggaaaagaggattttaatggcgtaccgtcaaaggaattatttgtgcagtggttcaatgaagaaagctcccacctttcttgtttcctgtacaatacagaacaatacagagtattaaaaacctttataaagttgctggacataggaataacaatattatgctaatgctaaaaagatcagctgaaaatgcagcataataagaagtgtaaccaacaatgaaaaaagggtttttaatagcatataaaatgaaaacggcttcaaatattgttcaacaacacagggcactaaacaattatgaaatttatgttatcatatgaaaaaaataagagtaattaaaatattaattcaaatacgtaccagatacaaaaggaaaggataattggaatgtattatgaaagtcaaatagaacctcaagcaaaactgcaaggaagttaattagagcgattagtctatgaagattagtctatgaaaatcagaattggtgagagagagacga

SEQ ID NO: 106326 - DNA, 1424 bp, Oryza sativa
  unsure (1)..(1424): unsure at all n locations
gatctttggagggggccacacccgagtgtttttataagcatatccgggtagggaagntttctttcattcacataatcggaagaggaaatataaggacaattaaatagttggncttttacgaaataaaagattattcgtgagtttggacacgagcttttctctgggtagggaagaaaacggcccagtcggttaaagcgccgggagataggaagcaaacctgtggggcaagaaaaaccaacncactagatctgtggccccttattggatgcccgccgaatgggaagaaaaaccaaccgtttgcttgaagttccaacgctggtgcgtgcaaaatatcggaagtgaagcgcgaccaacgcaagaggaaaaagcgagtgaatgtgtaatgcgacagtgatccttttttttttttgacttcaaaaaaggaatttttattgataccgaaaaagatgattacattctgggtctatcaagtctaagattcctgcgggagcacacaacttctactccacacacgatttagacctcatagccatttgagctaaagcatgagcaatcctatttgcttccctcttgatcttgcaaacctgcacactttagagacactgcatcatccctctcgcttcctttattgtcgctgccaagggtgatctcgacagctcctgttgtgacagagccttgaacacctctacgctgtcagtttccaagattcttggcatatgaatccattccatggctgcccttaatccttctagacatgccaatgcctcagcttggacagcagtagcacaggatttttttgcacagcaaacagcactaaacccctgcagtctctaatgatgattccagcagctgaaactcctgtgtcttctataaaaccagcatccacatttacctttgctgaaccttcgggaagggcgtgccatttatcaacctgattggttgtctgaacctgcagtaatttcaccattggttcattatacattaatccttttcctttgatgtcatcgctttgttgtcggatcggcaacagtaccttctcatagttgacgaggaaatttacagactctgcaattgtggccgtcccctttccatggatcatatcattcctgaggaaccatgctctccacaacaagtacaaaacacgcgccttgtctgaactattcaagctatccaacaggacaaggagccagtcaggcccagtcatagcaaacttcctttccggcggtagcgcccagaactctctgatggcttctcgcaacgatctcgccattgtacattcaacagtcgcatgggaaaccattttccttctttacaccacagatagggcagatgcctactgggtgtattcctcttttttcgttattcttccaaagtggcaacctgtcgtgagcaagttttcatgcaaaaatctaacttttggttga

SEQ ID NO: 106327 - DNA, 1225 bp, Oryza sativa
aaaatttaccgagaaatcaccatgttgctatacatgtagtgcaggatgacggtaatccatattcttgtaacccaacttgttacgtgttttctcgtcaaaactttttggataggctttgggctgtgttcagaatccagggttcccaacccatctccatcgtattccgcgcgcacgcttttcaaactgctaagcggtgtgtttttttgcaaaaagtttctatacaaaagtggcttaaaaatcatattaatccattttttgaaaaaaagctaatgcttaactatcacgctctaatggaccgccctgttttccgtgcgcactttgcatgttgggaacagctgattccaaacacagccttgattcgttttcgagatggaaaagaactaccacagatttgtagtgtgtcaagaaccggtttcctttgggtacatcatgcatgagttcctctagtttttttgaaacatcaggtttattatccattttgtttgcagtaaactatctacttgctatgttagattaatcttctcatagaaacgagggtgtcagcaagaacaacctcagcatgtaggagcattccataagtaagacatctcataattttcactttggaagaagtgtacatttttttaaagtcactctttcgtgactgaataaactaaggaacataataaatccttctttctagtttccaccctcgttgttgctgttgcactttttgcttctatactgaattagttacgtctaggttatgcttctgtgataccaagtgagcgaggctgaactaaagaatgacttgtacactacatcttgtcaggaaggatggacaacaagatggctttcaattgaaattaatatgcatataagaaagtcattaatatatcaatgtttaaaactttgaaattgtcagggttatggataccacatacctaatagtagttgactaaatctcggcagcacccaccagataccatgtcctatacggaaacaacctacggatataggagaagttctggataaggaaagacaaccagagttctgtatggaaacgacaagtactactcggattgtatccatattggtttccctagttttacttggacaaggggacacttatgggtataaatacaagaccccttaggaggagaggggacacgaccacctcaatcaacaccgaccataatcaacatacacggaacaacagaagccacaacatacaaaccaacatacg

SEQ ID NO: 106328 - DNA, 688 bp, Oryza sativa
ggctttgggaatccccacattggcaatcgagcatatgccacgttagaacggggtccaagtgaccatttctgggtgcggtagcaagtacgagtatacgactactcttttcgatcaacgacaaattaagttaattaatatattgtgatatagagttcctgtacatattactctatatccaacaaacaagcagtaatgaacaggcgaattaacgtgatgatcgctatatgctgcatgcacgtctgtatcatctagtactagtaacctaaacaccacataattatgtggtcaagtggacaatgatcgatatacgcatctctctcacgacgaaagaatctgtaggtgagcgttagacgtgcacgcttgcgcttgcacacacatttctcgtttcccacctatcgatcaccccgaatgaccttcagaattatatatttcggcgccgcgccgtgcactccacgtgccctcgctctttgacaatttgtataatccactgatctcttcagtcttcccagttctcactgtctgatacttgaagtcttcccagttctcactgtctgatacttgaagggtgtgtttgaggagaaggggattgaggagattggaagatacacaaaaagatgtgagccattaactcatgattaattgagtattaactattttaaattttaaaaatggattaatatgatttttt

SEQ ID NO: 106329 - DNA, 987 bp, Oryza sativa
  unsure (1)..(987): unsure at all n locations
acgttggtgaggaatcctttactatangccgaattcgagctcggtacccggtgaggtggggtcggggccccacatttttgcggggaggggacgggggaggcatttcaccgcgggtgacccgcggggccccgtgggatgtaaattaaaccttaaaatgtagtccatggaagacccaaaagagcccaatccaacaatagtctaaaatataaaaataaaaccctagccttatcctctttcctctcccaatctcctctccccgtcaccctcacaccacacaggcggcggctacgtcgaccgccaggcatgggcggtggcgacggccagggcgcgggcggcgacgtcgatggcctggcgcaggcggcggcggtgaccagggcgtggccggcggcgtcgacggccaggcgcaggcggcggcggctcgcctcatcgtcttccaactcgctgtcctcgtcgccattgtctatcttgccgtccaccggcccagccgggtagtgcggggccctgctcacccgccaggtccctgtggggatcggggctggtgacgttttccacccaaccacctctgcggggtcagggtcggggggagaagtcggggagcgggggcgggggcattccagctcaacccgccccgttgtcaaccctaatccgggccatgacatatgaaattcaaagactcagagagcaaaaaaagtttactggctaaaactcaaaagtactacagctccaacttgagacgtttctgaacatatttatacattccagcatatcaaaacactactggagaaaacatctttgcccggtcgagcaaaaaccacaatagtcccggttgcaataaaaaccgggactaactattatctttagtcccagttcaaaaggttcgagctacttttttatctttagtcccagttggaaacaccaatcgggactaaagatcatttttagtcccggctaaaagaataacaggcggtgccatacccctctaactaa

SEQ ID NO: 106330 - DNA, 679 bp, Oryza sativa
  unsure (1)..(679): unsure at all n locations
aggtcccttgaaacttatatccactcggacccacgngatttgtgcttctgtaaattcttggaatgttatctgcactgctgaatgcaatgttatctgcaatttatagtatatgatagtttgcaatgttatctgcactgcggaatgctgttctaggaatggtatcttgaatattttgtagttttgaaaactacattctgaacattagtggaagttcactcttgcattgttcttgtgtcactacatactactattcaaggtttctttaaaaaagaattcagatgttctgactggttttatcctgctagtgtttaatggatcagtaccatttcctgtctaggatttagggtatcttcttcaatgaaagagaaggctgtagtatcttaaacgaaagtctagtaattactccctatgtctgaagacggcacagagctcaagttaaaataatttgttaaatactattccctctgttaaacaatgtaagcctctgtagcagagggataaaatgtcttacattctgtaacataggtaatacatggcatcagatgaattcctgaccataatttgttgctgtgagcattaaaaaatgacatgaattttatgtatagtctctgattgaatgaggtgaagtactgaaatgccttatcttctcatgtgtagtctctgatgaaatgaagtgaat

SEQ ID NO: 106331 - DNA, 1790 bp, Oryza sativa
cttgtccaaaattcgccggttttccccggaagttgcctgatttcgcgtggcgtggaaggcgtgtgcatgcgacttgcttgcttgcgtcctcacgcctgcagcgtgcgcgcgcgccgcgccgactgacatgtaacacgtcgtaaccgatcggcgcgcgcgcttgccgtgcatggccgcatgcatgcgcgattgagcgcttgtttggatgccaccatgcgacgacgtacgtacatgtcacagatcgagatgacacagttgcatatgcccccttcatcccaaaagaatctaaaaagaatctaaacctgaacatatgtgtccaaattcatagctaggatttatttttttttaggacggagtagtaggttataagacgttttgactttggtcaaagctaaattgttttaagcttgtaaaaaaatagtaactttttaagccaaaataaatttattatgaaaaaatatattcaattattgattcgatgaaactaatttagtattataaatattactatatttacctgtaaacttagtcaaatttgaaataatttgacttttactaaagtcaaaacgtcttgtaacctggaacagaggaagtatatatgatggcatctcaaattgtttttgctatatgtttaattatcgataaattttcttttaaaagtatattaaatgtaaatataatacaattatcgtgtagtcacattatactttatatacaattataatgtaacttgtaaatttgaatcgttagatttgcttcacgattcgcgcaaactaggaaggaaaaaaatcacagcatgggcatagatgaggggattcggtcccacgacctccgttttacgaccattggatttttaaaagctatatacaagttatattatagttaaatacaagttaactagcatttaaaattgccaggctaacacggtttaaatttgatttctaccattacactagtacagtataaaaggttacattccgtaaacgcgtcccaatcatcagtgcttacggcacagttgagctagcggtggctagtttgtgttaattacactactagaaaaagtatttttgcaagcggccaaaagtgattttttcagacggatgggaggaccgcctgcatcccaacgactgcgaaaatcgatgatttccgcagtcggggcaatggcccgcctgtgaaaatgcattgaaaaagcaaaaaaaaatcgcggggccagagccacgccgtcgccgccgccccgcgctgtcgtcgtcgccgccgccgctggcctcccccttccctcctccggccggccagatcttggagggaggggggagggggagccgccaccgccctcccccagccggagccacgccgggcgtcgtggtcgttgccgccgccgcccccgccggtctcccccctccctcctcgggccggatctaggagggaggaggaggggagccgccgccgccgagccgtcgtcgccgccgcccttgccggcctcccccctccctcctccggccggatctgggagggaggcggaaggtgagccgccgccgccgagccgtcgtcgtcgccgccccgcgcgcgccgtcgccgccgccccgcaccgccgccgccggtagagggaggggaggggaggggagggggtgcctagacgcgcgttgaggataggggaaagtgtttgagggagagagaaagctgagtgagggaaatgagtggtggggaggggtggaggagaagataagacttagaaatatttggggtaggtaccattttcgcaggcgcggtttgagtggtccgcctgcgaaaat

SEQ ID NO: 106332 - DNA, 837 bp, Oryza sativa
  unsure (1)..(837): unsure at all n locations
acaaattaaacctccctttccttttggggggttcgggacaatccccctttccttcgaaaggccgggcccttttttccttcctgggcggactcccttttcttttctgggcagtcggccggttttccctcccctcgcgcagagtctaataacccctgggtcttctcctcctctccctcccgacaggtgggccgcggaccccaccgtcaggccctcctcctaccttcggcttcctaggccaaagccgccatggccggcggttgccgcccacgtcccgccaaatccggccctcccgctcgcgccctcgcgcccaaaccgcataaaatcggtcgccctccacgtctcctccaccttttcccccactctccccatggaaatcggcgccggtttgcccccgtcacgtgcccacgtcgccactccatctcgccggccgttgccgccccgttgccgcccatcccggccacgatctccctcccccgcgcccatttaaacgaccccgtgctcccctcatccatttccccattttcagaaatgtagtgcttctgagctgaagacgaagttagaggaccaaggctcagaccccagttgagttttgcctgtggagtggagctgaagccccgctaggatcgccttttccgctgccgccgcttttgtttcggtgtgaggactaagtgcctctcctgtaagtattttacgctttatttacgtttggaactgtttattacttgtcgttttgtgtaccctggctggtcctggacagagatttaatacacaaaatagtctggggtacaaagctngaattgcgcctatagtcatcaagtggatcatcactcccagtcg

SEQ ID NO: 106333 - DNA, 2562 bp, Oryza sativa
agggttcaaaattttggacttgaaaatcaaatcattgccaaggggtgggtttttttttcttaaaaaaagtcttccaaaggtaaagtttttttttttccaaatcaattaaaaacatcgtgccctggttgatatttgttgttttaaaaaaaaaaattttcacttgaatagaagtgcaacatttttttttgacaccttaattttaagacaaataatgtcgggtaggggcatctctttggaaatcatatatttaaaaacaagaaaattccttgacagacatagtggtagagctagtaaaagattgattctgcatgcacttcatgcatcatgttttcattatttctacactactttacaaaccttgccataaaaccagaggagaggaaagagttacaaaaactgccaattcagttggtcttgccacgaaaacatgggaaattatcaagctcttctgggatgcccttgaacatcatgggaataaaatatttcatatatttcttcgcgcctttgatttccgaatagactgaagaaaaataaccgaagaaaacggctagcctgcatcgagaatataagtaagcaaataatgtaagttccttcaactgcatggatcaaatgtccgacaccaagaacgtacatgttattcaaaaaaaaaagaaaggaggatgtatgtgaagcgtaattgatatatattacaaagtttttggccaccactcttgctaaccatgtacttaatcatttgtgttttgaaattactgaaaaaatcaagggggggggggtacttttgggtacttctttgatgataactagataatatcccacgctttgatgcgggaatatagaaactaactttcggttgaaattcgagtggtatgatatatttagaagatgtatgtatgaatcgaagtaaaatatgcaataataatggtgataaactgtgacagagttggtgatgcataatttgaatacatgctttgtcaggaaaaccaaacatatcaaataaaattgatcagaagatggctagaatggtaagataatatgaaattttgatggcattgttgtctaattgactgctagattaaatagagtctttagatgggtggagcagggattaatggtgctatttaattgctgtggaagtgtaatggacgaacatctctaatggctaatactaccaagactcaccgatccaacggttgaaactattttgatgatgtggctaaacgtggtgcctgcttgtaaggttacacttatataaaaagtacagatatataccaatagcattttcttgtaatgaatcgaattggaagaagaactctaataaattgtgtatacacacaatggtaaaaagtttataattttgacaagtaagaattaatgcataaggcacttggtggttatatatattttagcacatgataaaatagactataaaatgaggtgtgtgctatgaactctaaccagaccgaagagaacgatagcaatttgatacccaagaaaaaatcaggctaggatgggatgtaacattttctagcaccataaatctggataagtctctgttaagatttattgtactagaaaatatcacatctcatactagtttcgtttattttgagacgggaggagtatatttcaacgtttgtagggtttggaatgcacacacagatggtcgcaatggtgtgagtgtgacgtgtgaatcctatgcgcattaattgtcttaaagtccctgtctatctaaaataatatagttgactttgctcggccaacaaaggtgacttatactgacctgatataatcaagggggataatatttttgttgatgtccttgaagtacataactaccatgataactgcaattggaacacacacacatactgttagagatcttagacaataaattcaaacatcaaatgacatgtttgattgcaagataaacaagaaagatttcaaatactactatatctgtctcaaaatataaaaaagttttagaattgcatatggatattaagaaaattgatgaaattaaatgaggaaaggttatggttggttgagaaaagaagttcgatagagaatttgaatagcgaaaatttgtgattggttgagaaaataatataggtgaagaaattgttatattttgaggtaaattttggagaccaaaagttatattttgagacagaaagagtgatacgttgttaagaaaaagtaatcaacggaatgtttgactctagttaaatatatgaacatcattgacttcgagatattactcctatcggttttataattcttgacgtttgaagaatgacataattttcaaaatatatcttttgactatattttttaattataatatatatgataaatgatatattttttattatagtatttggtcttagtgcttttagctaaagttatttataattaaaagtataagagtttaactttaaactaatctaaaacatcgagaattattgttccagtgctttttagctttataataatcaaaagtttattcagttaactcttaacttattttaaaccctcagaattttatgaaaatatgcattagag

SEQ ID NO: 106334 - DNA, 1035 bp, Oryza sativa
tttgctcccagggatccgcagagaccaatgtgtccgggtgatgtcgatggaatgaataaggcgcccgtgctcaggtggggtgaaaacccacgcccacggctcccccaaaatcagcctgttgtcgtcgccgcccacgccaggagacgagatgccaacctgcgacgccgccattgcgccggcgagaggtattagctagttggtcgcgtcagcccgtatcatgttaggtcatacaactataattactccgtattatatacagagaatacttagcaaacgtgaaacatgccaaaatgtacgtgttcatcgaggagtgaaactcaaccatgctataattaattaggttcaaagcgattcgtagagaaccatatttgttccgtgttatcccggacgtagtcaatcatgttatcatcaggttcaataatacagcgacttctatagtagcccgaattttcttttttctccgtattacatacatgcctcaagtagtcaagtgcaccatcatatcgtatatcactcaaacttttctaaactgccgatcgcgcgacagcgacgacatcagcgggcgcaggccaatcgagttagcaacaagttcgcagaaaaaaccaaagcacatatatttcagatataaaatgggccagcttaaaatgtgccaacatgtgtcgatatgacgatatcccttcgagcatcacggtgctacccatcaaaaacaaactggatatatgtgtgacatagggcagcaaatcaaatcctgaatatatctagctaataaatccaaacaaactggattatatgtgtgacatagggcagcaaatcaaatcctgaatatatctagctaataaatccactgaacctatctaggtaaacttcctattgcctgcatagtatcaacctcaacctcctattatctgcataatgtcgactcctgggccaaagtactcttcacatcttcgatggcagttagctaccgtctgtataaagagaattccattagaaactatacaggaaatagggaaggaaatgtttaagtaaatggaa

SEQ ID NO: 106335 - DNA, 714 bp, Oryza sativa
acctaccttgggtgcccgttggaggggggtgaggttaacgggccaacgcacacttggagcggtcaccccccaccccctactatgcggtcctctacccctttctactcagggtcttctcttcctactacactgtaaaaggctaaaaaaatccaaaacaacgttggaaggcattttgttttgtactactgtatatcaaacagtgtttgaatcccaatttaaaatgggtacgtcaactttcgacttataaactttgggactataaactaatatgtgaaatcaaatttaaataagaatcgggtatgttaactatggactagtaaacttcgggtgtaccaactttggagatatagaagtaccatatataaataatctttgaatttaaattcgaatttggatcggatatataaacttttgacttatatactttggggctctaaactgtagatgtgtaaacttgaggtgtacaaagttaagtgcgtaaagtcgaaaagcactgcggcgctaacagaggaaaccacatggacgatggcttaggctttttgcgttggaaggttcggtctaccattcatatgtgaaacttgaccctgagaaaccagattcagactctcttggggatgatctctgacagtacattcacatgtgtgcgaggttgacacatgtatcaacagacacagtgcatgcatctgtctcgacatagacattgaagggagctta

SEQ ID NO: 106336 - DNA, 558 bp, Oryza sativa
tatttccagtttaaagaaaattctcaaaaaaaattccagtttaaaggaaaaaatgtttggactgaacagctacagagattgaaataatatttttttagaccctctcagagaaccatgcttatattggaaccaaagagattgataatcctcactccttaaaatgagcaatgctattttccttcagaaacccaggtaaataaatgaagctttgaatatcaaataaatgtttctgtgttattcatgcaaaggatcagtttcctggcatagtgataaccagaacaaactggatttcctgggctagatttggaatgcttacacggcagtctatttaaagtttaagtctgaatctttttattttagaatacaaagtctgcagtccatgtccacccacttcttcaatttgtggaacatatacttgatataacaacaattagttcaaccattaggaaatgatcgccaagttttgcctgcaaatcacgcttagcaaattacttgggtgcatgtttagcaaatggattttggaggcattaagttccataatgcacaatatgtattata

SEQ ID NO: 106337 - DNA, 644 bp, Oryza sativa
ttcagccaccatagtaaaacttgtatagtaaaacttgtttattgtcatccaacgagtaggatatttgccacgttgggaagagaagtatgtttggtccttaccacatatggacacattcagatgctgggcaaggagggttcattgtgtaccctctttgtacaataagaagagcaatctggaaggaaacacggaaaaacatcagggcattaaatggcaagtgtgcataataaatattccagtaaaccaagactgcggggaggttgatgattggtacagtataaagtatgtagaaaaaggctattttcttttgttgtacatagcttggtcagaatttcatatttagttagttataaataagtatgaaaatattaatgtgaaaggaaatctgtagtttttataatattcctagaaacagtgatagaatgcattctaacactgtggacttacatgatattttcaatgtaacctaccaaaaggttgaaagttcaaaccacaggcttaaagcacagcatcaacttaggagaaacaattataactgtcaactaccatgtcgcactacaaaactactcaaaatgatttgttgcattttctccttgcaatacaaatgtagtacttagataatcatgagcgcagggaggcactgc

SEQ ID NO: 106338 - DNA, 716 bp, Oryza sativa
  unsure (1)..(716): unsure at all n locations
ccgctgcnattgagaactatgctagatgcctctangtcgactctagaggatcccctgagctggaccaccataccaagggatcgccccaactaacatctaactatcacaagctgccatgctagctgactaccgggacccaccgggtcaaacctagccccttactgccatctattaactttatggacgagtatagaaccgttcgtacaaagagatgcaactaacaacaaaatcataactagcaagttacacgatctatacaaaaccatactctataagagatctattaccatactactaacatatgcatatgcttgagaggcccaacatacatgactatgtgcataaaaaacatgagtatcaacgcactagttatactatgatattatagctataacagaactgtgacataagagctattacaacataacaccctttaacggctgtacataccatgaaaaatatatagtacacacgcttaatacatagcacatgaactcatggctaataatatcatctcaaggagcatatgccccacatgtataaagaccattggttcatagacgaaaatagcaggcacatcgttaaatgcatagagcatgggctcatgacaaaaggtatcatcacagaaagcatatgcctctttctagacacgacatgtgacagcctatgtctctgaagcatcctcctatattctacacatatgacaggcagtgaca

SEQ ID NO: 106339 - DNA, 549 bp, Oryza sativa
accttgtcccttttttcttcaggaaggggggctttttaaaaatcaacgtaaggttttaaaatggggtaggcggtcgttccaaaatgggttgtggccaaaaacccgttataccacacctgtgcgtatatggaaaatttttgttaggcccaaccggaaaaaacatttatttccctttggaaccccttgaaaagattttacaaccgggtttggcgcggtcaaaattttaaaaggggcgccaacaccgtcactaaaaaaaattttgttttccttcttctaacacaaaactcttaaaaaaaattttgttttttcctcaaaaaaacctcgtgagggggtttttttgtcgcccctaatctccaaaaaagatctaaaaaattcttttttttggggttgtcttgggagaaaaccctcagggaggtgttggatataaagagcatccctcctctctttataaaagggttcacccaactattttatattttttgcgcaaacttatatagggcctcacatcttttttttatatttttctcccgcagaaaaaaaagagagaag

SEQ ID NO: 106340 - DNA, 833 bp, Oryza sativa
  unsure (1)..(833): unsure at all n locations
ccgcgtggcacatgtgttctatgtgacagaccttgcaaatttgaagaaagaaatagttctatcaggaaaacaaaagatcttgggagtagacggggtcgaagatgtcgaagattacaaccagtacgatagtatgccactttatacgtaatttgtacaaaagattaagcttgtagaggcatcaactcagaagaccatgaagccttacatgcacaaggacggtgtggggaaaaatgttaaagagtaattgtttgttctgtaatgatggtatgtagggggctatatgtactcatattgcacattattatgtttttactcacaatgcaattgttatgtgcacttatcatctttattataatatttatatggacttaccatttttattatattttataaaatcaattacatttttaaaatgttttttattaagtttttaatattttgtaacaatttttgggaaacttatcatctttattacaatttttatatggacttaccatctttattatattttagaaagtcaattacttttttaaaatgtttttattaagcttttaatattttgtaacaatttttgggaaacgtaccatctttattacaatttttatatgggcttaccatctttattataatttataaagtcagttacattaataaaatgtttctttattaagtattaatatttgaccttttctaattatttttgcaagtggggtgtccgcatgcgaaaaatgagtactgaagtgggggtgacatcttctcaggcgggtggcccgcctgcgaagttagttagnatgttcttcgcgggtnccagctcgatatgcattcatggccac

SEQ ID NO: 106341 - DNA, 760 bp, Oryza sativa
tgaatgtttttgaaaactaatctgtatgccttcatagtcgactctagaggatccccttcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagtcccggttggggccaccaaccgggactaaagtcccacccctaaatatatgtcgtcatcctccaccagctgcccgagcaagcttcatcctttcctcacgatgggggcccctgaatactcaaaagactttctttgcaatatgatgaaaaagctttggtcatgtggctagggattgcattgcctcagatcactgcatcaattgtgctcaagctactcataggaatgaggattgcatttttgatcagcaacctatattggtaaccaaattgtttagatatggagccccaggacttggttgtatactgatttagaacaccaaaccaatccctcttaaggaacacgcttatccaatggctctgacacgtgctgcgccgattcgacccgtgaacgccttgtgcatgacatttagggatttgacggagcggcgacactacagctgtacctgcgggtagctccacgagtggtgttgcaacaactttacaccaggtcctctacatagacccacaccttgctgacatgatcatgcgggaacgtgtgcaatgctctctatc

SEQ ID NO: 106342 - DNA, 1226 bp, Oryza sativa
atgtccccacattcacacgtccgggaaccaaaatttaaaatttaagcacgcaattacccacgttttttctaggcttatcaagcactgacgtacggcatctgctctagtctacttcaagtgcagtgcaggaggcagcgctggaatccaagattcgtggacggataattgaattatactatatatgcgttgtttcttggctttatttatggaggcgacgcatccgcctttttctaccacggcacacacatgccatgcctgccttcccaacgaaggaacaatatggtaccctttcctctcgaaaaaggagaaaaagagagggggtgagggtacgacgatcgacgatgactctccccggtccggtgcattgcatggacggacaaatttgcgtttccgtccatggtggtgcatggtgcatggtgcatcgcatggtacattttttttaaaagttttgtaagttactttcaaaaatcatattaatctattttttttaaaaaatatactaatacttaattgattatatactaatgagtcttttacgcgttcagaagaattagtttccatccttagggaggaaggccggatctttgctggtgggctccacacactactacggaacgtgtaaccagcagtaaccgcggccatctgtaaccgcttagctaagacagtttgcaaggacataacctgtaacacttaattatatagactgttatagatagaggtaggatcaaacactggttactgacgacaacctatctgtgtaatggttcaatattctaaacctattatagattttattctaaggcaaattttgctacaagacactgctaatgtgtggttttaatcttaggatactgcctaaactcacttttgggggaaaacactgcataaacgtggtaatttggcagtggacactgggctgattaaaaaaataatatttcggtttaagaggtgagagaaattacgtgaaatgtcaaaaatacccttgggcccacatgtcaaatgttctctctttgttctttctcccttcttattcctacccttcggcgcggcctgctcggagacaagagacatgcccggagcgcgaccggtttacttgataccggggggccgtggaagaacttcatacttacatggccgcttccttcgttcaacttgggcgcaataattcacaacgggcccagccggccagggctaaaagacgggcgcgccagccattaacggccaaa

SEQ ID NO: 106343 - DNA, 734 bp, Oryza sativa
  unsure (1)..(734): unsure at all n locations
cgcgcgccatgaactgacaacgtcacgacnngtcngangngantttaaggatcccctttctggctggcatagatttctattatctctgtccaaaatatatcttgtattacattagacacatcctagtaccgcttgttcagatttgttataatagggagcgatgaattcggttatattttaagatggaagaaccactgtttattgatcagcccattgggctatattcttctttaatccaggaatacgttggtcttctgacccacttgtcatttggcctgggcttcaagccattgtaagcccactagatctctcatctgtttgcctgtctggggttgacatgtaagatgggttagcccaatggcccagacgaagaggtgaaatggtgaattgacatattgtgaactaatgccttctttggaatgggcgaattttgcggggttttgaataaaacaaactaacgccttgtttagatccaaagtttttctttcaactcttaatttttctatcacatcaaaacttttctacacacaaacttctaatttctccgtcatatcgctctaatttcaaccaaacttttaaatttttgtgtgaactaaacacagtctanaccctgtgaaaacactgcaattttttgcgttccatataaggtgcccaaactgatgctccgagactgagcatgacaatactgaacggagggcttattcactttatgtcaaaggaatcttactttttgt

SEQ ID NO: 106344 - DNA, 744 bp, Oryza sativa
  unsure (1)..(744): unsure at all n locations
ccggccctgaactgacaatcgtactcccannngcngnnngtngantttagaagatcccctatattaatataatgttataaaatgtatgaaaaaatttaagtttaccttggagaccatgaaatgccatagcaccaaaaggagtgggatattcactgatccgtgtaggtggttcattatataattgaaatgaagtatttgctccacccttcaaaaataagttttctgaacaaaaatatcttatattgtattccttaatttataacaacagcgcctaaattgttaattagaaatattgaccatcattaattacgtaacattttccctaatttgattattcataagtgcaaaatattattgcacaaattaatttaacgcgaactatgcacagctaactgcaaagtgaaattcataggattaaatatgcatttagcttttaaaacgcatagaaaatcctaagccacgtgtcatggagtttggctcaactatctatatatttcacaataatcatataagatttgcaaagagaatatgtgtgatgtaaggatgaaagatactgctcttaatatatgcatatatagcaactgcttttttttttcaaactatatatgctcgtaaccgtccaagtagagatggatgagcttctatgatccttcatggcatagatgggacttgctacgtgcttgccctagcaatggctgttggattagctcaaaaacgtaatcaccgatggaagagcccttttta

SEQ ID NO: 106345 - DNA, 743 bp, Oryza sativa
  unsure (1)..(743): unsure at all n locations
cggccctgaactcacctcnacatcccacangccngcangtngattttagaggatccccggaatggttggcctgggttggcttgcgacgagctggctcccttggtcaggttgccacttcggtctgaatcatcacaagccttgggttaaagcaggttcgtgtgggcgcacagcttttataaataatattgtatagctctagaatcgtgtttactaaatagctttgagcaactaaatatctctcaatgctggttactgcaaccctaaccctttatagtataactcctttgtactcccttgcatttattctgtacttgtgggtgtgtcttgatgaatacggtgggtgtactcagtcttgctcaatttttcccaaacccagactatgagcccctgcaagatgaaggctatggtgtctatctcgtgcctgccgacaagcgcctgtggtccgcgccctagccttccgctgtttctcattgagctctgagtgtgctgggccttcgctgcccatgtaataaattaactatttacgctttcgcttgttcaactctggattgcatcaacttttggtgtacctagcctcctgcgacaaggattaatgcacgcacgtaaggaaccgcccgtgggttatttcccgtcgtgacaaagccactgtggtgcacgattcgcaacaatcattgactgtgatgaggatgggttgtagatcctcctgcatgaaagccgntgctcaagattattgcttttgcgga

SEQ ID NO: 106346 - DNA, 749 bp, Oryza sativa
  unsure (1)..(749): unsure at all n locations
ggggctgtttagtacctcnactggcancngccngaggtcgactttagaggatccccttacaaactacattcaacgtttagtctaaatagtgcttgtcactgaaaaaagtttattactgcgagaagagtgaaaaaaggagtatttcttggccaatgtaggcatgacaccaatactgacctaaccctagtggaaccaacctttttaagagaactagaattttagagtatgcttattaggacaaataccaaaatataactccggacagtcacaaatacttatccttttggacattgacactatcttcaaaatgcaactttgaccattaatttctattttaatgtattcgtgaaataaaacaaatatataatattatgataatacttttgaaacaaatctacatgcacgggttttatatttacaatcaaaatattttaaaaagattggatccaaggtatatccagaaggacaagtatttctgagttctgaccggtgcgagtatatttgcagcgcttcgggtaaagttcaaacatgaaatgccaactacttgaaatttgacaagccatcttaacattttattgctacgttggacacttaagcacggatccaatagctctaacctcataatttttggtaggctagtttgtaactgcaaaattgctttactgtgcaacaatgaaataacacagatgtattctgcacctaataaaagaatggggggaccctcaactcgccaccatgatccttcattt

SEQ ID NO: 106347 - DNA, 746 bp, Oryza sativa
  unsure (1)..(746): unsure at all n locations
gtgtccatgatacgtacttnacatgncanaatcnnccttngnnttnataaagccccaccggccccatcaagtttggcattttatatggaacttaaattttttcacgggtttcacaaggctcaagctccacttagttttgtcaaaaatttaaaaggtgggttgggaataaaactatatcacngaaaaattacaagtttttccttttaaaatttttgatgtgatccaaaaattaaacagtctgaagaaaaacttttgaactaaacaacgcattagtttattttattcaaaaccccgcataattcacccattccaaacaaggcattagttcacaatatgtcaattcaccatttcacctcttcgtctgcgccatttggctaacccatcttacatgacaaccccttacaggcaaacagatgagagaactattgcgcttacaatggcttgaagcccaggacaaattacaagttggtcagaagaccaacttattcctggattaaagaataatatagcccaatgggctgatcaataaacactacttcctccatcttaaaatataaccgaattaatcacaccctattattacaaatctgaacaaacagtactaggatgtgtctaatctaatacaaattatattttggacagagataatagaaaacaatgccagccaaaaagcaatacttgacacactaagtaaagcgatcttttcttctcaagacgaacattaattttttacccaaacaagctga

SEQ ID NO: 106348 - DNA, 747 bp, Oryza sativa
  unsure (1)..(747): unsure at all n locations
cgtggaccttgttgaatgacaatccacctggnacccgngancctccacaaaaatatacatccggggagaaagtatgtgaaatgacagagaaaatagtttgcgaatttggaaaagggactaataaaccttcaaagggtacaaagcgcaagaaacctgacaagaccaagaaaccagaagttctgtgatgataaattttgtactaaatctgtagttttgggatacacatatttaaatctgtagttttgcaaatagtttgattaaagtatatgtagttttatgaaatttaatttactctattttttactaactggttttgatatatctaggaaattctagtgaaatttattggccggaaatgcactctaccatcaagctaagaggcatccatgcatgcatgaagtgaaacatgtaatgttcttacttgttattttggataccgacattatctcaagaagacgcgaatattagggaaagtcctaatatcaaataattaaaaggagtgaggctttaaacccaggtcgtctagcccatcaccttgtagagctagccggaatactctgggcgtttctccaccgacattatctccagtgcagatttaaagctattagaatataactacacgatgttatttttcatgaaaatcgtctactagtatgtttttacatactaattcttaatattttttttgcatatttttattttagttatgcataagatttcgaggggatcctctagagtcgacctgca

SEQ ID NO: 106349 - DNA, 800 bp, Oryza sativa
ttgcttttgtcagtcgtacatgagacgcttgattatgtgagtcttttacccctatgccattaagaaagttgctgcttacctgtgtgccacaaaaaagtttggagttacgtgtatgccatgagcccaactttcgttgactcgtgtgccattttggatgaatggagacataacagaggtgttaggggctgtgtaaagacagttttgcccttgcagccccaccttcttccggcacgccacgcacctgttcggcttcgccggcgccgtcgacgatgatgcggcggcggttgcctcctccttccccttgagcgacgacgtcgggcgccgtggcggccggagtcatggggacgatgatgttgggagtggaggcggtggcggtggccggcgacgtccccttgaggtggtcgcggtagcacttggagcacatgttcttggtctccttgctgctgaagaacccacagctgctcgcgcacagcgctagctgctcgtcggcggcgggggcggccgtgctcgcctcctcctccttgttcgcgacgtcaggcgccgcgggggcaaccgccgctgacgacgccgcctccttgagttggtcccggtagcacttggagcagaggttcttggtcgcctcgctggcgaagaacccgcacccgttcgtgcacataggcgcgccgccgccgcccgccggcgctagctagcccgatgctacaagtggtgacggtgtaaccgcgctccggtcaccggagagatcagtcgtcagccctcgcggccggtgcttgttgaagagatctccgcggcctgggcgcacg

SEQ ID NO: 106350 - DNA, 1411 bp, Oryza sativa
caggaaacttagacactaagatcaagcactgttctatgaatatggttgtctttcctatgattttgcagaaccccagtgtgtcagtatctgtgaatgtcatgtcgtgcttagtggcaagcaacgttgaaggctccttctgtccaaaaagtgggctgacctttcttttgtttggactctgatatgatcttgaagtgtgcagttgttaggaagcatgcacagagatgggcagcttcaacatcatggggattggtgtggcatagatgcatcctactcccggtaatggtgagtagtgtttaggatcgtttttatcgctgtgctttcagctactgtctttatcagttatcacctcacaaatgcgcgttgcgcctgggcgcagtcacagatagttgaacagctttgggttggacctctcatcaccctccatgtaatttctggataatttcttcccatgatcatcttctaaccttaaatacttttttttgtcattttgtttggaattcttcagacatatgggagtagtaacttaacagtagttaatctgtagcacgtttccgtttcgtgtctgattgtgatggctcatggttcctagtctcataagcctctaatttctaattatctgaatatgattgattcctttgcctcgtagacgtaagtgcttacgacagcccggatgtcagtccccaaaaattaatgttttgtgtgtgtttttatatagagctggttccttcgattggcattttctgcaggtattatttgctggtagttgtgtcaagggcttggaagtcaagcgttgacgtcagtgggcccacatgtcagtatgcgtataatttgttgaattgtttgaatagtcagagttcggtttaaccgattatatatttttaccatgctgtggccatttccttctgctgattcatttacatgatacattgggaactggaatatgtccatgtataaagggtcctttatacataattttcacagaaaattttaggcttgaatgcatatggttgtcaaacaatcaaatatgtcaggtcagatgcactgtaacgattagctatatattctcctgtctatttcttttttaaaaaagtcaagatctcccgccaatagttatgtgaacgcgctgatccagatctttgaatggaactcttatccaagttaaaagagcactccccgcgtcgctacaggatgattatatatggataaatggctttaaaaatacatgcaagttaaagaaaaaaagagtacgaacaaaagaaaattgaagaacatgaactcttcaatcacttgggagattctttctactaaaagttaaaactgcataaatgcatcataattccaaagataaataacatgtatatagaaaagaattaaaggattttagcatcagtttcacatcaattggggcctt

SEQ ID NO: 106351 - DNA, 662 bp, Oryza sativa
tcagatcaaacagacaactggacataatatcagagataattgatctgtttatgccagagatacatggttttctttttcaaccacaaagattaaaaaaaacaaattatgatgatcctaatggcaaagaaaatggatagctttgatgcttgtcattggtactgcaaaacaagtggtatttcaacagccagaccaattataagatgtgggcaaaccctcccatcaagagataacggtatgtccgaaatcatagggcctgttcagtttgtagccaaaataaaccttaccaagttttagcaattccaaaattttggcaagatggcaatattgccaaaataaattttagcaggatttcttatgtattgaccaaatttggcaacaaactaaacgtagacattttttggcaactttgccaaaaaaaaatggtatggttgaaaatgacatcaaaataaacaggcccatatatgcacagaaaacactgatggtgatgtaaagttgccagcaaccagaacttctagaaaattcttcagcataattgcagatttgcaataccatgacttcactaaaaaaatctgcactatcatcaacattgccagaaatacagaaacatagcaatcaaggttctaaataccaactggcaggcatatagcatctagatacaagaa

SEQ ID NO: 106352 - DNA, 873 bp, Oryza sativa
ccagtgcgccctttcgccatcgacagttcgttttagccacggagcttttgctggtaacctggtactgctagtaacacacagagctgctatctgctactagcaggtttataaaaccgtatgattattacgtggttattatgtgcgataatcttctcagtttgtgaaactgcgttatacctcacggctacggttttttaaccactaaaccgtgaggtaacagtaaccccacttaaaacggtttggtgaaccctggttagtagtgataagttttatcccaagaaaaaactgtcattaaattgtacaaaatcttcacaacatgtgacttattagtagcgacaacattttttttcgcgaacgtgcaaaaattagtagcgacaacatacaaattgtttttttataagagtaaattacactcacggtacataaacttgtgtggtgagtgcaaatagatacaacaacttacaaattgctcactttgatataataacttggctatttggtgtgaaccgggccaaaatgatccacacaagtaaaattgctctaaattagtgcacactaatgacataacagcatatacatataactgtgatttggagatcttatttcgaatccaaataaaaatgtgcaaaagtttatttttcatgtccatggtacaatatttgtttcattttttggaaaaatttgatcatctatataactcgtctaatgtttatttatctattcaagaccaagacaatttttatatgtactattaactactaaaagaaaattttaatttttatgttcatgttctgacactttcatcgaaagtgtattttaacaatcaggtatttttaattattttgctttttcgttggtctagatcttgaaagt

SEQ ID NO: 106353 - DNA, 1585 bp, Oryza sativa
taggaggtatctctggatgggctcctcaaaatctgaagcaacccgatgaagatactacagcccacaatgggtatcttggcccaaagtaaccccagatgaaaaatccccaaataaccctcccagcccattcttcttttttccttctcttttcttccaccctctcttctcacgtcttctttcttcttcttctcgccctcctcgtcgaccattcgccgcccccgcctcccagcctgccgccgccacctccctcctctctcccccgccgctcgccgccaccgcttccctcctcgccctccccagccgccgccgcgcctccctcctcgccctctctagcagccgccttcctcttccctccgcctccaccagccgtgtcccaccgtcgtcgcagaagtggttccagcgccggcggcggcggatccggcaccgaggcgggcagatctggtgggcggacgcggccgtcgaggtggcgggtgcagtcgtcgccgggtcatcgtcattctctccgtcgcggaagccgagccccgtgccggttggtggccgccggctgccgcggcggtggccggatctggtcgtcaccgtcgcggatcctcgtcagcgacgcctctctcttatctctctctcgatgccatgccgccggtgaggggcaagaaagggaaacgccagaagagaatgtaggagatggggcaccgggtcgccacaacgcgtagcctcgagggagtgtctctggaaaaagtgagctggggagctagaggggcgcgttccccgcgtgagggtcgcacctccctctagagacacgccgcgcggacggacgggggacggcatgagcggggggacgacccagggacaccgactgtggatgggctaagaaattttgtttctataatttgtcccgcaatataagttactatttggaatcccaagataacacaatccctttcccattcatcaatttttttgctccctcatccataaatataaaagattttggttagatgtgatgtatcatagtactaaatcctttacatttagggacaaggagagtattactttattcttccacctatcaactctttgctaatttattccacatatatcaaatcttgtacaattttatcctcctatctaccacaatttgtattattttatcctcctatggtacaattgtgttaactaaggataatttggtgaaggaattagaatgatagtttaagatgttgttttttatgaaaaatgaaaccatctaccatctattcattgaatgtcattttttgagatttctttggagatatgtacacatttcttttgatttacatcctccacaaagtatgtctcatatattcgggaattggcttgttggtgttgataaaagaattaagaatcttattcttgttggagcatccgctttatgttgggctctctggcttagtaggaatgacatggtttttgataaatcaccatcaaaatcttatttacaggtacttttgagggcaacgtattggctctggtgttggacccaattacaaaggtgtaaagaagatatcagcctaattaatgatgcatgtcctaaacttgagtcaacgattat

SEQ ID NO: 106354 - DNA, 1469 bp, Oryza sativa
  unsure (1)..(1469): unsure at all n locations
aacatatactcattctatccaaaaatctaagcgctcattctatcaaaaaatctaagcagtatttcctttgtcacgaagacaaaagaggaatttactcatgcaaggaggaattaactcatacaccacgtgaaaaaaattaataaactatatgtatgcatgcacctaatgagtattaaaaaggctccctaagttctagacaatatttaatttaggcacataaaaactataaatatgccatagacttcataaaaataagaaaatgaaaaacgacttagtcttttggatcgtgagagtatatcacttcttttttttttcactaaacccaatacaaacaaatacaaacatttatgctcgtataagtgtatctacatatacaatataaagatacatttgcacaccatatacttatgataatccccaagagactaggccgacacaggccttgtttggaagattagcccagggctaattttaagagctaatgttggcccctttgaattggaggaaaaacataggaattttagaggatttcaattttatagaaaaatttcctatgaagccctttgaaacaaaggattgaatcctatccaatcctttgaaatttctatggaatggacaatcctatagagattttggagaaaatttagcaagagtttcaacctcttggtaactttcctttgagtctatctctctcatcctattcctgcatttttcctgcggttcaatcaaacagtcattcttgtgtttttcctacgttttgcaatcctctattttccacttacattcctatcaaaatcctacgtttttcctattcctacgttttttcaaccctgcgattcaaaggggcccttagtcatgaattggtaggctaaacattagcctaaagtggtatgtttggatccatgagctaattcaagactaaaaggtggagagagagtaaaaagagaggagagagagggagagatanagctgctttttatggtccccacacaaaattagccccattagagcaggttcaatagtgctattaagctggctacaaaacttacaaatcagcttaatctgtgattaatgaaagaaaatcacaggaaaaggaacaagcagcgcttgttttagcgccggcgcttgctcagcgcctgaaactgtagcgctcgcatgcagcaaaaagacgataaaaaatacatttatgtgggtcccacatggaaccatgtaactatttaatgtatatgtatgctttaaccaatgcagcttatagctaacttatagttagtttgttatatgagttgtctccttaagttagctctattttaacatgataaaattttgaagcttgctgctagctatactattgaccttgctcttagcactccttgaaggggctaatgttttgaggggggcttattcactttagcctcaaatagcccacctgtttggatacttgagagctaattcagggctaaatgatgggg

SEQ ID NO: 106355 - DNA, 685 bp, Oryza sativa
aacggcaccggccggccaccagctatgagcttaatagctatccatgcaaggtctttgactctttgacacaagcaagcgtcaggttaagaggtccagaagtttcagttcaaaagaactttcagatagtacagagggctgtaacttgcaaaatgggtgggcacttggtgttgttgagatgggtgaaacaaaaaaaaagaagttttgaataactgatcaggcaccagcggatacttctcttacatgtttcagtacatcccgttcaccaattaacgacctaatgcaagtttataaggtacatagccctgttcgtttctgctcgtagcagaggatgaaattttagattatcgtggcacgcttttcaaactgctaaacgatacgttttgtgtgaagattttctatataaaagttgctctaaaatatcagattaatccatttttcaagtttgtaataattaaaactcaattaatcacatgttattattacctcgttttgcgtgaaacacttgatctttattttcatcttcaggagattcaaacgccaccatagtctctatataccagatgtagatgtttgattaatttctttttctttgtacgaaaaaaggaattcgaaaattatttgtccttgcttacacactaggattggcatttggaggtttatttgcctgctagacgggccaaattgg

SEQ ID NO: 106356 - DNA, 714 bp, Oryza sativa
gcccgaagagattgaggaagcaaaatagacttattccatgaagaagcacgatggactatcgttccttcgaggcggcccgagtcttattgggtcgtgcctggaccattggtgcagcccgtgggcgagcatggcccagctcagcgtgtaggtcgggccgtgccggcctgactgatctcagctcgggcccggtcatggtcaagccgtgacaggccgggcggctcatttggccatctatgtgcataatgaaaatgctacgtttgggcctctatgcaccgaacactcgtgtttagattggaaaatgcacaatttgacttcctcaaatatatgtcgaatatgatttgtttcacttaaccttaaaatcgggtataccgatccattcaactagtaaaaccggtgtaaaacaactccttcagcagtattgacagtggttgtccacatgtcacattaacctaatcctcatctgatgcggcatctaagtggcattacaatcagaaatgaacaaaataaaatgtacgtgagacccaaaggtcagtgacaccacttctttatcctttatcctctcctctttcctcgtggtggaagcagtgcggcgtaaggggcctctattagcccaattagcgtgggggaagcagtacagcttgatggcatctattagcccaattagcccaactagaagtataagcgcggcgccacgccgcgcacagcaacgcacgc

SEQ ID NO: 106357 - DNA, 625 bp, Oryza sativa
acaaatactagatatggacctgtgtggttggttggatgcctaagcaaaataggagaggagaggaggattatttggatggagcaacttagctagaaacgattgattcttttggaaattcagaaaattatagattgaatgtgccacatccaacccgaatcccttatattttggaacggaggattataaacatacaaaatagcttagaaaaagtggttcaaattaatcattttattagaagcgtggcataaataatcttagtccaataatccatttggaacatggttatatgacaaacattttgattagtgccatacattcaccggttggcacaaaaactaagcccaatttgtatctgcatagttattccctccatcccaaaatataatcacttatcgagctttttcaaagattagggagagaggtgaaattaaattggaatggttgttggttgatactactaggaagtagtttgcaaaattaaatgagagatcattgccatttgctgagacgaggaagtaaatggagaagttgctatattcaagcatgcagtttaaatgctagaagttactatattttgatagggagtgagtacaaatttttgctaaacatgtgtatgtatgatttc

SEQ ID NO: 106358 - DNA, 1166 bp, Oryza sativa
  unsure (1)..(1166): unsure at all n locations
ggcctgggacatttttggaatggaaaggtattgtcattgctgataggttgccggttgggaatttttagtgcccccacggcaacaggggtgatcgggattgtttaatcatgcattcctggtcacaattcgcaatcacattcatgtggaataaaattgatgaacacgctttgctgagaaaaaggaagaagagtgaactaatacgtttttcaatttcggtgtatacattataagctttatattaccaaggggcaagggaaagtttagtaaattatcgcgtatggcacagccacggatcaaaaacaatgtgagctcaaatgctatgtctcggaaacatgtccacctctccatcttctatttgtgttccaatgcttatgtcaatcaatcagattttggtgatgcacgcatcagagagaatttttcccctagccgtgattttcctttctttctaacggttttgaaattgcaagtattggagtatatcatcattctactattatcttccaatgctacgaaatagagaaatcaagcagcgaagaaacaaaaagatgttacatgagatgacaaattaaagcccaattacctcgaatcatatatcaaattgaatgtcgcaaagatttcaacacacgcctacagcgttctgaaaagaaagcccaaatgctcatagtggctccaaatataaatcaggacagcatagtccttccagcatcacttccctccagaataatcttttatatcccataggccattgcaaagctcattaagataaaagtaaatgacgatttaataagaatatgcagcattttcaaacttgcaactcagataaaacatcaacaggaatgagatgcaaatgagcaaattgagcacatatttaggttcaaatccaacttattcataaagcatactgctgtcccacaggaaactgtttcataaaactaacatatcatacggactcgatggtccattaaaccagacacaagtagacatcagccccacaaatatttgatgaacataggctcgggccgaccaggcacatcggcagctccaccaaactggctgataactgaccaccccgaaggcggagcaccaggtggagggtgcactccttctggatgttgtnnnnnnnnnnnnnnnnnnnnnnngcacatcaacggaaactcaaccagggg

SEQ ID NO: 106359 - DNA, 860 bp, Oryza sativa
  unsure (1)..(860): unsure at all n locations
ccgcgttgatagaacngtnnnnnnnnnnnnnnnnnnnnnnnnnnnnnnncatatagcaagtatgatgaagaaaggtcttccataatggcatagtcccaatatcccatacatatactagcatttgctcagatatcttcaatggcgacttgtgaagaatcacaaaatgtttgaatcaccagtgagaataatacttccaatggaactagctgatgcaccataatcatataatgtgtgacccagtaattgcaaagccagctaatggcatgattgtatcacattgaatatattattggcaatcattcaatggaggcatcatccaagatcctcacaagttcaccttctggtacagcacaagcattatcgtcaacacaaatcgtcgaaataccaagtgaagaatttatgaaaaaggtcatgctatcctctggcagcagttgagtcaacatatctgcagagtctgctagtttgaatgataattaaatcaaaagacaaccagtaagaatgccacctaattctgcaacaagcttccacttgttagaattattttctatctgcagcaactggtggttgaattcaagcactcgtataagaaatacagtaaaaatcacaaacgcaatagaacaagacaaaaaagccagcaaactatcgcgcgaatcataaagaaggtttacagcaatgactggattctctcctaagtcctaactccttcatgggtatcgaatgtcctcttaaaaggcaacattccagcaatttccactttttatgacattcctttnttgcatggaagccaaacatcgcattcgggcttaccgccagtatgtcacgttcttcagaaccagncgcttagttcaaacttttcatgt

SEQ ID NO: 106360 - DNA, 1616 bp, Oryza sativa
tatgcacgcagccgcagcagcatcggtgagacggtgatccacgctccactatatgatctgcacagaaagtccgcacgccgcacgcaccaggtgcacttgcgcgaccggccttgacgggaacagccaacgagtgcactgtgcagcgtagtcatgtctactgaaaccgaggtcacgtgtaaagcggcaagctgtgttgtagcatggtgcaaacaccttttcctccaattcagtcaaaacactacgaggttttgcaagacctaagtatccagaagggaaaacactcattttgagtgggaactacctttccaagaggaagaacaccttcccaaagggaaaataccttcccagaggaagaacactcattcgaatagaaaatacctcttcgggtgaagaacacctttttagggacatcccataatcgctaatacaactacacatattttggacaagttacaatttcacaggtgttttccaaggatgaaagagaaggcaaaggggaattcgaattcccaggaggaagaagacggtccaggacggaaaaggcatttttcccaagagttcgaggaagagcactactcgaacaagagaagatgccaagggaagattccgtggggaccaccttcaaccactctcgccagctagcacctaaaagactaaaagacccctggagatgtactagaatgcccccacagacgctgatgtggcaggggcattagagtaaacttacaaagacccacaggggtaaaaatgtaatctcacgtgtacgaccactggttataaaagccagtcaaaaacctgtagcaggacaagacatcttgaatacaagagtaatcctcaaaagttgtgtttgctgttcgagctcgtttctaaggataggcgggaaaacacttctttccggcctatccccgatcttgttcgtgacctaaggtcacaacagtggcgccgtccgtggggacggaaagtctccattgaattgggctcaaacagtaaatgcgacgttctcaacgacagaagactgtgccagtacgctatacaggagcttttgcaagcgcgacagctgcactcgagagagagtgggaaaaggccgtggaagaaagtgacttggcaagagcaacggaaacacttgataagcagtgggcagagatggccaagacatccacagcagcaggaggtaatgaaacaactcaagaagaaggaattgctggcgcggtggtggaagaaacagggaaaacacccatgagtgatgtagagcttgctgaattggtccaagcgcaaggggctgtcatggtgagtaaaggacaatatgaggaattgcaaaaagagttacaaagattgcaaaccctacacaatcagacagtaggagcaggagggtcaagtgaccagtgtgcaataccaggggctagggaaaagcaatcagatcaggcaaaaggagatgcccagggggagaacaaagaaggagaaagtatcaaagccacccaagctcaagatctaccacgaacccaagctcccagtcaagtacaaaacccaccccaagctcaaattaccatccctactcagaacctagctcaaaccttgatcccttagccaaaaccaaattcctattcaaacgcacattt

SEQ ID NO: 106361 - DNA, 694 bp, Oryza sativa
  unsure (1)..(694): unsure at all n locations
aagaaagagacatggggtggaagagagagatcataccatggagaggtagcttgcctgtaagtcttgcccgggtccttcttcacctaacttctgtattaacctataaaaaatccccaattagaaaaatcttgaataaaccagataacttagggaatagcccagatattatagatctgggacaaaggagcttgtgggaaggaattgacctgaggagggcagcgcggcccctggccatcgtcgcgccggagcaactgccatgggtgaggtggcnnnnnnnnnnnnnnnnnnnnnnnnnnnnccggcagtctggtatccccattgctccggcgagtagggcaaaggagaggatgttgcggagggagggctagagctggagcagcaggaagagggggagagccgcaagtacggcggcagcaccgaagtggggaacatgacctccagacgtggcggcagggctcgtaagtggaatattcgggggagtatggagcaggtggcgctggatctagctgacccgcgtttgtcggcgtcagagccggtggatccgttgctccggcgaggagttcaaggggaggaggagcgggaggatttggacgcgccgacgcggagaaagggaaaagggatgtgtgaaaggtgttactctgggaggaggataaggttggagaggcgccctagtaagataaagatggggaaattg

SEQ ID NO: 106362 - DNA, 654 bp, Oryza sativa
gtgataattcgtcaaaaaactcctataaatatttaaaatatgtagcattagttcttgtcatatttcaattactgtatttaggaattcccgattctgtgaagcctgtgttggtttatgagtacattatatttttcggattagcttatttatttgctattcttcaagatttttttaatccaagtaaaaaaacagatctattattacgtgtagctatcatcatcagtttaattgtcttggctattacatctatctactataaagccacgttctcaattgctttttctgtaataatgtttattgcgttcagtttttcattatatgtaacaattaagctaaacaaaaaaaacaagcaaaaggattaataccttttgcttgttttttaaaattaatggtacgaatattttgtttgtgttgagtaagtaatattgttaccactcgcacctacatactccactaagtctgtagttgttaaaatgtgagtaccattacgcttcgcacaatcgtttaaaacggattgtaactggtttttattcggattttttaagaacattgcaacaaatccagttatcgtaataccaaagccaacaacttccaaaacttttgccatttttggtgcaatatatttagcaaaagccgttgctactaaggctacgc

SEQ ID NO: 106363 - DNA, 654 bp, Oryza sativa
ttgaggttattcaagcaacatatgaaaatctgggagtacaaattgcaatgcggaacgggatgctatatgacaaatcacaacgatggattgactataaaatcgatttatcagtaatgagcattaaatgctttaaggataacacttgaaaagctgatgatagaatgtttattagtctacagtctatatttattaaaagagattaggcatcttaaatttaaaaataaaggagcaggaatggtattcaagccaattcctgtttttgttttataataatattgttcgtgaactgagacattctttacttggtcctggttgtggggggaatttatggaaaggaatggctatgttacattagaaggtttattatttacaactcttgatataaagaaaataaatctgactcaagaaatccctatatttgaccagaccttcttagcccagcagggccattctaaaaaggatgagttagatttattcagctaaatagttagaaaccaattaattaagaaaataaatgatgaactctaatgaattaaatatcatagtattttataaaagtataaatctaatgtttggaaagctctattttgtaagatactagtcattcttatacagtgatataattgaatccataaagtcctctaaatagaagac

SEQ ID NO: 106364 - DNA, 1114 bp, Oryza sativa
gcactgaattttagtatggaactaattaaaaccaataaccattcagaaatatatataaaaatatcaaccctatctattgaaatttgaaaattttgtgcgatggttgtaagaaactgtaatacaaatggaatggatgtactgtacaaaagatgtacgctaggaattattagagaatggcaatagaatagctctattgccccattgtatgtatgatcaataattgtagctcctattaatctttgtcgtcataaatattgaagtgtttgtattagctaacactttttttactattcatgtgtaattttctgattatatatagctgttgaaatgaatgattaagttttgtattgattcaaccaatatctttaattattcatatttaattttatgcttatattcatttctgactttggctattttttgtgcttatataattagaagtgttaatatgccatcaaagagaaagcaagatccaataaaaatagcagaatatgataaatcagattgcaagaaaagaagatatatcagactacaaattctaagagagaaaaagcgaaaaagagaagaagaaaaaaaatatggtgcataataacaataaaaaatgtaagaaagatgaagaagaaacatcaaaaaatagtaatataagagatataatatatacagaaaagcaaaaaaatattaaaaataaaagaaaaatacaatataatttagattatctagaaaaaattgcaaaaaagaaatgtttagagatagaccatatatcttcatatttatcaactttacatggcatggtgtcctttaccccagaatacattaaatatctaaaagaatcatatgaaaacaaatcatttataggtatgccagagtataaatgtaaacattgcaatgctatattttggtttgaagaaagaaataaaagagagacaaagaaaagaaaaggtgaaattatatattcaaattgctgtaaaaataacaaaataaaaataccaccattccagaacccaccagaaacacttgctaggttacttaataataaagaagataatctatcaaaacattttatgcagaagattagacaatataatagtttattttcttttacttcaatgggtgg

SEQ ID NO: 106365 - DNA, 660 bp, Oryza sativa
gccgatctggctgaagtagtggagggcagggaaagggacgtgggggaggacagagactggaaggcatcatggaaacctttgacaaagctactcagccttataaacaattgctagatgctgagcaatgtcatttccacagaagcaattgtccctagcctgaactgatgctataggctcctaactactgttttaatgcccagccagttacccatcacccacgtgcccttcacaggacaggtcttatcaaagcgtaagtctgtgcctaccacgcctctgcataaaataccacaatggctcccgaagccctcagaatgaacgtctttctgtgatctagcctgtaacactatgtacagtctcatcccctgacacccacccctactaccatcttgggccatttttgttctcgtccatactaactggtttgtgggtgatctgtcatacatcctactgttctcatctctccaggcctctgctcaggctgtgccctctgcctggaacaccgtctgttcttcggtcactgcgagaactcctgctcatcctccacaggaattcattcattaagtcgctattcactgggctcttattgggtaccaggcactgttccaatttctaagggtgcagtggtgaagacagtcagtatggctcctgtcctcttagagt

SEQ ID NO: 106366 - DNA, 863 bp, Oryza sativa
gagagaagagcggagattgctacttagcacacatgtgtatctcttaaaacttttctccgaaaaccttaatttaaaaagtttctttctaaaaacttcatataaaaaacttccgcacgaagtgtacacccaaaacccatgttcgttagatagtaattttggagataaaaaatacactggtagcgagcttgcggcatactctgccgacttagagcagacacggtcgagacaaaaaactgtaagaagcgtaaactcgacgatcatgttctgcactgttctaatttgggattttggatgggccaccggccggctgggccatatcctacatgggctcgtaagctagatgtcctgcctggtccacaggaaacgcgttggggcagccaagtctgagctgtgctctgtatttcggcctgacctgccgtaacgccgttcactgggatgctctgtttgagtgtttctacaattctgctctgatcgaaacgcaagtaacagcagcaattgaggcatcatctccattagtctcctgcgtgtttcgatccaggctgttgagttttcattgccgatataattcagacccttctgacgtcataacgtcttacgaaacatgagcccgttttactcgtatgagttggcagaattgcaagcacgtaaagtcactacctcttcctctcttagcaagaaacagcttgggtgctcgagtcgatgtttcctgaagaaacggacgattccatacatcgacaaaccactctgcactccatgctctgtaggtgtacgtgcacgtatgatttcaatcggacgaactgctaaaaattgcaatgcaaacatattttttctttcacactccattctttaaatctttcgtgcat

SEQ ID NO: 106367 - DNA, 521 bp, Oryza sativa
ccacttctgtgatgctaacttacacaggcattcacatcacaaataccagcaattcttgggacatcatatattacaaaagaaatcccagttatcagctaggtgaacatcaagctgggttggttggttgagacccttcaaaccaatctgatagccttctaggagcagttcttggtggagcactggaagaagcaagaactctcctcttttggggtgttcgcttcttctttggagtttcatgtttcttcttatttggtgctgatgagctagcttcagcattcacattagatggcctcctcctgcaagtgaaaagaagaaacatgattcaacaatagttaaaagtactgaagtcatggatcaaatcagagatcaaaatggaagggttcagtacataccttttcctgggtgtttcttcagtagccatgtcatcttcacatagtggttcagccagtttgcatgttttctcaaagtgctcaaactggttgcatctcttgcatttcaccttttttcttccagctcaagac

SEQ ID NO: 106368 - DNA, 2211 bp, Oryza sativa
cggttgtaagggttgggttttgggagatcccggctatacgtcctttgttggcctagcgccggccggcctggtgctagccttctccggggtctgtgttggtgttgtcggtgtgtgggtagtggtaatgttttctttgttctcctgattacgacattccacacttgtaatcatgtattttttttcctgatttatcaatgtgaactttgcattgtctggtgcgagttgttaaaaaaatattcataattaaaagcttgcatgtgcttagaatttttaaaaatgggcctatagaatgatccaatgagaattggaaaccgtgcagctcgtatgctccacgtccgaagtattcgtccgagaagcacgcttattagctttttttattacacatgtgccctttcctagttcatattgctaccgattgttaaaaaaatagaagatgtttctgttataattttggtacgttatccgtgtttgaatcggttttaattttatgtttttgtcaaatcctttccttttttttcttacaccagagtgtccctcttatccgagacgcgtgcaaataatttggcccgcaccttttcacacgccttttgttgcatgcagcaattcggcccggcccttgactttgttttccacacatgcctttgtgcgccgctgcgattgggcccgcaacgccctcgtgcatgcaatttttcacatgcctgattgggtcacgacacccttgcgcatgcgatttgcccttcccgcatgcctgattgggactgcgtcgcccttcgtctgcgatttaaaaaataaaaaaggttttgtcaatactatggtatactatctgtatccaattcccatcacgcataacattcattgcgaagttacgactcacgagtgaactacgataaagagtctgtgtgatgtggataccaagcgaatgaaactcgcagagtccatgtggatatgatgtacattgttgcccagatcatctgattctatttgtattacacgacacaattcctgggacatgttagcatgatttcaagttagtctttacacatgctcgtacatactaccagtgataccgctacaataatccataagaatcagttttactttcgaaaagaacatacaaccgaaataaaggatgctcaaaatcgttgattccatccgtcttcaatttctatccgacttgagataaagctggaggacaaatcgagctcatgtttgaaggcctcatttttttggcttatgttattcctataagccaaaatttaaattttagaacttaattttgaattcgtttttttgattttttttatcatactttattttacaacatttgcttttaggtcgctaagaacatgtatataaaatatttacacaaaaatagtcttttattcagaaataagtaattcggataagcatatgaataaacgaaacaatgggctatgattatttatccaccgacacatatgtacaaattaaattggctctatccattgcaacctacgggcattttttctagtaaataataaattaaagatgtctctgaattgtgacgaagaaaatatcgatcaatgtttcattcatatttccaatcagtgcctatgaataattttgcattcagtgggaaggcatcatatagataaaaatatttggtttttgattgatgattacatactggtaaattttaacttaattttatagttattctgaaccatgcaattaaataaattcaacctatcaactgctctaattatattatcctaaataaaagggaatatggcacccttgattatcaatatgtatgaagggtgaagactaaagcatatcgggacaaaaattccatatttgttcgttaagaatatgtaacaccctgaaaattcgatcgacaaaatcaaaactataaaaatacggattttcaaaaactttttaaactaattgcatcatgccgatcttattcgtctattttatctggatttgatctcgaagattattaatcgtgagtaaagaatagttaattaggaataaaccttaaaaacaaattggtaaaataaatacaaattaaaataaagattaggtggggatagaaataaataaaatattatcgcaaccatatttggatcaattaaatttaaatacgatggaataagaattaaccctaattaaaactcaaataaattatataaaaataaaatatgagtaatattaatctagggtgaattc

SEQ ID NO: 106369 - DNA, 1851 bp, Oryza sativa
ccgtgcaccgccgccgtcgcagccaccgtgcgccgccgccattgccgtcgccgctggtaagccgtgccgccgccgcctttttcctttcctcagccggtcgcggtaggcaggacgagagagaggaggagaaggagccgaaagagaatagaggaagagaagggaagaaagaaaggagccgggaggagaaaagagaaggaaaaaagaaaaagaaaagagaggccggcagaaaagagaaagagaggagagaaaaaggagagaaaaagaaagagagggagagaaaagagagaaaaagaaagagaggagagaaaaagagggaaaatagaaaagaagaaacggagaaaatagaagggaaattgggggagaaattaggaggatttaggaaataaaaatggtcggggttaatcatagattattttcggaaattcctcgagcgtaatagtatttcggtcgaaattccgagttaattataaaaatatgtttcttaaacagattagattaaaattggtagtaatttagatataattaataactaaacaattagatgaattcttatagattattatagattatttttggtaatctctataagtcatcggttcacggtagaaattcggatttaattactaggaatcttagccgtgtattatatttaatcgtttagtcatagactgaattaaattgtataatatttctaggatttcgtccgatatttagctcgtaatagaaatttctaacctattatatggatataatgctcgggaagagtaaattaaaaacttatgacaacaaaataattatacccgcaaaatagtttaaatcgaaattgggtttgccgtagttcacagatagtaaagttaataaaaaggaatcgactttcgcatttgactttcatttggatttatttggatttttatttgaattctaaccgaattcaaatcaatttttgcacgtaaccatagagcccgagggagttgcggatccaagcgaaggccaagacccgcaagactttgagcaaggcaagtcatcactattccttgaacatgttgatcccaattgcaaaattgttttgtttacaaataaaattgcatgcaatgattatgccatgccttgattattgtttacccttaaaatccttgtaaccataattacgtatgagtccctagtcaattatgacaattgcttagaaatgccattctagaatcatgcatactcatatttatcaaatgctatatgcttggtcaattacctggaaggtaattgagatgcggcatgtggagacatgagcgccacattgccatgatgttgatgacatgatttgtgaaaggagaaataaaattaaacaattgttttcgactggggcggacggaggatttgggtggtatctgggaaaggctagtaccgtccccggtcaattaaggaccgagccataaagttaagcatgaaacgacccccgtacaaccgcacttctcatatgggtatagacctagcggattagatagccgaacggaggcagtatccctgcatagatggttcacccctgagtgaggcaggtgcgctacggtgggacagccgttgaggtagggccgagaggcgtgccctacatcggtgtcgccattggtaggactgccatgagtgtgtgaaagagagaacttaacttgaaccataatttaatatgtgtgtgagacttctctttcccgggagcgccagaactcctctcactgttagaaacatgaacgcctagagtgcatgaggatttaagttcatggagcgggtactaccaaaaaaaggtaatcgaaaagctttgccgtgacgcgtctcatgtgttgggacgaggctcatggggatcctcta

SEQ ID NO: 106370 - DNA, 999 bp, Oryza sativa
gggctggcaacccgtggaatgagaaaatcactactggagaactgatatttgctcggatggcaaaatcacattagtcctggtttgattaggaatcgggactaaaaaagatatttagcatcggttcaaaagcccaacgacactttacaccaaccgagattaaagatcatttttagtcccgcttcaaaacgtgtcaggcctctatcttactagccgggactaaagattgatgcaccgtatataatcccccacacttgtcatctcctcctcacaaactcctccgtccgtcctcatcttttcctcctcctcccttttctcctctctctctcttccctgtcttatcctctccttttcgtacacgcagcagcagcaacagcagcgaggagggctaggggccgctgtgtggggggctggggcggagcgagcgagcaagccggtgagtgggcggcggtagcgccctcccctccgccggattcggctggagggcaagcaacaggtggtggcgcacgaggaggcggcgggccctcccctccgccggatccggtgggaggggaggcagcggcggcttgtgtggcagtggagtgacggcggcggcgcgagcgtgatcggcgaagcgtgatcggcgaagatcgcgtggccttgcggcagcagcgcgcgtcgtggcagccctggtacgatggactcggaggcgcgcggcgcggcagcgagcgaggcaaaaggtccgtgaagaaggaggcaagtaggagttatgtgaatttgttcatttgtgatgtctgtgaatttgttcattctatggatctgtgaatttgtgatgccaatttaagtatattcattcgatctgtgaatttgtgatgttggtgagtttggctcgaaatcaatatgtaaacagtaaaaaacaataaaaaagaaataaaaagacatttagtcctagttggcaccagaactaaaaaaaaggatatttaatcctagattggacgtctcggtttgctatccgcgactaaa

SEQ ID NO: 106371 - DNA, 658 bp, Oryza sativa
aaacatggctttacctgagttcacaataaaaacatggtaatttaatagatgacaccgtgtcggttatttcatcattttcaaattgtatggaagagaaatattttaaaataactagaatgcccttctcatccgtgtgaacgaggcaatacatctagtttgaaccggattatacccccacctagtctctccgctcttcaagttgagtggatattgtattttaataactacagcgtcctctagcaaattaccatattttagatgtctcatattttagatgtctccaagtaaagctacgttttgatggtgtccactagcaaagatcacaatatttaaatatagcctgttttttaggatggcaaattttatctttatccaattcattcctgcaatggcctgtagcccacagcacgcatagaccacaaaaagcacaacatttgtttttacaaaagaagcgtgcaagaagatactccctacacgatagacatatgttactgatcaaataggggacacagtggatgaactagccaatcgagacacaaagggtgcacgtgacatcggggtttaagtcttgtagcccaagcaaagctgcctttttccgtggttgctttactgtggcaaagtggaagcgggattctttttcgtccaaaatataaatagg

SEQ ID NO: 106372 - DNA, 1659 bp, Oryza sativa
taggtgggggtataatccggttcaaactagatgtattgcctcgttcacacggatgagaagggcattctagttattttaaaatatttctcttccatacaatttgaaaatgatgaaataaccgacacggtgtcatctattaaattaccatgtttttattgtgaactcaggtaaagccatgttttgcgcgtgtccaacaggaaagacaataatttttttatgtgccttggataaatacggcgaaattgaattgaatgagtacttttgcaagtcagatggtgttgagagaatacttaaaccatttagaaaatagatggaaatggtacctgttgcagcggtaaattcagttgtatgactagtatatttgctttgaagctggctggttcgatttcatgtgccttgtacaattcacatcttttggagataacccaaagaataaaattaataattgagattacgcaattccaaggtaaagttgcaagctctccgcatggaaaatatggtggtttattaatgcataattaattaagtattaaaaaacttaaaaaatagaataatatgatcttttaaagcaacttttgtatagaattttttttttaaaaaaaacatcgtttagtagtttgggaagcgtgcgtgtgaaaaatgaggatggtgagttgggaaaagagggggaagaacataacctaagatgatttagcataaatgctaggaataattgagaatacctgagatgatgtgtataactttatgagagaagagacggtttgtatcatggatcgatgatccaaaggctaaggatgattgagatgatgtggtttataagagaggagagaattggtattgcctatacttattagtagtgtcaaaaagtactaatacatgagtatattggatttgtgcaacccaaacatttgcaattggtagttggggcggcgaacattaggggttcgtaggaaaggtcggattggaaagcttaggtcaaaggttcatagattagtgaaatcttctggactacttcctccgtccaaaaatataagcagttttagacttcgatatagtctttgaaatactattttgaccaatagcatctataaaagttagatgttttaaattaaaagagttgcatattatgataatttatttaatgataaatctagtaatatcaattttacatgattgatctttttaatttctatgctattaatagttaaagttaaaagtgtttgacttggcactattctaaaatgcttatattttgggatggatggagtactccatatggtattatggttgatgaattcatggtgatagaagtatgtccggtttaactcctgctcccttaacaggaacgttctcaaaattatcatgtcaatgatgaactctcacgttcctagaccgaaaaaacaatgatccaaaattcccaaatggacagataggcaaatctttatttgacaggagcgcacatacgctctccgttatctgtcgaatttgcatcaaattaaggtccacacacagcaacggtgcagcttttgatcagtagggatcatttgcactgtagccactagtcagtgggattatttggtcggcctgcagataccatatctctccatccgttggccggcttatccgtgatctggttgtcgtgtaaagctgtgtgcgtgc

SEQ ID NO: 106373 - DNA, 517 bp, Oryza sativa
actcccttgtcaggttaattttttgagttgtgaatgaaggccttagttgcagacttgcagggtttcaaaacatgacgataatcgctcggttatcttggtgtggttatcagccttatcgagccggtttgcatttcaaaaccgctagataaatcacctaagttaaaacacacacacatgcaaactatgattatttgaaactcaccaattttcatagatagctagtcagctattgacaaaaccactcgggggcggttttcggtggccaattggttttgcaaaccctctgctgtgactttggttgggaaatctggcccgaaagtgttgttccaacgtccagaggggcctggtcacagcagatagagaggcaggctaggccaatggtgggctaacatgccgtgtgggggactcctgctggggactgcgggcagagcctactgataatcgacagcacggaaggaaacagcaaaggagcagctgaaagcatgcagtcagatgcggatcaatgtcacctttgcga

SEQ ID NO: 106374 - DNA, 634 bp, Oryza sativa
tttgcttcaccttatagtcacacatagcactgttacatattttgtggataacaccatatttttcgaatacaattcaaataattgtttaatatgtgtgtttggtttaattgtgcatgataagatagcatatatttattaggtatcgttacttgaatctattttcagaaaaaactttagtgaagtagagatgcaaattgtctaactacaccgatacccatattgtgcatgaaaataatattcatatattataacaatataccatgatccttagaaaaataaagcatgaattttatttttaataatataaggcatatataaatccacattatcatatattttatatatacttagagttgcacctaaccatttaaaactatgattttgtttgacgataaaactataaaacccgtgtcaaagacatgtggtgctaattagttataataatacctcttatctgaaattgatagtctaattacttaagcatcgggttaattattttaatatgcattcaaactattgcaagaaatttattccatattacttaggaacttaattaaacctcataaagaattacaaactcatattgcattatttctacgactacttgacaacgcactcaactgtcgccaccacg

SEQ ID NO: 106375 - DNA, 648 bp, Oryza sativa
ttaggcttaaaatattcgtctcataaagtagtcacaatctgtgcaattagttatttttagcctatatttaatacttcatgcatgtgttcaaacgtttgatatgatatggtgtaaaattttaaggtgggatctaaacagaccctttaatactaatatgcgtcctaatccctacattaaaaaaatcaaattattattcaacaaggtttagtaagtcatataaaaaaatcacaagggcaaaattatcctttcatgtgccttctaacagcaagcaagccatgtacatttttttgaattggggacaaatagagggagaggcaagtttgcgagggcaaataagagaatcagttaacatctggggacaaatataaaattctctcatgattagtatatagaactctcaagataattctgtttctgaatttgcattctttctcgccaaacttattcttgtgcatacttgtttattatatataaaagaagtgcacatccgcataagaaaatctcaccaaaccaaacatcttatctgaggcacgattcctatacacgtaaaatagagcgaatcaccagtgtatagttaattaagtatttactaatttttaaaatataaattaatatgaatttttaaaacaaaattcgtatagaattttt

SEQ ID NO: 106376 - DNA, 635 bp, Oryza sativa
cgactagggtttactacgatttttaattgtggcagctaaggtttcgagatgagttgtctcacttccaatccatcttctactcataagcgtcaactcctactatcgccctatgccataatctatcgccctatgccacaatctctatgtaccaaaataagttgattttttaaaggcaaaaattagttgatttctaaagttgaaagtttatcccaaaataaattaatttatagcctcttagctaccctggttcataaatagaacatttttacttcttccatattcttttacttacccacccactaatattactttcttattaatgagcggcacattgattttcttttctcacggttatttttttcttgagtaatcgatttattttggatagagggtgctacaaatgatgatcccaatccggtagcttccctttgtttttttggtcatctcttctcagttttgctccctctgcggattttggcactcaacgtttcacccatcacccatagaaggatttaaaaatgagaggcaatcttaattatttcatttttttccttagtactagaaatgcaataacattatgaggtatctccagataactgagcgataatcctttatttaacgtgttaagttaaaga

SEQ ID NO: 106377 - DNA, 626 bp, Oryza sativa
tgtcgaatctctgctagttaacgatcattgcttatactactcaactctataatgtttttcaacggtttgatcttcgtactgatcctctctctatatatgtgtgtatgatataacctggcataatattattattcttgtaaatcacgtggtggcgacagttgagtgcgttgtcaagtagtcgtagaaataatgcaatatgagtttgtaattctttatgaggtttaattaagttcctaagtaatatggaataaatttcttgcaatagtatgaatgcatattaaaataattaacccgatgcttaagtaattagactatcaatttcagataagaggtattattataactaattagcaccacatgtctttgacacgggttttatagttttatcgtcaaacaaaatcatagttttaaatggttaggtgcaactctaagtatatataaaatatatgataatgtggatttatatatgccttatattattaaaaataaaattcatgctttatttttctaaggatcatggtatatttgtataatatatgaatattattttcatgcacaatatgggtatcgttgtagttagacaatttgcatctctacttcactaaaagtttttctgaaaatagatt

SEQ ID NO: 106378 - DNA, 695 bp, Oryza sativa
tctttaatttgacctatgcggactgcggtagaattctcaggtgtccaatataatttggttggcgtgtctcatatggtatagatatataggctataacggtaaaaaaaaaaacatgcaggtatcccaaggacccctgttggaacttagtaggtacgcataggggcagatacagaacaagatttaagggagaactcatctccttctttcttcttcagtcccccctactatttattttttcactattcttctcctttcgtctcctcttctatcaatggtgatccagcggggtaggagggactcgagtcccccagcacccatgctggatccgcccctgggtacgtacgcccctggctatatcctatagctcccgaatggagaaagcgtttggattgtctagctagttgtaatttgccttgttaattttgagctcacctttttactgctacgatcgctttaagattcgtgtggcactcttaatttagcccgctccatagcctctttcccctccatgactcacttttgtgtaatcccggccgcccgtgtgctaccatcctctctccatggctagctccttcgctggcacctaattccacacctttaattatgttcgcaataagtgtgaccatacttactcatcatagacactcatatctctttagcagcaggcatgttatatttgtcacctccattatact

SEQ ID NO: 106379 - DNA, 507 bp, Oryza sativa
ctgccttgggacgaaagttgacatggttttgcaaattaagaaacgtgttatatatggtattgcagttcagggatgaattttaaactacgtcaaaatgagggaccaaaaacaaacttattcatcgagttctgaattgatggcctagcatgcgcaccaactttaaaattcctcgaatataaagatgctcctttcctttgctttgcttttctttctttttttcttgtggattttgatgaaaaaggcttttggttttatagcttggcaattgaacacatcaaactatttcatgtggcatttgtaataaagtttcttataaatgtctaggattctaaacaagcctttggtttgataaatgtgttcctatgtggagccatctgaattcgctcgacattggctactttggatgctattggtatttcttacgaccacagataatttgcaaacacacgaaataccactgtagcactttactttcgggtgaccccaaaaggataccgaactcaggga

SEQ ID NO: 106380 - DNA, 869 bp, Oryza sativa
ggcgaattcgagctcggtacccgacactgtcgcgtgtgccgaggttgagggttttgttttcttgttgaccggcaatttggatgatgtaccatatgctgagtgcctctcaatgggcaacaaagaaaacatgatgtataagtttatgcagattgcctgttgttgaatgcgtttttgttcttcgctacacttgttctggtcaaggaaagaagaaccatgctgaagtgttggtttgaactttgaagggcaatatccagcgtgcttattggaaccttttctgttagtactcgatttttttctaatgtcggagtatgaccttcagccttgacaccctcctccgtacttgcggatggtttaggattcagcaggaccttccgaatggcttgtgtgtatatactccctccgtttcacaacgtaagtcattctagcatttctcatatttatattgatgttaatgaattagatagatagaacataaatatgaatgtgggaaatgtttctagcatttgcatttctcatattcatattgatgttaatgaatctaacataaatatgaatgtgggaaatgttagaatgacttacattgtgaaacggaggaagtgctttgtacgagttaggaaaatggttgttcagacaccgtcactcagggttatacaagctagcagccatacaaaattcgatagaaaaaatgtggaataagtgaaaaacaaaagcgcaaaacaaaaatttgtaccacattaaagcaggaaatgttaaggtttgagatgccagtaggcagtaggtctaactcagaacaaatttgtacacaactttttcttttttgaaaataatttgtacacataactaataatccatgcgagttaaggatcatg

SEQ ID NO: 106381 - DNA, 649 bp, Oryza sativa
ctccaagtgtcaagctgcaacgatatgatgcaacaccacattgttaattaattagtaatgattaagttgtagcttgatcgagtacaattaagtttctcccttttgtagcatacacatatcttgttagctttaatatatatcctagctctgatatccttgctaatctacttgctagctcttacgtacgtggcctgtccatcgatcatatcgatatattgatcaagcagagacgatgatatgatcatatgacacgcaatgtatatatgcatgtaacacacactatttaattatatacacggcatatatatatcacaaaagctagacatatataggtcagctacaaatgtagcagtgcacaagcgatcgatcgatgattattatatatgcatgataactaatttaaatatctgtatttatatatgctaactattttgagattagaaaggctagtacacactataccatatactccctccttctctaaatgtttgacgccgttgactttttaaaatatgtttgaccgtttatcttattcaaaaattattgtgaaatgtgtaaaactatatgtatacgtaaaatgtatattcaacaataaatgaaatgatacgaaaagaattaataattacttaaatgttctaaataacacgaa

SEQ ID NO: 106382 - DNA, 1133 bp, Oryza sativa
ctgcgcgccaccaccaccgcctcccgctccggtgtgcgatatcctccccggcggcgcccccttcgccgccgccgccgccgtcatggtcgcccgctccaccttgacgccacgtcgaagaactgagcacatcaagcatccaaccaaagatcaaaatcacctcaaccacacatagcaacatctatctatttcatcgatgtgtacctagagattgagtggcgtggtttctcgtgggggcggatctagggcttccggtgagaccgagagcgagagcgagagcgagagagagagtgccggggactcggctcggtggggatcgcgcggttgagagaaaacgtgggtcgatctggagcgttggatcgatgatttttatccgttgcatttgatgaatgaatgagcatccttcatccggaaatcctgttcggcgatcgatcgccctggggatggatcagcgatcgatcccctcccccctctctccctccacctggttttcttttttggcaccgcattactttcctattttggtaaatttatacacctaaagtttacacatctaatgtttagagaccaaaagtttataagtcaaaagtttatatatccgattcaaatttgaatttgaattcaaatatttttttacatatagtatttctatacatctaaagtttatacacctaaagtttataagccaaaagtttatatacccgtttcaaatttgaatttgaattatatctgattcaatttttgaatttgaattcaaatattttctatatatagtatttctatacatctaaagtttatacacctaaagtttatagatccaaagtttatagacctaaagtttatatacccgatacaaaattgaatttgaattatatccgattcaaatttgaatttgaattcaaatattttctatatatagtatttctatacatctaaagtttatacacctaaagtttatagacccaaagtttataagtcaaaagtttacatacccgattcaaatttgaatttgaattcaaattttttttatatatagtatttctatacataaatttttctaacttttgttttttttaaaaaattatgtgtcgtactgtagtagaaagagaagaaggggaggaggaagggggagaaga

SEQ ID NO: 106383 - DNA, 1820 bp, Oryza sativa
gtggcgaataaataggcgagaggagagagagagagagagagagagagagagagagagaggggcgtgacgtggggatgacgtaggtggcaggagagggtcataaattaattcatttaatcaatttaggaattaggaggagtactgccaaaattaagaggccactggtatgatgtttaaattcttccaagtttgactaaaggaaagaaaagaaaataaaatcctccgtatgaaattcaccgggcagcaatgaatgtcttctatatttgtgtaattctgaaaaagaaatactagtagaaattgttttgatcttccataaatttgctgggatctcatccggattttttttccctgcagtgatgaaggaaagatattaattgtggtatcacgtaatgctatctctatctatctctctctacctacctatcctctgcaatctctgatgtatatcttcttgtaaggtaacaatggcagggcactaatgataccaaaacagaattgattcaaggagtgcatttgtgtttgatggaataaatgtgtatctcacaaaatttttcaattaatgcagatggaagatcacatctcgtttctaaagttgggtatcttttgaaattaatggaggaaatttagaggaattatgaaagaactgaactaaatcacacggaaaatctgtgaaatccttatgttctaaataagtgaaaatggtcatgaaaattcctgatcaaccgatacccgtttctgatttttacgggctaagtaatatggaaatatttaccgatgaaaacacagaaaaagatgtaaaaaatatgggaatagaaatggaaatgattttgctttaataaatgccccaatatttatggtccatttctttatctcactcaaaatttagaggcccatcaactcctcaaccaaatccctaggttaactacaaaagtcaaaagggtgatagattgtaatttacatagtgccatcttgaatttatttcatgatattacacagctacaaagttaaatgtgtgattttacaattcaatgtttccgatttttattacaggttttcaaccaatattgacttgtttccgtctgtatccgtatagtatcggttccggttttccaatattttttatactattatcattttttgctatactgtttccgattttgtttttgaaaaaaaaagagatatggttaagtaaatggttgagacgtttttttgttcgtttccgaccctttttagcccttgttcagttaatccctatgtgggagggattggaggggatttattaacacctattatggtgtagaattattctccctcaatcctctccaatttctttcaatcccctctaaactgaataagacctaagggatgcatttacaacttgaaattaaactctaaccatacagaattcctatgttctaaagaaccccttaactgtgtaattctcataggactcgaacttgagtttctacattatattctacacaagtacctggtacaacaatgtataaaaggcaaatagcttaaacataacagcataatatgattttttttcttttttggtttatgaaatctcttaggccttcgggttttggttgaaattttgtagatagtttatcttttgtagaaattgagattaggatttatcggaccttcccgagccaaaaacaagggatagttttcataaaaatcgctgactcccaataacattcggtcaaattttataaaaataataataataaaatggtctgaattttttaaacttggtcgggaactaagcagttcgcgttctcgagccagtccagtttttatggaaattgaca

SEQ ID NO: 106384 - DNA, 1718 bp, Oryza sativa
tctatatatatatgccattcgttttccttcagaaatacttgggcctcttattttctgaggccaggaaaataatcaaaaggcataagcatctttaacatacatgtatgttaatttctcttagaaagataaatgtatatacatgcatggttgtgcacaaaggaattaataatgcactccctccgtactcgtaaaggaagtcgtttaggataatgtttaagttaaacattgggaatataaatcatgaataactctcaagtttattgagtttgaaaacgtaaaaaatatatgaatagatttgtcttgaaaaatactttcataaaagtatacatatatcatttttcaataaatatttttatagaaataagaagtcaaaattgtgttttggagactgtgtcgctgtccaaaacaacttccttgacgagtacggagggagtactatatacccctctctacttaaccctgatgttggtagcattatacaataagttagcatgtgcaccaacttgctgatgtgtcagctagatgagcttggaaggaacacaaatattctttctcagctactgtttggctcatgactttggtgacggatggctaatgcttgtactcctatattctctataaattaacaagagcaagaagacatggaaaaacatcggactcatgtagaatcacagtccaagaagataaccacttcctagagccggccaaggcaaattaaagtaccaagagagaattccagcagcacaaaagctagaggtttattactagcaaagccagtatatatcaacggcctgtagcaatctgctgacaggacaaggtgtgttcttgcagtccacataagcagaaaccaagtaaggataaacataaaacgacgtcatttcgatcgattgagtatatatatacttctagctagtgatctctcttccttgtcacatatatttcgtctatgttatttatttacaggcccactactacacatcgtccttgtatgggcaaaaaaatattctctctgtcctagctggtcttgaggaaatatttctcgaactaaaaccaattattgaactcttttaaagttgacaaactagtaggatgttaattaaacaggtcacattttattttcagagcaaaaggctagctagctatatagttggaggttggagatagaagtcgatcatccatcaaccagttgctgcctccaattaattctcaaaattttgaagtccgcgtatatattgttgaaacaggaactcaatttaattcatcagcaattgacaggtgactagcaccatatagcatgcagctagccaataatccggaaaaagaaattaaaaggtagatccaagaatgaattagagctagagagacttatatttataaaacgtcctccaccatgacagtgaccagatgatataaatccatgcgtagtacacggatcgaagcaccacataagcaatctgatcatcatcatcatcctcgtcgtcgacctcgtatagctcacgagccagctttgcatggaggccatgtgtgcacatagtgcctaataaaatcatcatgaaacatgcaaatccaatggaataggaggagtcgccactatgccacaaatgctgacatgacatgttggctctcctatgtccacataagcaggagtatggataaagtgaactttccaggtgcccctctggcctccatgtatccgactaggcacccggcctcccatc

SEQ ID NO: 106385 - DNA, 1494 bp, Oryza sativa
taggaggctgctaatttagcagccaacaggaaacttctctctgtatatctatgttataatctaccaaatgcccatagcaaacaatgaacttgaccagttcatgcacaagatgttgatcaaatgattaattcatccatagaaaggtcctaatcgtattgtatacatatgaaattgtaattaatctatacaagagagtagacactgcaggctagtttttgtatgaacacatttggtgcacctaatattatctcttcattagtagttatactagaaagcagttgcataacggcactccactgatagcaacaccatgttcctccctatccacacatcagttttgcattataataagatcaacggccagatacatttggatgctccaaactgatgattaatagaatcagctatgaccagttatagctaagcttgcttataatttactaatttagagaggttgcaacgacacaccaagtgatcatgctatatgacaaggataaagctcatgtacctggggtacttagagaagaagttgtattgtgtctctctgtcacgacttagcctaacaaagggtaagtggagctggtctaaaaaaaagaagtgcaggcaaaaatatatataggagaccaataaatacctaatatgtaattaaagtggttcaagtaattatttggttcatgtaagaatttattaattaggtacaccaagaacactttttttctttttatatttgccagggaaagcaacaatttttacaattaattttgattatggtaagtcagctggttttttaaattaaatgctttaaaaggaaactagaagagaaagtactaagtcggatgactgatttctacgctttaggcagactatgacagtgcgtcaaaatatttttcgttccgtacatgactacacgatccattaaaaaaggacctatagaaaacaatgatgtcaatttcttcttaggtaagtcgtgtcggcttccgtatagcataaaccttgtcataaaaagaaccgacacgcgcgacgaatgttcttgagtaagacgtttaaattccttcgaagaccgaattacgtcggcaccaaagcgagagaaactaccgatcacggcgcgccgcatccttctctcgttgacctaaaaacttctctttcaccgaacatcacacgcgtgcggagatcatagtcatcatcatctaaatttaaacccatatttcttttttcaaaagttgtttggtgtggaactattattccctaacccccataccctcctctctctctctctctctctctatccatctctttctctctctcttacacaacaacctgtgtaccggataacttctggccaccagtcacaagccacgagaggagaggagacgggtgacgcatgcaacggccggccggctgccctagcaagaaagctggtcaattggaagtaggctaaatgaatgaatgttgctggggacgttgggccagccgcaagtggattggacaatttgg

SEQ ID NO: 106386 - DNA, 701 bp, Oryza sativa
tgaggattagaacaaaagtaatgcatacgaagaatatttttcagatatcatatgtattttaagattacaacttcataaacatttctaattttcaaaagcagacattttaatatggccacatgttcgatctacacagacagtcggccgtctgaatacgaagacctaattttcacaggtctttaatgacaggtggagagccgagccgcttacgtagatccattttgactgcacgtgaaaatgctttccatagatccattttgactgcacgtgaaaatgctttccgtgatattgtgttggacttactatataaactatataaaattttaatgattgttaagagaaatatactgtcaaacctgcataaaaaatgcataagatgctatgaatttcactagaagattgcatattgcatattggattactttttatcatcatagttcactttagaccatttttcctttcgcacattacagaatactctccatgttccttctcttacaccctcctttattcgtatctgctactctgggtctaggtatgagttaattaacatgaacgaagtacaagcacagggtgtactaggacaacgcttgattgtagaatcctcgttgtagttgtgaacccgagctccaccccacctactgcactaggtctaggtactttgcttccacaccacttaagctccgtccaccgtcagggtt

SEQ ID NO: 106387 - DNA, 908 bp, Oryza sativa
  unsure (1)..(908): unsure at all n locations
tttctaggccatgagagcgaacgtggaggctcctttttctattccttaaattatatatttaattctgaatttctattttttcctaattgtatttctatatggattatatagtctacttctaatattccttatttttaattccgaatttcagttatttcctaattgtatttctatatggagtctatactctacttctaatatttcttatttttaattccgaatttcaggtattttctaattgtatttctatatggactctagtctcctcttctaatattccttattttttaattccgaatttcagctatttgtaaattgtatttctatatggactctagtcccctcttctaatattccttatttttaattccgaatttcagctatttgtaaattgtatttctatatggactctgctttttctttttctccgattaatgtgagaatttctaggccatgagagcgaacgtggtggctcctttttctattcctttaattatataatagatgttccagcacttagaaaaaaaatgttacagttcttaaaaaaaagtgaaacatagtgagatagttagatgaaacaatttaattcaatatatacaataaacgatttaagtcattgaaacacttaaaccttgtatacatcaaaacaaacccccgtgtatttgaaaatattaaacactatctaaaatcccacttcaaacatttgatacacacacccaaagaaacatcacaagtccactaactgaaacaccgtttttgaaccattgaaacatcaacaaaacctgtgtgtcgaaaatagaaatatagaacactatcgaaatatccactgacatttgatccaaacacaaaagaacatcacgagtatgggtncgaagtggggntatcaatnattcaaantcaaagtgccc

SEQ ID NO: 106388 - DNA, 679 bp, Oryza sativa
atagctggcagtacttggattatgtaagcacctactttggcgtttcagctatttattgaccatggcaattggccggcatgatgagtccccaacccacccttgtatcttgtacagtacttgccaaccgaaaatgctgtgccatataaatgcattcatcaatcattcgcagtgaaccagcaaggcgtcctcctttgtaagggaacatattctgtacatatacaaggtattttcagttagtgtgcagggccagtgcaccttgtgcgcacataatacactccccttttgtaaagcagtaataattcatttgttgacaattctgcagagagagagagagagagagagagagagagagacgttcaaggcttcaaggagaggtgcaattgatcaatatcaatgacagcgaaaatgccgtagttctagaatcagaagtccggaatccaacgtagatttttttctcgattacacgatagatttccgattacacgatagatgcacatgtacatagttacacacaacatcacattcacattcccgtgaatgcgttcctcgacacatgctaaagagaaaccagcaacatgccggcatatccctaatatcataatccaacacagattagggatatgccatgcccgttcatagtggataaattccacaggaacttagaaggtaaaggaaacat

SEQ ID NO: 106389 - DNA, 680 bp, Oryza sativa
tgtgaatataaattttcagcgactgtgaatcaagtaatcaggtatgaaattcgatttttatcctaaaaatttggaagtattagttagaaaaaaataaacatgaggcgataaacgaggggatcaatagcccaaattaaattcaattatgttttcctacaaacagacatatcgcccaaaaaatgtgagaaaaaaaattagaaaatgcaggagaaatgaggagaactttaaaatatgtggcaaaaatatagtacaaaattaggaaaagggatggggaaaggtggaaaattatgggaatgcgtagagaaatgtttaaaaatattaaaccaaatattaccagttccaaagtataaggaattttacataaacaactactttttgatgaaggtagtatcattttttgggggtggttggcagtatcattttttttattgaactgatttaattccacttgatatcaaactgtttataggatttaaaaaaacatatttctcatttttcgaaagggtagatttaccgtccttgataatgtaccgagaagtaccacattttttagtgtaaaatttggtacctctagctcctaagtatcatatgtcccaaaatttcatgtgtaaaattttggtttcctctaagtactaagtttcttatttttaatgtatccccaatttctagtggaaaatatt

SEQ ID NO: 106390 - DNA, 1346 bp, Oryza sativa
  unsure (1)..(1346): unsure at all n locations
cgagttgcatgtcactctgaccctagaggaatagatgattggtcgccttggcaggtattgctattaaaacagaaatctgttttcatgtcggggtctgggtgcaaaagaataatgagagtttcttccatctaggttagagacaactatggcatttcgtgatttcagtgaaggggcacaccaaggggaatcacagcagcttatgatttgccaaaatcatgccgtctcaaactgtcaaacagcgcccaaaaggcaattcatcacgacccagaataatttctttcctaccagtcaaattataagcaggcattaaaaatcgagttttttcagcaggcattgaacaaatcaaattcgacagaaatagaagtaacttgctgcatcgaatcataagatacatttttatgtcaactgctaataagttaataataccatcctgctgtttcaatcctaatattaatagctatattggggcttcttctcttttctttgagcaattgaagaaatgattaaatgaatttaaattacagcacctactcagccttgtagcccgtgcttgatgccagaacagcgagtaattaaactgacattactacaatcaaagtaaccaagagttgtgttgccatatatgcatttntcttagctcgacaatcaattctcatatgcagcctcttaatccaaaacgtggcttgaataccaatctaagatgcttaacgattgctcagacatttgagtgtcaatggntgcttaacagacacaaaatatgttagtgcacgaccattgatctcttgccccttggagaattcaaccgcttnacctcagtagagtggccggagccccttcttaatcacccggttcaatagaagagtgaattttaagtgatcttcagtgctcacaaaaagtacagtagatctttatacaccagggggccaatactgttggaaggaacataagaagcaactacctgaccgcctgtaagttctgcagggcaactattggtagaatttggaagtaatgaactaaacaaagaaggttttcataaaaaggaaaattggtatctctaaagtcgacccgcaggctgcaagctggatattctatacgcacctaaaagctggcgaatcatggcaaagcttgttctggngaattgtatccgtcacatnccacaaaatcgaccgaagcttaaaggtaagccgcgggccttatgaggacaaactaattatggntggcctcacggcgcttcaangggaaacctgtggccattattatgtattccacacccgcggagagcgttgctattggccttcccttttctaataaatctgggcgggggtggtgggaaaggtatacaaaaa

SEQ ID NO: 106391 - DNA, 875 bp, Oryza sativa
  unsure (1)..(875): unsure at all n locations
acagggaggggacagaatgaggacagaaaggataagggttatatcgcaacgcaagaatctgtaaaatggcagacatcgaacgttctcaattnnnctccccccccccaaaggccttgatgacgacccatgnacagccngcaggnnganaggagaggaaccccagcaacgaaagacacgangaggcccacnccaggacaaggaancnggacaacaactcattccatacaaagaaggtaaatcaggggagggaggtagtaaaatcaacgggaaaagaaaaagtcaaaatcttatcggacttagcaacatcgcagagagagaataacaagggaggaaaacaatccacataaaacagtgcaaaactttgtattgatataacaaaaaaaattacaagatcatactcccgagagactacgtaagggaaaaaaaaaagccaagccacgtcacgcgtctacaacaagacatcactgaagaggagcaagccacgacacccccccccccacaatcccataaccatccacgcctttgtgttgaaggggaaaacagggagagaaaagaaggaatcttctccccccggaccaccgcagctagcaagggcaacgagagactaaccagggggccaccggagagaagaaaaccgccgtagaaaaaagccttagaaagaaaaagggggaaccaaacaaagggcaccaggggaggttaagaaaacggaggatgccgacgggcaaccctccccgaaaaaataaggaaggaggtttgggccccgaaagaaacccatcagaaaagagaaggggagaaaaccacggaaaacaacacccaaaagggggggggacccccaagcagagcccgctgggggaccggcaccgaaaaaggcgggg

SEQ ID NO: 106392 - DNA, 814 bp, Oryza sativa
  unsure (1)..(814): unsure at all n locations
gactggctttgaatgctattcagctccnacccgacctactgatccaacatcaccgccttctgcaacggctaggacggctacatgggagccgtcccacttgatcccatcacccccaacctcgtcaatcccaacttcttcgacctcgtcatggccaagaagatgccgctcaccgtcgaccacctcatggggatggaccgaggacgtcatccggatcagctcgctaaacctcgaggagatgatgggctcctttgagccggccaacgaaaggccccttccatcgtctcgaagtccaggaaggtggcagcaggcggcgccatggaggaaagaatggcggccggtgaggcgaagacggttgctacggacactgagaggaagccaaccaggacggcgccgactgtgaggaggacaacgtcggctgaggagaagacccctcctagcgtctacaggtcggcaagctctgccctttttcctcgccggccactactcgtcctcccacccttccagccgccgccgcatggatcccggaggaggaggagatggggaggccaccgctgggtcgccgcattggggaggagacagcgagattggggaggaggactggaggagacgtgggtcccaccgtaaataatttatttttaatcgaacaatcacttgcatgggattgagtgagcttccctaaacccaggcagcttggtaacgactaacaacatatcatcttagctagttggttgtaattattctatttactatgcccttcatcccaaaataagtttatttttcacccataccatacatgccaatataaaaccaagag

SEQ ID NO: 106393 - DNA, 3527 bp, Oryza sativa
  unsure (1)..(3527): unsure at all n locations
aaaccaatgttggatgctcaacacttgtttgggcaatggctaaatgttattgacaaatctaccaggaatttggtggtaattgggtttgcagctgtcatatgggctatttggaagactcgaaatagagcttgttttgacaaaaaaactcccagatgaccctactgatttgatttttttggcatgtcactgggttgaaacctgggcaattctggagaaacagaaggcaaatcgaagaaacttgctgttgggtgccaagctcataaggcgggtgacaagtgaagtctaccaatcaagatttggatggaggatcaacaacaggaggcttgagaactgatctgcgaagactctgatggcgcgtctggatgtagtgttctgttctttcctctgtgtgttgatacatgcttaatccttttggaggacgcggtgcctctacttttgtaataacaatctggatggtcgttttttcttttttctggacctgtactctggtaatctcatttctggtaatggaaatggggggaaaccccttgctcaaaaaaaaaaagatgcaaaaacatcttggttgttctaggtattgttcaaataatcaagtgttcaaataatacacctcagaaaaaaatcctgatgaaacttgaaaccaaagtttcagtaatttgaagcgtgcaaactaatatcttcttggttgttctaggtatatccgttatatttgtgtcattatctaaaaaaaataaaatccgtatatgtgtgttgagtgcaaatcaatctgcactaattaatcatgtgcctgctctgtttggttgagggtctaatctgcaaaccaatctgaaccaaatcaatatgtaccacctctcgctcggtggacgtgttcgctgcaacagcaacatctcaacagcaattaaattaactagaaagatagtccgcacaaatgcacgggcttgtatcttagggtcggcttggaaggcttgtataccatcaaccagattattaatacaatatttcaaaattatgatatgtttgaaaaaccttcttaatcggtattgcttgggtaactttttctaagctattcgttgccgttagactatacaattcattcgtaagcaattatctatgagctggtttatcatccaaaagaaaagaaggtagacttagtttgatttggaaaataggtaagtgtaaattaaaagtaaagtgcttgtttattcaaacggaatgtttagaggctcactcttttttaacatcttttctaaaactgttattgctaataattatgttttagttgttccatgaagttaaccatccctcttactggttcatattgacataatttagatacttatctagaccctgcttcgttacaatgtgtgagacctatagattttttttcaaaaaaaacatagtcaacatcaagttcaataaaacttttaaaccaattatatatttctaccttagaaggttatatgtgcatgatgtagagaaactaataacaccaccatatgtgattgagtgaagggtattagaatctaagcactaaaaagtgtcgcaatgatacaatggttatggtaacaggtgttccagttttggtgaaaagaaagaaccaaatttttctaaaactttataataatttctctaattggtttgctttactccttattggcattttctatttctttttttattttatgcaagtattatttttaagttcaaatgtcgtgagatgataaataatgacagtgttacaccttaggtgtcaacttaaaaaaaaaatcaatcatcttttatgtaagcagccaagattgatatattttatcgttgtttattaatgaatagattgggcgtgggacgtaaggctacgctaaattcatggtctcttacagtgtgggaaacacccatttgggacccatttgggatcgattgaagcagcaaagcgagagcacaaatggctaaatataattaaagatgcatcattacttttgggatgtgatttttataacgcctccctaattcattcttcttgtttttattatttgatcatattttctgaggaaaatcacgaaccaattggattgtttggtctacctaaagaatcggatttttttttatgttatgctttgtgctattcatatttgagttaattctttattttccacatagtgagccccgcaccttggtgtaagaaaaacacaaaacctatgtgcacctgtcttgtaaccaatggtgaaactatatatgcatgtttgaagaatgatgtataataacataatatatgttgttaataagtatttaatttatttagatggcatacaaacttgcaaaatgcatcgtctataccacaataacatattgcttatatatagcaaaacattggatctaaaattgtcaattaattataaatagagcaacgttttagatagaatataaattagctgtgtacatttaaaattatggtcaacttaatactaaaattttagttttctctttttaatttgataacataaaataattaggaagagaaagagatggagatataaaagaattggaagaggaagagacagggagagcgtactgttcttatgtttttttctttttccggcccacggctgtacgaagtcacacgtatacgtatgttctttttttttctttttctggcccacagcagaggaagggattattttcttaaataatagatctaatccaatggtctaaaatatcggtctaccaatttaagtgaaaatcgacggtgagattatatagtgccatgtggcagtttaggagtgtttgtaggagtgacatgtggtggattgagagcgtttgtaggaagtttaatggacttaattatataactaggaaggtagctcgtgcgttgcgtaggcatctctatctttctgaatgttaaaattatgtatgatggttctttgtatgtattttggatatgaatactacttgctctactcttgaatagtatgataatacttcagaatcagtaacccgctatatctcattcttttaaaaaaatatttagcttgctttggataatattcaataactgtttgaaccattcactctatctccccctttccaacgattaaaattaaatatcaaaattaatgatataaatttgttatctgcttgagttcttgctaagtattattatttctaagatgggttaattgaatattctaacatgtagccttctagatataccaagttatgtatgcttcaagccaacgcgacttaaataaaattacatagatacttgatttaagagaagatttagtcataaaaaaatatttgtactggggttcccttgttgccttctcttaatggtggctcgatcaacaaaacacaaaaaatctcctatgggctctttttgtgatgcattggatggctggcaacctagtaaaactcaacgatagtcatccatacaacaaccctctaaaccatgcaacaggtcactacaacctcacctgacatggggatcctctagagtcgacctgcgggcntgcgacatgcngatnatcatttcaccg

SEQ ID NO: 106394 - DNA, 1882 bp, Oryza sativa
  unsure (1)..(1882): unsure at all n locations
gttataaagaacccccacttaaacaatagtttttataattaaaaaattgggtcaaaatttttggtggtagggccaaaagcggcctctttaaaatttaccgtaccattaagacccccaaacctttaaaagaagtggcccagagattctttaaaaggtatttggaggaaaaaccaatttttttttccctcccccccccttatttttctcccaagccagggggagtaaggtatcnccctttttaaaaaaccttgtcatgttgttcgggaaccaattgggcaagtttaaggaagtgggcaatgtttcctaaaaaacacacaaaaaagaccccggcggaaggttaagccttcacttgccccctggaggaaaaaccctccccaacggtgctcactcctcntcccctcaagagttgttaacccgccccccaaataagctcattgtttcaatcagatctgtccaccgcagtgaagcttgccaaccccatgttgccttttgccgcgtcaaccagcacgttacataacccgccatctttaccacctttcccctttggtgacaagctcgccacttccacaagaagtgatctcgtgcaccggttcatccccaaaagaaggaaggtagatggggtggagcatcaagcgccgctagatccagccccccctctcctccatcatggttagattcttgtcgccttccacttatttggaccagttggattcgccatgcccaactgccatcgccgttcgatttgtcgaaaaccgccacctgtaagaggagcacttccaaagctctggagcaacgcttgacactggtgagagggacactgagctctaccacagaaagagcccctcctcgtcgagagtaagaaaaagagagtgtgctcttgttgatcaaccgaggaagacaagaatgttaaggatcggatgaggatatttcataaaatatatgtaaaatatatatttgagttaatgaatacaatgacattgtttcaattaagcaaattgtagtggtatttttcaaagcaggcaaatccatttaaccattttctaatggtgtcatttattttttttgcgggatatgtaccagtacataagtacgtatgtacttaatctacgtatagttacgtgctttcttgtcactcctcttgtcgtctgcgagctaaacctcaagcttttgcttagaaaaataactgaaagcttaaattattgtacactggtggacaaaccttttttagtcccagttcacaaccccctatagtcccggttatgcaaccgagactacgaatccgggactaaaaatacccatttttagtcccggttgaaataaccgggactaaaaatggatctttagtcccggttgaagttactaaccgggactaaggatctagtcccggttagagttaccaaccgggactaatgttctttttttctttttctttaactgctgcttgcatgatttcgagctccacaaatcattcatattatccacaaatcattcgaacaccacagatcattcacaaaatccacaaatacatcaagctgcattttctttcttccaatccttccaaattatttcacaaattccaaattcttcccacaagggttccgagcctgcatattgcctataaggaggcggattacaataactgccggcgtttacacggcgggactgtgaaaacctgcgttacccacttaatcgctgtgagcaatctctctttgcagatgggtaatacgaaaagcccgaccgatgccctttcaacagtggcaacttgatgggataggaccgcctttacgggcttaaaccgggggtgtggggttaccccatggaccgttaattgtagcgctttagcccgtctttgtttttcttcttttttccagtggggtttccg

SEQ ID NO: 106395 - DNA, 743 bp, Oryza sativa
  unsure (1)..(743): unsure at all n locations
agctgaattgttatcngcttgccngcaggccgactttagaggatccccttcataagaggcctgcgagaagagatcagagataggatgtggcagcaaactcctgcttccgtggatgctgctgcccaatcggctctggtgcaagaggcgttgtataacttggaaatgcagagagctcagagggacccgtataaagaatgagatgccggcctctgtcgatttgctccggtgaactgtgggagtagtgctactgtgttgtttttatcatgtcgatggtctttggttcgattatgctgattagtttgaggaaggtccttgggaattttgggattcagttatttctagcatgtcgatggtctttggttcgattgtggtgctcagtctgaagaaggtccttaggatttttgggattcagttatgcgttgcttctgaagatcttggttagttggttagatgcgaattttcatttatctctttgaatggcaattctggggttgaagtattgctttttgcttaatgcccaactttaattaggtgaactttatgtttagctctcctggttctataggttttatatcgcaattatcttaggcaggtcggaacattatatattctatatttattttcatgcatggttctttgagctgtgcacattccttgggtgtagatgccggtattttaaaaaaaaaaagttcctttgagcggggcaggcctacttcccggaaacggtaaagatcatctgtttt

SEQ ID NO: 106396 - DNA, 983 bp, Oryza sativa
  unsure (1)..(983): unsure at all n locations
ttatgatgggaccctccgtagcagtagctggcggaggcgcttggtggtgatgccctcgacgatggcgatgtcggatgcggggagggacgctgtgcggctcgacacgctcccctacggccacgccaatgcaaccttgctgctgctatacggctctcacctttacctcatccgcatccaggtggcacacgtcatggcaaggtggggagcgccgagctgaagtcagtgcgtgggctacttggtgtaatgccattcttcatacaggcaacactgcagcaggcgatgagaaggccaactacgggggtggccgggcagcttttgaccaccatccaccagccccgctatctcgctcctaccgccccgaaccatcagctctgctatcgtttggtgggaatcgattcctggccagctagttgatcgagaacaccgttccatacacaggtagagaaaccctttttactctcggttggggaaccctttagtcccaggtttccaaccgggagtagcaatccggaactaaagatgggcatctttattcccggttgaaataactgggactaaagatttagtcccaattgttgttaccgaccgggactaaagaggatagccaggtttttttttccttttttattttctcctgaatctgggtgtattttcttctaaatatgggtggtttgcatatcccaaatcgaagtaagatcccaaatccacatcacaaattttaaagttctaaaaaattacatcacaaattttaaagttctaaaaaattacatcacaaaatcctaaaaaaaattacacacaaatcaaattncntcncnggtttctncnnnttcnttcncntatccttcncngttcnctcgcngggtggnagtagagtcttaataacacgggggggggggagaggnaggggagagacggacgccacaacatattatgtataaaacagataggggagaaaaattattgaatctagttacacggatcgg

SEQ ID NO: 106397 - DNA, 754 bp, Oryza sativa
  unsure (1)..(754): unsure at all n locations
ccggtgacatgaaatgctcatcccgcatgccngcaggncgactttagaggatccccgctcaagtaaaattcttctaactactggtgcaatatgttcattcaagcactattcaacctggggaacttggaccatcaattgagaagataaaatagtaggatggggctgtatagtctaggactctagtagcatacaactcaaatatgacatagtaacttaggctgcaacataaacgcaaactaacagaagtgatatttcattcttgaaggtcacaaaagttctggaactgcatgaagcaaagtagaagttacatgacttctgcattgaaagagaggttgtctccaaatcatatcaaccatatcaaggtatgccaatctatccttaccaagctagctactcaatcccttttgctttggtctaactacaatatcataaatatttatgcaatgcaacataataacaaaaaaaatgtttcaaaagttaattcgtcagcaatttccttatgtgccataagccacacaaaggaacaacagaaaccaaagaagtggcaatagcaacagggaggtcttagtatgagtacatattatcatgttgccaagcccacaagatataattgacaagccaggattctattgcattgagttcaactaatgagccacaatcgggagtggaaacacaccactaactaaagaaaattatgaagtattcatgtagttttactatactgttttttcatgaaaaaaaagccacaaatgat

SEQ ID NO: 106398 - DNA, 895 bp, Oryza sativa
  unsure (1)..(895): unsure at all n locations
actccaactatggtnactcggnggnttatntggtttaatatttccncnnctcgttcctntcttctaantttntctaccactcaaaggtggataatantgtctcttattatatcncnnncnntncnnnnnnncnnnaacgcgtgaaattgcanatccccatngccgcangccnngcagncgaanctagaggancccccaagaccaaaancccaactatggcatgaaaggagagaagggaaagacgaggaggaagattataaacatgggcttttacatagagggggcatggcattatttatttatgagtaaatttcagaaaactgcaactttagtgacaaaattatcagtttgttgtaacaatagcgtgggaaattatcacaaaactgtaacttttacgttatatgctgctacagtacatataggtgacaactgtagcagcatataatataaaagttgcagttttgtaataatttctcacgctattggtacaagaaactaaaacatgtcgctaatgttgcaacaaactgatagttttgtcactaaagttgtagctttctaaaatctactattcatttatttattatattgattgtaatgcaacccaagtgccacggaggtgccagatgataccagtgggaactgcataggaaggtaaaatgaagaattggtatcgaaaattgagggaggttggatacatgaattttcgattgcgaggaaaacccaaatgtaatatagactttcttttccaaaactaaccatgaaatctttgcccagattagtctagctacaaagcactggccaagagttcaaggccagaaactgggtcactaagcgttgggcccagttacataataatgggccaaagcccaaagagggcctttcggaacttaaaacc

SEQ ID NO: 106399 - DNA, 1232 bp, Oryza sativa
  unsure (1)..(1232): unsure at all n locations
ttagttgacgcaagacacttaaactgattggatgaaaaaaaaagatgttttatctttggtgtggtcaatttgaactaatttaccccctttatgtatgcaaaacacattaaactaaccgcacatatgtatttaatagtcaccctaattaattacttattggtatatatattcttgtctaaagcatcaagtaataaggaactggagggagtaagaatttaaatgtgtttgcatcatatgaatgtatactattttaaaggaatatgttaatcctagatgtgagaattaatcatttgctattttggacatatatatcatatacataagagatttcacattggattgacacgtaagtgacaaatgattagcggcaaatttaaaaagtgataaatagttaaatgtccctacgttaaaagttagtagctagtaataaggtgagtggtggatctgtcaccatcccttcaactccatatttctttcttttaaggagaataaataaataaaagtgtaggatcaaagaatccacctaccaacttataaaatatatgtggagattaagaggtgagatatgtaagtgatagaaaaatgagtttaagcacgaacaatatgctagttccatataaaagttttgtatcaaacaattaatatagtagtagcaagataaatttctactataagcgcatatttattttattgcaactttcaaccttaccaaattttaataggataacagactaaacacagtcgacatcctatcattaccagtttgctaccatattaaaatttagtaactatgaaagttttctcttccaaaaacttcaccaaaattcagtaatgttccaaaccaaacaaatacaacgctatagaaatttagcaacgtaaaaatatgccaaattttagtatttgtaatgttgattttgataataaaatgacctggccctaaaacttgtagatccactgctaagataggtgttattctcggcttctgctagtaactatccgtcccaaaataagttcatttttcacatatttcacacgtaccaatacaaaatcagactaccctcattttctaaaatggggatcctctagagtcgncctgcgggctgcgacgatgcgcaatcattcaacctgnnnnnngnnnngggnnaaagaaaaaccatacccctaatccgtcaaccgaaacacgtaacncagttaggatttacccnataccgccgtagaccanataaccagta

SEQ ID NO: 106400 - DNA, 892 bp, Oryza sativa
  unsure (1)..(892): unsure at all n locations
tctccgtttatatatttttaatttttgctnnnctgttcccacctttggcttttttttttatnctttttatctatcntattttttncnnncnnnnnnncncgggtggattcaatcctcatccccgcagccngcaggncgactctagaggatcccccccgctgcgtcgatgaagctgtcgccatccacaacgcccaggggaaaaaggagagaggaagggagacgaggggaaagagagagtgtgcgctgatgcggcatcctgacatatggatgctgactcagctgttacataggataaaaccgggttaaaatcatcgaagtacctattttaacctattttgattagttaagagacgccggatatttgttcttggttgggggacgattttgtgactggatgacaagttgagggaccttcgttgtactttttcctcccagtattgctatctgggccaagttctctcggtcctgagaaggccgtgaattgggccactgcgtgagtagaatttatctctccggttatgcgtgagtagaattttgccacgataaaaccatttggattagcacgcgtgattctctagaaatcatattgcaaggaagcagactatcatatcgagacgacccggcgagaacgagaccccgagaaatcatggccatatacttactgattggaaaccccgagtgagctggaagccattctctcaatcctgtgcaatgatggcatcgcccactgattcttacattaagatccccttaaattaggtagcctggtcatgtttaattttgcattaacttatcggagcgctggttgatcataacccgtgccaatcagtgaagtaatttatacatccaagaacactttccattggattttcatttcgtttcccctgccttt

SEQ ID NO: 106401 - DNA, 1291 bp, Oryza sativa
  unsure (1)..(1291): unsure at all n locations
agtcattgtgacatttgaancnncatccgcangcccgcaggtcgactctagaggatcccctaacatgtgatatatttctctacaaacatgtaacataaaatccaacttttacatatcacaatgaaaaaacaaagttgattgtgaatatacgttaactaactatggtaaatttagttctacaaaatgaattaagttgtagttttctaaaatcatcagctattgttataaatttttaaatgacttgtttaaattgtgctaaccggtaattaacaaatacaatcatagttttttttaaagaaaggcccagagagcccagctttttactgaaagcgtaaggtttggttcgatacaaagcgttggggactccagctttcgaacacggtaacaccgcacacaactctcaacagggactcatgggaataattaactatttgtcacttttgaatgggtaattaaaaatttgttactatactcacatattatagatacatgagggattatgaattgcaaatagttaaatgtcccggactcaggccgcaggccaaacaaacaagcatactaccctaaatccaacaacacacacaaaacaatcataatttttataaaatttgctctggttaatttagacatgcaaaataatttagaatgtactgcaaaataattttaaaagttaatttgaatgcaataaatggattagacgacaaggaaacatcatttgtatcttgtatcagtatgaaaaacaatttttccttctaactagtaactagtacagcagtatactattagaattttaaaagataaagttagtacctagtaagaaaggtttatttcttcttgtctgtatttgcatgccatataaatcatatttttttaaaaaaaatacccggaagaacaatatatgatttattccctttatgaaggggtaaggttaaaattacattacgttccttaccaaaattaataaattttctactcttgaatttttttccgggacagttgaaggagggatatcaattcattagggttgcagaagacctaacttacaatttaggccgtgatatccaaatttattctcttaataaacatttaaagtggaaggcctcctttttctgaggaaaaaaacaccctccttaggggcttctcttaaggtaaaaagggggcacaataattaggtacggcccatattcccttttagagggttaaaattatggccgttttacaaaagattatgaaaactgtgtttcacatataagtctaagataattctcttcatgtgttataataagacccc

SEQ ID NO: 106402 - DNA, 720 bp, Oryza sativa
cgtatgtatgcaatgtccacccatcacgatctttctgtcctcctgaattcttcccgaagaacccaatccttctctcttttgcacattcacctttgcctgcagtgccaatgaaatggacttccccttgttgttctttgaaaagccagggttattaatctcataagaatcagatgaagtcctaaagatcactatgtcatcttcgctattccagctcctgttcatttgctgccccctggaaaatctcacatcaggcagctcaagattggtccgagatgactgcagctgccgagacactgccctctgagaagctgggatattctcccgtgtctcagaaatcctcaaaggaatccgcgcaggactgtatgagcagattttctccctagaactgacctgtggccttggctcaagaatcttggctgctgcctccatgatttgagccgcatttcttgctgaactaaatcccggattcttgattggagataacaatctgtgatgggacattggtaagggtttggctgaccttggcggcaatgtttctatctggaacctctcaatcgggctgctcggcatcttctgagctctcagatccaatggcttcctcatgtagccatcaactcttcgtggcacataactgaactggtcactcccggagtactctgggcttctctttaggctctggctgtccctaaacgaccgtgtgtcacggaatggtgtgcagta

SEQ ID NO: 106403 - DNA, 1364 bp, Oryza sativa
atggggcttcagttccagaacttcgcatagttcatatctttggcgtcaacctcatagaagttaccacttcatgtcatgcgtcaacactagcttgtcattactaagatactatgcttgtcatcatgagaataccatgcttgtcgtcatgagaataccatgcttgtcacttacttctaacttgccaccaactgcctcatattaactttcctgctctccgggtgctagctacttctgctattcgatgcaagggtcgataactttgcctttgaattatgtttctcaactgaaccaacttctcccatttgacatgctttgacgtcttcccaaatggctttactgctggacttcttattgtttaatcgtatcctgccaaatctgaagcttcgttgtctgacctctgtagactatcttcgaacatatcacttggttcataactgggaatagctctcacgaacaagcaactcggattcactttctttacatttggttcacttcccactattctcttcatgttgtcctcagttagcattcaacgtattcctttacacctttgaccttgatgtgttctttcccgatttctcttatcaatcacctttcgacctacttctttgcctggtaaaaaacatctttttcgatatcttctatcaatcatcttttgacctttgtcaactaagtactcttcactccgagagttgtggatgcttctggtgacgatgtggtacttgagcctgctgcctttcagagaaaccttcaagtggtttgtcaaaagctagactggcggttgttgcctttgttccaaagaggacacatctgaaactctcagtccaaacaaaagtctctttggctttttaatccaacacagtttaattggttttcttttccatcaacaggttggttattaactcgagattagtatatgattcctctgaaatgagaccctaggtctcctttatcagtaagcaattatacacataatcacatatccgcatcttccaaaagaatcctagtagaacttgtctgtattacacatttctcccttattacatgaatactaagcactgcctaaaaggaaaggtgcttagcatcggtacattgtttctgctatgggttctgattaacacgaggcctcacgggtacagcgtttgctccagtgaccacaatacgattgggatgtctgcttcgtgtaaattggcggtaatgtggaggtcgactttgccttggttgcaggcagtccctcgagtaatgccctggttctttgcaattgtagcaaatcaacgtcttctttgctgagctatccgtctggggacggtcattctgacttggagttggaattggtggctggaaatccttgctaacattggcat

SEQ ID NO: 106404 - DNA, 883 bp, Oryza sativa
gggactttgggccagacttggcccaaaggaggaagggggattacttttaggtttttctttttaataaaatttgataattgtttttgttgcttaataaatatttacggtgctctgaaaattcaagtaaaatttgagggctcattttagaccaaggagaatttaacaaaaattctccgggccacattcgaatttttcttgtatgtattttagtgttaactaatttcttttcgaattttaattaattctattattccttttggagaatgatttttattttgggatgaatttatcaggacgtgacaaatccaccccccttacaggaatctcgtccccgagattcgaggaggctagcaagaagataggttgggcggtcttctcttcttgtctgacttcttctgttgcgtcttcacaaacttccagcaaaacttcaccactcggaactgcttggcttgacctcctattgcggatggaatcttctcttcacctgactcgaaccagggtgcaccttttaggttacttagactaggttgcggtagtttaatgatgcttccgttccagaacttctcatgattcatatcttcggcgtcaacctcacacaagttatcaacttcatgtcatgtgtcgacacctgcttgtcattactaggataccatgcttgtcatcatgagaataccatgcttggcgtttccttctagcttaccaccaaatgcattcgactatgatatcccacttaccaagggtaccaagattgacaacttgccactaactgcctcattttagctttactggtctccgagtgctacatacttctgctattcgctgcgagggtcgaccattctaactttgaattatgtttcttaagagaaccaacttatcccactcg

SEQ ID NO: 106405 - DNA, 822 bp, Oryza sativa
gaaatcctctctgccttctgcccacattagctttgtgtcttggattgaaccgaagaaagagataatcacacacgttcccttggattcgatacccttggaatactctgtaaggaaagtgctacatcggtatatctgtgcgcttgtggattctatctgtgatcgtaagaaataccaacaagcatttctggtgccgttgctagggaacggttgctgtttatttccgaaccttgttcatccttatcctttttacctttttattcaacctctacccctgctatcccatagaagtattcctgttcaatccttctcgaccatggagcaacctctcttcgagttgtgcgctcctcgggacgaattttacgagccacctccttcatcggagccaattttaacacctagctatgaaattcgtatcgaattcatcagtatggttagggagaaatctttctctggtttaggccaggaaaaccccttccaccatcttcaggaattcgaaaagctttgctcgtgccttaagattcgagacatgaagcaagaaactgttcgttggaaattgtttccgttctctcttcatgagagagcgaaacaatggtatacatctaccgttgggtgtgtaaacggtgactaggagaaattgtgagacatgttctgcctcacattcttccctataacccgtattactactcttcatgtagaaattctgagtttccagcagataaataaagaatcgattggtgcagcctggttcagattcactaatttagttcagtctggtccaaccctgtctatacccaattacgtgctattacagcattttcatgc

SEQ ID NO: 106406 - DNA, 706 bp, Oryza sativa
atgctaattaggaactaaccaagaataattctcacgaagtaaatcttaattactcagaatgatatttctattaaagcagaataattaacaaagtacaagaaatagaagaggattaccgaaaactccgaaattcctctgacttcttctattttactatctccctaatttagtatacaatatagtacaatgagcctcttatatttcagctcaagcttggagtgtgtgtgagtgaagtgagaatgggagctctatttatagtcaggtaatggcggttataactatgtgaattgtcggaattgcccggcaaccgccatcaagagagcatctggagcgtccataccaaaacctggatccaatggtgatcaccagggctgaacctggattgggccagatggctcctagatttggtctgggcctctttctcactctgccttatccatttctcctgtagttgggcccattttctgatgttttgatggagtttaagagcccaactcttgtatggatagaattcttattcactttagtctaaatttcctcccaactttagtggtttagtacctgcatccaaatatgcaccaacactcgtggaatatgtcagaattaagccctaccactatgttggatgtatcattatctaagtattatgcaggtattggcggcataaaactagcatttaatagctgccaagacagagcaaccgctg

SEQ ID NO: 106407 - DNA, 1509 bp, Oryza sativa
tttgataaaaatggacatatgagatttagccatatcattaagagtacattttttactaatgatttaatctgtgagtaaaatttttcattggctgcaccctcatacacaggaaccatatattgataaaaaaagtaaatttcagccacatcaatgcctcagaaaatttgacattttgatccaatctcaacttacactatagatggtaagtcatccagccgcaagtttccagcagtgatagataggggtggaaacgagcctagccaagcctagctcggctcggcttgcagtggctcgcaacaaactaggcttggcttggctcggcttggttagggaaacaagcttaaaacttgagctcggctcggctcgtttcctggctcgagccagctcgagctggcttgtaagacttcctgttaaaacacatcttcatatatattttgtaattattaaaaaaagcaagaacaaattattaacatgtaaaattaaaataaatttatggtaaatttgaagttgacaaataataacgccatataaaatgaaataatcgatataaacacaaaatggcctaggctcgcgagccaaaataagcggctcgcgagctagctcggtttggctcattttagcaacgagctgaaaaggaggcttgggcttggctcgtttggcttacaagccgagccaagccaaccaagctcgacccaagcccgagctgagctcacgagcctgagctttttttccacgactagtgatagatatttggtttggtatgtactctaacattgtaagcgactagtaatttcgttgagctctaatggtcttagcagctaattactctctacactaatatgaccagagcaggattatacttttttaatttatttctgcttttggcttaagatggaaaaactaccccctataatccgctggatcagattatctcgcgacaacgtcaattcagtaaccacaccctcctttctttctgaacacacttgctgtcgataaccatccaagacccaactttatttagcccatctcaatcagcaacacaaatgaccctgacccacgatccactcacaagccattgctcgagatttgagcttgaactcttcttggcgggacccaaacagtgcacgaatttcagacgcattgcataatcaaacccccaaaaaggaaaaagccgtcgcctttcaccaagttcgaattatttttcgcctttggagacggcacaaaaggcaagaaaacggaggaggaaaactaggccacgcattgacaggatcttctcccttgtgttcttgctgcttttctgctccatgtcctgctcttggagatggccatggctctggctctgagctgtggcaggaggcagagagggaagaaaggcggcggcggcggcggcgactgcggcggccgccatttccatgtccactaccatcttcctcgccgggtctgcgcctcctcgtttgttcccaatttgctgcctcgttttttctcgctgctgtcagcttgcgtgcttga

SEQ ID NO: 106408 - DNA, 780 bp, Oryza sativa
catcatgcctgagtgcagtccaatattatcgcaatctgcgtgctgagaggaatgatatcttgaactaattatgtgataattgcaagatgtaatacatctcaacatattgtacataatgtcttcttaaatttatactgtttgcacgaagaaatgatgtgcttatgtatttgttaggtctacacataagaaagtcagtggtctacattgcaaatggaaagctaatctttagaatcagccatatcatttattgagttcctatcaatacattagtagcttatatatggaattatttatcattgttgattcccgttctacactgtatttggtgtttatcatgcttcgctttgtcagttggcgacttgacatgattggaaatatttttgccttttgatttctctgtggatagaatgacattatttgtttatctgtttcttcaggaatcaagatttggcttaaatgggggaacgatataaattctttagtggaagtttcagctctaacactgacttggtatgatgttgctgtacttatctatttccctcgaagatcttccctggtcgcagcaagatccgcccaaatcccccaatctgtacaaggtatttggaagaaaattggactataagactcaacataaacttccaggtttaacaaattagttatgcctgttgttttttatcatggattataaaatgtagccgttctttcagattgctctgtacgtatgatgaggttggcatttaggattgttcttttatttgcttaatatactaacctcctaat

SEQ ID NO: 106409 - DNA, 591 bp, Oryza sativa
ctcatggaaacaagatagaatttattaaataaaaaggaattattgagacgacatgtccttctttggtttggcaaagccacatgcactcaattgttccagcttatctgttctgttactacttaccagacaggtggaaacggccagtacacatgtcagatgatatccaatgaaacaataacttttgatgttgacacgttgatacatcttagattggccttgacacctttgcggaaatgaatgctataagctcaacaagtaggaaaaagtaaatgtttggtttccttcctggtcaaatgaagaaaaagaaacatgatttaactgcaaacccacttattgatgctaacttggagtatgttttaaaatttactactactgtttcacaaattttgccggtttacatacccaagagatttaatattttattaacatttttaatagaattaaaccataatatatgctaagtgtagcattttctctatctgtaatcatagttcaattccgttgcacattacgtgaattttgcatttcatgtatacttttgccagcatccactaggaccactagtcatcctagaatagtaactagtcagag

SEQ ID NO: 106410 - DNA, 593 bp, Oryza sativa
ccactcgaccaaacaaaagtggatctattgccccctcaattccctacaaggaaaagcaagaacaatatatggcagaactcccaatccctctcttttgttttgcggtggcagcacaaaacctaggagaagaacaagagcaaatttttacaaatacatgggttagaaactaactagaaatcaaatacaacacaatatggaaacctctctacaacactgttaatttcttttggctcgtgtagtggaaccagaaggagtttgtttctgttggcccctccgtcacttgggtcatgaagttagctttccaacaagtgcacacacgtccaaaacagactccagacaagagagaaacaagcattttagtccaggtatgtccaagctagcccaaaccgagttcaaactgaatcttttctttcttatcttcaaacttcttgttttggaaggcttcaattcgtagggaacctgtaaatagactccataccaacccaagatgggccttgggataatagaaccccatccaaacatgttgtacaaggctcacatccaactttgatgccgctgcttgtgcaacatgtctttaacttacaattactggt

SEQ ID NO: 106411 - DNA, 1016 bp, Oryza sativa
gtgtaccttgtgtagacgcatgctcgagaccagaagatactcccgagaatgacacaactacttttcctagtcgctagctgctgcatgaaggaaaaattaagatacaacgccatcaatattgaaatcggcatttggctcggattacatgtgccccggactgatcgatctatcatcaggtaattacttcaatcctactagagcctctgggattcaattggatgatacgtggatgcggacggaccgcaatttttttcctttctcgttaattaaagtcggaacgtccgcgtccgctccgtgaggatttgataacagacgatcgacagcctcatgctggtttatttttcttcaatgttttcaacgtaaagactttgaaaaaacgtatactacttccatatggtgtacatcaatatcatctagcacaagtgtccggatgtcgacgtagcgccctcaaacaaacaagtgagaaagataggggtgagaaatcccaagcttaagctataactattttttattacaccgaataaatagacattaaaaattttattctctatatatgacaagatctagattctagaactaggaggtggatgtgatagccaaaaataaaaaaaagagaatttatgttaccacatttaaccaatacaattagaggcatcaagtattacacatacatttaacatccatatatcaaaagaaattaaatttaaaaacatggaggttttcctttacaattttggatggattaatccattacaaattaggttttaaaggttaaaaaagttggaaacctagtgtggaaatgagtagattttaggtccgtaagaaaatcccccgaagatttgaagttcaaaacctcccccctatatttaagtcactttaggagagagaaacttcggggagaatgaacagggctcggagaggaagaagactatataggagcatcttttcaggcgggccatataagcgtcgcctgcgaagattgatcttcgcaggtggaccatataagcgtcgcctgc

SEQ ID NO: 106412 - DNA, 934 bp, Oryza sativa
gaatggacatcttcatgttaaaaagtttacaacatcatatctatattatactattaatgcaatggtcgtagcaatgaatattacaaaatagtcctacacatttatatttttacactacttccctcatgtagtttgatattacaacatagtcctacatgtggtttaatgttatttcatctctaaaatacaaatttgtcatgcaaagacatctacagggaccaaatgttctgaaaacctcaattaatttatccaaacaatgcttgcacgtgtataattcatgagggcctatgagcatcacacttaggccctgtatagatgggactaaaacttttaagtccctatcacatcggatatttagaaattaattataaatattaaacgtagactattaataaaacccatccataatcttggactaattcgcgagacgaatctattgagcctaattaatccatgattagcctatgtgatgctacagtaaacgttctctaattatggattaattaggcttaaaaaaattatctcgtgaattagctttcatttatgtaattagttttataagtagtctatatttaatactataaattagtttctaaatatagggactaaagttaagtccctggatccaaacaccacctaagccgttgtagcctatagtagaccttgtccaatggcagtgccgcagaggacgaggtcactatcacagcttccataaaccccagcaagttctacactggcacaaccaccaacccaagatcgagggcctctgcaccatgaagcgtgaccgggacgaaaagttcaccgctattgacctgagaacaaagggctcaccacaaagaacaaggtcagggacgggcgacactcttggatggcagtaggatgccctgaatgagcgatgggagagggtaagaatagggcgctgtgcatcaaggaa

SEQ ID NO: 106413 - DNA, 673 bp, Oryza sativa
aacaaacaagatgctaaaaatatagatctttgtcaaaatatacaatgatataatactctgaagattgtcacagtttgtttagctatatatatttttagtgattaacttcactcatttctaaatattacattatatttgtaccataaaaaattaagcagttttgattaacaccataaacaaaattttgtctaaacaaaacataaagaaactatattttatattttataggaagaactaaagaactatttgcatcatatccatcttctctttgttcccctagagggcaccgagcatggataccacaagtatagcatggagcacatatatggttgagttgaggcaggcccaatggaggccaccattgataatagtgctcaacttcctacttactaatggaattatctctgagggtgccgatagtgaactaggattaattaaaattgtgctccacactggtcgtgagactgtgagaggcatgactatgttgacccatgcttgaaggaatcttgatggttccacccattagaggggcatgtctatttttttaacggtgctatgctaataaccaatagaagcgttagttttagaatatttattcgtagatttagaaataagtgttgacataaacatttaggtacatagttgaaagaatgtttatgcattaatgatgtat

SEQ ID NO: 106414 - DNA, 1146 bp, Oryza sativa
  unsure (1)..(1146): unsure at all n locations
atatatatatatatatatatatatatatatatatatatatataatggatatattttttaaataatcataattttacaaaacaaagaatctaccatcatataacaaagaatcttcctttcaaataatgcactattttaaaataaattatgttgatatgtacctattaaataaacaatatctatattaataaatttatacatgcacataaattgatggccccattacataaatcatcagatctacttttcattaccttggtctattattcactgtttcaaaataaggtctacaccactatattgtgtacccattaaattaacaatttaaaatctatattaactaatttaacttacactagaactggtggacttattattataatcatcggatctattgtttgctaataaatcagcgtncgaaattctctttttgcccactgcacaatacacgtatgcacctttgcctttcgcatgtgtgacaaagtgtagtgtctgagacatataaggtgatcacaaccgctgtagagctaccactttgccacaaatcaaatcatatatggagatgattaattttgttaataacatgaaaagaaaattaatgtgtgatgcagtgagagaataattaagtaccatgaattgtgcttttctcaccactaataagcttggtttaagttgaaaccaagagttgataccattnnnttttaaggaattggggtaaggtaatattaaaatttggaacaattggttggaaaaggtgaaatgattcataaggtaataaatgtaaggccataattgacgaaaatgaaaagaattttaattagaccaagggtaataaaggaagtttaaggccttttttttttttccgattccaatatttgggaatttggttggaagcctttcaaggtttttaaaaaggtttttttttaaattaaaacaattttactttttaaaaagccaattaattatttaaaccctccaaaaaaaattccaataattaaaataattaacccattccaaaaaaaaaaattccaataaataaaataattcaccaatttcagctatggtaacccttaagaacaccattttttttttcatgcaagtcatggtgataaattattaaagtcgtaagatgaatatgtaagagtta

SEQ ID NO: 106415 - DNA, 1562 bp, Oryza sativa
ccggcgcccccgacagctccgccactgctcatacaggaaacaacctcgtctgacatagtgtcaaccttttgctattaagacttatattacttgtttctcgtcctttattctatttctttgcacagacttcattgcacaatcaaatcaacttatattacttggaagatacccccttggttccacaaaggcttcatttttgggtcatgtgtccaacatttgaccgtccatcttatttgaaaaatttataaaaaaacaaatttaaaagtagtcacgcataaaatattcataatttatcatctaataaaaataaaaatataaattatagaaactttttgaataagatgaagagtcaaacgttgcatccaaaaactgaaaaatggagtctttgtgggatggagggagtagaatagcacaagtacactgttaatatttcatacgaatagaataacccatcatctgtcccgtaggcttagaaatggcacatgtaagaaatgaagtccacataaagtttagtttgcaagatttgatatatcaagatagctcagtcctaaaccacataaaagagggtacgagcggtttaagtgttcgaattaaatagatgagtggtctattttgtttgctttcatagttgaggacttgagggggccaattgtacttttgtaatagttgagatggtaaaccggagcaatgatgagagggagtaatatagatagctgaatattgtggtgacttggtcttatcttattattattttttcaacatatataaacccatgttgcatgtaactcaaaaccatgctgtgtagtatctttacagggcagtcgtgaatgatgcttcctatgagttcagcatgctcaggaggacaattccccggagcttcacctcatgggataataccaaagcagttcagcagagcgcctcgtattcgtgtcagtataagaggtatgaggtacctcccaagtgctacaaaagatctcttaatatatggtatacctctttgctactccctccgtttataataagttttatattataagtcgcttgattttttttctagtcaaactttattaagtttgaccaagtttattgaaaaatttagcaacatctaaaatattaagttagttctattaaatctaataaaaattaatatattttgtataatgtatttgttttgggttgaaaatactactatatttttctataaatttggttaaacttaaaagaaatttgactaggaaaaaagtcaaatgacttataatataaaacggaggaagtatttgagagtacagttgtcgaagctgttatactagacagataaattttattgtctatcacaatcctttctattgcaaagagatatctcacacatttcctttgctttccccaggagcagcaggtgttgagaagagcctgggattagggaggaatgcgggaagccagcaaggcatggtacatggcccatttttttagggagtatctaaaaaaccccccaagttttttaagggaaaaactttcaaatctaactatagtataattgttatataattcccctataactatta

SEQ ID NO: 106416 - DNA, 678 bp, Oryza sativa
agttttaaatccaacaacattttttcattaatttcatgtccatttttttttgagatttatgttttatgaatcatccttgatatgctttgatcttgcaaattgggatgaaaatagaagtgcatataaccttgcacagggtaaaggcatatgtttaaattttctctcgtgtattgaagtaatgatcatagattcatagtatttttagtgaattctcactaaactgaagtctcttataacaaatagaaatttctagattgttctacgttaaattcaagaatttacaatgtactatagcaagttttaccaaaaagaaaaacatggacaatgttaagagaaattaattaagttggtagaaagtcgttagatgtctaacaggatataagtaataggtggagatccatttgtggtttttctttgacatatagataatttcaattttaattgtcagggagataaaaaaacagagagtaaaggaatggtgcatgccacacacgggcagggagggaggaaggtttggcatgtttttctaaatgattaatctaacgacctaaatgatttgtcatatgtttaatcgaaatcgatggttggaagttttcttttcttgtcagaatttggaggatattgtctcacttaaaagagcaatgtaacagcttaaagagtgcttataagatgtataat

SEQ ID NO: 106417 - DNA, 651 bp, Oryza sativa
acagatgttgccgtcgcccgccgtttcccgccgatacccgttgcggtcaccacagacgcccatcagaaagaagatgtgaggataagagaaggtgtggaggggtagttgagtagcattttcatgtaaatagactaaaaacttaaagggtagtgggtcttttggggtggagtggagctgtggagcagcaaaaacctagctccacccccgtagttcattttctaggaatagttctgctaactccgctccagaaaacggaagatatggaccgtttggcacagctccggttctaggtaagctagagctgtgccaaacggggcctttatttagaattttcaatgttatcatttgatgatctccatggtcagggatgcttatggtacagcttcatcaagaagagccttcatggcatatgtgtttgaagggttaggcaacctacaagactggaatcaggtaatggcgtatcaaaggaagaatggatcgattttcaactcgccttctgcaactgctgctacaataatccatggccacaactatagcggcctcgcttacttggattttgttacaagcaagtttggtggcccaggtgtgccccccccctccccccgggtactatatgtattttgcccaagcaagtgaccaagaatgtcaact

SEQ ID NO: 106418 - DNA, 733 bp, Oryza sativa
taaaaatgcttacattttgggaccgagggttattttctacttgtaaatataccgtttcgttttttctcgagtataccgaacgatgggactgaccgatctggcctaattaattgcgggaacaacctttttaatgcaggggctgagttggggctagctagctaattaagataagccctttaatttgttctctcagtgattgggaacagcattaggaaacagtaaactgctactaaaatttcctgagcatgatgggaccggtatgtgacatggccagtacaatgatcatataatccgctgagatcgatcgctggaggttctgggtctcaggtcactcagccgaaacagtggaggaatcgattcctcaggataaccccgatcggcccggaacgaaaagggttcacgccctcacgactttccatcaggaattcaggatagcaccttttcggcacacgtcgtattcttaccagttgaaatctaagcttaggcagttgttccagttccagtaggagctccactgtggacttcggacttcaagtgcggatgcggatcccgtgagaagtgaagtgtttgccgtcagataatgctccaaatatgtaatactaacacactatttatggaaaatgaaggatacaatgcatacaatcattttagtgttaaccacaacaccatgccatgccggtagacgttgacagggatcgacgattatttgaacctaggtgattaccgggcaaag

SEQ ID NO: 106419 - DNA, 666 bp, Oryza sativa
caattccactccaggcccaactccaagagttaaatttaggagttggagctataccaaacaggcccttaaataaaggaattggatctggagtggagttgtggagctgactaaacccagttccactcactctatgagagagccctacttagctttgcttctattttaaatggaactgaaactatttggctgagctctatgaaaggtggagttggagatgtgctaaacaaaccttaagtataagacggtcaaatattttagttgatcacaataaaacattatgctatatatagtgaaataaaataaacagtcaatgaaacatttattttttttaaacattatgttcgtctataaaatattgagtattaacggtttgaaatatttgtttttatttcatcggaatataatcatatgatatattgttttaaagatttaattataattaatacaactatgtgatcaggtcgtagatcggatatagtttaagagaaaaaatattttaaagctcgctaatgcatgcatgtacaaataaaacatgattaaaaaattggtgtactaccaaagttattgtgcgcatagcgcattacaacaaggaaaagttcctagtggaaattagtgagatcaaagtattttatcattgatttctttgtgaacatgatgagtatgata

SEQ ID NO: 106420 - DNA, 1263 bp, Oryza sativa
gatgggttatacaactttgttgttgatgacatttttagttgaaatcatttagtatttgaaaatattgtttgaagttgtcatgatttgaaattcaaattcgaattatttaaaacaaagtcatatcaaaatgaccaaaacaaaagttgtagatattgatgagttatacaactttgttgttgatgacttttttagttgaaatcatttagtatttgaaaatgttgtttgaagttatcaaaatttgaaattcaaattcaaattattgaaacaaagtcatatagcaaaatgaccaaaacaaaagttgtagatcttgatatgttattcaactttgttgttgacatttttttcatttgaaatcatttactacccgaaaaattatttgaatttcttgtattttaaaattcaaattttatatagatcaatcaaactcagatagagaaataaccaaaataaaagttgtagatctcaataagttatacaacttttccacataagttaatttagtatgataaaattcgattcgaagttttaatattttgaaatttccaggttaaatgaccattttgtgcaagtaacttgtataataggtttccagatagcaaggttattctggtaaaatcgcatcaaaattggtacttccctcaaccctagccgattccaaatctgagtccagatctcgttcctcttctttccccaaaccagcgcctctcctcctcctcttcccgcaccgccgcctgattcgacgagacccccgcctcgtccttcctcttgttcgccgacgacggcgctgtcgctggggttaggggccatggcgcgtcgcggttcccctctcctcttctctcacctcgcctcccatggcggccgcgctcctccgccgcacgctccacctccacctccgccgcgtgctcccctcccctccccgcaccggcgccctcctcctccatcgccgctcgccgtgccgtcttactcccacctaaccgcttaccgcgctggcctccgtctccgctaccgccacgctcgggagcggcggttctgccgccgacggcactcctgggcctagggcagccagatcacgtggcggtagtccccgggcgtctcgacgatggcgtgtggctgcatgatgcattgacagcttgtagcggcagccccggggcgctttgattgcctgatttttccgagctgttgcacgatcagcttggaagtggattcgtcaccgcctctccatttccccaccacgtgcatggccaaatgattgcgtgagcctaa

SEQ ID NO: 106421 - DNA, 673 bp, Oryza sativa
tcataggtgggataagcctcatcaacaagagttctatactctgaagatgtaaaactactgtttcaggctctctatactacagtaaacgagattggcgcaaggcttctgcattacaaggccatgatattaccaagtacttgctagaaacagtgagtctccaatgtgcgatttcttgaattcttttgttgcaatgttgttgctattaacaagttgatgttcaaattgcagtggctagatatattgagatgctactttgtaataattagttgtaactctttttgagtagaggccgggatattatattttattattaaaaaaagatatattgaggtgtatgatagactgaggcagaatggcagaggagccaatatgtgccaaagttcgaagaatacatggagtgtggtgtgacctcactcacgcatggagctacagtgatctcgggaatgttttttatcggagtaaagctcacggacgacataatcaaacatcaagaatacaacgaaatatttaggctggtgggcacttgcggccgtctcctgaatgacattcgaggcattgaggtactttctctcatatttttcaaaattttattagaagatagagtacattctcatctaataaactgcatctttttttataaataacagcaagcaattttatcagaaaaatacat

SEQ ID NO: 106422 - DNA, 575 bp, Oryza sativa
aacaaattaaagggtatctatgataattacaccctaattacactacatttacagcctacttacataatgtaagtaggctgtaactatagtgtaattactaaagtaaaattggaatgaatacccatggtcttttatattgatgtgcacgccaactaatgcttcacagtgataggggaagccttactagtggaaaaaaaattgactaatttttagtctaaaatgtgtctgacatttagatagatactcccttttaaattgatgtgcacattaatggttcactgtgataggttaagcctaactactaccgtagtggaaaaaaaaactgaataatttttagtctaaaatgtgtctgacattttactccccaaaacaatactactattcgacttcacgatccctttgccggtaccacctcgcttaaccgaaacccccatggtactgctcagtactaccaattctgagccgtctgatctacaccaacagacgatcgggattaatttggaacctagccctgctccatcataatagcgtatggacacaggactgatgagcatcgtctttctaccgccacccgc

SEQ ID NO: 106423 - DNA, 732 bp, Oryza sativa
agtcattcacacaataaaaaagtgtggagcccactattatcctctctatctccatccttcttcctcctcccgctctcgcttctctctttctctctcccattttctcttcaccttggccggacttctggagcaacgacgacacgtcctgtgggtggtgcggctgaagaggtcttcgccctctcggcgtctcgcctctgcagctggaggaggagcttgtccttggcgtcgacggtgaggttggctcgccccttcgccttccggactccctcatggaggccgacacttgcccatctcctctctcttttagctcttctcgctgccgacgaaagacgcgccgaggtgccaccgctcgcacagcaagaccagacgacgatcctaaaataccaggaggcgcgcggcgggaggtttgagaagaaagaggcggtggtggtggagaggcgtgcgcgggctacgcctatgcggcggatcagtcggagatcggtgaggtgagtggctccgtgaggaggatcacccgcggcgagttcttggccgccgagttttcacgaggttgtcgccgccgcctcatccgccgccgttctcatttcggagatgccacgcacgtgtctctaccgctcgccgcggtctccgcctcgtcaaccgcgtctctgatgctttcttcgccatcgccgctacggtcgccgccctcgcttgcctgccacggccgtagaggaataagaagaggagaggaaagaa

SEQ ID NO: 106424 - DNA, 1683 bp, Oryza sativa
tcactgatagctggtcacgtatatattttttaattcttttagttaattgtaatgctgcataaacgtcatgttcagcaaaaatcaccttcagtgccacttgaggctcccaacctcactccctaatttatcgcgtgcacgctttccaaatactaaatggtgtagtttttttttaaaaaaaattctatagaaaagttgctgtagaaaattatattaatctattttttcaagttttcttttggctaatacttaattaatcatgttttaaatcatcgcactgtgtttccatgtggagaggaagggttcctaacccctccaaaagatcacagcctaaaggagtaattttgcatcggttttcatagttgaggggttaaaatatctagtattgctaagagcgagtataataagatgatgtaagtaggctatacaggctgccacatcatatttatgcttatgtggataagagagaagattagagagaaaagaagcggagtacataatagattattagtagccggctgcagcatgggtttcaacatactatgtgagataggtagatttaatacttcctccgtttcacaatgtaagtcattctagcattttccatattcatattgatattaatgaatctagataaatatatatgtctagattcattaacattagtatgaatgtggaaaatgctagaataacttacattgtgaaacggagggggtattaattatgcattatatatctataactaactattataactattatatgagcaggctattaggttggttattgatgatgttttaatttttaagaactagtggttggttatattattaaacttatatttaaggggttggaatcagattgaacagaaagtcaaatgcacttattccgtagaaaaaaaagagggcgcaatggggaatttcttatttttacatctttttattaaaatattttttaaaaaatttgttttgaaaatttacaattctagtggcctctcgctctttgggagggcgttttttaaaaatcgcccttcctgataagggacctaaatataaattttttatttgtgttcaaaccctttccaccggtgttaatcgtttaaaaactaataatgcttattcgacactccaaataattttaaatggaaaagtgataaacaacaaagttgtagatctcatcaagatgtacaatttttatataaaatttatctccatccgatgtcgtttgaaatgtatatctgagatttttaaaatagttttatattgtgtaacgaatatatggatatctaaaagatcttaaatgaaaacattgttaactacaaagttgtagatctcctcgatctctacaattttgatataaagttttatttcatatgactttatataatataattttaaattgtaaaattatagagctaataagctgtgttgaaaaatttgcatttaggtcccttatcgctctctggaagggcgatttttcccagaaggccagagacgactagaattgtaaattttcgaaaaaatattttttaaatattttaataagaaaatgtaaaaataataaaattcaatggggaggtcgattgcgacagtctctaaactctggcgggcctctccgaattggacgatagaaagcccaataccgttaacagcccatcactccgtacaccctagtcgatccgatcct

SEQ ID NO: 106425 - DNA, 2470 bp, Oryza sativa
ggacggtgccctcccctctgccggatccagcaggaggagaggtagcggtggcctggcatccttgcggcgacggtggcaccctccccttccggcgtcggtgtttttgtgcttgtgatgttcttgtgttgtcgttgttgttgatgaaatatgttcttgtgatcttgtagtagtattttctctaggattttatgatgattccgatttgtatttggattgagattgatattttgtttttgggttggattggatgtgggatttggagaggaggtgcgcatgaggttacgaagggacgaaaaatcggtgtgatgattggaaaaatacgaatatttatattagttatagatatatacgtatgtataaactttgtatatgtgtatataaagtttatacgtatgtatatgtagtatatatgtacgtgtgtagatatatataattttttatgtatacacttttaatttataaaaaatatatatacgtctataaagtatgtgagcgtacgtagaaaaaacccaaaaaaaatacacgtaatataaactttgtatacgtttatacaaagtttgtatacatatgtataaaaacccctaaaagtacatgtatacaacttttgtatatacgtgtatacaaagtttatttatgtgtataaaaagtttgtatgtgtacgtatacacacatacatacttattaaaaaaccgaaaaaaactaaaaagatacaaaagaaaaaaataagaaaccaaaagatatggacgaaaaaaacaaaaaaaaaagaaactgtatgaagaaacagtagaaaaaaaaaacgcgttttgcgccaccctcctctctgcgcgcgacaagtgtccagtcgcgcgaggcacccatgctactgtcgcgaaatggcgatctcggcacgcgatagcatcgcacccatattggcttcaatgcacccatatcggcttcaatggtacactcttttttttttccggaacgatgactagttccatcccgtgcgaacttttttttttctgcgtcaacccaattcttgtctcgtgggctacatatattattggctgccctttaggtccatgtattgctagccatttttcttatgagatgtattgcgaaaactcttattatcgtacatccgatacaagacgaaactacataaggtcctataagataggacccagttgaaacttatcctcattcctcctcgtccccaaccttatcctcattccggcgtccccatgctgcacgcgtggctgtggcgtcatcaggtggcggtggcggcagcgccgccgtctacggtggcgctgccgtcgcgggtagctggattccggctattcatccacgccccacgagtcactggaggtgttattttgggcgtcgccggggtaggaggagttcctcggggcacggtggcccgtgttccgagcggcactggcaatggaggcatcgggccgcgtcgacggcaacggccgcacgccgttgttcttcaccttctcccctggcatggtggtggtgtacggacgaaagagagggaggaagcatggggtggtgctcgtcgccgacgaggactaccatgcgtttgtgcagcagccagtgcagcagtttaggcggcgggatgcagtgagcacgggcaaccacattggcggcaatagggcagtaagacgaaaaagcttgagacgccatcatctgagagggctctgagctcggcagcgaaggtgaggaggcttgtggcaacgtcaaactagttagagaggattgttgcacaccacatgtttttttttttgcacatattatgtttgtgatattgcaatccgtcttttcggaatgtttcttaaatcagtaccggatgttgcatatattgggtttttgttgttgcagacaatgttcttgagtgttgcatttgattgaaacatcttcgataaagtggtaaaacattcttcaatgaaaactgaaacatcaagaaacaattcatattgaaatatttttttcgagcaatgaaacattgcaatattcattcaacatacagtgaaacatcgttcggagatttcacgttaaaatattttttttcgagcgatggaacattgcaacattcattcaacatacagtgaaacatcgtcctatttgcaaatctccagacatccgatgcatagctctttccgaagtattgctagtctttcggtccatatgctagaaatatttggtatatgaattttttattttttatacatagtatataaactttatacgtgcaaatatttcgtaggtaaacttcttacatgtaaactttgtacatataaactttgtgtagaaaaactttgtatatttaaattagatgtatagctttgaaatgaactcataatcctgttagcatgaacaaaaaatatatctatgcgtaagagcttttctacatagatattttgtagatatgtatataaaaactttttattataatttttttacatgtaacaaattttggaaataattg

SEQ ID NO: 106426 - DNA, 745 bp, Oryza sativa
ccgtcttgatttggatgagtttgtaccaattttatcgaaatgttttaaagttaattgagatcagcatatacctataccagttgcccttccaccgccaccacctccaatcctcccatcaacctatccaatggagctcctcacaaccagaagaaattggtcatgcatatgctttgttcttatactagatatatgcatgtagagtttttaattagctctgagtatggttgatttgcacttgtgcaccagcactaaaggaggcctgggggtgtggcgcgatccgtagggaagtagctttcttactgacagaattaataaagctagtcatgaaaaaatattgtaataacctcttttctggacgccattttcataacagcgatggtgaggctgtgactgaataatccacaaagtaagcacgatgattgctgcagttatcagttcacaatagtacgtacagaaggcggaggaagggcaggcaggggtggatttatagtataaggaccggtgtcaggcgacaccgacgactttcggtaaaatctataacgaaactacttatccatatattataacaccataatctaagcataattagtatcctataacaccgatagacacatcatgacaccgatgaaaagattttctggatccaccgagggcagggcatgtagcggtacatgcaggcgcacgaagctgtggccctcagtgaggtagggacttcatctagtggccgtcgcgtcgacgcccagct

SEQ ID NO: 106427 - DNA, 648 bp, Oryza sativa
aaaattttcaatgattggcagaagacatttcttagaagttgaaatgctatataaatctatgcacatatagatgcaagatgaataaaaattaatttagtatacgtactagataaaccataaacctagtgatcataataaaattttaggtcatataccctgctgccttgctggtgtgtgcagggcagctagcttgccgcttgtggtcgctgccatatcgccgaggagggcgcccaaaggcgttgctcgctggttgccgccttgccgctttactgcggcacgtcagcagacgtgcagacggcgagcgacgagggccaagagccaagcgacgaccgtgcgatgagcggccgagcatcgagcaggacagcgagacggcgagtgcgagagcggcgcggcgtatgggttggggcagacggacgggtggacgctcgaattgacacacgtgccgaaaacaaatcgacgtgctcgctcagcctccgtttccaactgcacatttcaactaatttattctattgggctaatggtcctgtgacacgtactaagatatttggggccctgtgcggtcacgcttgtggcactcccacaggaacggccctaacttcgtggacgcggagcgacttcagcgccgcggtgccgtaccttctttagctc

SEQ ID NO: 106428 - DNA, 703 bp, Oryza sativa
tcctatctattagggtctaatgcaactaaaatcactcaccgagcaaagagagacagaatcaagagatatggcaatgccgcctctttcgccaccaggttgccaaaaaccgagttcatacaagttcatcacgagttcttatatgtggctcatcgcctcgcctctacacgccacacacgccagctgtcaaccagctgttaccacggacagacttacacggcccactgtggcccatgatacatagggttgggtttgacaggccttgatgagcaatgcttcttgagcttgaagtcctcctctcctctttgctctgcttcttgctcagcttcagcactcagctctgttggcgcctcctcctcagcagcttcagtcttctcaccaacatcttcctggttgacgtcagataagggtctaacactatctcctctgctcattcccttcctagcatctgacctccggcaatcgagtggcgacgtgaaggcaaacaacaagggccgctcggaggggtgttacatccggcgccggagtgcaagtgcggcgaacggcggcaggcgttgtggctgcatgtgggcagccagacaagctgcaaggaagagcaggtgtttagtgattagccaattagctataggtcttgtagatgatttattctttttaattttcagtattgactcctctcatctcagagttctgtcacggtataagcttg

SEQ ID NO: 106429 - DNA, 552 bp, Oryza sativa
atagctggctagctaggaaaattaacacatcttctaccatcaacctaatagtcccacctagcctataatatatatactacatccgctccatcactatatttctcaaatctagaaaaatctatttttaataggcaaatttcaatccaacaatctatcatcttaataactttctcagatttaatgtatgactctccattcttccacacaagattggttgcatggacatccagaaatgtcaatattaatgaatcgcttgtttacgaggaatgactagtagcatgtttaaatagatgataagtagaatcacttattattggtctatgtgtcaagatgaaatatgactatcaaaagtagatggagggagtacatcattaactcttagacacaacttatagaggcttatgccttatggtgcagttaggtataaattagtaatctactactcttctctctcttatttcttatactctcttctccatcttagcacaaatctgatgtgacaattcttacatcccacccatatatcatctcattgttagtcgggcacctcca

SEQ ID NO: 106430 - DNA, 1116 bp, Oryza sativa
acgctcctaagtcgccatgtggcactcctacaaacgctcctaaaccgccacatggcgttatctaatcccaccgtcgattttcacttaaattggtggacctattattttacaccattggattagatctattatttaaaaaattataattttctcctctttatacgatacaagcgctactactatcatgtacgatgcgatccatacagacgctactaagttcttctcccctacgtacttacgtacaccaatgaaaacaaaagaatagcttacctgttgtttgcccgaaagaaaaggaaaaactatacgcacgttcatatataaaaaggacagcagaaaaatacatcagtaaaaattgatgaattataaaatatgattttctaaaatatattgcttcacaaaaataaatatatatagttaaactaagctatataataataatataaaatatccaatcattgttctgtataccttcttctaaattatttttttaaattagatatccaattagttattccattgtatttcgtttagttaaattacaaaagttatattgtagtcctaaatacatcacaacacatagggctaacatataatggttagttgtttgatttttttttaaagttcacaacatattttagggtgtgaatatcacttcataaatatagaacactaatttagatctatatataaaaaaataaaaacaacccaatttagttgtgttttttcaaatagatctaattaaattataattggtttgagattaagattctcagagtttttttttgacatttttagaattatttgattggtatttgagtagtgaccagcatacatagtgcatatatagatatgaaaaaaaataaaaaatatctccagccaatgatctttgctataattcaatccttcatccatcatgagatttatggtcattcttctttgccaaatagttttgacacaaatgaacaatgaaacaatatacgcaataaactactcatgatatactttcttatacttaaggaacttcaatatgtcagacacaattgatggatatatgtcataatcttcacagacgtgactataagtgtactacagtggattatttattgtaaataagtt

SEQ ID NO: 106431 - DNA, 625 bp, Oryza sativa
ttggaatgtggctaactcagcctaactgtgctcctggcaagctattgtgcgatcaatcgcgtgtggcgcgatctgttcagtgctttcttccatccaggagaatttttgtcagattgtcttgtttttatttttatatgtaggtatgtcctgtcaacatggcttcatggcttaactcgtttcacaatttctgttggttttttaggctcatagcccataagaccatatgtatactttttctcaattatttccaaaatttgttacatgtaaaaaaattataataaaaagtttttatatacatatctacaaaatatctatgtagaaaagctcttacgcatagatatattttttgttcatgctaacaggattatgagttcatttcaaagctatacatctaatttaaatatacaaagtttttctacacaaagtttatatgtacaaagtttacatgtaagaagtttacctacgaaatatttgcacgtataaagtttatatactatgtataaaaaataaaaaattcatataccaaatatttctagcatatggaccgaaagactagcaatacttcggaaagagctatgcatcggatgtctggagatttgcaaataggacgatgtttcactgtatg

SEQ ID NO: 106432 - DNA, 504 bp, Oryza sativa
aaaattatgtctagatattgtttacaaattcaaaagtatagcttgctagctttaaaaattaacacatcttctaccatcaacctaatagcccacctaggtatagatatatactactccctccatctcatatttccaaatctgaaaaatctatttttgataggcaaatttcaatccaacaatctatcatcttaataactttctcggatttaatgtatgactctccattcttccacacaagaatggttgcatggacatcgagaaatgtaaatattaatgaatcgcttgtttacgaggaatgactagtagcatggttaaatagatgataagtagaatcacttattattggtctatgtgtcaagatgaaatatgactatcaaaagtagatggggggaggacatcattaactctcagacacaacttataaaggcttatgccttatggggcaggtagctataaattaagaaaccggtactcttctctttcttatttcctataccctcttct

SEQ ID NO: 106433 - DNA, 538 bp, Oryza sativa
cgtcggcccagatgcccgatgagaagcattctcgctgaaattccatctaaaactcgagaatgctagttctcggtcgatcggcgcgggtgcgttaaatcggacgctcgcccgtgtctcccccatggggcacacccacatgtctcccctgcccccacctgccacttccacacacacaactccattgtaacaaatcacccacatattttagaaaccctatattaggggcatttggtttatttttttccaccaaaaatgttacacctagttactcacaatatttcactatgtgtacatctaacgttgcagtgaacgaaacattccattgcaaccaaaaaaacccgcatattttggaaaccccctattaagggaatttggtttatttttttttccaccgaaaaatgtttcacctaccgacttatatgtttactatatataaatcaaatgttacagtgaactgaaacattttttactatttactgaacattattttatataagctaaaacaacacccgattaaacgagtgaaacattttcggtt

SEQ ID NO: 106434 - DNA, 1851 bp, Oryza sativa
aggggcttgtgcgcccttgcgcagttgcgcgcacacggtgggggggagaagaagaaggggatcggatgtgggccgttggatctggcttggacggtggatagatgggtggtgcacacgtctgactttttctcgggtttttacactgatttgatcttggagttcaaaccgcctaaaccactataaaccctcgattatttttttcttgaagcgtaaaacctttgattataagtaagtccatttgaactagaggaaaaaactaaacttgatttttgatgtttaggataaaatccggttaaggtttcaacttttgaccaaatctcgtagtacggatatacagaatacagcgtaaaccgacaaaactgatgaaagatctagtacattattggactacatctaaacagaaggtaatgatagattgatcaatgttgatatgtgatgtctcaattaaatcaagaggaaagtgcatgaggtggtctctaaaattgtgtgggtgtgtcaccgaggtccttttaactttcgaaatgaatttttggatccctcaacttgtctcgggtgtcatatagatccaaacgggtttcaacccgctccatgtgctgacgtggcatgtcatgatgacgcctacgtgtcagtagaacacatatgccagcacatatagaaaaaattaagaatataatttttctcctctcttttttcatttattttttcaaaattaaaaacaccattttctcccctcccccgttcccctctctttttaaatttaattatctcctatatgactgacatgtgaatctcacttacatgtaagtgttactgtggcatgccacgttatctcatgaagcaggttggaatccgtttggacctatatgatacatatgacaagtttgaggatccaaaaaattttgagagtttagagatataaatgaaacatccatgtaagtttagggagtacgaaggaaggaggagctagtcttacagaaatagagccgttttcatattctattagacttagaaatctggccccaagcaagagaaaatataaccaattttcgatagtcgtcggccaaattaacatttgtctctgatcagaccggccaataaagcacaattagatcatctaatatccaataggaccgtaacatgaatagtggtcttgccgatctttacacagcggctacgatctttcctaagttcaaaataaatttattttgaatttaatctcgtgccaatttttatcgtcaatactgagctaaaaatatatatagtcttcttgcgtttagcttgttcatttgctggtgcaggtaccactaaccaatggttccctggcatggacttgaacagagcatgacgtgttgccaaggatcatcctagcggagtagataccacgataatattcagtactccccctccgtttcaaaatataaacatttttagcataatgacaagttaaatattttcaactttgactattaatagcaaaaaatataaatcatgtaaaattgatattaacattaaacaacctatcataatatgtaactcattttatttaaaaatcttatttttatagatattgttggccaaagtagcatttcggagacgtatcagaatctaaaaatgcttatattttggtacgaatggagtatatatacatatgtttgatgtttcctcgtagattgttaccgggttactttacagccctgttcattattgtcggtggctaatgatatatgagaataagttgtgttggttttgtgatttcacttgtacttgcatctgcacaagcccttttgttaggtgtgtgtttacctttgctaccactaaacactgatcctatcaagatgcatgtaccttcag

SEQ ID NO: 106435 - DNA, 4955 bp, Oryza sativa
ccctatgctctctgttctccccgattctgatcgcttgcgcctctgtgccacctgattctgatctgtccctgttcttcccctatgctgctctctgttctcctcgattctattctgatctgtcccttcccctatgctctctgttctccccgattctgatcgcttgcgcctatgtgccacccgattctgatctgtccctgttcttcccctatgttgctctctgttctcctcgattctatgattctgatcgcttgcgcccgttcttcccctatgctctctgttctccccgattctgatcgcttgcgcctctgtgccacccgattctgatctgtccctgttcttcccctatgctgctctctgttctcctcgattctatgattctgatcgcttgagcctctgtgctgctctctgttctccccgattctgatcgctagtgctgtccctgttcttcccctatgctctctgttctccccgattctgatcgcttgcgcctctgtgccacccgattctgatctgtccctgttcttcccctatgctgctctctgttctcctcgattctatgattctgatcgcttgcgcctctgtgctgctctctgttctccccgattctgatcgctttcgcctctgttcaccccgattctgatcgcttgcgcctctgtgccacccgatgattctgatcgcttgcgcctctgtgctgctctctgttctccccgattctgatcgctttcggctctgttcaccccgattctgatcgcttgcgcctctgtgccacccgattgtgctgctctctgtgtgccacccgattgtggctgctctctgttctccccgattctgatcgcttgcgcctctgtgccacccgattctgatcgcttgcgcctctgtgccagacaatctacccagtgctgtctgatcgcttgcgcctctgtgccacccgattgtgctgctctctgttctccccgattctgatcgcttgcgcctctgtgccacccgatgattctgatcgcttgctgctctctgttctccctgattctgatcgcttgcgcctctgtgccacccgattcttttgatcgcttgcgcctctgtgccacccctgtgctgctctctgttctccccgattctgatcgcttgcgcctctgtgccacccgattcttctgatcgcttgcgcctctgtgccacccgattctgattgcttgcgcctctgtgccagacaatctccccagtgctgtccctattcttcccctgtgctctctgttctccccagtgttgtccctgttcttcccttgtgttctccccagtgctgtccctgttcttcccctgtgctgctctctgttctccccgattctgatcgcttgcgcctctgttcttcccctgtgctgctctctgttctccccgattctgatcgcttgcgcctctgtgccagacaatctcccctgtgctgctctctgttctccctagtgctgtccttgttcttcccctgtgttgctctctgttctccctgattctgatcgcttgtccctgttcttcccctgtgctgctctctgttcttcccgattctgatcgcttgcgcctctgtgccagtgttgtccctgttctttccctgtgctgctctctgttctccccgattctgatcgcttgtgcctctgtgccagtgctgtccctgttctccccctgtgctgctctctattctccccagtgcttatcgcttgcgcctctgtgccgttctccccctgtgctgctctctgttctccccgattctgatcgcttgcgcctctgtgccagtgctgtccctgttctccccctgtgctgctctctgttctgccagtgatgtccctgttctccccctgtgctgctctctgttctccccgattctgatcgcttgcgcctctgtgctagtgctgctctctgttctccccggttctgatcgcttgcgcgcacaagtcattgggacgagcagggcctctgaaaccacaccctcaaaccacaccctcgcctgagatctgcacgggataggcggggcgggtgattagttctgatcgcttgcgcgcacaagtgtccctggttctgatcgcttgcgcctctgtgccagtgctgctctctgttctccccggttctgatcgcttgcacgcacaagtcattgggacgagcagggccttcgaaaccacaccctcaaaccacacccttgcctgagatctgcacgggataggcgggtgatcagttctgatcgcttgcgcgcacaagtcattgggacgagcagggcctccgaaaccacaccctcgccaccctcgcctgagatctgcacgggataggcgggtgatcaggtttttcattgggatgagcagggcctccaaaaccacaccctcgcctgagatctcctacacgaacaatctccattgctggttaaccatctctctgtgcctgtgctgctctctgttctccccggttctgatcgcttgcgcgcacaagtcattgggacgagcagggcctccgaaaccacaccctcaaaccacaccctcgcctgagatctgcacgggataggcgggtgatcaggtttttcattgggacaagcagggcctccgagaccacaccctcgcctgagatctgcacgggataggcgggtgatcaggtttttggggagtgctttcgcatgactgctctcttctccgtctttgtcgtcgttcggttccatctgcatcgcgcaatgtctactggtggcggttctgatcgcttgcgcgcacaagtcattgggacgagcaaggccttcgaaaccacaccctcgcctgagatctgcacgggataggcgggtgatcaggtttttggggagtgctttcgcatgactgctctcttctccgtctttgtcgtcgttcggttccatctgcatcgcgcaatgtctactggtggcggttctgatcgcttgcgcgcacaagtcattgggacgagcaaggccttcgaaaccacaccctcgcctgagatctgcacgggataggcgggtgatcaggttattggggagtgctttcgcacgactgctctcttctccgtcttcgtcgtcgttcggttccatctgcatcgtgcaatgtctactggtggtggtgattccggagactgatctcttctccgtcttcgtcgtcgttcggttccatctgcatcgcgcaatgtctactggtggtggtgcttccggagcggcaggaggtggtgcgccaggaactggaggcgcaccaatcgacaacaccaacggaggcaattctgcctcacaatccagcggagagactttcacagggtataacatccttctgctacctttcattttgttaaatctgtcagtcgcaatgttattgcgttgtctcattgatgatgcttattttaccttaagcatgtccataaccatggttatgtttagttttatcactagatcatttcacactgtgtatgccatgtttattgtcttaatattttggaataaaaaataccaatttatgaccatattttcaacaatagctatagtttaaaccttgtaaagaactgcatttgtaattattggaactataattcatcaacgagcatagacggatccaacatgagtatcagcctatcaggggctcgaggccttgctggatccgcatgaagcgcatgaagagatggggaggggggaagaggtagagaaaaaaagagaggttgagacttgagaaatgatgctaaaatctcagaaataattatcctacattcaaattatgcagcaaccctacatccaaatgtcccacggtttagccacgataaatcattactcatttcggtctcacaacacagccaaaagccttgcaaatggaaataaaaaggaatccttaattatattatgaattatagcacggaaaataaaaaaacttgagtttgtattaggagttaagcttgtaattaaggggcaatgtggaacctatgaatttttaggaacgatcttaatttccaaaacaattgttatatgttagatattattctaaagcgaaattgtatttactatattgttcttgtgtctgttttcgaaaaaaaggtatatttttcccttatagaatgtattaaccctcaaaatattcaatcaatttgcatcgttataatccggaccctccaaggtcaacatgacaacatgtagttgttcttgctctaataatgtgcacaaagttttggaccttcagtgtgggtactttttttttcactttgttgggataaccatagatagatatgatccatcatcaatccaagaatttgctaaaatttttgggtaaaatacaattttggacgaatggaaaaaaatattcggctaccttcagaacataagatttttttaaattagattataaagaaaccaaacttcttcgtgtaatttgtaagataacgccatattcgcacttttatcaaattcaaacactaaattcctatacgccaatatcaaaattgaaatcttaaaacttagggcacgttcttttcagcttttgattttggctttttagctgcacgcaaaataaaaaaaacataattagcatatgattaactgagtgttaattattaaaaactaaaaaaacgatttatttaaattttaaagcaaaatttctcacaaaatacaatgtttagaagtttaaaaaacatgttaacgaaatatgagaaatagctaagctcaattagcctttttagaatgtgttcttaattttgaacttgattttttttttcatcatagtctctttttaaccgttgatgtttaagtatcgaaaaacacgtgtttttaaccatagattattctcttattgctaatataatgtgcctacactgtttgggcgtatgattagcaaattaccgtctgatagcagactattttcttcgtcgcgaaaaaaccaaactagctcgatgggggaaaacttttaggtttagttgttagatcagatatatacatatatttaaatattaaatatggccta

SEQ ID NO: 106436 - DNA, 656 bp, Oryza sativa
catgggtaattctcctctctgaacgcgcagagatgtaccctagaggggggtttaataggcttcctgaaattttctcaacaatcgcagcggttaaattaacagtgcccggaacctgctggagaaaaacaccgaaacttgctggcagagatgagcagcccggaacttccggagttcttgagccatgaactttcgggcaacagagaaaatcaaaatttggggaagcaaaacaggtcctagctatagacaatcaggcacaaggttgcacaagatgtaaatcacaagataccagcagattcaaacacagatcatgcacaagagagacaaaggcgattttttcccgaagttcggatcacacggatcctactctctgttgaggtgctcaaagagccgggtctcgattaaccccttgcctcacttatgcaaagatcccagaataagtccacagccttcaactcaacacttataggtcattttctagaattgagtgaccaccaagatccaactcacaattccttctagaaaagaccacaagtgcaagttgctctacctaggacaacctctgaaaactcagcacaagaatctttactcacttacctcgtttccttgcggaggtgaggaaaaccttcacaaactttcccgggacatccacaaaatct

SEQ ID NO: 106437 - DNA, 1034 bp, Oryza sativa
acgcagcggcgccgcgcgggaggcggggatcctcgtcgatccttccaccgcgcaccgcctcgtcgccgtcgcgatcttcgtgggcgccaagtttggtgggcccatcgacaggctcccgacgaggtggactgtggtgttcgagaccagctcggatgcggcgatccgcgcgagggagatggccggcctcgaacggcgcttcctcattgccatcgattaccgcctgttcgtccgtgctgacgagttcgactggttctgccgtgtcctggagcgagggccacgtccaagcgggaaatgcggcggcggcggtggtggcaggaaaaggacggcggcggaagctgtggagggagaagcggaggacgaccaccgccgcgtccgggcctccctgccgccgccatctgtcgtcgccaactaggtccacgatttatgcatccacaggttcaattatatttacttaatgtattttcttttgctgcttcttgtctatcagttgtttgcaggtggctagggtggagaagatgcagttggcgttggaagagttcgatcagactaggcaagggtggagaagatgcagccggcgttggaagagttcgatcagcggccatcgtcggagtagagtgaaaaaaaaaaccagttttaatcgtaggatgtttagcaactgttaactcttgtcaaattctatcaatccttgtgtcttggatttccatcttattggaagtagataaagaaatgttaatgaagtccctttttctacctttctggtgtatgaaatctatatcaatctggaagttaataaagaagtctttttctgcctttgtggtgtatgaaatatgtatcaatctggattctgaagtggaagcctctggtgtatgaaatttgtatcaatctagaattgaaacgtctcttgctgtggctttgctctcttgctgtggctttgcgatgtgatgtgtttgatggagcctcttgagaatgaaactctacttctgtcatcataaaaaatttctgatgatgcttattcctttttactggttgatgcc

SEQ ID NO: 106438 - DNA, 1143 bp, Oryza sativa
atttctcaaaaatctctgggggtcaacttttcaaaatccagtctctctagggtgaggcccgcgattctgaagcggtcaaaaaaaacctagctcgattccatgaccgaaaggcaaagttatcaaggttttaatttgcacagaattctccatttgcattccacggtgtcgcgcccgccagcctaccttaacggcgtggttagtcgacgcgcttgaccccgacatcatctatgctatccaccctaacgtcctatgtgccatctctatactaaccacctcgttgaaaacccgttgtggaccctcagatattcgacgtttcgccgaataaaccgttgcttcctggcctatggtaagtaatttctacaaaaatctctgggggtctaactctcaaaatctagtctctctagggtgaggcccatgattctgcagccgtcaaaaaaaacctagctcgattccatgaccggaaggcaaagttatcaaggttttaatttgcacggaattctccatttgcattccacagtgtcgcgcccgccagcctaccttaacggcgtggttagtcgacgcgcttgaccccgacatcatctatgctatccaccctaacgtcctatgtgccatctctatactaaccacctcgttgaaaacccgttgtggaccctcagatattcgacgtttcgccgaataaaccgttgcttcctggcctatggtaagtaatttctacaaaaatctctgggggtctaactctcaaaatctagtctctctagggtgaggcccatgattctgcagccgtcaaaaaaaacctagctcgattccatgaccggaaggcaaagttatcaaggttttaatttgcacggaattctccatttgcattccacagtgtcgcgcccgccagcctaccttaacggcgcggttagtcgacgcgcttgacaccgacatcgtctaagctatccatcctaacgtcctatgtgccatccctatgctaaccacctcgttgaaaacccgttatggaccctcagatattcgacgtttcgccgaataaaccggtggttcctggcctatggtaagtaatttctagaaaaatctctgggggtccaactctccaaatccagtctctctattgtgaggcccgtgattcttgcaccgtaaaaa

SEQ ID NO: 106439 - DNA, 770 bp, Oryza sativa
gcgtttcgccggaataaacccgcggtttccgggcctatggtaagtatttcttagaaaaaattctgggggtccaactctcaaaatctagtctctctagggtgaggcccgtgattaagcagccgtcaaaaaaaccctagctcgattccatgaccggaaggcaaagttatcaaggttttaatttgcacagaattctccatctgcattcaagtgtcgcgcccgccagcctaccttaacggcgcggttagtcgacgcgcttgacaccgacatcgtctaagctatccaccttaacgtcctatgtgccatccctatactaaccacctcgttgaaaaccagttgtggaccctcagatattcgacgtttcgctgaaacaaccgctgctttgtggcctatggtaagtaatttctagaaaaatctctgggggtccaactctccaaatccagtctctcttctgtgaggcccgtgattctgaagccgtcaaaaaaaacctagctcgattccatgaccggaaggcaaagttatcaaggttttaatttgcacagaattctccatctgcattccacagtgtcgcgcccgccagcttaacttaacggcgcggttagttgacgcgcttgacaccgacatcgtcgatcctatacaccctaacgtcctatgtgccatccctatactaaccacctcgttgagaaccagttgtggaccctcagatattcgacgtttcgccgaaacaaccgctgcttcgtggtgatgaactacttgcagtaagcgaccatcgg

SEQ ID NO: 106440 - DNA, 1331 bp, Oryza sativa
aattctgtgcaaattaaaaccttgataactttgcctcccggtcatggaatcgagttaggttttttttgacggctgcagaatcatgggcctcaccctagagagactagattttgagagttagacccccagagatttttgtagaaattacttaccataggccaggaagcaacggtttattcggcgaaacgtcgaatatctgagggtccacaacgggttttcaacgaggtggttagtatagagatggcacataggacgttagggtggatagcatagatgatgtcggggtcaagcgcgtcgactaaccacgccgttaaggtaggctggcgggcgcgacaccgtggaatgcagacggagaattctgtgcaaattaaaaccttgataactttgccttccggtcatggaatcgagctaggttttttttgacggcttcagaatcgcgggcctcaccgaagagagactggatttcgaaagttggacccccagagatttttgtagaaattacttaccataggccacgaagcagcggttgttttggcgaaatgtcgaatatctgagggtccacaactggttttcaacgaggtggttagtatagggatggcacataggacgttagggtggatagcttagaagatgtcggtgtcaagcgcgtcgactaaccgcgccgttaaggtaggctggcgggcgcgacactgtggaatgcagatggagaattctgtgcaaattaaaaccttgataactttgccttccggtcatggaatcgagctaggttttttttgacggccgcagaatcacgggcctcaccctagagagactagattttgagagttggacccccagagatttttctagaaattacttaccataagccaggaagcagcggttgattcagcgaaacgtcgaatatctgagggtccacaactggttttcaacgaggtggttagtatagagatggcacataagacgttagggtggatagcacagacgatgtcggtgtcaaagcgcgtcgactaaccgcgccgttaaagtaggctggcgggcgcgacactggggaatgcagatggagaattctgtgcaaattaaaacttgataactttgccttccgtcatggaatcgagctaggatttttttgatggctgcagaatcatgggcctcaccctagagagactggatttggagagttggacccccagagatttttctagaattacttaccataggccacgaagcagcggttgtttcggcgaaacgtcgaatatctgagggtccacaactggttttcaaggaggaggttagtataaggatggcacataagacgttagggtggatagctt

SEQ ID NO: 106441 - DNA, 711 bp, Oryza sativa
  unsure (1)..(711): unsure at all n locations
tggcgcnncnttggatggcttgccgatcgcacaggagctcatcatgcattccacactgtcgcgcccgccagcataccttaacggcgcggttagtcgacgcgcttgacaccgacatcgtctaacctatacaccctaacgggctatgtgccatccctatactaaccacctgttgaaaaccagttctggaccgtcagatattcaatgtttcgtcgtaccgaccgctgcttcgtggcctatggtaagtcatttctagaaaaatctctaggggtccacctctccaaatacagtctctcaagggtgaagcccgtgattctgcagccgtaaaaaaaaacctagctcgattcaatgaccggaaggcaaagttatcaaggttttaatttgcacagaattctccatctgcattccatagtgtcgcgcccgccagcctaccttaacagcacggttagtcgacgcgcttgacaccgacatcgtctaagctatccaccctaacgtcctatgtgccatccctatactaaccacctcgttgaaaaccagttgtggaccctcagatattcgacgtttcgtcgaaacaaccgctgtagatctactcgatcagctgtagatgtcaacgatacataatctatccattgaacacacttagatcgggtgattgggatagatcgggcgttatgccgagacagtataaatcactcaacaactaagtgtgcccca

SEQ ID NO: 106442 - DNA, 887 bp, Oryza sativa
  unsure (1)..(887): unsure at all n locations
gatgtcncngagtagagctntcactgcaagtagttcatcatagtattgggatggcacataggacgttagggtggatagcttagacgatgtcggtgtcaagcgcgtcgactaaccgcgccgttaagttaggctggcgggcgcgacactttggaatgcagatggagaattctgtgcaaattaaaaccttgataactttgcctttcggtcatggaatcgagctaggttttttttgacgtctgcagaatcacgggcctcaccgaagagagactggatttggagagttgggcccccagagatttttctagaaattacttaccataggccacgaagccgcggttgtttcggcgaaacgtcgaatatctgagggtccacaactggatttcaacgaggtggttagtatagtgatggcacataggacgttagggtggatagcttagacgatgtcggtgtcaagcgcatcgactaaccgcgccgttaagttaggctggcgggcgcgacactgtggaatgcagatggagaattctgtgcaaattaaaacattgataactttgccttccggtcatggaatcgagctaggttttttttgacggctgcagaatcacaggcctcaccgaagagagaatggatttggagagttggacccccagagatttttctagaaattacttaccataggccacgaagcagcggttgtttcggcgaaacgtcgaatatctgaaggtccacaactgtttttaacgacgtgggtaatatatggattgcacataggacgttagggtggatagcttaaaccaagtcgggggtaaacgccgtgactaaccgcgccgttaagttaggctggcgggcccaacacggggaatgcattggaggattctttggaaaataaa

SEQ ID NO: 106443 - DNA, 781 bp, Oryza sativa
  unsure (1)..(781): unsure at all n locations
aagttctaatagaaacgnttatctcaaanccntannangtaaggaaaagatcaaggttttaatttgcacaaaattctccatctgcattccacactgtcgcgcccgccagcctaccttaacggcgcggttagtcgacgcgcttgacaccgacatcgtctatgctatccaccctaacgtcctatgtgccatctatatactaaccacctcgttgaatacccgttgtggaccctcagatattcgacgtttcgccgaataaaccgctgcttcgtggcctatggtaagtaatttctagaaaaatctttgggggtccaactctccaaatccagtctctcttcggtgaggcctgtgattctgaagccgtcaaaaaaaacctagctcgattccatgaccagaaggcaaaattatcaaggttttaatttgcacagaattctccatctgcattccacactgtcgcgcccgccagcctaacttaacggcacggttagtcgacgcggttgacacccacatcgtctaagctatccaccctaacgtcctatgtgccatccctatactaaccacctcgttgaaaaccagttgtggaccctcagatattcgacgtttcctcgaaacaaccgctgcttcgtggcctatggtaagtaatttctagagaaatctctggggtccaactcttcaaattctgtctctctttggtgaggcccgtgattctgaagccgtcaaaaaaacctagctcgattcatgaccggaaggcaaagtatcaaggtttaattttgcacagaattct

SEQ ID NO: 106444 - DNA, 1228 bp, Oryza sativa
  unsure (1)..(1228): unsure at all n locations
agacgggcttgaaccggacatcgtttaacttatccaccttaacgtcctatgtgccatcactatactaaccacctcgttgaaaaccagttgtggaccctcagatatttgacgttttgccgaaacaaccgctgcttcgtggcctatggtaagtaatttctagaataatctctaggggtccaactctgcaaatccagtctctcttcggtgaggcccgtgattctaaagccgtcaaaaaaaaccttgctcgattccatgaccggaaggcaaagttatcaaggttttaatttgcacagaattctccatctgcattccgcagtgtcgcgcccgccagcctaacataacggcgcggttactcgacgcgctggacacgacatcgtctaagctatccaccctattgtcctatgtgccatccctatactaaccacctcgttaaaaaaccagttgtggaccctcagatattcgacgtttcgccgaaacaaccgctgcatggtggcctatggtaagtaatttctagaataatatctgggggggggtccaactctccaaatctagtctctctagggtgaggcctgtggttctgaaaccgtaaaaaaaacctagctcgattccatgaccggaaggcaaagttatcaaggttttaatttgcacagaattctccatctgcattccaaagtgtcgcgcccgccagcctaacttaacggcgcggttagtcgacgcgcttgacaccgacatcgtctaagctatccaccctaacgtcctatgtgccatcccaatactaaccacctcgttgaaaaccagttgcggaccctcagatattcgacgtttcgccgaaacaaccgcggcttcgtggcctatggtaagtaatttctagaaaaatctctgggggtccaactctccaaatccagtctctcttcggtgaggcccgtgattctgcagccatcaaaaaaaacctagctcgatttcatgaccggaaggcaaagttatcaaggttttaatttgcacagaattctccatctgtattccagtgtcgtgcccgccagccttccttaacggcgcggttagtcgacgcgcttgataccgacatcgtctaagctatccaccctaacgtcatatgtgccatcactatactaaccacctcgttgaaaaccagttgtggaccctcagatatttgacgttttgccgaaacaacataataactatngcaacggcgacagcacntcacttcttt

SEQ ID NO: 106445 - DNA, 843 bp, Oryza sativa
cacaaaccacaaaggggggttgtttcttctcacaagggccaaaaaacagtagttgtttttgcaaaccgtcaaatatcggagggtccacagcgggttttcaacaggtgggttagtataggaggggcacatagcacatgggggtggatagcttacacgtgggggtgtaaaaggcatggactaccggccccttaaggaggcgctggcgggcgcgacattgtaaatgcagatggagaattctgtgcaaaataaaaccttgataactttcctttccggttaaagaatcgagctaggttttttttgacggctgcagaatcacgggcctcacccttgagagactgtatttggagaggtggaacaccagagatttttctagaaccgacttaccataggccacgaagtagcggttggttcggcgaaacatcgaatatctgatggtccacaactggttttcaacgaggtggttagtatagggatggcacataggacattagggtggatagcttagacgatgtcggtgtcaagcgcgtcgactaaccgcgccgttaaggtaggctggcgggcccgacactgtggaatacagatggagaattctgtgcaaattaaaaccttgataactttaccttccggtcatggaatcgagctaggttttttttatggctgcagaatcacgggcctcaccctagagagactggatttggagagttggacccccagagatttttctagaaattacttaccataggccacgaagcagcggttgtttcggcgaaacgtcgaatatctgagggtccacaactggttttcaactgatgtgctacagtgcgattagtaagcccattcgcc

SEQ ID NO: 106446 - DNA, 1838 bp, Oryza sativa
agttgtgaaccccaaataatcgaggtttcccgaaacacccgttgtttggtggccaatggtaagtaattctaaaaaaatcttgggggtcaacttctcaaaatccagtcttctttgtgtaaggcccgtggttctaaaccggtcaaaaaaacatagctcgattccatgaccagaaggcaaagtaatcaaggttttaatttgcacagaattctcaatcagcattccatactgtcgcgcccgccagcctaacttaacggcgcggttagtcgatgcgcttaacaccgacatcgtctaagcaatccaccctaacatcctatgtgccatccctatactaaccacctcgttgaaaaccagttgtggaccttcagatattcgacgtttcgccgaaacaaccgctgcttcgtggccaatggtaagtcatttctagaaaaatctctggggtccaactctccaaatccagtctctctagggtgaggcctgtgattctgcagccgtaaaaaaaaacctagctcgattccatgaccggaaggcaaagttatcaaggttttaatttgcacagaattctccatctgcattccagtgtcgcgcccgccagcctaccttaacggcgcggttagtcgacgcgcttgacaccgacatcgtctaagctatccaccttaacgtcctatgtgccttccctatactaaccacctcgttgaaaaccagttgtggaccctcagatattcgacgtttcgccgaagcaaccgctgcttcgtggcctatggtaagtaatttctagaaaaatctctgggggtccaactctccaaatccagtctctctatggtgaggcccgtgattctgcagccgtaaaaaaaaacctagctcgattccatgaccggaaggcaaagttatcaaggttttaatttgcacagaattctccatctgcattccacagtgtcgcgcccgccagcttaacttaacggcgcggttagtcgacgcgcttgacaccgacatcgtcgatcctatacaccctaacgtcctatgtgccatccctatactaaccacctcgttgaaaaccagttgtggaccctcagatattcgatgtttcgccgaaacaaccgctgcttcgtggcctatggtaagtaatttcaagaaaaatctctgggggtccaactctcgaaatccagtctctctttggtgaggcccgtgattctgaagccgtcaaaaaaaacctagctcgattccatgaccggaaggcaaagttatcaaggttttaatttgcacagaattcttcatctgcattccacagtgtcgcacccgccagcctaacttaacggcgcggttagtcgacgtgcttgacaccgacatcgtctaagctatccaccctaatgtcctattgccatctctatactaaccacctcgttgaaaaccagttgtggaccctcagatattcgacgtttcgccgaaacaaccgctgcttcgtggcctatggtaagtaatttctagaaaaatctctgggggtccaactctccaaatccagtctctcttctgtcaggcccgtggttctgaagccgtcaaaaaaaacctagctcgattccatgaccagaaggcaaagttatcaaggttttaatttgcacagaattctccatctgcattccatactgtcgcgcccgccagcctaacttaacggcgcggttagtcgatgcgcttaacaccgacatcgtctaagcaatccaccctaacatcctatgtgccatccctatactaaccacctcgttgaaaaccagttggggaccttcagatattcgacgcatgtgggtcccggaggtcaaaaatttaattattgaggttttataatcccc

SEQ ID NO: 106447 - DNA, 846 bp, Oryza sativa
  unsure (1)..(846): unsure at all n locations
ccctatactaacacctcgttgaaaaacagtggtggacctcagatattcgacgtttcgccgaaacacccgctgcttcgtggccaatggtaagtcatttctagaaaaatctctggggtccaactctccaaatccagtctctctatggtgaggcccgtgattctgcagccgtaaaaaaaaacctagctcgattccatgaccggaaggcaaagttatcaaggttttaatttgcacagaattctccatctgcgttccacagtttcgcacccgccagcctaccttaacggcgcggttagtcgacgcgcttgacaccgacatcgtctaagctatccaccctaacgtcctatgtgccatccctatactaaccacctcgttgaaaaccagttgtggaccctcagatattcgatgtttcgccgaaacaaccgctgcttcgtggcctatggtaagtaatttcaagaaaaatctctgggggtccaactctcgaaatccagtctctctttggtgaggcccgtgattctgaagccgtcaaaaaaaacctagctcgattccatgaccggaaggcaaagttatcaaggttttaatttgcacagaattcttcatctgcattccacagtgtcgcacccgccagcctaacttaacggcgcggttagtcgacgtgcttgacaccgacatcgtctaagctatccaccctaatgtcctattgccatctctatactaaccacctcgttgaaaaccagttgtggaccctcagatattcgacgtttcgccgaaacaaccgctgcttcgtggcctatggtaagtgatgaactgctgtaccacagatgatgcgccaactnnnnnacacatcct

SEQ ID NO: 106448 - DNA, 1743 bp, Oryza sativa
aacgtcatatgtgccttccctatactaaccacctcgttgaaacccagttgtggaccctcagatattcgacgtttcgccgaaacaaccgctgcttcgtggcctatggtaagtaatttttagaaaaatctttgggggtccaactctccaaatccagtctttctatggtgaggcccgtgattctgcagccgtcaaaaaaaaacctagctcgattccatgaccgaaagccaaagttatcaaggttttaatttgcacagaattctccatctgcattccacagtgtcgcgcccgccagcctaccttaacggcgcggttagtcgacgcgcttgacaccgacatcgtctatgctatccaccctaacgtcctatgtgccatctctatactaaccacctcgttgaaaacccgttgtggaccctcagatattcgacatttcgccgaataaaccgctgcttcctggcctatggtaagtaatttctagaaaaatcaatgggggtccaactctcaaaatctagtctctctagggtgaggcccgtgaatctgcagccgtcaaaaaaaacctagctcgattacatgaccggaaggcaaagttatcaaggttttaatttgcacagaattctccatctgcattccacagtgtcgcgcccgccagcctaccttaacggcgcggttagtcgacgcgcttgacaacgacatcgtctatgctatccaccctaacgtcctatgtgccatctctatactaaccacctcgttgaaaacccgttgtggaccctcagatattcgacgtttcgccgaataaaccgctgcttcctggcctatggtaagtaatttctagaaaaaactctgggggtccaactctcaaaatctagtctctctagggtgaggcccgtgattaagcagccgtcaaaaaaaacctagctcgattccatgaccggaaggcaaagttatcaaggttttaatttgcacagaattctccatctgcattccagtgtcgcgcccgccagcctaccataacggcgcggttagtcgacgcgcttgacaccgacatcgtctaagctatccaccttaacgtcctatgtgccttccctatactaaccacctcgttgaaaaccagttgtggaccctcagatattcgacgtttcgccgaaacaaccgctgcttcgtggcctatggtaagtaatttctagaaaaatctctaggggtccaactctccaaatccagtctctctatggtgaggcccgtgattctgcagccgtcaaaaaaaaacctagctcgattccatgaccggaaggcaaagttatcaaggttttaatttgcacagaattctccatctgcattccacagtgtcgcgcccgccagcctaccttaacggcgcggttagtcgacgcgcttgacaccgacatcgtctaagctatccaccttaacatccaatgtgccatccctatactaaccacctcgttgaaaacccgttgtggaccctcagatattcgacgtttcgccgaataaacggctgcttcctggcctaaggtaagtaatttttagaaaaatctctgggggtccaactctcaaaatctagtctctcttgggtgaggcccgtgattctgcggccatcaaaaaaaacctaactcgattcaatgaccggaaggcacagttatcaaggttttaatttgcacaagattttccatctgcattccacagtgtcgcgcccgtccacatacactaacggcgcggttagtccacgcccttgaa

SEQ ID NO: 106449 - DNA, 1947 bp, Oryza sativa
  unsure (1)..(1947): unsure at all n locations
ccttttgcatcccggtcaaggaatcgagctaggtttttttttgacggttgcagaatcacgggcctcacccaagagagactggatttggagagttgcccccccagagatttttctagaaattccttcccatgggccccgaagcagcggttgtttcggcgaaacgtcgaatatctgagggtccacaactggttttcaacgaggtggttagtatagggatggcacataggacgttaaggtggatagctaagacgatgtcggtgtcaagcgcgtcgactaaccgcgccgttaaggtaggctggcgggcgcgacactggaatgcagatggagaattctgtgcaaattaaaaccttgataactttgccttccggtcatggaatcgagctaggttttttttgacggctgcttaatcacaggcctcaccctagagagactagatttttagagttggacccccagagatttttctagaaattacttaccataggccgggaagcagcggtttattcagcgaaacgtcgaatatctgagggtccacaacgggttttcaacgaggtggttagtatagagatggcacataggacgttagggtggatagcacagacgatgtcggtgtcaagcgcgtcgactaaccgcgccgttaaggtaggctggcgggcgcgacactgtggaatgcagatggagaattctgtgcaaattaaaaccttgataactttgccttccggtcatggaatcgagctaggatttttttgatggctgcagaatcatgggcctcaccctagagagactggatttggagagttggacccccagagatttttctagaaattacttaccataggccacgaagcagaggtagtttcggcgaaacgtcgaatatctgagggtccacaactggttttcaaggaggaggttagtatagggatggcacataggacgttagggtggatagcttagacgatgtcggtgtcaagcgcgtggactaaccgcgccgttaaggtaggctagcgggcgcgacactgtggaatgcagatggagaattcagtgcaaattataccttgataactttgccttccggtcatggaatcaagctaggtttcttttgacggctgcagaatcacgggccccacccaagagagactggatttggagagttggacccccagagatttttctagaaattacttaccataggccacgaagcagcggttgtttcggcgaaacgtcgaatatctgagggtccacaactggttttcaacgaggtggttagtatagggatggcacataggacgttagggtggatagcttagatgatgtcggtatcaagcgcgtcgactaaccgcgccgttaaggtaggctggcgggcgcgacactgtggaatgcagatggagaattctatgcaaattaaaaccttgataactttgccttccggtcatggaagtgagctaggttttttttgacggctgcagaatcacgggcctcaccatagagagactggatttggagagttggacccccagagatttttctagaaattacttaccataggccaggaagcagcggtttattcggcgaaacgtcgaatatctgagggtccataacgggttttcaacgaggtggttagcatagggatggcacataggacgttaggatggatagcttagacgatgtcggtgtcaagcgcgtcgactaacccgcgccgtaaggtaggcctgcgggcgcgacactgtggaatgcanatggagaattccgtgcaaataaaaccctgataactttgctttccgtcatggaatcgagctagggtttttttgacggctgcagaatcatgggcctcaccctagagagactagattttgagaggtagacccccagagatttttgtagaaattacttaccatagcccaggaggcaacggtttatttcggcgaaacggtcgatatctgaagggcc

SEQ ID NO: 106450 - DNA, 739 bp, Oryza sativa
  unsure (1)..(739): unsure at all n locations
tgctgtagaatcacgggcctcacccaagagagactagattttgagagttggacccccagagatttttctagaaattacttaccataggccaggaagcagctgtttattcggcgaaacgtcgaatatctgagggtccacaactggttttcaacgaggtggttagtatagagatggcacataggatgttagggtggatagcttagacgatgtcggtgtcaagcacgtcgactaaaccgcgccgttaagttaggctggcaggtgcgacactgtggaatgcagatggagaattctgtgcaaattaaaaccttgataactttgccttccggtcatggaatcgagctaggttttttttgacggcttcagaatcacgggcctcacccaagagagactggatttcgagagttggacccccagagatttttcttgaaattacttaccataggccacgaagcagcggtttattcggcgaaacgtcgaatatctgagggtccacaacgggttttcaacgaggtggttagtatagggatggcacataggacgttaaggtggatagcttagacgatgtcggtgtcaagcgcgtcgactaaccgcaccgttaaggtaggctggcgggcgtgaaactgtggaatgcagatggagaattctgtgcaaattaaaaccttgataactttgccttncggtcaaggaatcgagctaggtttttttttgacggctgcagaatcacgggcctcacccttga

SEQ ID NO: 106451 - DNA, 666 bp, Oryza sativa
  unsure (1)..(666): unsure at all n locations
agaatatttgagggtacacaacaggtttcaactatgggggtcttatatggacggcacatctgacattcggggggttagcatagaccatgtccgcgttaagcgcgtcaactaaccgtgtttttaaagattgctggcgggctcgacactgtggaatgcatatggcgaatcttgtgcaaattaaaaccttgataactttacattccggacatggaatgtagctcggatttttttgaccgctgaagaatcacaggcctcaccctagacagactgtatttgcacaggtgtacccatagatatcattttaccaatgacttaccatatgccactaaccagctgatggttgggccaaacatcctatatctgatgatccacaactgattgttaacgaggaggttagtataggaatggcacataggacattataatgggtatctgagactatgtatgcgtcaaacgcgctcactaaccgagccgttcaggttggttggaaagctcgacactgtcttatgcaaatggataatagtgtgcaaattaaaacgttgataactaagactttcggtcatggaagtcgatctttgatatttacgacaggttcataatcacgggcctcactacttnatatacctgcaattgtagagaaagaacccgcagagcattttgttagaa

SEQ ID NO: 106452 - DNA, 924 bp, Oryza sativa
atgggcccttgaaattgcaatacaaaactcagcttgcagcctgatgtcgactctagaggatcccctatatatatatatatatatatgagatatatatatatacatatatacatacatatgtgtatgtatatacatatatgtgtatatatttatataacacaagaaaaaaaaaatatatatatatatgtatatggatatgtatatatatatacatacatatacatatacatatatatacatatacatatacatatacatatacatatatatatatacatatatacatatatatatacatatatatatatatatatatacatatatacatatatatatatatatatatatatatatatatgtatgtatatatatatatatatatatatatatatatacatatatatatatatatatatatatatatatattcaaacaaatgcgagaatgtttgggactaaaagatgttagggtgattgtattatatgtaagacatagatgactactgaaaaaaaaaataaatgggccatacgaggtggagagggactaaaggaaggctcggtggcatatggaccagaagatgaagataagagaagcgaggtattccctggaaaaaattggggaaacaatgaatgcgaaaagtatttacacaaaagcgaaggggagaatatttgggaataagatggatggggggaaacgtcggatattttatatatatgcgtacgggaaacaaaaaggaatggggtattttacctacagggggatggaaggaagttttgggtaatacggaagtgaaggaaagaggagccgaggaaaggattccatgggggaatatttgtttgagaggggacgggaaaaggactttaaacagagtaaagggggggaaaatttggatttggggatagcgcgttttaaaaaagggcaatg

SEQ ID NO: 106453 - DNA, 756 bp, Oryza sativa
cacgcccattgataacgtcatgatacccttcctccgctcgcagagtcttttcgtttttcatatctaccatgtatcctcccataggagtggttttgctggtctcctcttcaccattactttcatatgacaccgagacttcctttagtccccctacagcccatatggccaatttattttatttacaatatacatttatatgagacatacaatacattacactaacatcctttagttcgaaaaaatcttatcttcggttgggaatatatatttcttatggtctggggggaactaattggttagtttcaattttgggccatatgagactgagacttctctgagttcctctacaggtcatgggccatgtagaaacaatttatttagtttttccgaatatgtcaacaacctagagaaaaatacaaaatacataatgcactccaaaatattggaccttcgtctacatctgaagacttcttgcattccttatctaacatataccctactttagagaattgtttccttggctcctcttcaccatcacttccatatgtcacggagactttctttaatccagctgcaactcatatggcccattttataatttcaaatatacatgtttataacatatacacacaatatacgtaacatgagcaaccactaggtctaatgtaccctccgcttgttaatatatatatctgatgtgcataccctgtgggaacaaattggttagttcacatttgagcctatgacactggactt

SEQ ID NO: 106454 - DNA, 682 bp, Oryza sativa
  unsure (1)..(682): unsure at all n locations
ctaatcttgctagttagatctagagacaatgatgaaattcgtaccacttaatgtgttgctatgaagaccagaggagctgttaagtactctagttaatttggccacagcctaatttgccattagtgtcacattcacaaactgctgatcacaactgtactaaattttggcgactgtctgggcatataacatacagacaagtggtgtaataaaatgtttggcttgattcagttgtaaaattgaaccaaacagttcctgaataaattgtgcagctaaccaacaaacaagcccctcaagcttcaacatcattttgttaggtagcagttatgtttcgtttggatggtctcttgtgtgttctggttggaggagtttttggcagctgtagttttcttgaagtcaaaagcttgtctaaacaatatagcttttcatccagattcttagaagatgtagttatagaatccagaaaataaactagattctcaccagctgaatttctactaatagcttcatagaatctaaagctacctaaacatgcccttagatgatgccaccagtgggagctattctattatcccttttagctagatgtgccatgactatgggttttgttagccaatctttaggttttagctagacgatgaaatctgtttgntgaataattttctatgtaagatgtttggttttt

SEQ ID NO: 106455 - DNA, 734 bp, Oryza sativa
ttatacacttaaaaaaaaaactaaaacacaactaaaccacccactacaatatcacttgtaggctacacgggccaatttcacaccacactgcaggttgcaaacaggcatgggtattacgaatctcccccaaagattctaccataggataacccaattcccgccacctaccagcttggcaaggaacaatcaaggcatcgttcaacacacatgtgaactatgaaagtatatatagcctgtgataatttgtgacatatacacaaacatcatatcgtgtagagtgtgattcaaaaaagtaaattattccttgcaaaaaggaaaagaagaaaaaatatatcgtgagtgggtgaaaaagcatggatgtaagagctcaacttaatggagacaacacttacaagaataaatgagaggagtgacaaaagagtactcattgcttagtctcagataattttagcattggctgcttatagttcttgctcaatttggtcaggactagcacaagaggtatttataggctagcatcgctatcacgatcacgtacaatcatctgctaaaaaacaaagaaattgagaaatggtggcaggatctaaaaattaattctgaattaattttccatgctggggcgcacatgctttttttacactgtatatgtattaaattcaaataaaggaataccctgtgaaaacagtgtaaatccactgcaaactttaaaaggtattaccaaagtaacttttcat

SEQ ID NO: 106456 - DNA, 853 bp, Oryza sativa
  unsure (1)..(853): unsure at all n locations
acatcatggaaaatgcgtggcgcttggggggtgaccaggtcaggtagtgttggtcgcaaccccgtagccacagagcaagtacgcacagcagggaggataggctgcggtggtggctataggtgcagncggcgacaatgacacatgcgaggtgaggaaaccacattgccgcaagggaagaagggtgcccctatcatacccccgatgattgaacggtcagatttcatttgatacatgcttgtacaaagtacctggaggtactaactgctggaccggaacaaaacacattttagatggaggtagtaaatttcaagcacccaagtttaatcccaaaattagtgcacttttaaattactactctctccatcctaaaattagcaacatagtatgcaatgagacatcctagtattatagatgtggacatagcagtatctcatcttatctcatctcatacaaagttgctatattttgagatggaaggagtatatgccccatcagttgaagcatgggtactggtcggcgttgctctcagtccgcacgggtggcaatgccactcaccatgccgtgcctcccttcctcccctccgtcgctgtccaagctagcaatcggatatctgtgcagcggcaaggtcaaaggcggtgggggctgcttaccagctccgcaatggttgaaggcaagcagtagctatcagatctgggtctccgctcctaggtctagatgtgtggtggagtggtgacagggatcctctccggttcatcaacaatgatgcccctggcttgcggatggtgccgatatgggggctttccccagttcgtggatggcggtgcaattagggcttctccccggtttgctgatg

SEQ ID NO: 106457 - DNA, 716 bp, Oryza sativa
  unsure (1)..(716): unsure at all n locations
ctggtaagcagcccccaccgcctttgaccttgccgctgcacagatatccgattgctagcttggacagcgacggaggggaggaagggaggcacggcatggtgagtggcattgccacccgtgcggactgagagcaacgccgaccagtacccatgcttcaactgatggggcatatactccttccatctcaaaatatagcaactttgtatgagatgagataagatgagatactgctatgtccacatctataatactaggatgtctcattgcatactatgttgctaattttaggatggagagagtagtaatttaaaagtgcactaattttgggattaaacttgggtgcttgaaatttactacctccatctaaaatgtgttttgttccggtccagcagttagtacctccaggtactttgtacaagcatgtatcaaatgaaatctgaccgttcaatcatcgggggtatgataggggcaccctccttcccttgcggcaatgtggtttcctcacctcgcatgtgtcattgtcgccgcctgcacctatagccaccacccgagcctatcctccctgctgtgcgtacttgctctgtggctaccggggtgcgaccaacactaccgaacctgtccaccccccaagccccacgccattttccatgatgcgcgtgactgtgtcgctgctgccgcagtctcctcccccatcgcgtnttgggctctcggcacct

SEQ ID NO: 106458 - DNA, 800 bp, Oryza sativa
tctaatttttagggatatgatcaagttttttgtttaatttgtaaggtggatgggaatgatttagtttcttacttggttagattgatgtggatgaataactggaaatatgaaagtttttattaataacataatatattctatattagcggtagttatcattaacttctccatattatacacaaattaacaacaaaatgactcattatctctaatcaacacaaaccttgacaattaattactatttaacaacaaaatatattaattatcattattgtcaagattagaaaaggtggatggtctcatccggccaatatttccgaaatagctcatccagcatctgcatgaaatattctctcttataacggtctcattcatgattcgtccttcctatcaaccaaacatagttaagttggatggtcatatccatgtagggatttcctttcaaccaaacacatccccctagcatcttcatatggaaaaagtgcacatggtctaagtccctgcatactagtatattgtgccacatgccaatagctgattttactttgttggtctggatggactcatttgtttgtagaagttggtccgggctggtctggcatttaaataactagcaaaaatacatgtgcattgcaacaggtgaaaataattttcacgattaataaaactcgatcaatttaaacaacaaaccgaaattaaacaaacaaatcaatagcaaaacaaagtcagaaaccatatatagcattcaaccgggttgtgcgtgcttcatgtgtcatcacacgaagaatcacttatgtacg

SEQ ID NO: 106459 - DNA, 692 bp, Oryza sativa
atgacaccgagacttcctttagtccccctacagcccatatggccaatttattttatttacaatatacatttatatgagacatacaatacattacactaacatcctttagttcgaaataatcttatcttcgtttgtgtatatatatttcttatgttctggggggaactaattgtttagtttcaattttgggccatatgagactgagacttctctgagttcctctacagttcatggtccatgtagaaacaatttatttagtttttccgaatatgtcaacaacctagagaaaaatacaaaatacataatgcactccaaaatattgtaccttcgtctacatctgaagacttcttgcattccttatctaacatataccctactttagagaatgttttccttggctcctcttcaccatcacttccatatgtcacggagacttcctttagtccagctgcaactcatatggcccattttataatttcaaatatacatgtatataacatatacacacaatatacgtaacatgagcatccactagttctaatgttacctccgcttgttaatatatatttctgatgtgcataccctggtgggaacaaattgcttagtttcacatttgagccatatgacactgagacttctttgaggtcctctacaatttacgggcaatacagaaaatatttttatattatcta

SEQ ID NO: 106460 - DNA, 691 bp, Oryza sativa
  unsure (1)..(691): unsure at all n locations
aactagagggactaccgagatggttgtttcttctgtgcaaaattcgtaaggtgttatattcaagctcagtcaaacaggggctgagcatgataacaagctgaacacatttctagctcatgggagtttggcctactcagtaaccaacaattatctaatggaaagtatcaatttatgtactcaagctgcctttttgatttccaaagttcatctcagcaactgcaagctagaggaacaatggtgaatgtttttttgtattttggacatcccgaagaattctcagaactaaaggtgccatgggatctaggagtttattgcattggcttggagacaagccaaaaattaagggaacgggttgttaggagccgatgggcttcctaaggtgcagccgccccacactattgatgcagcccaagaccatgttccatgtaaagcctaagggcctgttcggctgctttgtaccgccgctgtggtgccacagccgaaagaaacaacacactgtgctggttggctgcagcacaataaaaataatggcagccgaacagagccttagaagaagagaatattaaagcagcagttctaccgcaaggaggagagggagagaatcccaaaaccgaagcttgggcctgacngtgcgggcgaatggcngcagtggccgcgacttaagtctatgcttggattctcgtcgagtacc

SEQ ID NO: 106461 - DNA, 580 bp, Oryza sativa
atacacttagtttaaaaatgtaaaaatggtgcttgtaaatttgtattgaaaaatactttcaacctcttataaactcctcgtgctttagaagatgataccccaatataaaactggaccaatgtcaatccttcatatccatatcaaaaagtcaaacatcaagtagaatttttaccgaatgaaatgttagtctatatttctttacccaactcttgaagctccggattcttcctttacaaattgcacggaagaacatcgccagagttatttatccaattggaaatattgtgcaataatatgaacaggtcttggctggtttgaaatgttaaatggagtatatctacactaaccaaacaacgatggcgacacttatacataagtgcatgtttatacgcattgaaaagcttatcctttttgccattttgtgccactagccgcgtttgccagttcaaatggcggttgccagactgtataaagagtatatatagtagtgaaaaatccgatgacgattgcctgaaatattggccaaatcaaataccggatgcttgtacccataatcgatcttattacctactaccttcat

SEQ ID NO: 106462 - DNA, 823 bp, Oryza sativa
ttctcaatatataacatagttttatatagcatatttaatatgctgtcattctagtaattaaaagtcaattaaattgtattatttagaaaattttgtattttggtttaaattgtagaaggtgaagaaacaaatccaaactagtggtgcaaattgaatgagtaacataatttttatagattaaatgcaagattgtaaggtaatatctgcataactggtatatgatggcatataaacatcatgaaaaaactcatctagcatttctgaactaaaacaacacacatctagccaaattgttgcacaaaaatgctaaattgtcaagtttcttttactagaacgtacccatttgccaagttgatgcacttagatgttcaattctcactttcttgtactactagatcatactcgcatgtcaagttgttgttccaagtttatactattttactgggattcaggtcttcttttagttgtgaatgtagaaatggctagtttttgtagcattctaattgcaatacggaatttgagagtactgttattgttaatgggtatttttgtaaagtctggactttgtaataaatggattagccaaagcttgttttgttttgggctatcatttaacaggcttattgatgagtcttggtgatttctataatatcttgtggaagcgtacataacatagtgtgttaatgcacctttctaatatccgagagaaatcccagttccagaaacactagaacaaaacatggttgctttctactattatttaacattttcatttctaagaaatatcaaaggtgaaaaaagtatacaatgtgtactatcatgt

SEQ ID NO: 106463 - DNA, 595 bp, Oryza sativa
actatagggcgaattcgagctcggtacccaagaatatttgatgatgaatcaagttacaataaaataaatgataattatataattttttttaataagatgaatggtcaaacgttgaataaaaagacaacagcgtcatatattaaaatatggaggtagtagtaattaagatcgatgatgcgtacaagcatccggtatttgatttggccattatttcaggcaatcgtcactcgatttttcactactatatatactctttatacagtctggcaaccgccatttgaactggcaaacgcggctagtggcacaaaatggcaaaaaggataagcttttcaatgcgtataaacatgcacttatgtataagtgttgccatcgttgtttggttagtgtagatatactccatttaacatttcaaaccagccaagacctgttcatattattgcacaaatatttccaattggataaataactctggcgatgttcttccgtgcaatttgtaaaggaagaatccggagcttcaagagttgggtaaagaaatatagactaacatttcattcggtaaaaattctacttgatgtttgactttttgatatggata

SEQ ID NO: 106464 - DNA, 611 bp, Oryza sativa
ctggccagccgcgttgccgcaggcccgcagccattgccgtccctcccttcgcgcgtcgatcggcgccgccgctcctccgtacgtagcagccgccgttatccccttcaagcgtcgctgctgccaccgctcctccacgcggagcagctgccaccgtcccttccaagcgccaccgctcctctctgcgccggccggtcgcgtcgccgatttatatgtttggatagggttcgtataaccataggtattttggtcagttcacgctagcaatttggtcagacggcggtttcaattttgaaaaacgtggttaaatgagaaaacaaaaaaaaaaggtaaattaattattagatctcaaaacagagtcaaataagtaattgccaccaaaatttatcctcatacttatacaggatcgtgctgctttgctgctttgcatccacgcactttttgcgactaagctgaggaacaaaaaggattctctaccaatgatgaaccaaaatgtaacaagatctgcatatctaccatgcaaagagttgttcacaaagatcgtacgagacagagatgggaatgctctcacgccttaacaagaaggataccggagtctcgacgatcaccatgcc

SEQ ID NO: 106465 - DNA, 625 bp, Oryza sativa
ccatgtgtgtagatgtgaaaacacgaggcctggaagatctgcttaacttcagtgcaggtccaaaaatcttgcctttaggttcgtgagcgtgcagttgatttgatcctccaatcaccaagaaataaagccaaagaacccgcggttaaatccataaacgatagccgatcggctagttgccgatgatatatcatttatctccaagccgatgtcatatgtgaattgatcggcaatcatgaataaaatgaaaaagaactaaatctactctatcggctgtagatattaacaatatgtagtccttatgtcgatatatacttaaatcaaatgattgggatatatcggtcgccacgccgagacagtataaatcactcagatcgaaatatatactaacaatgagactatatatgttcatagcatagccgatcagatagatccagtatgtatcggctaatactccgataccactctatattaagatattaaagcaagtaaaatatatcaaacagaagcgtaatatatctagatgtaacaagatcataacataaagggcagatctagcatatcaattaagtacatgaaatataaggctaaatcagataagatcgcctgaaactctgatactactata

SEQ ID NO: 106466 - DNA, 763 bp, Oryza sativa
tttactgaggtaaatgattacacctagattccattttctttggttgcactcaaaaataatgggtggactgctcacagaattaaacaaagatgggctattagaaagctggattgaatttttaggaggattaaacagagaaggaaaattctagaaaaattatatttattcatgataactaatctagtatttgaataaattatttcccatgttcacttatgtgcagttaaatgttcttttggatgaaatatggttttagccgattaaatttaatttgatttcttttagttgtctgcttcgaccgattaatttgagatttcaacttgagtgttaacatgttaccaaaattacagaggataagtttgtgctaatcactgtccacataaatttttccatgattttatcttgcacaaaatattttagagaattaggatgacctttgtttgtatatgtgttcccacttcataatttcatctaatattattatagggattacattaaacttcttttggactgagaagatgatatttgagtttaatattaagtccacatgttatcacccaagattaactataggtttgtttagtgaaataattcttttagattatgctcatgggacctattatggaatgcaagaccaaaactccaaatgcacaaagaactcgagcctaggcatgcattatgtacatgtatgcttgatgacatttctagtctaatgttgggaatgaaaagattttattttgttctcaaattttaatcatgcaat

SEQ ID NO: 106467 - DNA, 766 bp, Oryza sativa
  unsure (1)..(766): unsure at all n locations
ttcacttgagacagcatcaatcagtgttgtaaatatcctttgacagccaaagcatctcaatgacaatcaagcccatgttgaccacgcgacagctcgcacgtgcaaaaggtaggaggaataaccgtgcatgctctccctccaatgcaaaagtcacctctgcctaatttacctttccttcaaagctacaagttaccggcttactctcactttctaccatcagtcacaaaacctaggtccaattgtagctttgtttattagctaatgtattattagtactaatactttgttccaaaacagaagtcaccggtttacctttttaccatcagtaacaaagccctaggactaaccacattcccattcttagttttcgccccccgagtgatttcttagtttactattacctaaatgtaggttaaatagtagtaatacaaattagtcttggttctccttggaagtggtaaagagcaagtaaaggtcaattcaagtatttgcagtttgtttccaatcaacatgaatttagatggcatgtgagaaacagttaatcaagcatggtgacagcctgatggactagttttggaacaatcttatttggctctattgcagatcatacccagaagatgcagaaaaggactaatcttcagagaagggttgattcacaaccctgatgtactggtacagnggagtactgctactttatagacatatatgtctcaatgtactcctccaaataccatngtcttagctcaacaaaatcttctacccttct

SEQ ID NO: 106468 - DNA, 602 bp, Oryza sativa
ttgagctataagatcaatcttgtgggcttcaagccgatctatgttcgactgaatcgccccaacagagagttgatcaagcttggctttctcctcatgcacaagttgccgattggcttggatagtggcttcaatatcttttcgcacctgctgatcggcaatccgttgcttagccttctccagcttgaattgatgttgctcgagtgacacagctggagtaatggtatttgccagatcatccgggattaaggcttggatttcagcaaaccgtgcccggatggaaccgcagtcggccaccaagttgtctaatgatgactctagccgaagggatatatcttcgagtgttttcttgacattttcatccagaggggctagagccttgcttgggattcttcttctacttctttatcaaagtaatctttgatgtcaaaggagaatagatcggctaaggtctggaaaagagaaatttaaagatagttaaatatcaaacagtgtcagccgatctaagatcttatgtcaatgaaagactttctaggatggcaggagccgctgtttgtcctcttcttcaacatgatgacttcctgtagccgatgggtacggtcaat

SEQ ID NO: 106469 - DNA, 763 bp, Oryza sativa
  unsure (1)..(763): unsure at all n locations
aaaactagggtttggaggagcgcgaggctacatcccctcctcatttctcaggtgagctcgtagctccggtgagcaacccgtcggccgtcgtccccttgctgtgaactactcatgtttgtttcatactactgtttctacatgtcccactgtgtttgttatgactgtttcagtattttcttccattatgttgcaccattttacttagactaacctcagcacaattaattttaatgttttagcacagtctttgtagatgtttcagttggctatccatgcttgtttcattatattaataaaacttgtttcaccacatttttgcatgtttgttgtgaactactcatgatttggttcatactactgtttctacatgccccactgtgtttgttatgactggttcagtatgttcattcattatgttgcaccattttacttagactaacctcagcataattaattttaatgtttcagcacggtctttgtagatgttccagttggctattcatgcttggttcattatattaataaaacttggttcaccaaataacaggctactagacccatccttggagatgtaggcttccatgtttcacttaagtacttctgagctgccatgaaccaaggngagaaatgagccatgaagtacttgcttggttgatagaaatgttnaatggagagtgtagagaagatagcacaatgcaatcaaacataaaaaaatattttttatatgtcttctctccaatcatatcggaatttttttaatcta

SEQ ID NO: 106470 - DNA, 596 bp, Oryza sativa
attcggaatttaaaataaggaatattagaagtggagtatagagtccatatagaaatacaatcaggaaataattgaaattcggaattaaaaataagaaatattagaagtggagtatagagtccatatagaaacacaatcaggaaataattgaaattcggaattaaaaataagaaatattagaagtggagtatagagtccatatagaaatacaatcaggaaataactgaaattcggaattaaaaataaggaatattagaagtggagtatagagtccatatagaaatacaattagaaaaaaaaaataaattcggaattaaaaaaaaggaatattagaagtagagtatagagtccatataagaatttaaaactaactaaaatttggaataaacataataaaattaaaagtagagttttgagtccgtataaaaactaaaagtataaaaatataatttacaaataactaaaattcgaaattaagaaaacatgggaagaagagtttaaagtcaatataggaatacaatttagaagtaactaaaattcgaaattaaaaattaaaggatattggaagaaaagtttagagtccacatacgaatata

SEQ ID NO: 106471 - DNA, 646 bp, Oryza sativa
ttttgcattatggtaatccagtccttcagcctagggggtagtatcatgttcaactaattgcagtttgcttactgccctgtttgtcggattcctgacatcttacctttttttgagtatcgctttattcatcagaacggactagacattatgattaagggtaagtaaagttgggtttaattaagtgacctaatcaatgtcctgaaaaacaaaagatggagatataaccgaggataaagatagccatgctttttatccctccttttgagctttcttttcctttggaaagcaaaatggattggtgccgctgttgctccatactccgtagcctaacctatgagagagatgtatttcttccattttgtcatatatgtctgatttccggtatcaacaggaaattttgtgctatcaaatgaaatgaggaacctttagaaatgggaaaaaaagacgtggacattaacctttggagagtgaccagctatctaccggcttcactagtcactatacagtcgtgagaaaatcatgggattggtatatatagtaaaattaatatatgtggtgcaccttttgatcacaatcaacatcatgaaatgttgttccccacctcattatgggttttaattggtccggtaccagaaaatcacctcaa

SEQ ID NO: 106472 - DNA, 505 bp, Oryza sativa
attttttatgcaaatataaaaatatttatgtcatgtttaaagaacatttgatgacgaatcaagtcataataaaataaatgataattacgtaaattttttaaataagatgaatggtcaaacgttggacaaaaagtcaacggtgtcatacattaaaatatggaggtagtatatagttattttttctgcaaaagcatgtgtgtgtatatgtgtgtatatacatatacatatatatactctctccatcaaaacaacctaacctaatcgaggatgtgatacaatctatgataggataacgaatctgttcctatggtgtcttatcatcacatagctttagttttttctttacggtagtaggttggaggttatttggacggagtgagtattattcagtcatttttgcataatttttatataggaaatgtgatgcccacctagattgaaaacgccacccaggaaaatgatttcatcgtgagaaagattcggtgggagcagagtgaaataaatt

SEQ ID NO: 106473 - DNA, 918 bp, Oryza sativa
acatgtggaagtacggtagtgctttcaacaaaggcccgaagaccggtctttatatggccgaggtgctactatcaaaaccatgcaccccgagcccaagcctaaaaccattttgaggattttgaatagagggggaggtgtgaatccaattccataataatccaaccattccatagtgtccacctaatgttgcctaattaaccagcgaagcatctacctaaaatcatactagtggtaccatgagtagagtgtccactagttggggttttgtttattctagggtgaacaaggtaataataacaataacaataataaggtcataacacaggtacataggcatggctagataaaacagtgataacgcgggaatttaaataaagcgataatgcaataatttaaatcaaaataactttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggtcatttgaagtttatatgctctttaaatgaatatttgcgaatttctttatttaaattttaatttaaaaatggatttattgcgtcagccgagaggagggggcgcgcggaccgggtccacgggagtggggcccacgcggcagcctcacggtccacggtggaccgggcgcacccgggctcgcaccggccggtgccgtgggtcccacgcgtcagccgcacccgagggcgcgggcggctgacggccgggccccacgc

SEQ ID NO: 106474 - DNA, 623 bp, Oryza sativa
ttcgatgcaagggtcggtaactttgcctttgaattatgtttctaaaaaaatcttttttatcccacttgacatgctttgacgtcttcccaaatggctttactgctggacttcttattgtctgatcgttatcctgccaaatctgaagcttcggtgttagatgtgggtttaatccgacccctggagactatctttgaacatatcacttgggtcataactgggaatagctctcatgaacaagcaactcggattcactttctttatgttcagtttactttccactattctcttcatgttgtcatcatttagcattcaaagtattcccttacacattcaaccctgatgtgttattttcagatttctcttatcttcgacctacttctttgaccggtaataaacacccttgctgttatcttctatcaatcacctttttgactttgtcaaccaaatactcttcactccgaaagttgtggatgcttctggtgacgatgtggtcctttggtctgcttgccttcaatgaaacctcgaagtgtttcgccaaaagctgtactgacccgttttgccttttatccgaaaaaaacacatctgaaactctcagtctaaacaaaaggctcttttgcttttta

SEQ ID NO: 106475 - DNA, 806 bp, Oryza sativa
aacggatggagtacttcattaagcatgcgctatagtttatctcgttaaacatgtcaccaaaaatcccaacccccaccccttctcgaaagaagtattaacctatcgtggtgcccacaaggctttttaacgaagttttcttcggtcctgttgtacatatagatatttaaagtgttaaagaattgttcaattttgtcgttggttatacccatatcatagaatccatatctataccagtttgtttggaagacgtacggattggctagtatgaggaagcaacagaatccatatctatcggtttgttttggaggacatagggataggctagtatgagaaagtaaacgaatcagtaaaagaaagcaagagagacatgtattgttatacaggttcatgtcctgatggtaatagggtactagatcttccgttaggcgaatataactatcgatttgatggaaacttaacacaaacaatccggttttttattaacacaatccgaaccctgcaattacagcattctgtctcctttatatatcaaccgtgctgaagtatgattggccacgtcaagaatgctaatccttacgtgtgaatcgaaaaacacaatcaagaacaagaaaaacaacaactcaattgcagacgaatgattaaccaagaactcgaagttagggttccatgaaccaataaacaacaaaactataatgacaaaaataatctaatcagaagagcttattccctctacatgatgtacctttacaatttctactactatctcaaattaacataaaaatacggggcttttaactatttgccac

SEQ ID NO: 106476 - DNA, 2340 bp, Oryza sativa
tattgttaagcaagttagtttagtatccgatcagtataggtttcttttctcccatgcctgcatcgactctagaggatccccgtatccataaagcagacagtagggatggcaatttcccttgcggggacccgacccaacgggggcgggggcgggggccatttctgacccgcggatgagtcaggggatgggccccgcatttgggcggggaggggacgggggagacattgaacccgcgtggccccaggggatatattaccccttcaaatgtagcccatagaagacctaacaagcccaacttaataaaatattgagatatataagcaaaaactgaacagtctaaccctaccttatcctctcccctctggcctcccgtcctctccaggctccctttccctcttgtctccctgcggcgcagcgtaggacgacacacgggcggcacgcggggaggctcacaggcgggcgctgtgaggggcacagctcggcacacaggcacggtggccggcgatgggacaggcgtggcgagcgggtgtcaccgggtggcacaggtgacaggcgcggtgaaacgcactgagaggtatttcactattttggtgaaatgtttttgtgtattgaatgaatttgtgtgtcaaagtagttgtgaactttgtggtcatgcatgcattcagatcatggacgaaatgatggatcatgaaagaatttgtgttcttgctgaattctatatgattggcttgaattttttttcctgattggatggggatactacccaatacggggcatcggaggggtcgggggcggggcctaatagatccccccgcatctctactcgggggcgggggcgggttgaaaaatcgggggtcgggggcactactatgaaaaccatttttcgtgacggccattttgggttttcgctagcggaatttagagccggcacaaagcaaaggccagtgaagatcaagatcttcgctagcagttatcgaccgccagcgataattcattttcgctggcggtcatcttaaactagtcgccagcaaagatccgttttcgctggcggttggcttaagacggcctgttttttcgctggcagattacaatgtactagccgccagtgttaatactggccaagtttaaaaaaaatgacggacggagcgactccgctccgtctgccttcttcaacactccaccattcaaaaatttcacagaaatttacccaagcattcaaaaatccacagaaatttacatcaacaatctacagtcaactgctttcattcacccaagcattcaagcatcacaaaaatcaacacagaggagggagccgggcaacacggtcgatggcgtcgaggtcggtgctgcccttcccgcggtccggtgggggcagtctgacgtccccgcggcccggtggcaaatgatccggcctccctgcccgcgcccgagctccgccgaccgcgcccgcttggtctggcatgtcatcgtcggtgtcagctccgccaccagccccctgccatcgctgccacggtggccgccgccccctccctctggctagatctagaagagggagagggaggggaggggagggaagggaagagaggtgagggcctcgtcgctcacgcccgtcgtggacgccgtcgtcaccgtcgccgacaggacaaggaggagggctgggggctccgggaggaggggagagaggtgggggaggaggaggaggtgggtggagaggagaaagaggtagaggagagatgaatgcatgggtgggtgggtgaaaatcggttttaaatgcgtgggtgggtgaaggaatctcgcgtgcatggttttaaatgccgcgaaaattttttagtgaggctttgctttccgctggtggatctatttttttgctggcagatctctttagcagctgccagccggtttttgctagcaaacatttaagaggtttgcctaaaaaatatagtattttttatggcggacctcttaatgtggcgctggcgggccgtgaccccccgattttctacgccggcgtttttttctcgtagccgccataaaaaatattttctaaacgccattaaaaatcgtttttctagcagtgagatggggccgttccagtacaacccgtcccgacccgccctgttgccatccctaccgggtcagtcgcccgacctgcctgggaggtgaatccgccgctgcgaattaggtgagcctacacgcgttctttgaacattcctatggtacatcagtgcatatgtacctggtgtatatatataagtcattgggataggcttgatcacactagctatcttctgcaaagagcacgcagagcgacccctgcctactgccttgcctacaaggggc

SEQ ID NO: 106477 - DNA, 1570 bp, Oryza sativa
ctaataaagacaatcgactgatgataatataacaaaacaacaaatacaatccagtagaaaccaatcggccaacaatgatgtgaccgaacaagtgttgatccgaaggttaaagtatacatcggctagaggaccgatgtcataaaatccaaacgattaggtaaatagtgaaatctttgttgcgatcgactaaatccaacatgtatgcaatccttgtaaaccgatgcaatgtctaaataactcattggttgaaaccccgatgaaacccttattggcaattaggaagcaggctagaggttatggttctaagcacgactagggctgatgcagtgcaaagtacgaaaataaacataatataatatctagacaatcaagcccttgtctaattttcaggatggtagaaaccttagctaatctaatctggtaaagcaatttagccgatactggcataaaccctaaaacgaatcttagccgatacaagtaattaaactaccaaactagattaactaagatatatgatagatagatgcttacattgacaagatcagagtgtcgaatcactagctccgccgatgcaaacaaccatgacaagtataaactcgtcgaaaaagtagaaaagtagaaagtggtggcgctgcactgaatttgtattgatcgtggagatagtttacaatgaccctgagcgtatatatttatacctatgggtacatactagtccttcttgaacaagaaagaaacttttctaaagataaaaaaaaaacataaagttcttatcgaacactaaacacacattccaaaagataaaagaaaactaatagactcttcctaattaatagatacatcgccaagccgcatgctccttgaactcggtctcttctgcataaacttgctttaattgattaatttttttaatcaaatatagcaagaatccaactattggcgacttgataattcccatcggctgattacagaattgtgaagccgatactgactccaggccgatgatgaattcagggcttaccaaatttcactgttaacaacactatactaaaaatgtttatattttggaacggatggagtacttcattaagcatgcgctaatagtttatctcgtttaacatgtcaccaaaaatccaacccccaccccttctcgaaagaagtattaacctatcgtggtgcccacaaggctttttaacgaagttttcttcggtcctgttgtacatatagatatttaaagtgttaaagaattgttcaattttgtcgttggttatacccatatcatagaatccatatctataccagtttgtttggaagacgtacggattggctagtatgaggaagcaacagaatccatatctatacggtttgtttggaggacatagggataggctagtatgagaaagtaaacgaatcagtaaaagaaagcaagagagacatgtattgttatacaggttcatgtcctgatggtaatagggtactagatcttccgttaggcgaatataactatcgatttgatggaaacttaacacaaacaatccggttttttattaacacaatccgaaccctgcaatag

SEQ ID NO: 106478 - DNA, 6159 bp, Oryza sativa
cgcggggcgcgcccgaactcggccacgccggcacagccgacggaaggcggcgcgcccgtgcccctatggtcgccgcgctcgaccataggcacgggcgcacgacggagcggcggcgtagagaggggaagggaaggggaaaaagaagcggcggtccacggctcaccccgagtcgactgcgacgacgtaaacggcgaccggagcggaagaagacgccggctcggctcgggtggacggggtcgacggtgctccggcggtcggcgtgcgaaacgtaggggtgcacgaggtcgccggggatgcggtgaagccgaaggtggcgacgccgaggcggaaggtggtccggggcgacgacggcggcggaccggagctcgccggtgacagcggagagagagagcgacggcgcgagctcgattccgacggggagaaaggccggcgagtgtcggaatcggtgaagggaggcacggggaaggtttatatagggttgggagggggagagaacggccggatgtgggggaaacgggcgcggaagatccggccgccattgatggcgccggcgaggtttaggggaaacgtttccgaacaaatccgagggagagagggagggaaaaatggggggaaagggagagggaatcacggggagtgatttccccctctttattgcgcgcggggacggcgggatgcggcggaatccgcggcggcggcggcgctagggcacggacgaagcggcgggtgcggcgcgaggacagggatgacaggtgggcccacccgtcagcggcacgcgcgcggggaggaggccgattgggccgcgggggagaggagagagagggagggaggtggaccaatccggcccaaaaggggaagggggggaaaaagactttttagggtttttctttttatgaaaccattttaactttgtttatttcttaataattattatttgtgctctgaaaattccactaaaatttgagggctccttttagaccaaggagaatttaacaaaaattctccgggccacatttgaatttttcttgtacgtattttagtgtttgctaatttcttttcgaattttaattaattctattattccttttagagaatgatttttatttcgggatgaatttatcaggacgtgacagaaatatccgagatcctagtcggttacgattgtattttatctgtaactacatattctgttagggatatggactttattttgtaatacggaccccttctcctatataaggaggggtctgggtgcctctaggggcacgatttcctcccagatcatacgatcaataatacactcggcggatcaatccccggacaggagtagggtattacttcttgatttagaaggcctgaacctgtataaaattccttgtctctaaacccatccgcttttccagcttgatagccacccccttttagtattgccgaaatcttgtttcgacagaatcctatgaaattcctatggaatgcctaatacaatgtaagtttgggaggaattctaacatgaggtagaacctcatggaaactttcctgtgagtctttatctcatctaattcatgtgtttttcctgtggtccaatcaaacgatcattactgtgtttttcctgtgttttgcaatcctctgttttacacttaagggccggcctgtttggcacagctccagctccagctccacccctcctggagctggagctcagtcaaacagtttcagctccaccaaaactgggagtagagttgggtggagctctctcacaaaatgaattagagttgtggagctgggtttaggcagctccacaactctactctagacccaactcttggagctaaatttaggagttggagttgtaccaaacaggcccttatattcctatcaaaatcctatgtttttcctattcctacgttttttcaatcttgcgattcaaaggggcccttagatacaacaattcgtcaaggaatccaggaaatatggaaggtgtgcacatggttttggtgaaccaaaacacagtgaaggacaaaagcatatgagtatatgtcagatctttataccttgggagattaattttactgtacctgagaaagtacggtatctaaattttagagggttgctacaaaacaggatcccgttgcaacgggatagacatattaactattatcttgcacgagtatcacaggtataaggtcctaaatatcataggtaccggataacagacatcacagatatcgggtaccatgtagctggtaccacaataggtatcaccgtatcaggtatcaggtactgtcacatagaagggtatcccgttacaacgggataccgttgtctaggttttctgaaattttacactaatattattttacctcgaagtatttagtatctgaaggtatcaaatttacataagaaaatatgacacattccggtatatattttcaaagagggataagtccaatttatgccctcaaacttatgtttgtctaaaatacaccctgaactataaaagcgggtattatacaccctgtaactatcaataccggatactttacccccctagagctgtttcagactggttttcgatggcacgtcaacatgagtcccaccagtcagatgatctctctttcgtttttttttctaagctcgctgaggagcggaagaagccagcgagcttcctccctctgtcggttccttccctggcatcctccctctgtccatcccaggtgacccccctccctgatccatcaacatccatggtgaggcgggggagatgctgcggcgagcgacggtacgggatatgacagggcagtgcccggaacagcgagaggtcctggtggtcgccgtcgcctccctcatgaatcacgagcttgctgtccccgaacgggagaaatggacctcgctagagccaccgcaggaggaggaatcatccctgtggagcgtcgctgccgcctggtcgaggacgaggagtcgctcggggaggaggagctcgagcttgccggtgataacaagcgcacatccgtcttcgtttccgccgtgatggcggcgtcacggcccctgccccggtactcgcgtctctgtcttgtccaagctcgcgccaccttttatctccccatcttctctgatcttggccaaggaggctggctctgccatcctcttcagcggtgagggaatagtgggagggacgagaagaaaacgcaatggcagatggatgcagaagttggggatggtacggatggatgcagagattgggattagtgcaactggtgtccacgagctagcttcgccattgccggtcgcctcgctcctcctctacgagctttgcctccggcgagtccactcgcaaccttgcctctgtgaactcccaagcttggtggcttgagagagaggggaaggaggtagcaaaaggaaggtcagagttcggtgaggattccaacggcggcaagccggcgaccatcgaggggagctctatagcggcgttccacagtgataattccgatggctgtgaccctcggggtgtaggtcagcgacagcactccacagcacaggtaaaattcggtggcgccgtggcaacgctcctctacatcgccgtcgagatatgcgagaggaaagatagagagatgaggggagtaagaggataagacttctgactggtagattaggcccactgttttttaaatattttttcattaatcggaatgccatgtcatttgctatgtagaccaaaaccgcctgatctaaaatgaggggatcaattgaaacgattttgatagttagagccttagaggatgttgaatacctggttttatagtttagggggcattttagacaaaggtaagaatttgagggtgtaaaatgaacatatccctgaaaagtactatcagaaaagtactaccagccaccggcgcgttgtgtcctcgtcggcgtgttcgtcttcctagacgttttctgttccattcggcgagatcgatactgcagtcgccggtcataaagcggacttcttgcccccgtcaccccgggagaaaaagccgaggcagcagcaggcgtccactagtcatcgatcagccagcgcaggcggaaaagcagcggcggcagagaaaagctcacgcgtggctcccaactcccaaggaagaatattccaccgagcacctagcttgtatcacgtgaatccaaattcacgtgatttttgctatacgcgcacagagccttctaccaggagattcctccatcattgcttcgtgcacacgagaagtgcacctagaggttcacgtttcagctaagtttacaccaacttcttactggcagctttagaattaattcccatgacgagtttaaattatgttcaaccgttcctataccgagacacaagattctcactacagatgatgcactatctgaattcgacataagtactaaggattggtccgacgatgagaaaaaaaaaggattgtaagactatagcatatattcatttcatctaacaattatttgtaggaggtatttaaggagaagacagtcataaagttgtggttgtgtcacgaccggaaataacccaacgggcgttccttacgtgcgtgtattattccttatcccaggaggcaaggtacaccaaaaattgatacatttcagagtttatcaagcggaagcgtaaatagttaatttattacatgggctgcgaaggcccagcacacacaaagacaaacgagaaacagcggaagactagggcgacgaccacaggcgcttgacggcaggcacgagctaaacaccaaagccttcatcttccagggactcctcttctgggtttggaaaaaattgagcaagactgagtacaaccaccgtactcaacaagacacacccacaagtgcagaataaatgcaagggagtacaagggggttataatataaagggttagggttggcagtaaacagcattaaaagacacttagttgctcaaagctattttgtaaacacgattctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgtagctcgtgtagccttcatttgtcctagagatgtccatcgacctgctatattattatccccttgtacccctatattattatccccttgtacccccttgcattaattatgcatctccggtgtggcttgctgagtactgtggttgtactcattcttgcttaatcttttcccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgccttttgtattatgtttgtttggtgtaccccggcatttcctgggatggggattaatacactagcgttcgggaaaaggcaattttctcggtcgcgacacaaagggccggtgtcctgctgctaggggctcagtcctgcctacctgtcccgggggttccggccgtaggtggggttgggtcggtactcttgtctatggctaggatgggttggaaactatgtcatgtcttccgtccgtatgccgtggtggtatgtggcacgtggttacacgtgagaaagatgtgtcttgtgggtaaagatgtacacctctgatcagagtataacctattcgaatagccgcgtcctcggttatgggcaagccgagcaatgta

SEQ ID NO: 106479 - DNA, 1373 bp, Oryza sativa
ttcttgtacgcattttagtgtttgccaatttcttttcgaattttaattaattctattattccttttagagaatgatttttaattttgggatgaatttatcaggacgtgacaaatccaccccccttacaagaatctcgtccccgagattcgaggaggctagcaagaagataggttgggcggtcttctcttcttgtctgacttcttgcgtcgcgtcttctataacgaacttgcctagcaaaacttctccactctggactgcttggctcgatctcctgttatagatggaatcgtctcttcacctgacttttccctggttgcacctctagctgacttcgactgggctgcggcattggaagatggggcttcagttccagaacttcttataactcatatctttggagtcaacctcatacaggttaccacttcatgttatgcgtcaacactagcttgtcattactaggataccatgtttgtcatcataagaatatcatgcttgtcatttacttctaacttgccaccaactgcctcatattagctttcctgctctccgggtgctagctacttctgctattcgatgcaagggtcggtaactttgcctttgaattatgtttctaaaaagaaccaacttatcccacttgacatgctttgacgtcttcccaaatggctttactgctggacttcttattgtctgatcgttatcctgccaaatctgaagcttcgttgttagatgtggttttaatctgacctctgtagactatcttcgaacatatcacttggttcataactgggaatagctctcatgaacaagcaactcggattcactttctttatgttcagtttactttccactattctcttcatgttgtcatcatttagcattcaaagtattcctttacacattcaaccctgatgtgttattttcagatttctcttatcttcgacctacttctttgaccggtaataaacacctttgctgttatcttctatcaatcaccttttgaactttgtcaaccaagtactcttcactccgagagttgtggatgcttctggtgacgatgtggtcctttggtctgctgcctttcagtgaaacctcgaagtgtttcgccaaaagctgtactgaccgtctttgcctttgatccgaaaaagacacatctgaaactctcagtctaaacaaaagtctctttggctttttaatccaacacagtttaatggctttcttttccatcaacaggttggttattaactcgaggttagaacatagttcctctgaaatcagaccctaggtctcctttgtcagtaaacaattatacacataatcccatatccacatcttccaaaagaatcctaatagaacttgtctgtattacacattt

SEQ ID NO: 106480 - DNA, 533 bp, Oryza sativa
agtgttttctaggatgcgatccaaaatcgtttttccttctgacggcgtcttgtgcatgaacgatcctccagcggttatgtccagatagaatgcagactcctaatccaaacccgtatgaaaatgctggagaagcacatactcgggtaaggaccgggttggtccggactgcactaaattagtgaatctagaccaagctgcaccgattgattcgttttcgatctgcttgaaactgagaatttttactcgaagggcggtaatacgggtgactgggaagaaggcaagacataatctgtctcgcagctttttccagctaccgcttacacatccaacggtagaggtgtaccattggtttgctctctcttgaagaggtcaccgcacagtttcttgtctcatgccacgaatcttaaggcatgagtagacttgtcaaagtctcgcagatgatagtagggattttctagatcacagccagaaaagggattttccctaccatactaattagctcgagacaattttatagccagttgtataaatgg

SEQ ID NO: 106481 - DNA, 661 bp, Oryza sativa
agacgaaaacaaaaaccaaccaaatgtccatcttttcaacaaaaagtacaaatatacttctcacgacaagtttgtgaagtagatggttttgaaatatttatttttgtttcttttaaagttgcaaaaagagaaggcaaaattccaccagatttaaaaattgttttctttgcacttggttttgtcaaaatttctctgcattctgctatactcaaaacattgggttgatttttggtgaaatagtcacgaacatcaaaaccaacacccctattgtaactagtcactttagactgatctaaaatcatgtcaagttgtttcttaccatcagaaaatctttgcaaagaacttttcaaataagaaacctcatttttcaaattagcacaattttcacaatctaccatgatacctttgcttttacgacatttggggcaagaaagcacttcattggttttcacaatgttttctatatgctcaacacatactaaagcatatttcaatttcatctcattcaaaaaacaatttgaacaactttgagaaatcaaaaaatctttggtttggttagccctttttgcacataaaacattgtacaaagaacttgcacttaaagcaactttgtattttgtcaaaacgttctttggcgaaacccattcatcaataacacgag

SEQ ID NO: 106482 - DNA, 678 bp, Oryza sativa
ccttcataggtggagggatatgggattccgctgcccccttcttctcccatgccgtcaaaggccggagtaaacctgtcacgcccggaatttctatccaaaattctaaacgcttacatgtgtgtgaaccctcatccaggaatcagccgaggcacacaataacaaattgataatagaggacaattattactctaattaataagcaaataaaatatcattacagaggtagatagttcctctcaatcaataaagatctaagcagcggaaaaaaaaagataaacggcgcagacgactccactccacaggcagcttgaccagggctatacctaatcctccacaccatcagcatcactgtagaactcctcctctgatgaatgattgcaaggtgagtatatgacatactcagcaagccacacagcaaatatgcaagtgcacatgataccaaaggatggcatagtatggtttcatttgcataaataatatttaataaacatttcagaatttaataaaacagttaagtaataattaaacaatattaatccaacgctatacaacataccatgttgcataggccaaccattctgaacaaccttcgcggctgcacagttctatctccaaaccaagaattaaccattccaaaccaggagctaatcaaattattaccagttatagcatcattta

SEQ ID NO: 106483 - DNA, 586 bp, Oryza sativa
agctcggtaccctcatatgcgccacttgtccatttcatatgattcttctcccattagactacggccattttctttttgtaatactaagacaaaatggaccataattgactcggttcatcactcttcaaatcaataagaaatattgaagactaagagacaaactaagcacgatcttgttaatcttgtcatttgatggcaaagatgaagcttcactaagggggagtgttgcaacttccaaatttaatgataataaagctcatattcctcgcaaggggaaatcaaattgcctctatgtcctatgtatgctactcttgaaattttcttgggtaagttctttgcaaaaaatagggacatgcttaatgggctgaattaagaaagtaggtaataagaagattaatggcattattttggggtgaactattatgagacgttgtcaaaattatggccttaatattcggccacatttcaaggggagaatggaccgctcattgagatcgagacacttcacccttagaaatttctgacatctattattacttagatgataaatcaccaagtaaaattcagcgattcaagtttatgaaaa

SEQ ID NO: 106484 - DNA, 562 bp, Oryza sativa
aaaatatactgttataagttgtgcactaattaaacacagttttctattctagtagcaacatgttgtgtgttttctgcctaacacattgatatggttgtgaaagacatgtcccatgatcgaattattaagctaagcatttgctaatggatccatattctaaaggctcataaattaagattaattaagattatgttttggccagtacatatgtaaattagagccttactaagatcctggatgagggggacttaatttttcaatcaacactcactaagttaagcttgagtttatttgagtattatagtgagctataggtcttgttgtctcagtgacgcataatgttgttgaagacacattgccttgggagctattttatttaatagactcataagtaagtctcgaaatcaaggggagaatgttagctgattttgtcgacttgagtcgataaggattaggagaagaactaaaccaccggtttccttatcctaacaagaaacaaactaagagataaattcttttttttgtgtgatcggcacagaaaacagaatcctaaactaattga

SEQ ID NO: 106485 - DNA, 551 bp, Oryza sativa
ccatgcctttccctccttttctcattttctttttgccatgaactttcccaagaaaagaaagcatagttcattgtaggagtttatttgaatgatatttttgtggaaagccaacttctagtgtagaagcttagcttaattttatatgtgaaattggaaagtggaaatgatactgactccttgatcatgacagtatgaaagatatctaacacaagtcacacaaatttgacaaaactcaatataatgtcaagcagtcatatgcatgataatgtttgattattaatgtacttgcatatggtcttggtaggtataaggtaaagtcaactggaggatagagtttttaaaatagttctatttttgaaaacaaattcccaagagtcataagaaagttgcaaggattcctttcatcttaatcatctcacataaagcaattacttagatgcataaggttccctaatcatggatggttattcacaagcacaagttcagctgagaataatgaatatacaagatcaatcacatgaagaatttcattagttggaaattttatctct

SEQ ID NO: 106486 - DNA, 542 bp, Oryza sativa
ataattatgtatgattattagaatttttaacaattttaaatcatgcatatgctagttatatgcgataattaaaaattttaaaagttttaaatcatgcatgtggcatttacatatgttaattagagtttttaaaaattttaaatcatgcatatgctaataaaatatgattattagaatttttattaattttaaatcatgcatgtggtatttacatatgttaattagaatttttaacaatttaatatcatgcatatgctaattatatatgattattagaatttttaacaattttaaatcattcatgcgcttattgcgtattatccacttaatttactatagacaacaataatttttcgaagtaattgtcattaattttttaactttaaataattttaattcattatttactatttgagaaacacatatgtaatgaaattcaatattctgtgctattttctgtagtcccggttcttaaccctaaccgggtttaataagaatttggaaatagcgggaaaatatctttagtcccggttggtgagaac

SEQ ID NO: 106487 - DNA, 714 bp, Oryza sativa
tgtggttatagctggtttatagcttgctattgtacctgctctaatagattagttataaggttgactacaattttcttctcatctttctatctctcacttatacattaagagcaaggataataatacagccagctgcttacttatagcctatctatcagctcactcatataatggttagctcttcactataaatatatggtgcacatgtctatctcacaaattttcttggttattgtgcctaagccggctgtaaacttacagcccgcttctcatctctctcctcttttctcccatccacctcagcattcagacttcttatagcccactattatacttgctctaattgtatatgtcttggagcttgtgttaagctagctcttgcatgagagccaacacctttaactttttgttacatctcttctccacataagtttatagtaatcttatagctcactattatacttgctcttacaagttacaacccgtgaaatgaaattcatgaggtcatgcccgagctttgaattcgtcatatgttctgaaaaagatgcagagaatcaggatatcaattactccgtgcaagagttcgaagctagaggaagagttcgcttcggtcccgcccataacagcccagatgaaagcttatatcgatcgattcacctgctattgcccggcccatatgatggcgtttttgcaccggttcttatttgggccaga

SEQ ID NO: 106488 - DNA, 708 bp, Oryza sativa
agggtgatttataaattcaattttaggattaggaggagaacttcagggtgtgacaccgcggagctcgccccctctcctgccggccgcccctacgagctcgcctcatccctcgcgccgctcccatcggccgccctctcaccggcgcggcgcgcaccgccgcccttcttcctcccacccgtcggccggctcgatgagctcgtctcatccctcgcgccgctcccatgggccgccctctcgccagcgcggcgcgcgccgccacccttcttcttcccactcgtcggccggctcgacgagctcgccccctccctctcggcgctcgcgtcggcctccctctccgccggcgcggcgctcgcgtcagtcgccctcttcgccgggacggcgctcccgccggccgcctctcggctcaccgacgtgatcacgaggagggaggctccgccgccgctcccgcggcatcagccgccaaggccgcgagggagagggatggaggcggtggggagttcccatgcgcatcggcggcggcggtgctgggggcgtcctcttggtggtgcgcgttgtggcgacgatagggaagatgggagtgagccgagaggagagatgggatgacatgtggggcccacgtgtgacccaccatatttattttgctgggtagctgacatgtggacccacatgggtcccaccatttttaaataaatttttgggcagctgaca

SEQ ID NO: 106489 - DNA, 815 bp, Oryza sativa
tccgtcggatctggcgtcgctctgctcgtgagagaggaagaatatattgtcgccgctcttgctcacggtatctgctcgcgggtgaataaggaaaagataattttcaaattgattgccacctataattaatttcatttaaggtgctggttaaaaaaaatacacatatagtatttgtgctttttttttctaaaaccgacacctatagtttattaaaggtactggttatacatctttttaattcgtggagatgagaaatgttttaataggtatcgattttagaattgttggtatttatagtgttgttcattcatgatgtcctgcaatagtgatggtactagattgtaccatctggtcctagattgttatatgatagaatgaagagaatatattcttgtgacggatcctgagctactcttaatttcttaactaaacgattatacacataatttgttgtactatgaaatgtatcatccaattttatattgctatattatgggacaaagggagtatattcttgactaaactaatacaagtactatttgctagaacaatgctatacgtacgacgtgtttgtccgaccaacgtacgatcaaacggtaaaacaactccatacatggctgagtaaggtgacaacatggcttagtccaacagagattaacgtcatgaactcaggacattaagttcgttccaaagtcgaacaagtttagtcgtatatatagcattttcctacatactattgttccacccttatctagagccttgaagaacatattcaatccaatggtgagttagttgccacagttatcatccaatgg

SEQ ID NO: 106490 - DNA, 783 bp, Oryza sativa
tgaaattggtcatctcaactctgaactggttacgtccacttctttcgaactgatcactgatatcgatcggttgatggcgggaactgcaactctgcaagagatagttttgctgggtgttgtctgtctgctgtcctctttcaagggtgagagtgacagaaatctctcgtgtgctcatcagctcatgcttgctggaccagtagctacttggcaggtgcagagcacgatttgatgcgaaacagacggtcagtactgtcgatcagccaacgcagattaagaggtccactcgtcctacctaccaccggagatacgaagtgttactgttacaaaaacaacacgaggaaattagaaaatactatgcatacgatttatgtgtacgatcattgtacgattgctaacagatggtggatgtgtgttaacaaccaaatttgttaatatcttaatatcttaatatagagtaaaaacacgagattcatgtgtttcttcgttagaaacggccagaaaatgccatgggatttggctggcaaatgttgcatcgtacaagtatcgtatgcaaatactatgcatacgatttatgtgtacttttcaaattaggggttcttttagtcgatggagaaatactttagcctgggccctggagagtttaagatggaccatgaccattgttgggaaccaaggtcaagaaataaatttggggataggtttcatttccaaaaagtgaagtgaacttgagatatattgacagacacttgccaccattgtttcagtaaaaagtatcatgtctct

SEQ ID NO: 106491 - DNA, 649 bp, Oryza sativa
agtataaggagtataaatgtataaaatttgacgatctaaaagtacaaacaataatttttgtacaatttttagtgagatatgtgtgtgtatgtgtgttagttggtttacaccatgtgttcacgtagtctgtgcataatcttcaatgcgaagcctgcaatacctaccctattttatcttctttctttgaaacaattaggcatttaaacaatcatggtagtttattatgtccattgctataagatggcataagtacactgaaagtaaaagttttactcatgatgatagtttttaggtttgcaatatatgtggtttatactacatattttaccttataattaattaaacctctgtttatatgcatcgcgccgccctcggtcccggcggtgcacatgtaaaatcgtttgcttgaactaaccagaaaacaaattcactccaagttgtttggtgcttatgtatggcattatatatatctatggcctgtgtttatgagtatgcttaagtatatatatcaatcgttagtttggtctagccaacgaacaatttagcacaatacagtatgaatcgggacatattcatcttcataaagtgaaagtgtgtggatacaatataaagtgtgctcataaaaaaacctgacacgggacagcgatct

SEQ ID NO: 106492 - DNA, 593 bp, Oryza sativa
ctactttattagtaactttctgccctcgagaaattcagactggtaagattttagaccaattcctatattcctgacatctaactgatttagcaaaaaaaaaaaaaatcaccggccggcggcgaaagaagcccaggccaattttattaagatcatgagtgaagtacagtttataactgatgaagcatgatatgagcatataaatgttgctagctctcattggaaactacacatatatacacatataagaaattaataattctgtaaaattcagctgaaatagctaggcagttcaatccgtgcctatcagaagagtaactaagttcataccagatgcagttttctccagaattagcctcccacaagtacccttggagattgctcctttcctataggcagcgttggatgtgtatgccatgccagtatatatggagatgtattgcacatcaatgtcatcgtggaaggcgtggaacaagtccacgcaaacaatacaaaggcgccgggggtaaaaagtcatatatagcaaaaggccatggatgataggcagcgcatgcatgcaggtgtgtgccattgagcatatatataaagtattaggg

SEQ ID NO: 106493 - DNA, 1524 bp, Oryza sativa
tagtacaactaaaaccctaaaaatataatgcatttattcaaacaaatttttaaagaatacacactatttaactcaatagtcacatataggatctatgaatattacctgaaattggcgtctgaatccggcagggcttcgccccttcttctcttctcctcccctctcttctttttttttcactggaattgaggagagaagaatgagggctgggggctgggcagcaggccttttataggcagcgaggcctgccgcccggccagagggcggcaaggggccgcctgcaaaatagccggccccgactggcttttttgcattcgggccccttgccgccccaccagagggcggcaagggttttcctgcaaaaaaccctccctccgtcaccgcccgttcctcccccgtttgccacgtcagcttgccgccccagaggtgggcggcagggtctatttttgtaatttttttggccgatagattatttctgtaaatattttttaaaaaaaatctaaaaccgaaaaaaattcaccagatgaatgtgtaccccagctacggaaaatacaatccctctgcagtctgcaccatgcctcccatgcatgcatcaaatcgagggtgtgtttagttcacgttaaaattggaagtttaattgaaattagaatgatgtgatggaaaagttgaaagtttgtatgtgtagaaaagttttgacgtgatggaaaatttggaagtttgaagaaaaagttgggaactaagccagacccgagtctccacctaaccgaagtgctgcagtacgtactgctccaagatttgtgacccgacgtactacgacctgcaccactgttttattgcgatctgaaattctgaagactagccgtacatcgttatcgtgcgtttctcagtctaagcttgcagagcattgagttttacgcagtctggttgatcatcaatttcagaggtgcatgcatcgatgtatatgcctcaatttctcacttctgtgtgcatcaatttcgtagggtggaggactataactggcttcgtttgctttgtgtttggagctttggatctgtgggagcgtgggctgcagtcttgcagatagtaatcccaagttaatcagctcaacttgcctagttgacatctgtgcagttttgcttaggtaggcccatttaaattgggcctaaacaaaaactcacaaacacctcagctcagtattgttcatcctaccaaccgtcaatggaataagttcactttgattcccttaaaagtgaccctcaaccgtaaaaccggataggatgactccccgaactattgaaacccgtgcaatttgactctgtagcgcccgttccgtcgtggcgcctagcgggaaaattatctcttaaaaaccctaattgcgaaatttgtttcttcgcttgtcgtctagggtccgtgccatctcaagatctcaatccccgatctatcgtcaagttcaaatccgaatccaaatctttccaaatcaaattcctccgcaaaagtctattttgcctcccccggggtcgatgg

SEQ ID NO: 106494 - DNA, 1154 bp, Oryza sativa
gcgtatcatatataatgttagaacttgtcggccgtggatcctcctcatcatagcactcgtcttcttgatatgcagcagcactaccctccatctgacttacgtaataaaaatgcctatggtcaaatgtctgtacaacttgccaattttcacccagctttgtatctggcaaatagaaaaccttcgtagcatgagtggccaatatgaaacaatcattcttgtaccacaaacttccaacattgatgcttttaaaaaagccatcatctttaagtgcagtcctctttccatccagtttgaaccagtcacactcaaacaaaactacggacctctcctctaagttatagtccaactgaattatctcttttatgtttccaaaaaaatcaattaactgaccattatgtgtagcttgtgacattactccactattcagtgtcttcttgttcttgtcacggttaactgtgttaaaccgcacaccattcactatgcacgaggagtattttctaactctcaaatcaggaccgcatgccaaggagaagatatcaacatccacctcttctggatttgtactatgcttcttcaaaatctgccacatgcatacaacacacatatattagaaaaatagaagttacattatgcaatatataacttgacaatgaacactaacatggttcctaaaccaggtctgaaatccttgtcaaagcattctttcaatgttaggcaccccttgtgtctctaactcttctatgaacaaactgcagaaaaaaaaataaattagtgtgcaacacaaaggtagcatatagaagaagtctaaaagtaagtatatagaacatacttgacgtaatactcaacttgggcacagttgtttagcacaaaccacaccatttgatcaatgccattttcatcatatacatattcaggtgcagaagtaaaattaactccatgcccaaaaacatcaacaccataagcttcttcattggagaaacctttatttcttggctcccgattaaatcttgtttcaacatcgtccatgtatttagagcaaaatgtcagacactcatcagcaatataagcctcggcaattgaaccttctggtcgtgacctattcctcacatatcgcttcaaagtatatagtcgcctttcaattgggtacatccacc

SEQ ID NO: 106495 - DNA, 649 bp, Oryza sativa
tcccctgtattacgggacggagggagtactactaggtgaaaccccgcacattgctgcgggaatttagtatgataacaataaaaaaataacgtgtaagatagctagataacatcagattaagtaaattaatgtggtttatgataatttaaatttaaatagtatgtagaatggtgattcaaacgtaaaaagtaaggtggtatcactttatgaaagaagaaaagtagggagatagtttggactgtagattaatcatctaaaggctaaaaacaatcgatgtgatatgacttaattagagaaaaaaaggagaaagataatttataccatagattaattatttaagcactaagtgaggatgaaccatataagtatataggatatcataaaacataataaggatatacattaaaacattatgtgaattatgttggatgataatttaacatgtttgtatttgaaaagctcttaaattataaaaactataaagatatagtatgtttgcatgatgtttaaatgtgattattgttagtggatgatgacgtggcatcttgttagtggatgatgatgtggtatctttgcatgttaaacttaagaagttagtggggggataacttatagcaagataggattagtatagatcttaccggtgggg

SEQ ID NO: 106496 - DNA, 1043 bp, Oryza sativa
ccttaatttttttcctccatgaagcatttctcccaatataccccacacacttggccaattaatgttttgaggaatgttaagtaatctccttaagtataaggtttttgcctaataaaaaaatgtgaatccaagtttcccatgtttgatcctacccagtcccacaattccaaacccttagagtgggatccaaaaaagcaaatttggtagggatttcatattattacacttggcgagattaagtaaatcaattgaggaacttgcttttcttttgcaaattcatttgaaacttgttgaaataagagtttgaataaaaatggggtgattgggctcctaattgttgtttttcctttcaccgggcaaggcaagaacaaacagagtctcgtgaaaataaggggtaagggtaagccacccgtgccaaagattatttaaatgtaagagagagtacatatcccttgcacctgtatctttgagatatgcagcatagtagcaactcctgatcaacaagcaagtctttgtttcctttcttccttcactcgggacgagcaaaggttcaagcttgggggggggggggtttgacggtcgttatcgatcagtttcgaccgtcaatattaccaaaatagaagagaactagtgatgcttgcgttgcacaaatatgatagaataataatattctactagtattaggtctactaacattttgcagagaataacaataaagtggagaagaatcggcatcaactcaaacgataaatcaatgagacgatgtcgagaatcagacttatgcatgaatgggcctagaactcagagttgacacgtcaaactgggctaaaattcacaagtctatataaaggagcaacagaggaggccgccagccgaaaggtgggctggttgggccagcccctggttcggccgaacctcccttacctccgttggatccaggttttggttgtacggtggagatgaagccccaatgacggttggagggtattacctaccattccaaccgtcacaaccatcatagttcggctataaaaggagctcct

SEQ ID NO: 106497 - DNA, 796 bp, Oryza sativa
tataatatatgccatagataaacatatttttacttttgtataggtgaattataagccaaatatatatatatatatatatatatatatatatatattatattatattgtgtttaaactaaatgttttaaagttactgatagtcatagttataatagttatagaagtttaataatcttaatataaacgtcaagaattataaaatcggagggagtacgaataaacgattgctcttaactagttgatgaacaaattgcagaggaacatgttgggtttaagtcaggtacagctagtctacttctcgttacctttccttttgggggctaccaaattaatcacgttaattaattcccatccctcttcttaccttcttttttttttggggccaattatcatgccaatccagtccttgttagggtaaatggtggtaaagttaatagtactattaaaatagctttattattcaattctgacaacaacctactaacttggatgtaatttactacactctctccatccttttctaattgtaatgtactagtgtggtctttttgcaacgtactactgctggtctgcacgcctacagaggactgaaatacatgttctacctactcggagtaattattagtgcaatgactgctcctttaacctgtaccatacttatcatattactcctacatgcaccttcagggtaattatttttttaaaaaaaaacattacgtaccattactaatctttataaatacaaattatgaaggttctgatattaaccctacttaatcaaaaaataaaaaggtta

SEQ ID NO: 106498 - DNA, 799 bp, Oryza sativa
tgggttgattaaatgccgttggatgtgatgggggggttaggtcccgatcttccgataggtattgataaacaacgagttcgatggagtcgtgacacaactcgatccggcttccgaacgaacacgctactgagcccggcaatcgcagcaccacgtctcctctggttatcaaccgtgccaaaacccggttgacctcgccgagaaggctaatccctggatgcgaatcgaagaacacaagcaagaacaggatagattgcaaccaaattgcatatgaatgattaagcactcgaatttggggttctacaaaccgatctagcggcgaaactgttcttgacagaataatctaagcaaaacccgactctaaacgatgacggctactgaataaatgtgcttagggacgtcatagggttgccctagggcgcacacccccttgagctaagcccatgacacaattacaaggctcaaaactcaaaatcagattcggactggatgagatacgtggcttgttttgcagattcccggcagctcggtaggaattttgacatgggaccaaaaccatttgaaagtagactccataatctttccaacaagtactcatgggcctcgaaattccttctagatcagtggctaggtccgtttgaagttgatgctgtcaggaggcccgaatccgaatccaaaacgtgtacaacttgatctcttgtcttctatggaccaatagtgacgtggtgaggtagaagtagacttgaagaaggtcttggtttggtccccaatcaacttatttaatcatccatgcattagttac

SEQ ID NO: 106499 - DNA, 689 bp, Oryza sativa
  unsure (1)..(689): unsure at all n locations
tcccaaanaatagagattggaggagattgaggataaataattcccattcccaatagagatggaataaatccccttcatatcccctcaataccattgtgagagggattaaccgaacaagacgttactggggaataaactatcttaatttgcctgggatttctgcatagatcgaagcatctgaagcaacgtgttaggttaactactacatgcgctagtggcaagatttagtcatatttaggcttgtaaagagaaacatggagtactttagtgctttcgccggacgtatacgtacatttttgtcgtccggtgaccagccgtgattggtggttgtccaacaatatgaaattgtcattgtccgaaacaatctgcatccaaatatatgtaatttaatgtgtcagaattacgatttaagaaataatgaaattacgaaagccgccacagaatttgatagtcaaatggtctgcagtgcccgttcaggggactcggcaccacttccaacgttaacttccatgtgaaagactgggcccgttcgtttgggctgttcgatcggtttgggtaactctatatttagttaacagaactaaaattttcacgctgtcatatcaaatatttagacacatatatagagtattaaatataaaaaaaaaataattacatagattacgtgtaaattatgagacaaatcttaa

SEQ ID NO: 106500 - DNA, 675 bp, Oryza sativa
caccagggtcacaaccattgaatctggcatatgagcatatgtttattcagttaagatcatcatatggctttggtgggaatttatgatcgttgaggaacttttaaatttacttttttaaaaaaatgctctgaaattccaatatcacttagagtaatatcatagcaactttatttcaccaactcatatccaacaacaatctagacttggatcatgctttttgcaacccacaagtttcaagttcatggcaaagattttgtttttaactaacaaactcaaaaactatagtgaaggttaagctccaaactaagtactagatagaaataaaaacatcgcaactattcgtcatttcaactgggaaaacttaaaacattcttatcacgtatacaaaagtaaatatttttggtatttttatgttttgcaaatttttacttttttttctttttatgatgcaaatgcaaaaatgtaaagatataagttatcttggtgggggtggcactccctcaagctagcttcttcttggggtgcgtgatggggtttgaatccctgtgatcagaagtaagccatcatgtcggcctaattctgctgtatggcggtgttgatgtccaccatctagtcggtggtatgctgccgccacgaatgggtctcccagacatgctggtttaacatgtcatgcat

SEQ ID NO: 106501 - DNA, 800 bp, Oryza sativa
  unsure (1)..(800): unsure at all n locations
cccgctcgccaaagcggcttgaacaagcgccgcctccccaaggccgaatcgggcgggggggttgccccctgcccggatccgccaatgttgcggaccagcccgtcggtggcggcggggtgcccggatctagggttaaggtttcaatttttattttcccgtgcgggcgacattagaacccgcacgcgaaaatcggattttctcgtgcgggggcgccacccgcacgcgaaaatcgcgattttcctagacagcccgctccagacgggcgaatctactgcacgggataatcgaaacaaccgcacgcaaaaatagcttctgtagtagtgcggcgtgtgttggcttgtgtgtatgttgtgtcttatggctttgtggcgtgtcccttcacctcgtagggggttatatttatacccatagatgccccctttccaagtagaactagggagataaatatggatacgatcttatacccatagatgcccccttgttcaagtagaactagggagataaatatggatacgattcgattagtccttgtcgtttccatagagaactctttttgtccttccttatctggaactctttctatatacgaggtttgtttccgtataagatatgttatgtggtgggacttgccgagatttagtcaactactattaggtatgtggtatggataaccctaacacatatgttcaaagattcaatgtcacgtttttcgagataaaagtctgagaactaaaccagggaccttagagtcggcctgcaggcatgcaagcttgaggttntatatttngatntcacggccc

SEQ ID NO: 106502 - DNA, 715 bp, Oryza sativa
agagaatccattgaatcccggaaaatgctttcctcctagcctttcgtaccacgtggggtcacgtactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccatggcggcagagtatctgatagtgaagggtcagatcaagtctcctcggattatgaagatgagtctctccgacatctcggcgaggaagagatggaatcaaaagcatgcccccgttgtggagaaattggacacgttgctagcatgtgtctcacactttgccctcattgtgaggaagaccatccaccaggtggatgtcccacccgcaaggtcacatgttttctatgcgaaggtacaaaccatgtgcccaaggattgccaactcagtgtgttgttgaccaagactgcagaaatccaacgaacaaccctacgattgtctcatcagctagtcagctccaacatcaacatcgacgatatcatccccagcaccaatgctcctcctgctgcacctgactctgcagtaaatcatagcaataataccttcaacaccaaccattctctggaccgacggcctcagcaaagaattgtg

SEQ ID NO: 106503 - DNA, 710 bp, Oryza sativa
ccgatgcaaaccacgcgctacacacacaagcaaggaacacacgactaacaacactaccctatagggtggcttaggttctgcgacgggttctccaagatcttcactcctgcttcacagctggcttcactacttcctttgcttcgctagcggatcctgcagtcttccggagcttcggcaaacgactgacgacatcttcttcttcgcaaagctgaccatctagtactagttgaaaattgaagacggaagaaaagggtaaaccttttgcaaatagcattaggggaaggagaaaaagaggaactttcgcaaatagttttatttataaaatatgtccttaggtttttatcccctgggcttatcctacagtcgagatggctctgataccagcttgtcgcgaccgagaaaattaccttttcccgaatgctagtgtattaatccccgtcccaggaaaagccggggtacaccgaacaaacatgatacaaaaggcacatctttattatatcgataatatttacattattacaaaggcacttaggcctgaccatcaaaaataaacagcagcggactagcgggcctacggcttcatttcacaggcgctcaactggggtataagccaagactccacctaagacttcttctccaaagcttctcttactgaaggggggagaaagatagagcaagaatgagtacaaccacagtactcagcaagcact

SEQ ID NO: 106504 - DNA, 543 bp, Oryza sativa
aatacctctctgggcaagctttgttggacaacaattgctttgagcagttcttatcaagcctgctcattttgtgcaaatacccattcgcagaacagcaggcattagctactgactggatggtcgtcgtgaccactattctgctgccaatatccttatcagtcggaaaagccgatttgatgcttttccactgatcttctgtttgaatgtcatcgataacaatgaagtacctgcaagacgaggcagatcaagaaagaataattgtaaacatccccatctggagccacagtaatcaacaaattgaaacgaataatttgtataatttcatacggtagagcaatttagaagcagtgaattgttttttccatttttattctattatagtaaatttgtaaaagataaagcgcatgagaaatgcactgtatgcatttgatgactaaattagtgcagctaacacctagcagttagcaagatatagtatctgttcatgattcactttgctattgaaagtgtcagtcgcactgaacttgtgcaaaagaacaggcg

SEQ ID NO: 106505 - DNA, 735 bp, Oryza sativa
agggtcatctggatctagtggaccatgactattagggggccaggcctgatcatggttagaaatttcggactgaaatttctgaaaattcgctcatttcggacccctctgatatgatattattctggccgaaattttttacttttttaaatttttcatgatttaggtaatatttgttcaaatttaactaaattttgttcgaaatttcggtatatcggtgaccttcgatcaaatcagctaaaccaaaaaagtaaaccctaggctgacgtctcgcactttgttaccactagaactacggatgttgacaacaagagtagaaagaggaagtggaagctgctttggatctagacagcccagtgacaaggacggcgagcttggttgggtgatctcgaggcatcgacaacattaaggaggaggtggaaagctccactatgggaacacaatatgtgcggtagcggtggagttggagcaagaggtgaggccatggcaaagagggcaagtgcgagagggtcagtaagcagcagggtacgagcaagagagaaggtgagcagtttggtagacggggaacaaagatacgtcttccgtgaagatagacagatagaccttacaatatatcactgatattgcaaccgtcccagacgtggggccaaaacgatgatcctacttttgtgatggttcattttcctcttcaatccatatcttattttagacaagtattatatatcagttggggcagcg

SEQ ID NO: 106506 - DNA, 550 bp, Oryza sativa
taacacgttatagcttgtaaaatgcataaagaattcattataaatccaaaaattgtgaaaccaaatgtgttagtcttagaaaacacatctacacacccctgttaagtctaatctaataaaaatcactttacaaaagtattttgtagcactacctaagactatactactataaaccgacataacttataaaaattcataactcccaaatggaataagataaaatagaaattctttcacctaaattcattttagaccagtaccaacccactgtgcacaaatcatgcattttagagcattttggatttttagttctttcggtgtttaattgcataacatgtatttatctagataattgcataatcggtgaaggagtggattagttgctaacatttctctgatcaaggcaagttttctcctcccatcctttgaacacattgaatccccatgatttgaggaatggaaatgtttgattgcaaagttgcatgtgaacttagactatatcggtatttaaaattgggttaaggtaggtatgacctatttgctgcattcc

SEQ ID NO: 106507 - DNA, 802 bp, Oryza sativa
agttctcttctttctcggggataatttgatcacctggcagtctcagaagcaaaaggtcgtcgctctgttgtccagtgaagcggagtacattgcggcgacgactgctgcgtgccacagtgtgtgtggctggcgcgtctccttgttgagctcaggggagaagaagggagcgccgtcacattgaaggttgacaaccagtctgcaattctgcttagtgttaacgaccaaatttggtaatccaaggatcagagaagaagaagaaactgagatggaattcgagatggaaatcgtcccgcaaacagagtgaagatcggctgaagtccgaatcggctgtggctagatcggcagggttcgagtcggactaggttagccgattgagccgaatccgacaatatgacatagcatatgttgtcggtttaggttgatgtgcttcatgatgattgccacgcatggatagagtcctgagaaggaaattgtatctattaattatgatattttatgtaattttcttagagatatgtttgggcaaaagtctgccgcaaagacttatggtatcttagagtttgttagagataagagtcgtgtccgatatggtcatattttgtaattctagggtataaatagaccccgagccccatgtaatcaaactaacagacgttcaatacaatctcggcgcatcgccaccttttcactttcattttgtttcgacgagtttttgcttttgggttgagctgcatcggttttgatcttcaacaagagataaaacttgttatggcggcttgcgttctcagtattagtgattcca

SEQ ID NO: 106508 - DNA, 664 bp, Oryza sativa
ttcgtttcgatggatgatgatagtactagatacgaaatgggatgccggccggccaatctcaacgctggcatgcaccgcgcgcggcgaggcattgtcgaagatgaggctgatgggcgcgctggcggcgtacgtgaacaccaccggcgaccccttcacgatatgcaggccgtcgttgacgaggcagagcccgtcgttgccggcggcgtggatcttgctccggtcgacgccagccggcacgctgcacttgtgctctctccgtattttaatatatgacgccgttgactttttgacaaacatttgatctttcgtcttattcaaaaaattatgtaattataatttattttattgtgacttgatttatcatcaaatattctttaagcatgatataagtatttttatatttgcataaaaattttgaataagacgagtggtcaaacgttgattaaaaagtcaacggcgttatacattaaaatatggagggagtagtttattagtgccacttctgactactgatcaagcggaccatgttatctgtacccgataaaattaactaaatagtatgcatgcataaattagattttgcctaagcacttaccatgatcaaagttagcttttttcatttactggaggaattctataacgatattgtactgtgattgaggga

SEQ ID NO: 106509 - DNA, 724 bp, Oryza sativa
caaactgggtacatcacatatgtaatttcagatgatgtctcatctagttataaaatactatattgtgggttggaggtaactagaatactatattgtgggttgaagggagtagattaattactccatccgtcccaaaataagcgcagccatgagttttcgtgtccagctttaattgtttatcttatttatttttttaaaaaaataaaaacataagtcaagcataaaacactattcatattttataatctaatatcaatacaaattccaatctatttttttaaataagacgaacgattaaagttgaacaggaaacccagtttcctcatatatgcgtttattttgggacgaagggagtactaaaagtgtcactagtttcaatggcacctaaatcatattggactgttaaatcaatttgacactatcgaatcaattattttaatgattttattttttacatacaacttcatattcgccttgtcccctaaactttctttgctcacgtaagataaagtaggcaagggcaatgacaccactattgaattatagcctccacccagatccccagtgctcggtagggtcaacactttgggagatggggtgcatcacagcgcgaaaaaagtagaagcaaagccatctaatttgacatttatgttttctaggatcttgttattggctgcaagctttttgcttagcgcatcagtggatttagtctatgtaaaaacta

SEQ ID NO: 106510 - DNA, 586 bp, Oryza sativa
aatgtattgacccaccgggcatacataaagatcatatcgactgaatctctagtgtatacaagtatgaacccctttgcctcatgatttcgattaagctcaaggctagatatgtgccatcctctaatagctcaatcattcactcgaacctgtgatagattatataacttgtgattgactcctcaatcacctttggcatggccatgcacttccataatctataacatcgaggggcccagagatatctctccataggaaggacaaatcccatcttgattattcatatcccactacatgtttcatagcatacctgaaaactacttttataactacccaattacggagtagtgtttagcagtccctaagtaagttactacatatgttgggaaccatgacaatctcaggtctaacgattcaacaccaacactaaatgagatcactgatgacataacacatatggctcttgcagtgtcttatgttgggtctatccaacaacatgttccctaacatgtgttcacattattaatttggtatctctataccatgattcatgagacatgatcatcaattaatacatgtgctgatcatt

SEQ ID NO: 106511 - DNA, 1046 bp, Oryza sativa
cttgatagccacccccttttattattgccgaattttagttttgacaactatattagtacgacaacgaacttttgttgctattttatccaaaccttatattaatatctaaaatgaagtttacataattttattaatatttttcatcaccttcatcgtagcataagtcgttgccttcttgccatctccgctacagcattacccttatccttcactcattttccattagtgcataagttttatagcatgtgtaaatttactattttccaattttattatgtatatttatattagaatcgtacaaacctaatgatttataaagaacaatctgacatttaactacctatttgttatagtattattttttcgctgatataccaaagttagtattctgccatgtgattttcccttcttttatttgctctgtatgtcccatgtgtgagcaagccaagggaggttctggtgtggtattggtatgctggaagcctggaaagctcgagagaacgctctgtcaggttgttttactgatatgatcctacggctctctttaatttttttttttcatcatcggatggtcctgtttttttggcttacatggacctatcaggtgatgctttgggatttaaccttcacttatagagaaacggattaatggctaagcggcttctagatttgggggcctcccccccctgttttaggggtgggggtgaaatctcatcgtgatgtggatggtttggagtgagttatgcgaaggatcttatcataatcactcgcatggcaacgtgttaggcatggcacggtgatatgatggggcattgtgttctatgggtatagttgtacacctctggtcagtgtaaaactatttgaatagccatgtatgtagttacgggcgatcgaggaggttagtcgtaattagtctcactattaattaacttaacataataaattggtgtagtttagatggtttggttggacctgttcaatatggtgtagcgttattcaacggagattaatgttaacataattaattaattgttttactgtattca

SEQ ID NO: 106512 - DNA, 601 bp, Oryza sativa
ttagtttgatttagctaggaaacgtatacggtataccatcctaaatgttcaagtcttaattcaacttgaatgcaatgtcaaaacattggagagacaaatccgagatataagcaatacaagtattattcacatccaaattgattatgaaatagaaatttgatgatatatgtcactacgtacactctatgctcttcattttttttctttacaatttttcttgacacgtattgcatttgagggaaaatttaactttttgcaactcaagtggccactctccaaatgccattcttaaatttgtccctgtaatttgccacaagagagataaggctctttaactttgttcaacatacgtatatatggcatgatacgtagacgcaccaatgtggaacacgtacggaaatgaagggcatgttcactttattgccacgttcaatcctaccaattttttgtgttaccaaatttcgttaaggtaacaaattaaccatgatctttaccaatggaattctaccaaaatttgatagtttcagaacactagtgtcttgacagatttacttgacataggtacattggaattccggtgtcatgtatgaacttcacagca

SEQ ID NO: 106513 - DNA, 663 bp, Oryza sativa
  unsure (1)..(663): unsure at all n locations
cttgtacatagaaattgtttctgtggtagtggctgttgatgttcctattgtcgcgaacgtccaccaccgagcagaggtggtacatgatcaaactgcttatctttggctcatattgatttgcatattagaccgtccaccaagcatagctggtacatcaatattcattagttcagattgatttgtagtcaaaacagatatacggatatacctagaacagtcaagacgacattggtttgcacgcttctaagtctcttccttgaagtgcaaattactgaaactttggtttcaagttttctcaggatttttcctgaagtatattagtggaacacttcaacaatatctagaacagccaagatgtttttgcatctgacaggcgctgccagcaatatgaagagaaaaaaatgaatttaaatttcaattgtggtgtttggaattgtggatttgaatatggttgaattttatgtattattaatatttatgtttgaattattctcctgtgaatcaagaaataaatatgtagtatatatcaaaatagaagagaaaaagaaatagaggctaacaaatggnggttactgttgcagcttgagccataattttgggatctcgaaaaataggtgtagccccatttaacttttggggactctaaaatcaggcctattgctg

SEQ ID NO: 106514 - DNA, 1419 bp, Oryza sativa
gttattctaagggggaggtgtagaatatatatatatatatatatatatatatatatatatatatatatatatatatatatatatatatagaaagtaatgaaagggccacgtaatctgaaaaacaatggccatcggatgaatgtttggataaaagatgaccatccgatcatagatatccatgcagcaaaagaaaatacttttagcgtcttctagcgtctcccctttgacacatgaataaaagaggcacttccctccggtttcttctagcgtctcccctttgacacatggcaaggaaaaaagagtccacaacatgaaaaatacactataggatattgatttgcatggaaaatgactacactactgtttgatctcgtgctgattaattaaatttgagaagtgaaataagtaaaacaaacatacatgaattggtgttgtgtaaaaaaaataaagatattgctgtagtagtatgtaatttatgggctacttcgcagtagtaacatttaggggcaagacagcaagaccactataattgtaaaaaaaaaatttaagatctttaacaaagatgcatctcatggtcgcacaaatgcacaactttgagtggctaatatgtaatggaaacctataaaaatactgtaggatgtaaaaatagacgtataaattaaatttgtacatgtcataccaagtaaaacttttactcctaaattaaaccataagtaaaagtttcagttaggatgacgtagataaatctcaaacatccatttttcatcctacaatagataaacaaagtcaagaatgatgtcccatgcatttacacaacaattttttatctaagggtttgtgtttaagaggaggagaacagagaagatcgaaaaaaaatacacaaaacgagttgtactattacgcatgattaattgagtattttttaaaaaagatttaaaaatgaattaatacaattttttaataaaattttctatagaacttcttttgaaaaaaaatacatcatttagcagttcgaaaaacgtgcgcacgaataacaatgaagattttctcccaaatcactattgccgaacacagccatgtttttattcaaatagaagttactgaaggattttcaatttgaaattcttgtggaaaaaacttctaaattattatatttttcaatccaaattgcaattaatcttatgatgtattaattagttaatcctaaattgcatttgatatgttctttctggtttattgagaccaacattgagctgggctgcaaaggaaattaatatggaattatgaatgtgccttttttcgctatttcaataatatgatttatagtagaacgatgttaaaagaaaactagtatatatatatatatatatatgtatatgtatatgtatatgtatatgtatatatatgtatatatatatg

SEQ ID NO: 106515 - DNA, 919 bp, Oryza sativa
atctttttccagcgctgcgctgcgtaccgcttcgtctctattttgagtgctgccctgctgccgcttcgtagctgttcatcttcttccccacaagaactctgccatggctttccctgaagattgagctatctattaattttttttttgcaaaaatcagagggtaggctagagcctgatggagcctaccccttaaaatcgccactgtcaattaccgattttctgctgttctgtcggtgattttgtttccaacatgagatgcactacgatagtgcagtgatactgagtacgtggttttggtctcatgtttaatcctcaaatcgctcatgattttttttcaaagaaatatttagagaaatgtatttcccttgatcaaatcttctttttttttcaaacgtgcacggcgcgtgagacgagagaatattaggtactaccaaatagtgctatgctaccggtgctgtcaacccttaaaatacatttaaaagtcacaaaaaatatgaaaaatttctgagacgtgcaacaccataacttatagtatcacacaagaaatcaactcaaaattcgctgtaatcgtgaagaaacaaaaaagataaactcgttccgtaaatagtgctcaaacagttcacatcactattcacaacagatttgtcttttttcttcttcacgattacaacgaattttgagtttattttttatgtgatactacaagtcatggtgttgcacatctcagaattttttttcatattttttgtgacttttaaatgtatttttaaaagttggtaacaccggtagcatggtactgtttggtagcacctgatattctctccgcgtgagacagagagaaggggaagaaaaggaggactccgtgcttttaaggtaggaatatcacaaaatatatatttttagcatgcccatttaacaa

SEQ ID NO: 106516 - DNA, 540 bp, Oryza sativa
actttaaaaaaaatctgaaaccgcgccatgtgttacgtcttaaaaattagaaaaaaaaatagaaattctgagagaagtattggattattgtttttcacttaaatcatttagaaaagaaataaaccaccactacacttcaccctcccccgcacatgcacacaacacaatactaccggtccccttttctctcagcttgagctctcccttgaatgttctttatagcgagaaataataaaaaaattaaaatatacatactgctttctaatctagctatttttgtattcataattgaaccaacaatttgaagatccataatacctatatttcgaaatgatataaaataaacaagaaaaataaaatgtcaataaattgaactatttggttccaaccagaaggactaacttgatggtgcaattaggacatatttattaccaataatagttatttaggattagttgaaaaagccactaaactttcaattaaacaagacaaaacaccttacttttaatttacacttaatttgttagacacgtttttcca

SEQ ID NO: 106517 - DNA, 805 bp, Oryza sativa
tgccaaaatatatatattacaatattgttttacattgtcactttaaataacgtcatctagttacattatggcatagtagtgttccactcctgaagatccttgaattcgtcacttgccgctagggcaccctctgggtcgaagaaatctcttttgacatgacagcactcatggtggatgaagtggcacagatcacgctgcacatttgtgatacctgtatcgtcaaagcttgttcgacattctaatcttggcaactgcatgtattgaaattaatcaatatattagtatcaaaaatatcaagagctgtctagtacatagtatagagacttacatcctccgcgttagtcctgtaccgtccattaaccttaaggaattcgcacgcataatacccgcaaaggaccgttcctcgcggttgcttgtgacactgaagaacatatcatagaaaaaagtagttataatttgcaattagtgaaactattggaatatataaagtgagtggagtattaccggccaataggtacgtactagcagcttctcccgtgttcgggtctgttctccacccttgaacttgtagtattggtatgaactgtatggatgtcataccgtttcagagtaaggaggatatttatttgtaatacatccatatacaaatgcaagagtcataataacttactactgtaagatggttagaaattctttgtattgcttgtgattgtaatcgagaggatccaagactaccacggttccgtctttagggtggatgagtaaacagatataatgatcgctacatattaacaacattattatt

SEQ ID NO: 106518 - DNA, 555 bp, Oryza sativa
aaaaatatttgaatttaaatttaaatttgaatcgggtatataaaactttctacttataaactttgggtctataaactttaggtgtataaactttaggtgtatagaaatgctatatataaaaaaattgaatttaaattcaaattcaaatttgaatcgggtatataaacttttgacttataaactttgggtctataaactttaggtgtatagaaatactatatataaaaaattgaattcaaattcaaattaatatttgaattcaaattcaaatttgaatcgggtatatataaacttttgacttgtaaactttgggtctataaactttaggtgtataaactttagatgtatagaaatactatatataaaaaaatatttgaattcaaatttaaatttgaatcggatatataaacttttgacttataaactttgggcctgtaatctttaagtgtataaactttagatgtgtaaacttgaggtgtataaactttaggtgcataaattttctaaaataggaaagtaatgcggtgccaataaataaaagtggagggagagggg

SEQ ID NO: 106519 - DNA, 513 bp, Oryza sativa
cttatttttctaacccgtttgcatcatggcgttcgtaaaataatgtccttaacgaaactagaaccatcataactatttttaacgtcgttactgcggaaagtagtcgtgttactatacattagccgtcgcgttactacgccattctagtgagacgaggattaaaaagaggtaaatcccaatctttagagaacaatatctctcacatcatatcttgtttttttaatttgtttgcaccatgacgttcgtaaaaaaaagtcttaacgaaactagatccatcatgactactttttgacgttggtattgcgagaaagttgtcctgttactgcacgatgaccgtcctattactgcggaatttcttgtgagacgagaagaacaaagtgatgggcgggggagggggtggtgggcaggttttgattcgggtttgacctgcgggagggggctttgaccagcctttgactgaggtgggaggggggatttgtgccctaggaagagtgggggaggtgggattgaccc

SEQ ID NO: 106520 - DNA, 655 bp, Oryza sativa
cagtaaatggaagatcaattccaatgtccttgtttgtactatatatattagtaaatagcagagatcctttgacagcatcagcaaatagaactacaagagaagcatttagtggagcataatcttctgcttcagtagaaatgattaaactcatatcactaagcaataaaatgtcaaaggccctcttctttgctaaataaagtaaggactaaggagcactgctgcagaataacaacaaaagcatcattatgcatcctatcaagtatagagaaagttagtgacaatttaattttcaacattgatgagctgttccataattgtcaacatgtttgcaatatgcagtatccagtgattcagacgatcacacccaaactttaatttcagaagcatgtacatatcaaatataaagaactaaagagtacatttttgttttgatattgacataaactctaaaagaaactatagcaaatacttcgattatttatgacaacttaatgcaatcatgttagggtccaaaaaccaattgtaatctcattatcatctcagagaaagcactattctcaaaccaacaacaggggccagccagatgttgagtagtatcttccttcattaatctaacatatgcacaaaaagagatagaaaatgtacagctcatgtg

SEQ ID NO: 106521 - DNA, 533 bp, Oryza sativa
  unsure (1)..(533): unsure at all n locations
tccctcccctcctccccctccaccttgccgccacccgagcggccgccgcccgagaggccgccggcanagccggccggccgcaaggacggcggcggcggggcttctcgcatcctctcttccgggcgggcagggggccgccctaggcagagcggcggtgaccgctagatccggcccgctccggctggatctggtgggacggcggctggcggcggcgagggtggcggtggctgaagacggcggggatggcgacgtcgatgctaagggcgcgcgacgctgggctgcggtggctgaaggcggcggggagggcgacggcgatgctaagggcgcgcgacgctgggcggcggtggctgaaggcggcggggatggcgatggcgtcggggacagagttggccgatggcgcgaaggcggcggtggtgctcccgtggcggcgacagcgcgaaacctggcggcgacggcggcggtgccccccagatccgcccctctcagccagatctggagggtggaggcagttggcaacggcggcgacagtgtgg

SEQ ID NO: 106522 - DNA, 873 bp, Oryza sativa
aggatacggcggatcacgagtggacttacctcccctcgtcgtgatcgctttaacattttcaatggaggagtctggttgccccggaatcctcctagtttcatttgcagggactaaggatgccaactgagctaactaagtttccatcatcttattaaagctcagccggttctgaaatgcggaagcaaagccatctagtttgacatttatgttctctaagatctaatcattggcagcaagctttttgcttaccgcatcagtggttttagcttgcgcaaaaacaagatccttcaaggagggttggttacagaagttaccgttattatttcctccttgataatatggtcgtgtttggttccacccctgacctccttgtagacgatacccgttgctgttgttgcccatgtgcatcgcctcctcacaggtttccgggcagtcgttcccagaatgacccatgccgccgcagacttcatacatgacatgtgagtccaaggccttggcggtgccttgtggccgtttcttgtggtcgtccaagcatttcatgaggaggtccagcttggtagcaagtagttctgtctccttgatggtgtgcatgcctcgctgacgggtctagagtcgttcctcgctccaacccatatggagaccatcttctctatgagttcaacggctccttgaaccgttttagagaagaacgctcctccagctgttgtgtctaggtgatcgcgggacatcgaggtgagcccattgtaaaagttctgcaggatcaaccagtcgtccatcccataatgaggacaggtggccacgtactcctgcagtcgttcccatgcttccggaatggactcgtcccttgtctgctggaaactggaaattcgtcca

SEQ ID NO: 106523 - DNA, 1195 bp, Oryza sativa
tttgaattgatgcccgggcatgtacatagtattaggatgtgtcacatcttatcctaaatttattttttattggacatggaagtatgtgaataggctttaccattctactatggccttgtttagttcccacgtaaaaacatttcactatgtcacatcgaatgtttggacacatgtatgaagtattaaatatagacaaaaataaaaactaattatacagattgcgtgtaaattgcgagacgaatcttctaaacctaattgctccatgatttgacaatgtggtgctacagcaaacattttctaatgacatattaattaggcttaataaattcgtctcgcagtttacagcaaatttgtaatttgttttgttattagtatacgtttaatacttcaaacgtgtgtccgtatatccgatgtgacacactaaaacttttcacccctggatctaaacatagcctatgtatgtagacagatctgtccatatatgtagtactccctccgtccctaaatataagggattttggtttcatatgacataagtctatttagattcgttgtattagtatatgtcacatctcaccaaaatcttttatatttaggaacagagggagtattagattatatcgagttgacatgtgacagagagagtacaatagtggcattttaatgtttactctatctgtcatatatatgatacattctaataatatgaatctatatatatctctggctgtgtttagttcagcgcaaagtttgaattttggttgaaattggagatgatgtgactgaaaaattgtgtgtgtatgacaggttgatgtgatggaaaaggactgaaaatttgttatactagaatgtatcatatccgatccaaggtttttttttaatggagggagtagttcagtaattgaggccatctaaaccagagggtagggtggattgaaatcctctgccttcaaagacacaatgtctttgtcactgacagatagccccatagtttattgggcccacatgccagtgacaaaggtagtgtttagattcagggactaaaaactaattacatgaatgagagctaattcacgtgacaatttttaagcctaattaatccataattaatacatgtttactgtagcatcatatatgctaatcatggattaattaatcccaatagattcgtctcgtaaattagttcagagttatg

SEQ ID NO: 106524 - DNA, 725 bp, Oryza sativa
tagtatcagcttgtttgcgaggacccaagcgaggtcaaacggaggggggaggccgccattgaagaggctcgctctgcatcgttgccaggtacgtacgggcgcgacgaatgcttgatcttcttggttgcctaaccatcgatttttttctttgttgatttgttttggttggattgatctgtcgcttatattgcgccccccgtgtgcttgattgagctgctcgtttccatttctgctgaaatggagatgaaactgtaggaaaaaaaaaaaagcccctttctctgtgtgccgcggcgcagcgtcggcctcgccagcggcggcggcggcggcgccggccgtggcctcgcccatgctactgccctcccgcatggccgcgcctgcctacgggtcttggaacggccggcgggggcaaccaccacgcagatgccggtagcggggtagccggattcaggcccctacgtgcttgctgggctcgcacgcgtcctgctcgacgaattgccgagctgagcacagaaggaaaaaataagggagggaattttgcttgttctctagtctttctttgcgacaccgcgtttgctaaagtctgctctgattgtattacgtcctggggcagatctaacttctgtcacctctgttttttgagagctgcttctctttgatattcctgagacttatgataaggatatagcttgctgtggtatgaccggtctctttgtgcatccaaaggg

SEQ ID NO: 106525 - DNA, 674 bp, Oryza sativa
tccaaatggagtataaataatttggtacgtattaattcagattttgaattatgaaatcatcaaaaaataaagtaaagactctaaagccaattacaactaaatagcatttatttatttgaattcagtaattgttgtgtggtgaatattttggccatagaatataaggatgcatatgattttatttatattaatgtgagaattgcttacttcttctcttaatgaaggaaatgctaggtaatttctcgtctactcattcattatgtgacaaaaccaatgaacatgcaaccaataagtactaaaatgacttcttgagtttcgataaaaaaaattaatatagcacatagtgcctacaaataggacttagacttttggaaaaccaaagaatgaaataggacttagacttttggaaggagggagtaaaaaaaatgtatggagtaggataataataatgtggacacttctatatgagagcttcaaattagtatgaagaaagatttctgatacaataacaagattattaatttctatggtattatggaacgttgagagtggccttgtatatgcaagaactataaatcctcaagaagatcctagagtcttagaccaatcgtaagtcaaatgcgagatttaattttgcagaaatcttgaagagttgtttggatcccaagagaagt

SEQ ID NO: 106526 - DNA, 527 bp, Oryza sativa
aatcggatataattcaaattcaaatttgaatcgggtatgtaaactttttgacttataaactttgggtctataaactttgggtctataaactttaggtgtataaactttagatgcatagaaatactatatatagaaaatatttaaattcaaattcaaatttgaatcggatataattcaaattcaaatttgaaacaggtaaatttgaatcggatataattcaaatataaatttgtaacatgtatctaaactttagatgtgtaaacttgaggtgtataaactttaggtctataaactaactttaggtgtataaactttagatgtatagaaatactatatataaaaaatatttgaattcaaattcaaatttgaatcggatatataaacttttgacttataaactttgggtctctaaactttagatgtgtgaacttgaggtgtataaactttatgtgtataaatttactaaaataggaaagtaatacggtgccaaaaaaggaaattaggtggagggagggaggggggagagg

SEQ ID NO: 106527 - DNA, 631 bp, Oryza sativa
gatcctatctcaggtgttggtctctctattgcagcatatttcacgatggaccagcagtctatcactgctagaaaaaatatttttcaaggcggacaaaatcagtcttcctaggcggatggccggtccatctgtacaaagaggtttgcgaaaatgaagttttttcgcaggcgtgccgcctggtcacatagccacttgcgaaaatgggacaaatctgcctggaaaaatatacgcgccaaaatataacttttttctgccaattttttaatattaacttttaattaataatgttgcaattagttaagtaatacataaatacatttaaccattaacaaacatttaattcggatataatgcatatattgcttaagttaaaagtgccgtcaatacatacagtaatatttacaactaatattgtcatttcgaaatgcacgaatataatttttattatttcatcgtgttggtataatcccgaggagacttgtattaattattcactcattgctatgctgacttcacttgcggtgtatgaagtgacagagatcccgctgtatatttttaatgcttgtgtcatcaaagctagttcgacgtttgtgtcatataatattctaggtgaaaccccacgcattgctac

SEQ ID NO: 106528 - DNA, 777 bp, Oryza sativa
  unsure (1)..(777): unsure at all n locations
aagattagctccttcatgctcttatacggcgataaggctatgatgccaagtgagctaggggctaattcgccaagggtaatcttctctgggggtgaagatgggcgtgaagtctcacgcgaactcctagaaggggtgtgagtcaaagcacttgaacacatggcgaaatacggcaatgacactttggcatcctataacaagaaggttcgaccgacnnnnnnnnnnnnnnnnnnnnttgtgctaagaaagaaggcgaaccagatggtcgttggaaaactgaagtcaaagtggaaaggagcatatcttgtcaagcacagatctagaacgggttcttttcagctggcgacattggagggcgaagagctaagccactcctggaatgccgcttcgctcaggcggttctatgtgtaaaacataggtggcacccattcaccagttgtaaatatgtaaatatggtgttgtaagccttcagcacgaaaatacaaaaaaaaggaaaataaaaaaagaaaaaaaaactagatgaagggttattatccattctggaggcccgaaccagtataaaaatccctgtgtgtttcgtctcttgtgtgaatgatgtcttggaaaaaaaaaacctctaaggcaaacacctgcttaacgaaaatgacaggggtgcgaagtgaatcggtcaaagcatcgctcactgaacactaaaattacaacagctcgttttcgatcatgcatcgatcatcgcattaatcggcttacaaaaagcacttagcatttttaaacgtttgctaa

SEQ ID NO: 106529 - DNA, 872 bp, Oryza sativa
tgtccctcctccccctcccaatcccctcctcccaatctctctccatttttttcgcttttttctactcccgcgctctcctcctcttgatttttttctttttcttcgtttttctctccctcccatctctcattttttcctcctatccttttccttttttttagaaaaattaaaaataaattggtgaaatcaagacttgaactcatgatctcatggttcatggcaagctctctaaccaattcaccatgtgatgttatgtgaatagaaaatattgtttgcatgctttatatgtttgttcaaattgttattatgattcggcagcaacattatcacaaaagtgtagtaacaagatacgttactactacactgttggtagtaacaacatggtgaaatttgcagtaacagagaacatacatagtaacagtgacactatggtagtactgtttttgtagagctaaagtattttaaatctcaatctttagatagcaataacgtacacatcatgtcttatttttctaacccgtttgcatcatggcgttcgtaaaataatgtccttaacgaaactagaaccatcataactatttttaacgtcgttactgcggaaagtagtcgtgttactatacattagccgtcgcgttactacgccattctagtgagacgaggattaaaaagaggtaaatcccaatctttagagaacaatatctctcacatcatatcttgtttttttaatttgtttgcaccatgacgttcgtaaaaaaaagtcttaacgaaactagatccatcatgactactttttgacgttggtattgcgagaaagttgtcctgttactgcacgatgaccgtcctattactgcggaatttcctgtgagacgaga

SEQ ID NO: 106530 - DNA, 600 bp, Oryza sativa
ggacaactgcgcacgtcgaaggacgtggttactcaacagtgttggaaacagtagatgtattaatttaagatttttcttaggatcccccctttacatgtccgtagggggctatttataatcctattacaggttccccattagggtttaggttttacaggggaatttacatggttgcccttatgaaagggacatttacatgggtacacagtgtaatttggatatatgggcctctaatgggctaatgggcgaatgttggcctaatggcaaatgggcctgatggttcgactggccccttaggcctctttgaagttggacttgttgtgacgaagtctccttccttcggcatacacccttcgccatttactcttcgcccaaaatgcctttggtttcgtgggataccagcgcgactcttcggctttcgccgtctttgcttcatagtcttcgctatgggggcttcgcccaaatggacttgatgccttgagcttgaatcctcgctaggtacatggtttcggcaggcctggttggggggtctcacgacataccaccaacaatatatacatatatagcaaatctattctacacgcctcccttagaataact

SEQ ID NO: 106531 - DNA, 678 bp, Oryza sativa
ttccgttgataaccatttcacggtatacgggcttgcacgaatacctaatctttggtaagcccttaattgtgacaatttactcgtttgcgctttgccagtctttgaaaggaggctgaacgcattctttacgcagtggaacctgcgaagaatgtggaaatacatagcaaatcgccttaagaacaaagtcattcggaaaatttgcaagtttaaggcaagattctggcgaagatttccattccattcacataaacataaatgccatttcggctacataaaagcaaatcgccagcagcaaacaaaagctgaaccaagaaaaatttacatcaaaagaaaagaaggcctcacacctcacgatggtcttgcatatcttcgtctcttagtagttgcagtagtcggtcagggccgcggcctccttcttcgtcttttccaatttggcctttaagaccttattctctaccttcgcctatttaaaggcgtcggcgacaacctcattgtagggatacgcgcaggctatgataacataaatcaaaattttctagcacataaaccaggaaccatataagtattagatcatagatcggtaccactcgacatactgtgtccacattattaatttggtatctttataccatgatccatgagacatgatcatcaatttatacatgtgctgatcattaa

SEQ ID NO: 106532 - DNA, 618 bp, Oryza sativa
caatttccttttctacgtacgctaactcgtgattagtttggtaaatgttttacaacagtagctcgtgaatcggtctttaatttttatgagctagatcatcgaaaccgtcaaaaccgtgtgctcataacccaataattaagcatagatgaagcattaattatctttatgtgaatctagtgtttttaagcatgactaattaagtaaagttaaaataatctagccaaaacattataaagttctaagctagtccaattataataccggttagaaagaataggtgatcaacaatcaaaggggtacgtcacacgcgtgaacttagatatcgtgagtattggtagaagatatcgttagttccaaactaaatcttgtaaactttatgtacacactgttgtctggaacttcaggattgttaacaatggaaaagaattgcacttttgtcaccattattattaggagaggacacacgagaaagagacagggatcgctcccattaccatctactactaggcatcaaacacaactaatacacacagaaatattgaacgattgttaattagagctagccatggacaacgctcgagagagtgaggatgagcattgcctgtacgcgcaggagct

SEQ ID NO: 106533 - DNA, 781 bp, Oryza sativa
  unsure (1)..(781): unsure at all n locations
tgttcaaggtagcacggccgaagatggcgttgtaattatatgggatgtctgttggtatttcttaacgacattactagaaatataattctcagcaatggcacaaaaatacttctggtatattatggtcatagagttcatccgcaagagcacgatgtactattgtagcatttcacccgagagtattccaagggtatcgtatttgtttaatcccataggaagattataatagagagaaccaagctaatatttatatgttacttgtaataattatgtctaagcaggggttaagataagcatagggtagagtgacacacaaggataagactactcactctcatattaaattatctgagctaagtggaaagaaaatagaaaagaatctattcctatacttctagtatacatattatacatacatcctagctataagattaactagctaatgccctctttccgatgccctcctggtacttcgagaagccacccctgactaccaagttctttacgatagtccgtcatgaccatacaactggggctaaataaagtacaagtcttacgaaagaagaaatgagagctactagaaccatacccaaactcttccgaagacttccgaactcagacttctattctatttctactccactagcttgagaatactaaactaagcttgagagagtatgagagagcttgcttgggtgtgttttgaaatgagagagtgagggggttatatangtttgtaatgacngnttgaaaaggtcagtatacccacccaccgtcattg

SEQ ID NO: 106534 - DNA, 634 bp, Oryza sativa
  unsure (1)..(634): unsure at all n locations
cactaaatttgattagtagtatgttggcttgggaatctggatgacgacttttttgtgatgacatctcagaatgatgaatggaaaatttgagagtcataaaaaaagttaattggattcataccattacaaatatacgaaatttaaaaaataccactaatattcataatgttagctaagtgccactgaaatttagaaaaattaaaaccgtatcactccgtcctattttccatccacttttctgtcatctccgtcaatttctatccttgcaccagcccggcctgctgcctccgcacgaactcctcgtcgtcatcaccggcgccgtcgtggtcgtcctcctccagcttcatccgcagcgtggcgatcttggacgccgtgtgccgcaggccctccacgctccagtcgtcccccggcgacgcgccggcggcgagcacgcggagccgctgctcgtccacgcggtccgtgtcgtcctcccgcgacctgggtcttggactgcggtagcgccttgatattgctcggcagctcggtggccgcagcgtgccgtcccgccaccgncgncggacgcgcgtgctttaagaagagcacctgcaccaccatacggagcaggaggagctcgttctgcgccgcgtgcatgcac

SEQ ID NO: 106535 - DNA, 661 bp, Oryza sativa
agcgcaactgttcggctttcgccgtctttgcttcatagtcttcgccatgagggcttcgcccaaatggacttgacgccttgagcttgaatcctcgctggttacatggtttcggcaggcctggtcggggggtctcacgacataccgccaacaagccccacacaggcaagggtgagataggagcttcggccgagatcgtgcaaaccatgtggtatggtaggaggcgccccccctttcgaccgacgctcctgccgaaacctatattggagtcctgcagaaaatgcgtataccttgtgcgtatgtatttttacggttagtgattattcttagttttcgccttttgcaaacggcgaagccatccttatttcttcctgtgggccgcaatgaacagcgacgggcttcccttcgtgggcctagcactgtgcggctcaatgaatgggaatttaccatttcgcctacccttgtgacacgtggcagcttacgatttggtgggaaggcgaatcgacgcctgggtgggttatatattcccccccccccccgttttcaccgccgcacccccgtcattttcaccgggagctttctcttttttccgcttttactttacagggctttttgagtaatagaccattccaatgttccctttttcggcaccggccacactttt

SEQ ID NO: 106536 - DNA, 2610 bp, Oryza sativa
caaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccaggatgcaccttttggctgactcagactaggttgcggtagtttaatgatgctttcgttccagaacttctcatgattcatatctttggagtcaacctcattgaagttaccaacttcatgtcatgcgtccacactagcttgtcattactaggataccatgtttgtcatcatgagaataccatgcttgtcatttacttctaacttgccaccaactgcctcatattagctttcctggtctccgggtgctaactccttctgctattcgatgcaagggtcaaccactctaactacaagttatgcttcccaagagaaccaatttatcccacttgacatgctttgacgtcttcccgaatgactttgctgctggacttgttattgtctgatcgtgatcctgccagacctgaagcttcgttgctagaggtgattttaatctgacctctgtagactatcttcgaacatatcacttggttcataactgggaatagctcccacgaacaagcagctcggattcactttctttacattccatttacttcccattattatcttcaggttgtcctcagttagcattcaacgtattcctttacacctttaaccttgatgtgttctttcccattgggtcatctcccaacacatggcattccctggtaaccggtgcttgcactttttactccgtgtagcatctgatactgagttgaggatttcactccttgccttcatagaaacacttttacctaggtcatcttgcttacttaatgacaaggtgactgttgcggggcaattactatcaggggtcttccttgagcgatgcagagcatgtttctgtttatcaatcacctttcggcctactttttttcatgctggagaacatctttgccaatctcttttatcgatcatctttcggcttatctctaacaggtggtattctttaatgtggattgcggacgcttctggggacgatgaggtccttcggcttgctgcctttcagtgaaaccttgatgtggttcgtcaaaaagctgcactgactaccttcagggaaatacattgcctgctatctgtatctatgccactagggtttaattgccgatggtcatctttagtgcttcctcgagatggggagcatccaaattgttcttctgccatatcacctttgacctttttctgataccaggtaaactaattaccaaccatcgactattatgttctcaaatattgatgtctcctggatctccttatctgttggcaggtatatccgatcttatcaacgtagaggcatgacgagtacccttcggggtttcctccaacaatccttatcttgatctgtaaaaggcgtatccgaactcctatcctcaactactgtctcgttggctttttaacccaacacagtttaattggttttcttttccatcaacaggttggttattaactcgaggttggaacacagttcctctgacatgagaccctaggtctcctatgtcagtaaacaattatacacatgatcacatatccgcatcttccaaaagaatcctcttagaacttgtctgtattactcatttctcccttattacgcgcatacaaggcactgccgtaaacaaaaagggaaggtgcttatcatcggtacattgtatcctcaacatgaatcatccataaacatagtaagctcactgtttacagacatgaatatatttattgattacatgattgctgcaaactttcgactgcacaatgataagtagcgaactgaaaaccacaagcgtggctgctcattttgattctggagcgatatagctggcgttgttctggtgactgcatcatccttgattggttctgtgatgatgtaataggactgcctattgctatcattcacaggagaagcttccttctgattgctggttgaagcgaataacggtcttctgcttggtatcgccctcctgaggttgattgcccttcgctcggcctggagtaggtcgagaaacaacttcttccatcgacgacaattctttgctgaggctgtcggtgcagagaatggttggtgctgaaggtattagtgctatgatttgttgcagagttaggtggggcaggaggagcattggtgctgtggatgatatcgtcaatgttgctgttggagctgactagctggtgagacaatcgtagggttgttcgttggatttctgcggtcttggtcaacaacacactgagttggcaatccgtgggcacatggtttgcttcttcgcacagaaaacatgtcaccttgcgagtgggaca

SEQ ID NO: 106537 - DNA, 900 bp, Oryza sativa
ctgggacggggattaatacactagcgttcgggaaaaggcaatttttccggtcgcgacaagctggtatcagagccatctcgactggaggataagccaagtggataaaacctaaggacatattttataaatgaaactatttgcgaaagttcctttttcctcctttcccctatgctatttgcaaaatgtttactctttctttctttttcaaatttcaactagtactagatggtcagctttgcggagaagaagatgtcgtcaattgtctgccgaagctccagaaggctgtaggatccgctagtggagtggaggaagctgtgaagcacgagtgaagatcttggagaacccgtcgcagaacctaagccaccctctagggtttcgtttgtcgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtgacagtggtccaacacctgattaaccagaaccgattgcttatagagatactacagcagcatcagacgccaattttgaacccgagtcagatgcaacctcaggtgcagttggaggcagtccaagcactcacaccaccagtcagcatgccgccagcatcccgaaggacccatggtgacgtgccacatgttgactcaaaagaagcaagtatcatttg

SEQ ID NO: 106538 - DNA, 1380 bp, Oryza sativa
tcacgtggttcacacgaccccgaatgacgtccttgcaaccgttgttggggcggggaggcgcttggccttgctgacgccttggcttcggggcattatccgcaaagtgcccgggctccaagcagttgaagcacagacgctgctgaccttgagtgtcacatcctgattttcgtttcaggatttataaattatttaataaattattaatagaatttatattaaatgttctttaatttacaagtgaagtaaaaatgtgggaaataaaatttcttaaatattaagcatggatggatttaattttgtattaaattctccatggttaattatactctctggaattttctcggatttttcggagctcaattattaattttaatcatacaaagagaagttcagcaattatttaaatattaaattaatcatataatgacctaattataattgttaagtgattttcttgtttaaaatccttaaattataaattgttgtttaaaaggaattaatagaaatgattttaaaaaaaagtttaaaagagaagatctttcttttaatttgctaaatctcaacataaaaatgagctagataaaattttgttaaatactttgcttgctcctctattttctagatttttctgggaattatttgagcaagggaagtatttttaataaatgaaacaacattttacaaattattttattcaaaaaagttcaaaagtttccccttcttggtccttgggccgttttcggcccatctctccctttctctctctttcccgcgcgcggcccacgccggcccaagccgccgccgctcgcgcccgcgcccctctctctctggaggctgacaggtggggcccacctgtcaggtccatcccctacctccggccgccgccgagccgaaccctagcgccgttttgcgccatcgattccgcccaaatccgagcccgattccttcgattgattgaggggttttgttcctctcggtctcctctttcttttcccccaagaatcaaagaaattcgtgacggtttggatccgaatcgaactcgttttgttttatctctaaaaaccgagttcgttttcttcccgattcgattcctcccgtttgcggcttgatctcttcaatccgagctcatataaagcttcctcgtgtcctcctcttccgtttgccccctttcccgtgctctcccgtgccccgtagcgtcgccgccgcgtgcacgaagtccgccgccggcgccggccatcttcgggatcgtcgcgccagcgtcttcgccgtcggctttggtcgccgccaccaccgttaggtgcgccgtggtgtggagaagatccgccgccccttcgttttcggcggcgaccaccggagcgccgtcgtcgccactaacccgag

SEQ ID NO: 106539 - DNA, 692 bp, Oryza sativa
tgcacttgcatatttgctgtgtggcttgttgagtatgtcatatgctcattcttgcaataatcaatcaacctcagtcgaagaaaaaggatccagaaggagaagacgtttggcttataccccagttgagctgcctgtgggagtggagtcggagcttcgctagattttatttttccgctgcagttttcttggcgaggactaagtgcctcttaagtaagtatttattcgctttagttatggtggatttgtatattaaattgtcagtttgtgtacctcggctgattcctggacgaggattttatgcacaaataagttcggaaattactagtgaatttctgggcgtgacattgagcgtccctgcggccttggccaggctgcacagttggcgtaggaggacggggcgcacgagtcccttgttgattctgctgctgctgcggctgtgggacgtgcaccacgaattgaggtcgaggcgcggagcgagattgctgcggctggtgttgctgctgcgaggaggatccccctgggtagggattggtgtagcggaccctttggttagcaccctgttgattgcggaagttcgccaagcggcgcttgtgcgactccagcttccttgtgcttggcttccaagcggatgttcttgtccaccagacgttggaagttccggtagtccccagagactagacgaatggacagct

SEQ ID NO: 106540 - DNA, 1602 bp, Oryza sativa
ctccggccattatgcaagaagaagacaagtcactcgccttgtggtcactggagcaaacgccatacctgtgagggctcgtgttaatcataacccatagtagaaacaatggaccgatgttaagcatcttccctttttgtttaaggtagtgccttgtattcatgtaataagggagacatgtgtgataaaaacaagttctatgaggattattttggaaggtgctgatatgggatcatgcgtataaattgttactggcaaaggagacctagggtctcattccagaggaactatgttctaacctcgagttaataaccaacctgatgatgggaaagaaaatcaagcgattaaccaaagagacatttgttggaattaagagtttcagatgtgtctttttcggatcaaagacaaagacagtcagttcagcttttggcaaaacacttcaaggttttcactgaaaggcagcagaccaaaggaccacatcgtcaccaaaagcatccacaactctcggagtaaagattacttggttggcaaagttcaaaaggttattgatagaagataccagcaaaggtgtttattatcaggcaaagaagtaggtcgaaaggtgattgataaagaaatctgaaaagaatacgtcagggttgaatgtgtaaaggaatactttgaatgctaaatgatgacaacatgaagagaatagtgggaagtaaaccgaatgaaaagaaggtgaatccgagttgtctgttcgtgggagctattcccagttatgaaccaagtgatatgttcgaagatagtctatagaggtcagattaaaatcacatctaataacgaagcttcagatttggcaggataacgatcaaacaataagaagtccagcagtaaagccatttgggaagacgtcaaagcatgtcaagtgggataagttggttcggttgagaaacataattcaaaggcaaaattatcgaccctcgcatcgaatagcagaagtagctagcacccggagaccaggaaagctaatatgaggcagtttgtggcaagttagaagtaaatgacaagcatgatatccttatgatgacaagcatggtatcctagtaatgtcgagctgatctcaacgcatgacatgaagtgggtaagttgtatgagggtgactccaaagatatgaactatgcgaagttctggaactgaagcaccatcttcaagtgccgcaacccagacgaagtcagctaaaggttcaaccagggaaaagtcaggtgaagaggagattccatctgcaacaggagatcgagacaagcagaccagagtggagaagttttgctaggcaagttcgttatagaagacgcgacggaagaagtcagacaagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatacgtacaagaaaaattcgaatgtggcccggagaatttttgttaaattctccttggtctaaaaggagccctcaaa

SEQ ID NO: 106541 - DNA, 818 bp, Oryza sativa
taagctttacccactagacatgtggaagtacggtattgctttgcaacaaaaggcccgaagaccggtccttatatggccgaggtgctaccatcaaaaccatgcaccccgagcccagcctaaaaccattttggggaattttgaatagaaggagcggtgtgaagccaattccccaattaaccaacaattccagagtgtccaggtgatatgagagtttcccaagtctaaagttataaaaccacctaatgttacctaattaacttgcgaagcatctacctaaaattaaactagtggtgccatgagtggagtgtccactagttgaggttttgtttgtctagggtgaacaaggtaataataacaataacaataataataaggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgtcttcccaaacgtcggcttcgacttcgacgaagagcggatcttccgaagctgcagcgtctacacgaccaacagaaaagaaaaggcttaaacactaaataactccacataacagcagaaacaaagcacaaaaatgggttcttgacttcttaagaaaaaattagagacttgaacggtccaattccgagttcaaatggccaagatatggccatttgaagtttatatgctctttaaatggatatttgcgaatttcttcatttaaattttaattaaaaattccatttattgcgtcagccgaggg

SEQ ID NO: 106542 - DNA, 545 bp, Oryza sativa
tttgtttgtagatggccggcagcgtcacccgtcgtggtttggacatgactgacgtcgtcttggagttgcggggcatgtgcgttgtcctggggtatccacatggagtggactaccagggcaggccgctcccggagtaggagggtgacgatgcaaagcccctcgctgcttgggaggtcactgcagtgatcctcgccggctctcccgagcggacttcgctggcagtcaccacgggtggagattccttccccgccgcttgccagaacgccgctctcctcgccatcggcactcttcgccagcgctacccggacgagttgcagcactcgccctaccgctaccaccctcgtctcggaggagcccgcgactacgccaccttccgggatgctagctcggagaatgacgctaccatcgtgcacctggcgcgcatggtggaggcgtacgacgcggctcgtatcgacttccaccagatggtgcaccgtgggatggtcgagaacaacatgaagataaatgaaactacgtcaagagaacctgcagctcaagaaggacct

SEQ ID NO: 106543 - DNA, 508 bp, Oryza sativa
acggagggaggtgggccgagccggcccaagagggggaggggggaaaaaagactggggagggtttttatttttataaaagccttttaactttgtttatttctccttaattattatttgcgctctgaaaattccactaaaatttatttacacattttaggcttttaggaaatatacaaaaatcctccaagccttatttgacttttaactttgcacattttaattgttggatgctttcacaaggattttacttattctttgcataatttcgaggatgtattttagagtcgttttgggacgcgacaataatctattcctatacttctaatatacataggatacatacattctagttaaccgatatactagctaataccctctatctggatgccctcatggtacttcgagaagccacccgtgactgccgagttccttacgacaggccgtcatgaccatacaaccggggctaaataccgaagaataccctccccagggaattaacttaggatta

SEQ ID NO: 106544 - DNA, 543 bp, Oryza sativa
ttcttcatggtaaggactaagtgcctcttaagtaagtatttatcgttttagttaatttgatgatctgtatattaaattgtcagtttgtgtacctcggctgattcctgaacgaggattttatgcacaaataagttcggaaattactagtgaatttccgggcgtgacaaccatgcacccacaacccaccatttaatacattttaattaaccaacaccacagcggtggcactaatccaacatcaaactataatctgaagtctatgtattagtgtgtttcccccattgtgttgtcgcgtcccaaaacgactctaaaatacatcctcaaaattatgccgagaataattaaaatccatgtgaaagcctccaacaattaaaatgtgcaaatttaaaagtcaaataaggcttggaggatttttgtatatttcctaaaagcctaaaatgcgtaaataaattttagtggaattttcagagcacaaataataattgagaagaaataaacaaagttaaaaggttttataaaaaaaagaaaaaccctaaaagtctt

SEQ ID NO: 106545 - DNA, 793 bp, Oryza sativa
gaccgccgccaaccgcgtgcgcacggtccaccgtgtaccgtggggctaaagcgtgggccccactccccgtggacccggtccgcgcgtcccctccctcggctaacgcaataatcagttttttttaattataatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtttggagtttattagagtaaaagtctttttctttttccgttggtcgtgtagacgccgcagcttcggaagatccgctcttcgtggaagttgaagccgtcgtttgggaaagcgagcaaggcaagacacatcatcttgatcatattgaatcccattttataaaattatgttgatttaaattattgcattatcgctttatttaaattcccgcgttgtcactgttttatttagccatgcctatttatctttgttacgaccatattattattggtattggtattggtattaccttggtcaccctagattaaacaaaacctcaactagtggacactctactcatggttccactagtatgaacttaggtagatgcttcgctggttaattaggcaacattaggtggtttttacaactttagacttgggaaattctcatatcatttggacactgtggaattgttggattatgatggaatggacatacacctcttttcttttttaaaaccctaaaacc

SEQ ID NO: 106546 - DNA, 544 bp, Oryza sativa
atgtcgacaatcagacttatgtataatgggccaagaactcaaaattgacacgatgaattgggccaaaattcacaagtccgcgtatgagagcaaaagaggaggctgtctgccgaaattgggccaggtcgccccatcccatggttcggccgaacctcccgcagctccgtttgatccagggttctcctggacggctgagatggctccctaatgatggttggagggtattactgaccatttcaaccgtcacaaccgtcattgggaggctataaaagcagctctcatcctcacttcactcacacacctcaagcaagagctctctcattactctcaagtttagtttagtagtatctagctggtggaataggaatagagtagaaatcagaagtccggaagccttcgaaagagttcgggtatggctctagtagctttcctttcctcttttgtaagcgttgaacttttattagaacattcttcttcatacatttatggtattgaaatactttccaagtatatgagtacctactttacattatgttcatgttat

SEQ ID NO: 106547 - DNA, 968 bp, Oryza sativa
gtttttaccacgaacgcacccaatacactccaatatgtccaaaattcatgttttggtgccttaatgaactttttcattctggtcaaaaacatcgcacccgtggggctcaatatatgccaatattgtcattaatggcaaaaagtacccgcgcgaatcacgaagtgagtttttgccacgaacgcacccaatacactccaatatgaccaaaattcatgtttggatgatttttgaccttattccatctggtcaaaaatatcgcacccgtggggtctcaacatatggcaatattggtattaattgacaaaagtacccgcgcgaatcacgaagtgagtttttgccacgaacgcacccaatacactccaatttgtccagaaattttgttttggtgctttttgaactttttcattccggtcaaaaacatcgcacccgtggggtctcaacatatgccaatattggtattaattgacaaaagtacccgcgcgaatcacgaagtgagtttttgccacgaacgcacccaatacactctaatatgtctaaaattcatgttttggcgctttttgacctttttcattccggtcaaaaacatcgcacccgtggggctcaatacatgccaatattggcatcaattgacaaaagtacccgcgtgaatcacgaagtgagtttttgccacgaacgcacccaatagactccaatatgtccaaaattcatgtttggatgttttttgaacttattcagtccggtcaaaaacaccgcacccgtggggtctcaacatatgtcaatattggtattaattgacaaaagtacccgcgcgaatcacgaagtgagtttttgccacaaacgcacccaatacacttcaatatgttcaaaattcatgtttggtgctttttgagcttttttgttctggtcaaaaacatcgcacccgtggaggctcatatacgccaatattggcattattgacaaaattcgtc

SEQ ID NO: 106548 - DNA, 978 bp, Oryza sativa
atgtccaaaattcatgtttggatgcttttgaacatatccaatccggtcaaaaatatcgcacccgtggggtctcaatatatgccaatattggtattaattgacaaaagtacccgcgcaaatcacgaagtgagtttttgccacgaacgaacccaatacactccaatatgtccagaaaccttgttttggtgctttttgaactttttcattccggtcaaaaatatcgcacccgtggggtctcaacatatgccaatattggtattaattgacaaaagtacccgcgcgattcacgaagtgagtttttgccacgaacgcacccaatacactccaatatgtccaaaattcatgtttggatgctttttgaacttattcaatgcggtcaaaaacaccgcacccgtggggtctcaacatatgccaatattggtattaattgacaaaagtacccgcgcgaatcacgaagtgagtttttgccacgaacgcacccaatacactccaatatgtccagaaatcttgttttggtgctttttgaacttttccattccggtcaaaaatatcgcacccgtggggtctcaacatatgccaatattggtattaattgacaagagtacccgcgcgattcacgaagtgagtttttgccacgaacgcacccaatacactccaatatgtccaaaattcatgtttggatgctttttgaacttattcaatgcggtcaaaaacaccgcacccgtggggtctcaacatatgccaatattggtattaattgacaaaagtacccgcgcgaatcacgaagtgagtttttgccacgaacgcacccaatacactccaatatgtccagaaatcttgttttggtgctttttgaacttttccattccggtcaaaaatatcgcacccgtggggtctcaacatatgccaatattggtattaattgacaagagtacccgcgcgattcacgaagtgagtttttgccacgaacgcacccaa

SEQ ID NO: 106549 - DNA, 813 bp, Oryza sativa
gaggatcccctctcaacatatgccaatattggtattaattgacaagagtacccgcgtgaagcacgaagtgagtttttgccacgaacgcacccaatacactccaatatgtccaaaattcatgttttggcgctttttgaactttttcattccggtcaaaaacatcgcacccgtggggctcaatatatgccaatattggcattaattgacaaaagtacccgcgcgaagcacgaagtgagtttttgccacgaacgcacccagtacactccaatatgtccaaaattcatgttttggcgctttttgaactttttcattccggtcaaaaacatcgcacccgtggggctcaatatatgccaatattggcattaatggacaaaagtacccgcgcgaatcacgaagtgagtttttgccacgaacgcacccaatacactccaatatgtccaaaattcatgttttggtgctttttgaactttttcattccggtcaaaaacatcgcacccgtggaggctcaatatatgccaatattggtattaattgacaaaagtacccgcgcgaatcacgaagtgagtttttgccacgaacgcacccaatacactccaatatgtccagaaatcttgttttggtgctatttgaactttttcattccggtcaaaaatatcgcacccgtggggtctcaacatatgccaatattggtattaattgacaagagtacccgcgcgaatcacgaagtgagtttttgccacgaacgcacccgatacaggggatcctctaaggtcacaaatcatgttttggcgcttttgaacctttttattccgg

SEQ ID NO: 106550 - DNA, 846 bp, Oryza sativa
agtgtattgggtgcgttcgtggcaaaaactcacttcgtgattcgcgcgacgaacttttgtcaataagtgccaatagttagtatatataggccaacacgggtgcgatgtttttgaccggaatgaaaaagttcaaaaagcaccaaaatatgatttctgggcatacctgcgtgtattgggtgtgttcgtggcaaaaactcacttcgtgattcgcgcgggtacttttgtcaattaataccaatattggcatatgttgggaccccacgggtgcgatatttttgaccggattgtataagttcaaaaagcatccaaacatgaattttggacatattggagtgtattgggtgcgttcgtggcaaaaactcacttcgtgattcgcgcgggtacttttgtcaattaataccaatattggcatatattgagagcccacgggtgcgatatttttgaccggattgaataagttcaaaaagcaacaaaacaagatttctggacatattggagtgtattgggtgcgttcgtggcaaaaactcacttcgtgatttgcgcgacgaacttttgtcaattaatgccaatatttgtatgcgttcgtggcaaaaactcacttcgtgattcgcgcgggtacttttgtcagttaagaccaatattggcatatattgagaccccacgggtgcgatatttttgaccggattgaataagttcaaaaagcatccaaacatgaattttggacatgttggagtctattgggtgcgtccgtgcaaaaactcacttcgtgattcgcgcaagtacttttttcaattaataccaatattggcatatattgagacccccacgggtgcgatatttttgacc

SEQ ID NO: 106551 - DNA, 1403 bp, Oryza sativa
atcaagtctactttcaaatggatccagccacatgtccatatctgttctggagcggccgcaattgtcattttactcccgactattttctgtccatggtgctgcgtcacctcttttggcccaatgggctgtgtatccatgttgggcccattaggggcgcgtcctagggttggagcacgaccctatggtcgttcttcccctctttttatacctctagtcgccgccaagaacaggcgggttttgatgatagagttagcttcttgctaccggctcgcagcgcgcgtgttggttaaaccgcccgtctgcctgtaatcggaaccccccatattgtgtttgatagtgaaactttcatctttatctagcaatttcagtgcttgtccaacttgttcttgcttgttcttcgattgcttgcagaacgagtgccctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccaccaaccccagcgggttcgcatcacacttttgtcaataaatgccaatattggcatatattgagccccacgggtgcgatgtttttgaccggaatgaaaaagttcaaaaagcgccaaaacatgaattttggacatattggagtgtattgggtgcgttcgtggcaaaaactcacttcgtgattcgcgcgggtacttttgtcaattaataccaatattggcatatgttgagaccccacgggtgcgatatttttgaccggattgaataagttcaaaaagcatccaaacatgaattttggacatattggagtgtattgggtgcgttcgtagcaaaaactcaattcgtgattcgcgcgggtacttttgtcaattaataccaatattggcatatgttgagaccccacgggagcgatgtttttgaccggactgaatgagatcaaaaagcatccaaacataaattttggacacattggagtgtattgggtgcgttcgtggaaaaaactcaattcgtgattcacgcgccgaactttttgtaataagtgccaatatttagcatatataggcccacacgggtgcgatgtttttgacccgaatgaaaatgttgaaaagcaccaaaacatgatttgtggacatattggagtctattgggtgcgttcgtggcaaaaactcacttcgtgattcgcgcggggaacttttgtcaataaatgccatatttgcatatattgagccctcaccggtgcgatgtttttgactggatttcaaaaagtcaaaaagcaccaaacaagatttcttgacatattggagtgtattgggtgcgttcgtggcaaaa

SEQ ID NO: 106552 - DNA, 631 bp, Oryza sativa
ccccacgggtgcgatatttttgaccggattgtataagttctaaaagcattcaaacatgaattttggacatatcggagtgtattgggtgcgttcgtggcaaaaactcacttcgtgattcgcgcgggtacttttgtccattaattccaatattggcatatattgagccacacgggtacgatgtttttgactggaatgaaaaagttcaaaaagcgccaaaacatgaattttggacatattggagtgtttgggtgcgttcgtggcaaaaacccacttcgtgattcgcgcgggtacttatgtcaattaataccaatattggcatatgttgagaccccacgggtgcgatatttttgaccggattgaataagttcgaaaagcatccaaacatgaattttagacatattggagtgtattgggtgcgttcgtggcaaaaactcacttcgtgattcgcgcgggtacttttgtcaattaatgccaatattggcatatgttgagagcccacgggtgcgatgtttttaaccggattgaataagttcaaaaagcaacaaaacaagatttctggacatattggagtgtattggatgcgttcgggcaaaaactcacttcgtgattcgcgcgacgaacttttgtcaat

SEQ ID NO: 106553 - DNA, 788 bp, Oryza sativa
caatatgggcatatgtcgagaccccccgggtgcggtgtttttgaccgcattgaataagttcaaaagcatccaaacataaattttaaacatattggagtgtattgggtgcgttcgtggcaaaaactcacttcgtgaatcgcgcgggtacttttgtcaattaataccgatattggcatatgttgagaccccacgggtgcgatatttttgaccggattgaaaaagttcaaaaagcatccaaacatgaattttggacatattggagtgtattgggtgcgttcgtggcaaaaactcacttcgtgattcgcgcgggtacttttgtcaattaataccaatattggcatatgttgagaccccacgggtgcgatgtttttgaccggattgaataagttcaaaaagcatccaaacatgaattttggacatattggagtgtattgggtgcgttcgtggcaaaaactcacttcgtgattcgcgcgggtacttttgtccattaatgccaatattggcatatattgagccccacgggtgcgatgtttttgaccggaatgaaaaagttctaaaagcaccaaaacatgaattttggacatattggagtgtattgggtgcgttcgtggcaaaaactcacttcgtgattcacgcgggtacttttgtcaattaatgccaacattggcatatattgagccccacgggtgcgatgtttttggccggaatgaaaaagttcaaaaagcgccaaaacatggattttggacatattggagtgtattgggtgcgttcgtggcaaaaactcactt

SEQ ID NO: 106554 - DNA, 606 bp, Oryza sativa
tgaatatgtccaaaaagcatccaaccatgatttttgacatattgaagtgtattgggtgcgttcgtggcaaaaactcacttcgtaaatcgcgcgggtacttttgtcaattaataccaatattggcatatattgagaccccacgggtgcgatgtttttgaccggaatgaaaaagttcaaaaagcaccaaaacatgaattttggacatattggagtgtattgggtgcgttcgtggcaaaaactcacttcgtgattcgcgcgggtacttttgtcaattaatgccaatattggcatatgttgagaccccacgggtgcggtgtttttgaccgcattgaataagttcaaaaagcatcaaaacatgaattttggacatattggagtgtattgggtgcgttcgtggcaaaaactcacttcgtgattcgcgcgggtacttttgtcaattaataccaatattggcatatgttgagaccccacgggtgcgatatttttgaccggaatgaaaaagttcaaaaagcaccaaaacaagatttctggacatattggagtgtattgggtgcgttcgtggcaaaaactcacttcgtgattcgcgcgggtacttttgtcaattaa

SEQ ID NO: 106555 - DNA, 676 bp, Oryza sativa
tctcaacatatgccaatattggtattaattgacaaaagtacatgcgcgaatcacgaagtgagtttttgccacgaacgcacccaatacactccaatatgtccaaaattcatgttttggtgcttttagaactttttcattccggtcaaaaacatcgcacccgtggggctcaatatatgccaatattggcattaatggacaaaagtacccgcgcgaatcacgaagtgagtttttgccacgaacgcacccaatagactccaacatgtccaaaattcatgtttggatgctttttgaacatattcaatccggtcaaaaatatcgcacccgtggggtctcaatatatgccaatattggtattaattgacaaaagtacatgcgcgaatcacgaagtgagtttttgccacgaacgcacccaatacactccaataagtccaaaatttatgttttggcgatttttgaactttttcattccggtcaaaaacaacgcacccgtggggctaaataaaagccaatattggtattaattgagaaaagtacccgcgcgaatcacgaagtgagtttttgccacgaacgcacccaatacactccaatatgtctaaaattcatgttttggcgctttttgaactttttcattccggtcaaaaacatcgcacccgtggggctcaatacatgccaatat

SEQ ID NO: 106556 - DNA, 1120 bp, Oryza sativa
attaattgcaaatgtaccgcgcgaatcccgaagtgagttttttccacgaacgcacccaatagactccaacatgtccaaaattcatgttgggatgctttttgaacttatcaatccggtcaaaaatatcgcacccatggggtctcaatatatgccaaatttggtattattgacaaaagtacccgcgcgaatcacgaagtgagtttttgccacgaacgcatacaaatattggcattaattgacaaaagttcgtcgcgcaaatcacgaagtgagtttttgccacgaacgcacccaatacactccaatatgtccaaaattcatgtttggatgctttttgaacttattcaatccggtcaaaaacatcgcacccgtgggctctcaacatatgccaacattggcattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatatttgtattaatggacaaaaatacccgcgcgaatcacgaagtgagtttttgccacgaacgcacccaatacactccaatatgtccaaaattcatgtttggatgctttttgaacttattcaatccggtcaaaaatatcgcatccgtggggtctcaacatatgccaatattggtattaattgacaaaagtacccgcgcgaatcacgaagtgagtttttgccacgaacgcacccaatacactccaatatgtccagaaatcttgttttggtgctatttgaactttttcattccggtcaaaaatatcgcacccgtggggtctcaacatatgccaatattggtattaattgacaagagtacccgcgcgaatcacgaagtgagtttttgccacgaacgcacccgatacactccaataagtccaaaattcatgttttggcgctttttgaactttttcaatccggtcaaaaacatcgcacccgtggggctcaacatatgccaatattggcattaattgacaaaagtacccgcgcgaagcacgaagtgagtttttgccacgaacgcacccaataca

SEQ ID NO: 106557 - DNA, 687 bp, Oryza sativa
aataccaatattggcatatgttgggaccccacgggtgcgatgtttttgaccggaatgaaaaagttcaaaaagcaccaaaacaaaatttctggacaaattggagtgtattgggtgcgttcgtggcaaaaactcacttcgtgattcgcgcgggtacttttgtcaattaataccaatattggcatatgttgagaccccacgggtgcggtgtttttgaccgcattgaataagttcaaaaagcatccaaacatgaattttggacatattggagtgtattgggtgtgttcgtggaaaaaactcacttcgtgattcgcgcaggtacttttgtcaattaataccaatattggcatatattgagaccccacgggtgcgatatttttgaccggattgaataagttcaaaaagcatccaaacatgaattttagacatattggagtgtattgggtgcgttcgtggcaaaaactcacttcgtgattcgcgcgggtacttttgtccattaattccaatattggcatatattgagccctcacgggtgcgatatttttgaccggaatgaaaaagtttaaaaagcaccaaaccaagatttttgacatattggagtgtattgggtgcgttcgtggcaaaaactcacttcgtgattcgcgcgacgaacttttggtaataagtgccaatagttagcatatataggcc

SEQ ID NO: 106558 - DNA, 1413 bp, Oryza sativa
tatatgccaatattggcattaatggacaaaagtacccgcgcgaatcacgaagtgagtttttgccacgaacgcacccaatacactccaatatgtccaaaattcatgtttggatgctttttgaacttattcaatgcggtcaaaaacaccgcacccgtggggtctcaacatatgccaatattggtattaattgacaaaagtacccgcgcgaatcacgaagtgagtttttgccacgaacgcacccaatacactccaatatgtccagaaatcttgttttggtgctttttgaacttttccattccggtcaaaaatatcgcacccgtggggtctcaacatatgccaatattggtattaattgacaagagtacccgcgcgattcacgaagtgagtttttgccacgaacgcacccaatacactccaatatgtccaaaattcatgtttggatgctttttgaacttattcaatgcggtcaaaaacaccgcacccgtggggtctcaacatatgccaatattggtattaattgacaaaagtacccgcgcgaatcacgaagtgagtttttgccacgaacgcacccaatacactccaatatgtccagaaatcttgttttggtgctttttgaactttttcattccggtcaaaaacatcgcacccgtggggtctcaacatatgccaatattggtattaattgacaaaagtacccgcgcgaatcacgaagtgagtttttgccacgaacgcacccaatacactccaatatgtccaaaattcatgttttggtgctttttgaactttttcattccggtcaaaaatatcgcacccgtggggtctcaacatatgccaatattggtattaattgacaagagtacccgcgcgattcacgaagtgagtttttgccacgaacgcacccaatacactccaatatgtccaaaattcatgtttggatgctttttgaacttattcaatgcggtcaaaaacaccgcacccgtggggtctcaacatatgccaatattggtattaattgacaaaagtacccgcgcgaatcacgaagtgagtttttgccacgaacgcacccaatacactccaatatgtccagaaatcttgttttggtgctttttgaactttttcattccggtcaaaaatatcgcacccgtggggtctcaacatatgccaatattggtattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatattggtattaattgacaaaagtacccgcgcgaatcacgaagtgagtttttgccacgaacgcacccaatacactccaatatgt

SEQ ID NO: 106559 - DNA, 1134 bp, Oryza sativa
gcgcgaatcacgaagtgagtttttgccacgaacgcatccaaatattggtattaattgacaaaagttaccgcgcaaatcacgaagtgagtttttgccacgaacgcacccaatacactccaatatgtccaaaaatcatgtttggatgctttttgaacttattcaatccggtcaaaaacatcgcacccgtggggtctcaacatatgccaatattggtattaattgacaaaagtacccgcgcgaatcacgaagtgagtttttgccacgaacgcacccaatacactccaatatgtccaaaaatcatgttttggtgctttttgaacttattcaatccggtcaaaaacatcgcacccgtggggtctcaacatatgccaatattggtattaattgacaaaagtacccgcgcgaatcacgaagtgagtttttgccacgaacgcacccaatacactccaatatgtccaaaaatcatgttttggtgctttttgaactttttcattccggtcaaaaacatcgcacccgtggggtctcaacatatgccaatattggtattaattgacaaaagtacccgcgcgaatcacgaagtgagtttttgccacgaacgcacccaatacactccaataagtccaaaattcatgttttggcgctttttgaactttttcattccggtcaaaaacatcgcacccgtggggctcaatatatgccaatattggcattaattgacaaaagtacccgcgcgaagcacgaagtgagtttttgccacgaacgcacccaatacactccaatatgtccaaaattcatgttttggtgctttttgaactttttcattccggtcaaaaacatcgcacccgtggggctcaatatatgccaatattggaattaatggacaaaagtacccgcgcgaatcacgaagtgagtttttgccacgaacgcacccaatacactccaatatgtccaaaattcatgtttggatgctttttgaactttttcaatccggtcaaaaacatcgcacccgtggggtctcaatatatgccaatattggtattaattgacaaaagtacccgcgcgaatcacgaagtgagtttttgtcacgaacgcacccaatagacttcaacatgttcaatattcatgtttggatgc

SEQ ID NO: 106560 - DNA, 798 bp, Oryza sativa
attgggtgcgttcgtggcaaaactcactttatgatccgcgcgggaacttttgtcaattaatgccaatattggcatatattgagaccccacgggtgcgatatttttgaccggaatgaaaaagttcaaaaagcaccaaaacatgaattttggacatattggagtgtattgggtgcgttcgtggcaaaaactcacttcgtgattcgcgcgggtacttttgtcaattaataccaatattggcatatattgagaccccacgggtgcgatatttttgaccggaatgaaaaagttcaaaaagcaccaaaacatgaattttggacatattggagtgtattgggtgcgttcgtggcaaaaactcacttcgtgattcgcgcgggtacttttgtcaattaataccaatattggcatatgttgagccccacgggtgcgatgtttttgaccggaatgaaaaagttcaaaaagcaccaaaacatgaattttggacatattggagtgtattgggtgcgttcgtggcaaaaactcacttcgtgattcgcgcgggtacttttgtcaattaatgccaatattggcatatattgagcccccacgggtgcgatgtttttgaccggaatgaaaaagttcaaaaagcaccaaaacatgaattttggacatattggagtgtattgggtgcgttcgtggaaaaaactcacttcgtgattcgcgcgggtactttggtcaattagtgccgacctgcaggcatatattgagcccaacggtgcgatgtttttgaccggatgaaaaaattcataaagcgccaaaaca

SEQ ID NO: 106561 - DNA, 705 bp, Oryza sativa
ttcattccggtcaaaaacatcgcacccgtggggtctcaacatatgccaatattggcattaattgacaaaagtacccgcgcgaatcacgaagtgagtttttgccacgaacgcacccaatacactccaatatgtccaaaattcatgttttggtgctttttgaactttttcattccggtcaaaaacatcgcacccgtggggctcaatatatgccaatattggcattaattgacaaaagtacccgcgcgaatcacgaagtgagtttttgccacgaacgcacccactacactccaatatgtccaaaattcatgtttggatgctttttgaacttattcaatccggtcaaaaatatcgcacccgtggggtctcaacatatgccaatattggtattaattgacaaaagtacccgcgcgattcacgaagtgagtttttgccacgaacgcacccaatacactccaatatgtccaaaattcatgttttggtgctttttgaactttttcattccggtcaaaaacatcgcacccgtggggctcaatatatgccaatattggcattaatggacaaaagtacccgcgcgaatcacgaagtgagttttgcaacaaacgcacccatacactccaatatgtccaaaaattcatgtttggtgctttttgactttttcattccggtaaaaacatcgcaccctgggaggctcatatatgccaatat

SEQ ID NO: 106562 - DNA, 1270 bp, Oryza sativa
atccaaacatgaattttggacatatcggagtgtattgggtgcgttcgtggcaaaaactcacttcgtgattcgcgcaggtacttttgtcaattaataccaatattggcatatattgagaccccacgggtgcgatatttttgaccggattgaataagttcaaaaagcaacaaaacaagatttctggacatattggagtgtattgggtgcgttcgtggcaaaaactcacttcgtgatttgcgcgacgaacttttgtcaattaatgccaatatttgtatgcgttcgtggcaaaaactcacttcgtgattcgcgcgggtacttttgtcagttaataccaatattggcatatgttgagaccccacgggtgcgatatttttgaccggattgaataagttcgaaaagcatccaaacatgaattttagacatattggagtgtattgggtgcgttcgtggcaaaaactcacttcgtgattcgcgcgggtacttttgtcaataagtgctaatatttagcatatataggcccacatgggtgcgatgtttttgaccggaatgaaaaagttaaaaaagtaccaaaacacaatttctggacaaattggagtgtattggacgcgttcgtggcaaaaactcacttcgtgattcgcgcggcgaacttttatcaattaatgccaatattggcatatatagcccccatgggtgcgatgtttttgactggattcaaaaagttcaaaaagcatccaaacatgatttttgagcatattggagtgtattgggtgcgttcgtggcaaacactcacttcgtgattcgcacgacaaacttttgtcaataagtgccaatatttagcatatataggcccacacgggtgcgatgtttttgaccggaatgaaaatgttgaaaaagcaccaaaacatgatttttggacatattggagtctattggctgcattcgtggcaaaaactcatttcgtgattcgcgcggcgaacttttgtcaattaatgccaatattggcatatattgagccttcacgggtgcgatgtttttgaccggaatgaaaaagttcaaaaagcaccaaaacatgaattttggacatattggagtgtattgggtgcgttcgtggcaaaaactcacttcgtgattcgcgcgggtacttttgtcaattaataccaatattggcatatgttgagagcccacgggtgcgatgtttttgaccggattgaataagttcaaaaaggcatccaaacatgaattttggacatattggagtgtattgggtgcg

SEQ ID NO: 106563 - DNA, 661 bp, Oryza sativa
tttgtcaattaataccaatattggcatatattgagaccccacgggtgcgatatttttgaccggattgaatatgttcaaaaagcatccaaacatgaattttggacatgttggagtctattgggtgcgttcgtggtaaaaactcacttcgtgattcgcgcgggtacttttgtccattaatgccaatattggcatatattgagccccacgggtgcgatgtttttgaccggaatgaaaaagttctaaaagcaccaaaacatgaattttggacatattggagtgtattgggtgcgttcgtggcaaaaactcacttcgtgattcgcgcatgtacttttgtcaattaataccaatattggcatatgttgagaccccacgggtgcgatatttttgaccggattgaataagttcaaaaagaaccaaaacaagatttctggacatattggagtgtattgggtgcgttcgtggcaaaaactcacttcgtgaatcgcgcgggtacttttgtccattaataccgatattggcatatgttgagaccccacgggtgcgatgtttttgaccggattgaataagttcaaaaagcatccaaacatgaattttggacatattagagtgtattgggtgcgttcgtggaaaaaactcacttcgagattcgcgccggtacttt

SEQ ID NO: 106564 - DNA, 1606 bp, Oryza sativa
aaaagcatccaaccatgaattttgaacatattgaagtgtattgggtgcgttcgtagcaaaaactcacttcgtgaatcgcgcgggtactcttgtcaattaataccaatattggcatatgttgagaccccacgggtgcgatatttttgaccggaatggaaaagttcaaaaagcaccaaaacaagatttctggacatattggagtgtattgggtgcgttcgtggcaaaaactcacttcgtgattcgcgcgggtacttttgtcaattaataccaatattggcatatgttgagaccccacgggtgcggtgtttttgaccgcattgaataagttcaaaaagcatccaaacatgaattttggacatattggagtgtattgggtgcgttcgtggcaaaaactcacttcgtgaatcgcgcgggtacttttgtcaattaataccaatattggcatatgttgagaccccacgggtgcgatatttttgaccggaatgaaaaagttcaaaaagcaccaaaacaagatttctggacatattggagtgtattgggtgcgttcgtggcaaaaactcacttcgtgatttgcgcggttacttttgtcaattaataccaatatttggatgcgttcgtggcaaaaactcacttcgtgattcgcgcgggtacttttgtcaattaataccaatattggcatatattgagaccccacgggtgcgatatttttgaccggattgaatatgttcaaaaagcatccaaacatgaattttggacatgttggagtctattgggtgcgttcgtggcaaaaactcacttcgtgattcgcgcgggtacttttgtccattaatgccaatattggcatatattgagccccacgggtgcgatgtttttgaccggaatgaaaaagttctaaaagcaccaaaacatgaattttggacatattggagtgtattgggtgcgttcgtggcaaaaactcacttcgtgattcgcgcatgtacttttgtcaattaataccaatattggcatatgttgagaccccacgggtgcgatatttttgaccggattgaataagttcaaaaagcaccaaaacaagatttctggacatattggagtgtattgggtgcgttcgtggcaaaaactcacttcgtgaatcgcgcgggtacttttgtcaattaataccgatattggcatatgttgagaccccacgggtgcgatgtttttgaccggattgaataagttcaaaaagcatccaaacatgaattttcgacatattggagtgtattgggtgcgttcgtggcaaaaactcacttcgtgaatcgcgcgggtacttttgtcaattaataccgatattggcatatgttgagaccccacgggtgcgatgtttttgaccggattgaataagttcaaaaagcatccaaacatgaattttggacatattggagtgtatggggtgcgttcgtggcaaaaactcacttcgtgattcgcgcgggtacttttgtcaattaatgccaatattggcatatattgagccccacgggtgcgattgttttgaccggattgaaaaagttcaaaaagcgccgaaacatggaatttggacttattggagggttttggtgcgttcgtg

SEQ ID NO: 106565 - DNA, 1114 bp, Oryza sativa
gatttttgaacatattgagtgtatagggtgcgttcgtgcaaaaaactcacttcgtgattcgcgcgggtacttttgtcaattaataccaataatggcatatgttaagaccccacgggtgcgatgtttttgaccggattgaataagttcatagagcatccaaccatgaattttggacatattggagtgtattgggtgcgttcgtggcaaaaactcacttcgtgattcgcgcgggtacttttgtcaattaatgccaatattggcatatattgagaccccacgggtgcgatgtttttgaccggattgaaaaagttcaaaaagcgccaaaacatgaattttggacatattggagtgtattgggtgcgttcgtggcaaaaactcacttcgtgaatcgcgcgggtacttttgtcaattaataccaatattggcatatattgagaccccacgggtgcgatatttttgaccggattgaataagttcaaaaagcatcaaaacatgaattttggacatattggagtgtattgggtgcgttcgtggcaaaaactcacttcgtgattcgcgcgggtacttttgtcaattaataccaatattggcatatattgagccccacgggtgcgatgtttttgaccggaatgaaaaagttcaaaaagcaccaaaacatgaattttggacatattggagtgtattgggtgcgttcgtggcaaaaactcacttcgtgattcgcgcgggtacttttgtcaattaataccaatattggcatatattgagccccacgggtgcgatgtttttgaccggaatgaaaaagttcaaaaagcaccaaaacatgaattttggacatattggagtgtatagggtgcgttcgtggcaaaaactcacttcgtgaatcgcgcgggtacttttgtcaattaataccaatattggcatatgttgagaccccacgggtgcgatgtttttgaccggattgaataagttcaaaaagcatccaaacatgaattttggtcatattggagtgtattgggtgcgttcgtggcaaaaactcacttcgtgattcgcgcgggtacttttgtccattaatgccaatattggcaggggatcctctagagtcgacctcaggcat

SEQ ID NO: 106566 - DNA, 645 bp, Oryza sativa
tgaactttttcattccggtcaaaaacatcgcacccgtggggctcaatacatgccaatattggcattaattgacaaaagtacccgcgtgaatcacgaagtgagtttttgccacgaacgcacccaatagactccaatatgtccaaaattcatgtttggatattttttgaacttattcaatccggtcaaaaacatcgcaaccgtggggtctcaacatatgccaatattggtattaattgacaaaagtacccgcgcgaatcacgaagtgagtttttgccacaaacgcacccaatacactccaatatgtccaaaattcatgttttggtgctttttgagctttttcgttctggtcaaaaacatcgcacccgtggaggctcaatatacgccaatattggcattaattgacaaaagttcgtcgcgcgaatcacgaagtgagtttttgccacgaacgcacccaatacacttcaatatgtccagaaatcttgttttgttgctttttgaacttattcaatccgggtaaaaacatcgcacccgtgggctcttaacatatgccaatattggcattaattgacaaaagtacccgcgcgattacgaagtgagtttttgccacgaacgcacccaatacactccatatgtctaaaattcatg

SEQ ID NO: 106567 - DNA, 2383 bp, Oryza sativa
tgctttttgaacttattcaatccggtcaaaaacaccgcacccgtggggtctcaacatatgccaatattggtattaattgacaaaagtacccgcgcgaatcacgaagtgagtttttgccacgaacgcacccaatacactccaatatgtccagaaatcttgttttggtgctatttgaactttttcattccggtcaaaaatatcgcacccgtggggtctcaacatatgccaatattggtattaattgacaagagtacccgcgcgaatcacgaagtgagtttttgccacgaacgcacccgatacactccaataagtccaaaattcatgttttggcgcttttcgaactttttcattccggtcaaaaacatcgcacccgtggggctcaatatatgccaatattggcattaattgacaaaagtacccgcgcgaagcacgaagtgagtttttgccacgaacgcacccagtacactccaatatgtccaaaattcatgttttggtgctttttgaactttttcattccggtcaaaaacatcgcacccgtggaggctcaatatatgccaatattggaattaatggacaaaagtacccgcgcgaatcacgaagtgagtttttgccacgaacgtacccaatacactccaatatgtccaaaattcatgtttggatgctttttgaactttttcattccggtcaaaaacatcgcacccgtggatgctcaatatatgccaatattggaattaatggacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaatatatgccaatattggtattaattgacaaaagtacctgcgcgaatcacgaagtgagtttttgccacgaacgctcccaatagactccaacatgtccaaaattcatgtttggatgctttttgaacttattcaatccggtcaaaaatatcgcacccgtggggtctcaatatatgccaaaattggtattaattgacaaaagtacccgcgcgaatcacgaagtgagtttttgccacgaacgcatacaaatattggcattaactgacaaaagttcgtcgcgcaaatcacgaagtgagtttttgccacgaacgcacccaatacactccaatatgtccagaaatcttgttttgttgctttttgaacttattcaatccggtcaaaaacatcgcacccgtggggtctcaacatatgccaatatttgtattaattgacaaaagtacccgcgcgaatcacgaagtgagttttttccacgaacgcacccaatagactccaacatgtccaaaattcatgtttggatgctttttgaacttattcaatccggtcaaaaatatcgcacccatggggtctcaatatatgccaaaattggtattaattgacaaaagtacccgcgcgaatcacgaagtgagtttttgccacgaacgcatacaaatattggcattaattgacaaaagttcgtcgcgcaaatcacgaagtgagtttttgccacgaacgcacccaatacactccaatatgtccaaaattcatgtttggatgctttttgaacttattcaatccggtcaaaaacatcgcacccgtgggctctcaacatatgccaacattggcattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatattggtattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatattggtattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatattggtattaattgacaaaagtacccgcgcgaatcacgaagtgagtttttgccacgaacgcacccaatacactccaatatgtccaaaaatcatgttttggcgctttttgaactttttcattcccgtcaaaaacatcgcacccgtgggggctcaatatatgccaatattggtattattggacaagagttcccgcgcgaat

SEQ ID NO: 106568 - DNA, 832 bp, Oryza sativa
caaaaacaccgcaccaatggggttcaacatatgccaacattggcattaattgacaaaagtacccgcgcgaatcacgaagtgagtttttgccacgaacgcacccaatacactccaatatgtccaaaattcatgttttggtgctttttgaacttttccattccggtcaaaaatatcgcacccgtggggtctcaacatatgccaatattggtattaattgacaaaagtacccgcgcgaatcacgaagtgagtttttgccacgaacgcacccaatacactccaatatgtccaaaattcatgtttggatgctttttgaacttattcaatccggtcaaaaacatcgcacccgtggggtctcaacatatgccaatattggtattaattgacaaaagtacccgcgcgaatcacgaagtgagtttttgccacgaacgcacccaatacactccaatatgtccagaaatcttgttttggtgctttttgaactttttcattccggtcaaaaacatcgcacccgtggggtctcaacatatgccaatattggtattaattgacaaaagtacccgcgcgaatcacgaagtgagtttttgccacgaacgcacccaatacactccaatatgtccaaaattcatgttttggcgctttttgaactttttcattccggtcaaaaacatcgcacccgtggggctcaatatatgccaatattggcattaattgacaaaagtacccgcgcgaatcacgaagtgagtttttgccacgaacgcacccaatacactccaatatgtccagaaatcttgtttaaaaactttttgaacttattcaatccggttaaaaacat

SEQ ID NO: 106569 - DNA, 983 bp, Oryza sativa
caatccggtcaaaatatgcaccgtgggtctcaacatatgccaatatcggtataattgccaaaagtaccgcgcgattcacaaagtgagtttttgccacgaacgcacccaatacactccaatatgtccaaaattcaagttttggcgctttttgaactttttcattccggtcaaaaacatcgcacccgtggggctcaatatatgccaatattggcattaatggacaaaagtacccgcgcgaatcacgaagtgagtttttgccacgaacgcacccaatacactccaatatgtccaaaattcatgtttggatgcttttcgaacttactcaatccggtcaaaaatatcgcacccgtggggtctcaacatatgccaatattggtactaattgacaagagtacccgcgcgattcacgaagtgagtttttgccacgaacgcacccaatacactccaatatgtccaaaattcatgtttggatgctttttgaacttattcaatccggtcaaaaatatcgcacccgtggggtctcaacatatgccaatattggtattaattgacaaaagtacccgcgcgagtcacgaagtgagtttttgccacgaacgcacccaatacactccaatatgtccaaaattcatgtttggatgctttttgaacttattcaatccggtcaaaaacatcgcacccgtggggtctcaacatatgccaatattggtattaattgacaaaagtacccgcgcgattcacgaagtgagtttttgccacgaacgcaccctatacactccaatatgtccaaaattcatgttttggtgctttttgaactttttcattccggtcaaaaacatcgcacccgtgggggctcaacatatgccaatattggtattaattgacaaaagtacccgcgcgaatcacgtagtgagtttttgccacgaacgcacccaatacactccaatatgtctaaaaagcttgttttggtgctttttgaacttttt

SEQ ID NO: 106570 - DNA, 1105 bp, Oryza sativa
  unsure (1)..(1105): unsure at all n locations
tccccgcaatgaataagttccaagagcatccaaacatganttttggacatattgaagtgtattgcgtgcgttcgaacaaaaactcacttggtgatcgcgcgggtactctgtcaaataataccaaatattggcatatgttgagaccccacgggtgcgatatttttgaccgaaatgaaaagttcaaaaagcaccaaaacaagatttctgaacatattgaagtgtatggggtgggcgttcggacaaaaactcacttcgtgattcgcgcgggtacttttgtcaattaatacaaatattggcatatgttagcacccccggggtccggtgtttttgaccatttgaataagttcaaaaagcatccaaacataaattttgcacatattggagtgtattgggtgcgttcgtgacaaaaactcatttcgtgaatcgcgcgggtacttttgtcaattaataccaatattggcatatgttgagaccccacgggtgcgatatttttgaccggaatgaaaaagtttaaaaagcaccaaaacaagatttctggacatattggagtgtattgggtgcgttcgtggcaaaaactcacttcgtgatttgcgcggttacttttgtcaattaataccaatatttggatgcgttcgtggcaaaaactcacttcgtgattcgcgcgggtacttttgtcaattaataccaatattggcatatattgagaccccacgggtgcgatatttttgaccggattgaatatgctcaaaaagcatccaaacatgaattttggacatattggagtgtattgggtgcgttcgtggcaaaaactcacttcgtgattcgcgcgggtacttttgtcaattaatgccaatattggcatatattgagccccacgggtgcgatgtttttggccggaatgaaaaagttcaaaaagcgccaaaacttgaattttggacatattggagtgtattgggtgcgttcgtggcaaaaactcacttcgtgaatcgcgcgggtacttttgtcaattaataccgatattggcatatgttgagaccccacgggtgcaatatttttgaccggattgaataagttcaaaaagcatccaaacatgaattttggacat

SEQ ID NO: 106571 - DNA, 725 bp, Oryza sativa
aaaagcatccaaacatgaattttagacatattggagtgtattgggtgcgttcgtggcaaaaactcacttcgtgattcgcgcgggtacttttgtcaataagtgctaatatttagcatatataggcccacatgggtgcgatgtttttgaccggaatgaaaaagttaaaaaagtaccaaaacacaatttctggacaaattggagtgtattggacgcgttcgtggcaaaaactcacttcgtgattcgcgcggcgaacttttatcaattaatgccaatattggcatatatagcccccatgggtgcgatgtttttgactggattcaaaaagttcaaaaagcatccaaacatgatttttgagcatattggagtgtattgggtgcgttcgtggcaaacactcactttgtgattcgcacgacaaacttttgtcaataagtgccaatatttagcatatataggcccacacgggtgcgatgtttttgaccggaatgaaaatgttgtaaaagcaccaaaacatgatttttggacatattggagtctattggctgcattcggggcaaaaactcattttgtgattcgcgcggcgaacttttgtcaattaatgccaatattggcatatattgagccttcacgggtgcgatgtttttgaccggaatgaaaaagttcaaaaagcaccaaaacatgaattttggacatattggagtggatttgggtgcgttcgtggaaaaact

SEQ ID NO: 106572 - DNA, 750 bp, Oryza sativa
tgtcaattaataccaatattggcatatgttgagaccccacgggtgcgatatttttgaccggaatgaaaaagttcaaaaagcaccaaaacatgaattttggacatattggagtgtattgggtgcgttcgtggcaaaaactcacttcgtgattcgcgcgggtacttttgtcaattaataccaatattggcatatgttgagaccccacgggtgcgatgtttttgaccggattgaataagttcaaaaagcatccaaacatgaattttggacatattggagtgtattgggtgcgttcgtggcaaaaactcacttcgtgattcgcgcgggtacttttgtcaattaataccaatattggcatatgttgagaccccacgggtgcgatatttttgaccggattgaataagttcaaaaagcatccaaacatgaattttggacatattggagtgtattgggtgcgttcgtagcaaaaactcacttcgtgattcgcgcgggtacttttgtcaattaataccaatattggcatatgttgagaccccaccggtgcgatatttttgaccggatggaaaagtcaaaaagcacccaaacatgaattttggacatattagtattgggtgcgttcgtggcaaaaactcacttcttgaattgcgcgggtacttttgtcattaataccaatatggcatatgttgagaccccacgggtgcgatgtttttgaccgccttgaataatttcaaaaggcatcgaacaagaattttg

SEQ ID NO: 106573 - DNA, 1213 bp, Oryza sativa
caaaaacatcgcacccgtggaggctcaatatatgccaatattggcattaattgacaaaagtacccgcgcgaatcacgaagtgaatttttgccacgaacacacccaatacactccaatatgtccagaaatcatgttttggtgctttttgaactttttcattccggtcaaaaacatcgcacccgtggaggctcaatatatgccaatattggaattaatggacaaaagtacccgcgcgaatcacgaagtgagtttttgccacgaacgcacccaatacactccgatatgtccaaaattcatgtttggatgctttttgaacttattcaatccggtcaaaaatatcgcacccgtggggtcccaacatatgccaatattggtattaattgacaatagtacccgcgcgaatcacgaagtgagtttttgccacgaacgcacccaacagactccaatatgtccaaaattcatgtttggatgctttttgaacatattcaatccggtcaaaaacatcgcacccatggggtctcaacatatgccaatattggtattaattgacaaatgtacccgcgcgaatcataaagtgagtttttgccacgaacgcacccaatacactccaatatgtccaaaattcatgatttggtgctttttgaactttttcattccggtcaaaaacatcgcacccgtgggggctcaatatatgccaatattgacattaattgacgaaagttcccgcgcgaaacacgaagtgagtttttgccacgaacgcacccaatacactccaatatgtccagaaatcatgttttggtgctttttcaacattttcattccggtcaaaaacatcgcacccgtgtgggcctatatgtgctaaatattggcacttattgacaaaagttcgtcgtgcgaatcacgaagtgagtttttgccacgaacgcacccaatacactctaatatgtccaaaaatcatgtttggatgctttttgaactttttgaatccagtcaaaaacatcgcacccgtggggctcaatatatgccaatattggcattaattgataaaagttcgccgcgcgaatcacgaagtgagtttttgccacaaacgcacccaatagactccaatatgtccaaaattcatgtttggatgctttttgaacttattcaatccggtcaaaaacatcgcacccgtgggttctaacatatgccaatattgtattaatgacaaaag

SEQ ID NO: 106574 - DNA, 1707 bp, Oryza sativa
tagcagaaatcttgttttggtgctttttgaacttttccattccggtcaaaaatatcgcacccgtggggtctcaacatatgccaatattggtattaattgacaagagtacccgcgcgattcacgaagtgagttttttccacgaacacacccaatacactccaatatgtccaaaattcatgtttggatgctttttgaacttattcaatgcggtcaaaaacaccgcacccgtggggtctcaacatatgccaatattggtattaattgacaaaagtacccgcgcgaatcacgaagtgagtttttgccacgaacgcacccaatacactccaatttgtccagaaattttgttttggtgctttttgaactttttcattccggtcaaaaacatcgcacccgtggggtcccaacatatgccaatattggtattaattgacaaaagtacccgcgcgaatcacgaagtgagtttttgccacgaacgcacccaatacactctaatatgtctaaaattcatgttttggcgctttttgaactttttcattccggtcaaaaacatcgcacccgtggggctcaatacatgccaatattggcattaattgacaaaagtacccgcgtgaatcacgaagtgagtttttgccacgaacgcacccaatagactccaatatgtccaaaattcatgtttggatattttttgaacttattcaatccggtcaaaaacatcgcaaccgtggggtctcaacatatgccaatattggtattaattgacaaaagtacccgcgcgaatcacgaagtgagtttttgccacaaacgcacccaatacactccaatatgtccaaaattcatgttttggtgctttttgagctttttcgttctggtcaaaaacatcgcacccgtggaggctcaatatacgccaatattggcattaattgacaaaagttcgtcgcgcgaatcacgaagtgagtttttgccacgaacgcacccaatacactccaatatgtccagaaatcttgttttgttgctttttgaacttattcaatccggttaaaaacatcgcacccgtgggctctcaacatatgccaatattggcattaattgacaaaagtacccgcgcgaatcacgaagtgagtttttgccacgaacgcacccaatacactccaatatgtccaaaattcatgtttggatgctttttgaacttattcaatccggtcaaaaacatcgcacccgtggggtctcgacatatgccaatatcggtattaattgacaaaagtacccgcgcgattcacgaagtgagtttttgccacgaacgcacccaatacactccaatatgtccaaaattcaagttttggcgctttttgaactttttcattccggtcaaaaacattgtacccgtgggctctcaacatatgccaatattggcattaattgacaaaagtacccgcgcgaatcacgaagtgagtttttgccacgaacgcacccaatacactccaatatgtccaaaatttttgttttggtgctttttgaactttttcaatccggtcaaaaatatcgcacccgtggggtctcaacatatgccaatattggtattaattgacaaaagtacccgcgcgaatcacgaagtgagtttttgccacgaacgcacccaatacactctaatatgtctaaaattcatgttttggcgctttttgaactttttcattccagtcaaaaacatcg

SEQ ID NO: 106575 - DNA, 1343 bp, Oryza sativa
cattccggtcaaaaacatcgcacccgtggaggctcaatatatgccaatattggcattaattgacaaaagtacccgtgcgattcacgaagtgagttattgccacgaacgcacccaatacactccaatatgtccaaaattcaagttttggcgctttttgaactttttcattccggtcaaaaacatcgcacccgtggggtctcaacatatgccaatattggtattaattgacaaaagtacccgcgcgaatcacgaagtgagtttttgccacgaacgcacccaatacactccaatatgtccaaaattcatgttttggtgctttttgagctttttcattccggtcaaaaacatcgcacccgtggaggctcaatatacgccaatattggcattaattgacaaaagttcgtcgcgcgaatacactccaatatgtccagaaatcttgttttggtgctttttgaacttattcaatccggtcaaaaatatcgcacccgtgggctctcaacatatgccaatattggcattaattgacaaaagtacccgcgcgaatcacgaagtgagtttttaccacgaacgcacccaatacactccaatatgtccaaaattcatgtttggatgctttttgaacttattcaatccggtcaaaaacatcgcacccgtgggctctcaacatatgccaatattggtattaattgacaaaagtacccgcgcgaatcacgatgtgagtttttgccacgaacgcacccaatacactccaatatgtccaaaattcatgtttcggcgctttttgaactttttcattccggtcaaaaacatcgcacccgtggggtctcaacatatgccaatattggcattaattgacaaaagtacccgcgcgaatcacgaagtgagtttttgccacgaacgcacccaatacactccaatatgtccaaaattcatgtttgggtgctttttgaactttttcattccggtcaaaaacatcgcacccgtgggggctcaatatatgccaatattggtattaattgacaaaagtacccgcgcgaatcacgaagtgagtttttgccacgaacgcacccaatacactccaatatgtccaaaattcatgtttggatgctttttgaactttttcattccggtcaaaaatatcgcacccgtggagtctcaacatatgccaatagggatcctctagagtcaaaagtacccgcgcgattcacgaagtgagtttttgccacgaacggcacccaatccactccaatatgtcgaaaattcatgtttggatgctttttgaatttattcaatccggtcaaaaacatcgcaggggatcttctagagtcgacctgcaggcatgc

SEQ ID NO: 106576 - DNA, 1453 bp, Oryza sativa
acactccaatatgtacaaaattcatgtttgggtgcttttagaactttttcattccggtcaaaaaacatcgcaccggtggggctcaatatatgccaatattggcattaatggacaaaagtacccgcgcgaatcacgaagtgtgtttttgccacgaacgcacccaatagactccaacatgtccaaaattcatgtttggatgctttttgaacatattcaatccggtcaaaaatatcgcacccgtggggtctcaatatatgccaatattggtattaattgacaaaagtacccgcgcgaatcacgaagtgagtttttgccacgaacgcatccaaatattggtattaattgacaaaagtacccgcgcaaatcacgaagtgagtttttgccacgaacgcacccaatacactccaatatgtccagaaatcttgttttggtgctttttgaactttttcattccggtcaaaaatatcgcacccgtggggtctcaacatatgccaatattggtattaattgacaaaagtacccgcgcgattcacgaagtgagtttttgccacgaacgcacccaatacactccaatatgtccaaaattcatgtttggatgctttttgaacttattcaatgcggtcaaaaacaccgcacccgtggggtctcaacatatgccaatattggtattaattgacaaaagtacccgcgcgaatcacgaagtgagtttttgccacgaacgcacccaatacactctaatatgtccaaaatccatgtttggatgcttttttaacttattcaatccggtcaaaaacatcgcacccatggggtctcaaaatatgccaatatcggtattaatggacaaaagtacccgcgcgaatcacgaagtgagtttttgccacgaacgcatccaatgcactccaatatgtccaaaattcatgtttggatgctttttgaacttattcaatccggtcaaaaatttcgcacacgtggggtctcaacatatgccaatattggtattaattgacaaaagtacccgcgcgaatcacgaagtgagtttttgccacgtacgcacccaatacactccaatatgtccaaaattcatgttttggtgctttttgaactttttcattccggtcaaaaatatcgcacccctggggtctcaacatatgccaatattggtattaattgacaaaagtacccgcgcgaatcacgaagtgagtttttgccacgaacgcacccaatacactccaataagtccaaaatttatgttttggcgatttttgcactttttcattccggtcaaaaacatcgcacccgtggggctcaatatatgccaatattggcattaattgacaaaagtacccgcgcgaagcacgaagtgagtttttgccacgaacgcacccaatacactccaatatgtccaaaattcatgtttggatgctttttgaacttattcaatgcggtcaaaaac

SEQ ID NO: 106577 - DNA, 594 bp, Oryza sativa
atatgccataattggtattaattgacaaaaagtacccgcgcgaatcacaaagtgagtttttgccacgaacgcacccaatacactccaatatgtccaaaattcatgtttgaatgctttttgaacttattcaatccggtcaaaaatatcgcacccgtggggtctcaacatatgccaatatcggtattaattgacaaaagtacccgcgcgattcacgaagtgagtttttgccacgaacgcacccaatacactccaatatgtccaaaattcatgttttggcgctttttgaactttttcattccggtcaaaaacatcgcacccgtggggctcaatatatgccaatattggcattaattgacaaaagtacccgcgcgaatcacgaagtgagtttttgccacgaacgcacccaatacactccaatatgtccaaaattcatgttttggtgctttttgaactttttcattccggtcaaaaacatcgcacccgtggggctcaatatatgccaatattggtattaattgacaaaagtacccgcgcgaatcacgaagtgagtttttgccacgaacgcacccaatacactccaatatgtccagaaat

SEQ ID NO: 106578 - DNA, 560 bp, Oryza sativa
tccggtcaaaaacatcgcacccgtggggctcaatatatgccaatattggcattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatatcggtattaattgacaaaagtacccgcgcgattcacgaagtgagtttttgccacgaacgcacccaatacactccaatatgtccaaaattcatgttttggtgctttttgaactttttcattccggtcaaaaacatcgcacccgtggggctcaatatatgccaatattggcattaattgacaaaagtacccgcgcgaatcacgaagtgagtttttgccacgaacgcacccaatacacttcaatatgtccaaaattcatgttttgatgcttttagaactttttcattccggtcaaaaatatctcaccccccgggggcttaatatatgccaatattggattaattgacaaaagt

SEQ ID NO: 106579 - DNA, 678 bp, Oryza sativa
cccgtggggtctcaacatatgccaatattggtattaattgacaaaagtacccgcgcgattcacgaagtgagtttttgccacgaacgcacccaatacactccaatatgtccaaaattcatgtttggatgctttttgaacttattcaatgcggtcaaaaacaccgcacccgtggggtctcaacatatgccaatattggtattaattgacaaaagtacccgcgcgaatcacgaagtgagtttttgccacgaacgcacccaatacactccaatatgtccaaaaatcttgttttggtgctttttgaactttttcattccggtcaaaaatatcgcacccgtggggtctcaacatatgccaatattggtattaattgacaagagtacccgcgcgattcacgaagtgagtttttgccacgaacgcacccaatacactccaatatgtccaaaattcatgtttggatgctttttgaacttattcaatgcggtcaaaaacaccgcacccgtggggtctcaacatatgccaatattggtattaattgacaaaagtacccgcgcgaatacgaagtgagtttttgccacgaacgcacccaatacactcaatatgtcagaaatctttgttttgtgctttttgaactttttcatttcgggcaaaaacatcgcacccgtgaggtctcaacatatg

SEQ ID NO: 106580 - DNA, 1384 bp, Oryza sativa
attgacaaaaatttcccgcgcgaatacgaagtgagtttttgccacgaacgcacccaatacactccaatatgtccaaaaatcttattttggtgctatttgaactttttcattccggttaaaaacattgcaccctcgtatgccaatattggcattaattgacaaaagttcgtcgcgcgaatcacgaagtgagttttttgccaacactaattgacaaaagttcgccgcacgaatcacgaagtgagtttttgccacgaacgcacccaatacactccaatatgtctaaaaatcacgtttggatgctttttgaagtttttcaatccggtcaaaaacatcgcacccgtggggactcaaaatatgccaatattgacattaattgacaaaagttcgccgcgcgaatcgcgaagtgagtttttgccacgaacgcacccaatacactccaacatgtccaaaaatcatgttttggtgctttttgaactttttcattccggtcaaaaaacatcgcacccgtgggggctcaggatatgctaaaattggcattaattgacaaaagttcgtcgtgcgaatcacgaagtgagtttttgccacgaacacacccaatacactccaatatgtccaaaattcatgtttggatgctttttgaacttattcaacttattcaatccggtcaaaaacatcgcacccgtggggctcaatatatgccaatattggcattaattgacaaaagtacccgcgcgaatcacgaagtgagtttttgccacgaacgcacccaattaactccaatatgtccaaaattcatgtttggatgctttttgaacttattcaatccggtcaaaaatatcgcacccgtggggtctcaacatatgccaatattggaattaatggacaaaagtacccgcgcgaatcacgaagtgagtttttgccacgaacgcacccaatacactccaatatgtccagaaatcttgttttggtgctttttgaactttttgaatccagtcaaaaacatcgcacccgtggaggctcaatatatgccaatattggcattaattgacaaaagttcaccgcgcgaatcacgaagtgagtttttgccacgaacgcacccaatagactccaatatgtccacaaatcatgttttggtgctttttcaacattttcattccggtcaaaaacatcgcacccgtgtgggcctatatatgctaaatattggcacttattgacaaaagttcggcgcgtgaatcacgaattgagttttttccacgaacgcacccaatacactccaatgtgtccaaaatttatgtttggatgctttttgatctcattcagtccggtcaaaaacatcgctcccgtggggtctcaacatatgccaatattggtattaattgacaaa

SEQ ID NO: 106581 - DNA, 851 bp, Oryza sativa
attaattgacaaaagtacccgcgcgaatcaacaaagtgggttttttgcccgaacgcacccaatacactccaatatgtccaaaattcatgttttggcgctttttgaactttttcattccggtcaaaaacatcgcacccgtggggctcaatatatgccaatattggcacttattgacaaaagttcgccgcgcgaatcacgaagtgagtttttgccacgaacgcacccaatagactccaatatgtccaaaattcatgtttggatgctttttgaacatattcaatccggtcaaaaacatcgcacccatggggtctcaacatatgccaatattggtattaattgacaaaagtacccgcgcgaatcataaagtgagtttttgccacgaacgcacccaatacactccaatatgtccaaaattcatgatttggtgctttttgaactttttcattccggtcaaaaacatcgcacccgtgggggctcaatatatgccaatattgacattaattgacaaaagttcccgcgcgaatcacgaaatgagtttttgccacgaacgcacccaatagactccaatatgtccaaaaatcatgttttggtgctttttcaacattttcattgcggtcaaaaacatcgcacccgtgtgggcccatatatgctaaatattggcacttattgacaaaagttcgtcgcgcgaatcacgaagtgagtttttgccacgaacacacccaatacactccaatatgtccaaaagtcatgtttggatcggctttttgaacttattcaatccggtcaaaaatatcgcacccgtggggtctcaatatatgccaatatggtattaattgacaaaagtacccgcg

SEQ ID NO: 106582 - DNA, 693 bp, Oryza sativa
aactttttcatccggtcaaaaaacatggcaccggtggggctctcaacataatgcaaaaattgcatttaatgacaaaagtaccggcgcgaatcacgaagtaagtttttgccacgaacgcacccaatacactccaatatgtccaaaattcatgtttggatgctttttgaactattcaatcctggtcaaaaatatcgcacccgtggggtctcaacaaatgccaatattggtattaattgacaaaagtacccgtgcgaatcacgaagtgagtttttgccacgaacgcacccaatacactccaatatgtccaaaattcatgtttgaatgctttttgaacttattcaatccggtcaaaaatatcgtacccgtggggtctcaacatatgccaatatttgtattaattgacaaaagtacccgcgcgaatcatgaagtgagttttttccacaaacgcacccaatagactccaacatgtccaaaattcatgtttggatgctttttgaacttattcaatccggtcaaaaatatcgcacccgtggggtctcaatatatgccaaaattggtattaattgacaaaagtacccgcgcgaatcacgaagtgagtttttgccacgaacgcatacaaatattggcattaattgacaaaagttcgtcgcgcaaatcatgaagtgagtttttgccacgaacgcacccaataca

SEQ ID NO: 106583 - DNA, 710 bp, Oryza sativa
aatattggcattaatgacaaaaggacccgcgcgaatcacaaaatgagtttttgccacgaacgcacccaatacactccaatatgtccaaaattttgtttggatgctttttaaacttatccaatccggtcaaaaacatcgcacccgtggggtctcaacatatgccaatatcggtattaatggacaaaagtacccgcgcgaatcacgaagtgagtttttgccacgagcgcacccaatacactccaatatgtccaaaattcatgtttggatgctttttgaactttttcaatccggtcaaaaatatcgcacccgtggggtctcaacatatgccaatatcggtattaattgacaaaagtacccgcgcgattcacgaagtgagtttttgccacgaacgcacccaatacactccaatatgtccaaaattcatgtttggatgctttttgaacttattcaatgcggtcaaaaacaccgcacccatggggtctcaacatatgccaatattggtattaattgacaaaagtacccgcgcgaatcacgaagtgagtttttgccacgaacgcacccaatacactccaatatgtccagaaatcttgttttggtgctttttgaacttttccattccggtcaaaaatatcgcacccgtggggtctcaacatatgccaatattggtattaattgacaagagtacccgcgcgattcacgaagtgagtttt

SEQ ID NO: 106584 - DNA, 910 bp, Oryza sativa
tatgccaatatcggtattaattgacaaaagtacccgcgcgaatcacggagtgagtttttgccacgaacgcacccaatacactccaatatgtcgaaaattcatgtttggatgctttttgaacttattcaatccggtcaaaaacatcgcacccgtggggtctcaacatatgccaatatcggtattaattgacaaaagtacccgcgcgattcacgaagtgagtttttgccacgaacgcacccaatacactccaatatgtccagaaatcttgttttggtgctttttgaacttattcaatccggtcaaaaatatcgcacccgtggggtctcaacatatgccaatattggtattaattgacaaaagtacatgcgcgaatcacgaagtgagtttttgccacgaacgcacctaatacactccaatatgtccaaaattcatgttttggtgcttttagaactttttcattccggtcaaaaacatcgcacccgtggggctcaatatatgccaatattggcattaatggacaaaagtacccgcgcgaatcacgaagtgagtttttgccacgaacgcacccaatagactccaacatgtccaaaattcatgtttggatgctttttgaacatattcaatccggtcaaaaatatcgcacccgtggggtctcaatatatgccaatattggtattaattgacaaaagtacccgcgcgaatcacgaagtgagtttttgccacgaacgcatccaaatattggtattaattgacaaaagtaaccgcgcaaatcacgaagtgagtttttgccacgaacgcacccaatacactccaatatgtccaaaattcttgtttggatgctttttgaactttttcaattccggccaaaaacatcgcacccgtggggtctcaacatatgccaatatcggtt

SEQ ID NO: 106585 - DNA, 706 bp, Oryza sativa
cccgtggggtctcaacatatgccaatatcggtattaattgacaaaagtacccgcgcgaatcacgaagtgagtttttggcacgaacgcacccaatactcaatatgtccaaaattcatgttttgatgctttttgaacttattcgatccggtcaaaaatatcgcacccgtggggtctcaacatatgccaatattggtattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatattggtattaattgacaaaagtacccgcgcgaatcacgaagtgagtttttgccacgaacgcacccaatacactccaatatgtccaaaattcatgttttggtgctttttgaactttttcattccggtcaaaaacatcgcacccgtgggggctcaatatatgccaatattggcattaattgacaaaagtacccgcgcgaatcacgaagtgagtttttgccacgaacgcacccaatacactccaatatgtccaaaattcatgttttggcgctttttgaactttttcattccggtcaaaaacatcgcacccgtgggggctcaatatatgccaatattggtattaattgacaaaagta

SEQ ID NO: 106586 - DNA, 1515 bp, Oryza sativa
  unsure (1)..(1515): unsure at all n locations
aaattcatgtttggcgnctttttgaacttttccatccgagcaaaaacatcgcacccgtgggctaagtatatgcaataatggcattaattgccaaagtacccgcgtaagcaacaagtgagttttacccacgaacgcacccaatacactccaatatgtcaaaattcatgtttggtgctttaaaactttttcattccggccaaaaccatcgcacccgtggggatcaatatatgccaatattggcattaattgacaaaagtacccgcgcgaatcacgaagtgagtttttgccacgaacgcacccaatacactccaatatgtccaaaattcatgttttgggtgctttttgaactttttcattccggtcaaaaacatcgcacccgtggaggctcaatatatgccaatattggcattaattgacaaaagttcgtcgcgcgaatcacgaagtgagtttttgccacgaacgcacccaatacactccaatatgtccagaaatcatgttttggtgctttttgaactttttcattccggtcaaaaacatcgcacccgtggaggctcaatatatgccaatattggcattaattgacaaaagttcgccgcgcgaatcacgaagtgagtttttgccacgaacgcacccaatagactccaatatgtccacaaatcatgttttggtgctttttcaacattttcattccggtcaaaaacatcgcacccgtgtgggcctatatatgctaaatattggcacttattgacaaaagttcggcgcgcgaatcacgaattgagtttttgccacgaacgcacccaatacactccaatatgtccaaaatttatgtttggatgctttttgatctcattcagtccagtcaaaaacatcgctcccgtggggtctcaacatatgccaatattggtattaattgacaaaagtacccgcgcgaatcacgaagtgagtttttgccacgaacgcacccaatacactccaatatgtccaaaattcatgttttgatgctttttgaactttttcaatccggtcaaaaatatcgcacccgtggggctcaatatatgccaatattggaattaattgacaaaagtacccgcgcgaatcacgaagtgagtttttgtcacgaacgcacccaatacactccaatatgtcgaaaattcatgttttgatgctttttgaactttttcattccggtcaaaaacatcgcacccgtggggctcaatatatgccaatattggtattaattgacaaaagtacccgcgcgaatcacgaagtgagtttttgcacgaacgcacccaatacactccaatatgtcaaaaatcatgtttggatgctttttgaacttattcaatccggtcaaaaatatcgcacccgtggggtctcaacatatgccaatattggcattaattgacaaaagtacccgcgcgaatcacgaagtgagtttttgccacgaacgcacccaatacactccaatatgtccaaaattcatgttttggtgctttttgaactttttcattccgg

SEQ ID NO: 106587 - DNA, 684 bp, Oryza sativa
cgaattgagtttttccacgaacgcacccaatacactccaatatgtccaaatttcatgtttgaatgctttttgatctcattcagtccagtcaaaaacatcgctcccgtggggtctcaacatatgccaatattggtattaattgacaaaagtacccgcgcgaatcacgaagtgagtttttgccacgaacgcacccaatacactccaatatgtccaaaattcatgttttggcgctttttgaactttttcaatccggtcaaaaacatcgcacccgtggggctcaatatatgccaatattggaattaatggacaaaagtacccgcgcgaatcacgaagtgagtttttgtcacgaacgcacccaatacactccaatatgtccaaaattcatgttttggtgctttttgaactttttcattccggtcaaaaacatcgcacccgtggggtctcaatatatgccaatattggtattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatattggtattaattgacaaaagtacccgcgcgaatcacgaagtgagtttttgccacgaacgca

SEQ ID NO: 106588 - DNA, 681 bp, Oryza sativa
agaccccacgggtgcgatatttttgaccggaatggaaaagttcaaaaagcaccaaaacaagatttctggacaaattggagtgtattgggtgcgttcgtggcaaaaactcacttcgtgattcgcgcgggtacttttgtcaattaataccaatattggcatatgttgagacaccacgggtgcggtgtttttgaccgcattgaataagttcaaaaagcatccaaacatgaattttggacatattggagtgtattgggtgcgttcgtggcaaaaactcacttcgtgcttcgcgcgggtacttttgtcaattaatgccaatattggcatatattgagccccacgggtgcgatgtttttgaccggaatgaaaaagtgcaaaaatcgccaaaacataaattttggacttattggagtgtattgggtgcgttcgtggcaaaaactcacttcgtgattcgcgcgggtacttttgtcaattaataccaatattggcatatgttgagaccccaggggtgcgatatttttgaccggaatgaaaaagttcaaaaagcaccaaaacatgaattttggacatattggagtgtattgggtgcgtacgtggaaaaactcacttggggattcgcgcgggtacttttgtcattaataccaatatggcatatgttgagaccccacgtgtgcgaaatttttg

SEQ ID NO: 106589 - DNA, 730 bp, Oryza sativa
gagtgtattgggtgcgttcgtggcaaaaactcacttcgtgattcgcgcgggtacttttgtcaattaataccaattttggcatatattgagaccccacgggtgcgatatttttgaccggattgaataagttcaaaaagcatccaaacatgaattttggacatgttggagtctattgggtgcgttcgtggaaaaaactcacttcgtgattcgcgcgggtacttttgtcaattaatacaaatattggcatatgttgagccccacgggtgcgatatttttgaccggattgaataagttcaaaaagcatccaaacatgaattttggacatattggagtgtattgggtgcgttcgtggcaaaaactcacttcgtgattcgcgcgggtacttttgtcaattaataccaatattggcatttgttgagaccccacgggtgcgatatttttgaccggattgaataagttcaaaaagcatccaaacatgaattttggacatattggagtgtattgggtgcgttcgtggcaaaaactcacttcgtgattcgcgcgggtacttttgtcagttaataccaatattggcatatgttgagaccccacgggtgcgatatttttgaccggattgaataagttcaaaaagcattcaaacatgaattttggacatattggagtgtattgggtgcgttcgtggcaaaaactcacttcgtgattcgcgcgggtacttttgtcaataatacca

SEQ ID NO: 106590 - DNA, 1086 bp, Oryza sativa
tcacttcgtgactcgcccgggtactcttgtcaattaataccaatattggcatatgttaagaccccacgggtgcgatatttttgaccggaatgaaaaagttcaaatggcatccaaccaagatttttgaacatattgaagtgtattgggtgcgttcgtggcaaaacctcacttcgtgattcgcgcgggtactcttgtcaattagtaccaatattggcatatgttgagaccccacgggtgcgatgtttttgaccggattgagtaagttcgaaaagcatccaaacatgaattttggacatattggagtgtattgggtgcgttcgtggcaaaaactcacttcgtgattcgcgcgggtacttttgtccattaatgccaatattggcatatattgagccccacgggtgcgatgtttttgaccggaatgaaaaagttcaaaaagcgccaaaacttgaattttggacatattggagtgtattgggtgcgttcgtggcaaaaactcacttcgtgaatcgcgcgggtacttttgtcaattaataccgatattggcatatgttgagaccccacgggtgcgatatttttgaccggattgaataagttcaaaaagcatccaaacatgaattttggacatatcggagtgtattgggtgcgttcgtggcaaaaactcacttcgtgattcgcgcgggtacttttgtcaattaataccaatattggcatatgttgagaccccacgggtgcgatatttttgaccagatggaataagttcaaaaatcatccaaacatgaattttggtcatattggagtgtattgggtgcgttcgtggcaaaaactcacttcgtgattcgcgcgggtacttttgtccattaatgccaatattggcatgtattgagccccacgggtgcgatgtttttgaccggaatgaaaaagttcaaaaagcgccaaaacatgaattttagacatattggagtgtattgggtgcgttcgtggcaaaaactcacttcgtgattcgcgcgggtacttttgtcaattaataccaataatggatatgttgagacctcacgggtgcgatgtttttgaccggaatgaaaaagt

SEQ ID NO: 106591 - DNA, 1101 bp, Oryza sativa
tattgggtgcgttcgtggcaaaaactcactttgtgattcgcgcgggtacttttgtcaattaatgccaatgttggcatatgttgagagcccacgggtgcgatgtttttgaccggattgaataagttcaaaaagcaacaaaacaagatttctggacatattggagtgtattgggtgcgttcgtggcaaaaactcacttcgtgattcgcgcgggtacttttgtcaattaataccaattttggcatatattgagaccccacgggtgcgatatttttgaccggattgaataagttcaaaaagcatccaaacatgaattttggacatgttggagtctattgggtgcgttcgtggaaaaaactcacttcgtgattcgcgcgggtacttttgtcaattaatacaaatattggcatatgttgagccccacgggtgcgatatttttgaccggattgaataagttcaaaaagcatccaaacatgaattttggacatattggagtgtattgggtgcgttcgtggcaaaaactcacttcgtgattcgcgcgggtacttttgtcaattaataccaatattggcatatgttgagaccccacgggtgcgatgtttttgaccggattgaataagttcaaaaagcatcaaaacatgatttctggacatattggagtgtattgggtgcgttcgtggcaaaaactcacttcgtgatttgcgcgacgaacttttgtcagttaatgccaatatttgtatgcgttcgtggcaaaaactcacttcgtgattcgcgcgggtacttttgtcaattaataccaattttggcatatattgagaccccacgggtgcgatatttttgaccggattgaataagttcaaaaagcatccaaacatgaattttagacatgttggagtgtattgggtgcgttcgtggcaaaaactcacttcgtgattcgcgcaggtacttttgtcaattaataccaatattggcatatattgagaccccacgggtgcgatatttttaaccggattgaataagttcaaaaagcaacaaaacaagatttctggacatattggagtgtattgggtgcgttcgtggggggatcctctagagtcgacctgc

SEQ ID NO: 106592 - DNA, 750 bp, Oryza sativa
gtgcgttcgtggcaaaaactcacttcgtgattcgcacgggtacttttgtcaattaatgccaatgttggcatatgttgagagcccacgggtgcgatgtttttgaccggattgaatagtttaaaaagcaacaaaacaagatttctggacatattggagtgtattgggtgcgttcgtggcaaaaactcacttcgtgatttgcgcgacgaacttttgtcaattaatgccaatatttgtatgcgttcgtggcaaaaactcacttcgtgattcgcgcgggtacttttgtcagttaataccaatattggcatatgttgagaccccacgggtgcgatatttttgaccggattgaataagttcgaaaagcatccaaacatgaattttagacatattggagtgtattgggtgcgttcgtggcaaaaactcacttcgtgattcgcgcgggtacttttgtcaattaatgccaatattggcatatgttgagagcccacgggtgcgatgtttttaaccggattgaataagttcaaaaagcaacaaaacaagatttctggacatattggagtgtattgggtgcgttcgtggcaaaaactcacttcgtgattcgcgcgacgaacttttgtcaattaatgccaatattggcgtatattgagcctccacgggtgcgatgtttttgaccagaacgaaaaagctcaaaaagcaccaaaacatgaattttggacatattggagtgtattgggtgcgtttgtggcaaaaact

SEQ ID NO: 106593 - DNA, 1068 bp, Oryza sativa
aaaattttgttttggggctttttgaaatttttcatccgggcaaaaacatcgcacccgtggggtctcaacatatgccaatattggtattaattgacaaaagtacccgcgcgaatcacaaagtgagtttttgcccgaacggcacccaatacactctaatatgtctaaaattcatgttttggcgctttttgacctttttcattccggtcaaaaacaccgcacccgtggggctcaatacatgccaatattggcattaattgacaaaagtacccgcgtgaatcacgaagtgagtttttgccacgaacgcacccaatacactccaatatgtccaaaattcatgttttggtgctttttgagctttttcgttctggtcaaaaacatcgcacccgtggaggctcaatatacgccaatattggcattaattgacaaaagttcgtcgcgcgaatcacgaagtgagtttttgccacgaacgcacccaatacactccaatatgtccagaaatcttgttttgttgctttttgaacttattcaatccggttaaaaacatcgcacccgtgggctctcaacttatgccaatattggcattaattgacaaaagtacccgcgcgaatcacgaagtgagtttttgccacgaacgcacccaatacactccaatatgtccaaaattcatgtttcgatgctttttgaacttattcaatccggtcaaaaacatcgcacccgtggggtctcgacatatgccaatatcggtattaattgacaaaagtacccgcgcgattcacgaagtgagtttttgccacgaacgcacccaatacactccaatatgtccaaaattcaagttttggcgctttttgaactttttcattccggtcaaaaacattgtacccgtgggctctcaacatatgccaatattggcattaattgacaaaagtacccgcgcgaatcacgaagtgagtttttgccacgaacgcacccaatacactccaaattggccagaaattttggtttggtgctttttgaacttttttattccgggcaaaaacatcctcacccgtggggtctcaacatatgcca

SEQ ID NO: 106594 - DNA, 566 bp, Oryza sativa
attggcatatattgagcgccacgggtgcgatgtttttgaccggaatgaaaaagttcaaaaagcgccaaaacatgaattttggacttattggagtgtatcgggtgcgttcgtggtaaaaactcactttgtgattcgcgcgggtactcttgtcaattaataccaatattggcatatgtcgagaccccacgggtgcgatatttttgaccggaatgaaaaagttcaaatagcaccaaaacaagatttctggacatattggagtgtattgggtgcgttcgtggcaaaaactcacttcgtgattcgcgcgggtacatttgtcaattaataccaatattggcatatgttgagaccccacgggtgcgatatttttgaccggattgaataagttcaaaaagcatccaaacatgaattttggacataatggaaagtgtattgggtgcgttcgggcaaaaactcacttcgtgattcgcgcgggtacttttgtcagttaataccaatattggcatatgttgagaccccacgggtgcgatatttttgaccggattgaataagttcaaaaagcatacaaa

SEQ ID NO: 106595 - DNA, 787 bp, Oryza sativa
catattggagtgtattgggtgcgttcgtggcaaaaactcacttcgtgattcgcgcgacgaacttttgtcaattaatgccaatattggcgtatattgagcctccacgggtgcgatgtttttgaccagaacgaaaaagctcaaaaagcaccaaaacatgaattttggacatattggagtgtattgggtgcgtttgtggcaaaaactcacttcgtgattcgcgcgggtacttttgtcaattaataccaatattgacatatgttgagaccccacgggtgcggtgtttttgaccggactgaataagttcaaaaaacatccaaacatgaattttggacatattggagtctattgggtgcgttcgtggcaaaaactcacttcgtgattcacgcgggtacttttgtcaattaatgccaatattggcatgtattgagccccacgggtgcgatgtttttgaccggaatgaaaaagttcaaaaagcgccaaaacatgaattttagacatattggagtgtattgggtgcgttcgtggcaaaaactcacttcgtgattcgcgcgggtacttttgtcaattaataccaatattggcatatgttgagaccccacgggtgcgatgtttttgaccggaatgaaaaagttcaaaaagcaccaaaacaagatttctggacatattggagtgtattgggtgcgttcgtggcaaaaactcacttcgtgattcgcgcgggtacttttgtcaattaatgccaatattggcatatgttgagccccacgggtgcggtgtttttgaccgcatt

SEQ ID NO: 106596 - DNA, 1790 bp, Oryza sativa
  unsure (1)..(1790): unsure at all n locations
tttttggcaccgccgggagccttgatggccattcttttcatcataggtctccttcgtcaagtcgtcgaaatctgttcgcaatcatctacgagcacggcattcttgagtgtcaacgcgaaaaatcaaggtgtgtaccgatccacgccgacgccgcgaagttttctttttcatttacttttctttttttttttgctatttccgacgtcgttcaaatatgagtacagcttgcggggtgtggtggtcgtttatagtaagggaagaagaccttttccgtgtctgtgtctagagttttgattggtattttagacgaatttaatttggcggcatgtttggcccattaactttgtaaaatttggtcatcatcagtgttttttttttggtagaaaggtttgtttggattggaacaaaacgaatttggagttaaatttgtcaatttaagttagggcttgtttagatctcctggtaaaattttatacctatcacatcgaatgtatagacacatgtatgaagtatttaaatataaaaaatagctaattacccaaattgcgtataaattgtaaaacaaatttttaaacctaattgtgccatattttttaagccttagcttgtttgcttggtaccaaaatttcttgcctagggccgagtttagttccaaacttttttttcaaacttctaacttttccatcacatcaaaactttcctacacacaaacttctaacttttccatcacattgtttcaatttcaaccaaacttctaattttggtgtgaactaaacacaccctagattggcaccgttagtgctaaactaagccaagccaaaatatgaaaataatagtaataattgtttaagatatcattgtagtatccaatatacatgtttgtctttcttgttattttcaaataaaaattattgaatatagctacatgtacatgagagtagttttcactacaacacccatggcataaatgctggtcgcagaaccttgggtgtgacaagttgcggcaaccaaaccagatactcttggtttcatgtgggttcatgatgccagcatccacttcatgaatcaaattcaatgtgaatagtagtagtttataacaattgctcatcagtacgagcaaacgtgtaattctatgtacatatgaaagattgtgtcaaatactcaaatatgatatatgatatgatgattagagagtgaaaataattttattttgctttttgggttttcttataatctcgtgtatatacctaatattatgaaaataatctagtgtacttccttcaaaattaggatggaaaccacttgtccactacaacaactaacactaaagcaacggtaagtttaactttagggcttaattagattgatgccatttcaaaccatatcattttttggtagagttaacaaacatgtgcatctatttaattttttgccaaactgtactaaatacataagaaatcctgccaaaattttggcaatatgacatattttggtattgtcaaaatttagtaaagtttattttagttataatctgaacagccctcaacatccagttgaactcagaatttgtaactgattaagcgcacacaaaacgtaccaccaaaattctactagtacatttcacacctaacgggcaataatgcaaccagtgcctcctcgttgccaacccaaatctccctgacagaacacgccttgaactcacctaatgatgccttctaaagtcaaatttacaactcaatggaatccacagctgatgngtnntgcagtaggagaactcaccaaaggccacg

SEQ ID NO: 106597 - DNA, 997 bp, Oryza sativa
  unsure (1)..(997): unsure at all n locations
gcgtgcggtagacgnctctgtcggagcncaccatgcagctggctacagatctgtagcccactgctcttctctctcatcttttatctcattaaaatatgtttacagctagctaatagcctgctattggacctgctcttaggcttccttcgttcccaggtgatctgggagattgagagagaaaacatcttgttttccgcgcgcacgctttccaaactactaaacggtgtgctttttgcaaaaaaattctataggaaagttgctttaaaaaatcatattaatccatttttaaaatttaaaatagttaatactcaactaatcatacgctaatggctcacctcgttttgcgtatcttcccaatctcctcaatccccttcttctcaaacacacccttaggctgcgttcgttcacaggagacaggggagattgcgactccttttccatgcgcacgcttttaaaactactaaacggtgcatttttttttgcaaaaatcttctatagaaaagttgctttaaaaaatcatattaatctatttttgaagtttaaaatagttaatacttaattaatcatatgctaatggctcacctcgttttacgtatcttcccaatcttctcaatcctctcttcctcaaacacagcctatctttaaaaatgtttatgttttgaaatgaggtagtagaaaggtcagcagcagtgcacccggaagaggaagcttccatggcggatgtagtatagtgtgaaaaaacgtaagcatggccacgtgatgggtaagtagaaacgcggcatgcggcagctggtcaatgcattccacgtctttcagggtcaaattcaaataatccatttttttaaaaattaccccctttcgaacatgaacgatcaactccaaattagatccaaattaattaacacataaacgtacgccatcaggtagaagaattaatctcgctccaaattataagcatccgtacgcagttattttccatatctcctgctcatgaaaa

SEQ ID NO: 106598 - DNA, 3797 bp, Oryza sativa
aacgagagaagagagaaacaacattaaatacacttagtgaggatgaactatataaatatataggatactcctacatttactatggctaattatgatgttgttgccactactagaaaaatcatttattgccacgaaagaaatcgtggcatcaatactaaaattgtggtaatagatacatgttgccacaattgtaaaatcgttgctagccgtggtaataaacaacgtggtaataggttattgcaacgatttttattttgtggtaataaatttagatgttgccacggaatggatgtggcaaaaagtcatattgcaacacttcacagcgttgtaataaaaattattgccaccactccatatgtggcattagttttacgtaccaaattaaaagtttaaatattaatctatcatcctatctatttgtatacttatttttttgattttgtgtcttggctaagattcaaacccaaacctatccttcacgcgtgctctcctttaccaactcatctacgtatcaattttgttggaaaatgcatatcgttccatttgagcctagctaaatgagatttgaatcatagatttgaatatctaaaagatttcaaatgaaaaagttatcacctataaaattgtagatctcgtcgagagctataatttccatataaaatttgtctcaatccgtgtccatatgaaaaaattaagttaaattatgagacgacaatctttttattgcaacgaatttgttgatcgtggcaacaaaaaatagtgaaaagtaccatgtactatataaattgccacaaaaattaaaattgtggcgatagaacatgttttttttgcaacagtacgattttttgtggcgatatcttattttctattgcaacaaaagtacgaaataaaacaacgattatagatcgttgcaataaaaaataattatttgccacagaaaaattatcattgcaatagtataatatattgctacgaattatttttttgttgcaataatttggtggcaatagctcaattatcttgtagtgtgcttcgtacgcatttgatccctaacagaaacaacgaaattatatgaagtactctatcagttctaaaataaataaaatatgatatattctctgtctatattcataatactataatgtgtcactttcataataaatttgtttattttaaaatgaaaaggttagtatatatagtacttaatatgcagccagccgtaggtagtgatggtatgtaagcctatcctgaaagatgtatatataaaagctaaaacaaaaccgcagctgaaaattcaacgctcactttagctacacacgctgggggagtaggctgtcaaattgcagcattatcattatcttttgggatctatcgatctatctatccatatatctatatatattttttgatctcctatatattaattactatggcaagcaaaaactcctccactacttctaacagcgacagatgctacacatatactccctccgttaatataagggattttgagtttttacttgtaacatttaaccactcgtcttattaaaaaattttgaaattattatttattattttattatctacagtactttaagcacaaattttcattttttatatttgcaaaaaaaatttgaataagacgagtaaaaaaatttaaataagacgagtggtcaaacgttgcaagcaaatactcaaaatctcttatattgtgggacggggggagtataaaactccacttcctttacatgcagatataaacatgtacgcatgcatatttagttcaagaaagaaaataaaatctatactatccagacacacaggatcaattggttagattccttgtgataaaaccatcctatccgaaataaagttataaacttaacacgggtggtcgcacacacacgtttacaactaattatttttttaagtggtagttaagtgacatatctgttgctaccgaagtatccgtttatgatgactttatcaatcttaaaatataccggtacagtattttggaggtgctcataaaacataaaaaacctatagctaagccaaaagaaaaaaaaagaagcaaatatatgtatacagttgatcgatcgtgttgcacggaaagttcgaaacttaattaaagacgcacccactaaattcggcagtatacatatacaaatcgtccacaatgtacatgcgtgtacactgggcctacctatacgacctgcactttgttagtattatatattgaagaaagttgtacgactagtgtacgtatgcgacaacgcagcggccaccacacagctggagtatatatacgaaatgtaggaattaacgtacgcctacgtcagcatccaattaaattcatccgagacgaagaagcggatgccggcgccggtggatcccgaaccgccacggcgccagctgtccacggcgggggcggcgggtggtctggtcagtgcggtgctttccgcgtgtcgtccccgccggcatttggagctgccggtgtggtcgcgcgttgcaccagtggtgccaggagagggaaatcattgattacatctgtttgttggttctggtaggtaactgaaacaaatgctatttgcaaggtctgtgaaggtcaagtataggctaacgacatggtgtgagatttaggtttagtgtagtgcaaaaaataaagttttgtgacgtgagcatttatattgatagttgttatagaggctaaaagctaatcacaacatatatgcagattgtggacagtcctaaatagcaaaatgtgtcacatgtttgatggcaggatagacaggacatagtagttttatagtggtagcattgaaacagttctgctagatgagcacataggagtataggactataaaactatattacacatggctaaattctactaatatggtttggatgccttcaccgaattcacacaggggcccttttgttgatgtgcaaatggaagtgcaatattttttgctatgatgaattgcttcccccgtgtacatagctgcctgagaagtgatgcaaaaatacaattttttttatcaatactggcagtcaataatcttatggcattgaactactcaacaatattagaacaattaagcatccttgtttcctagtaatgttctttttctgaatgtgaaaaaagcaagttaacatagttgttttttggtatatattcagattgtaagaatcaaagaagcaattgccgatgtcaagtaatctgtgaatgaattaactgaaggaccaccagcaggtacaaatttagcccaatgtgaggaaattaattaaacatctcaaatagcagggggggcacaaaaaggtaccaaccaaaagcaaagtaatgatttatccatactaaaaaaacaaacaggtaaacaatccaaactgttttcagtaattttctaataatcaggtatgtgaaccaaataatgcacacagcagcatatttattcagcaaagaaagttggaatggacggtattgtaggattgtaaaggtcaatatgtcaagttaacctattggtttctggttgtacatcttttacatagattataaaaggtatgtgattttaatacctaaatcatagcaagcacaataattttatgagcagatactatcagtatgtttaaaggaagagggtgaaagtgcaagttagtcaaataatacataacttagttaaaatgggattttaacctacagggcagcgctcatcgtcataaactgaagttttatcatcctaccccagtagttatatcatcaagagtcctgaaaagccacttctatggcaagagcaaat

SEQ ID NO: 106599 - DNA, 5787 bp, Oryza sativa
  unsure (1)..(5787): unsure at all n locations
ggggtgnnattgtgacagtggtacagnacnncatcatgagcctaattaatccatgattagcctatgtgatgctacaataaatatgtgctaattatggattaattaggcttaaaaaatatgtctcgtgaactagctctcatttatgcaataagttttattattagtctacgtttagtgcttctaattagtgtacaaacatccgatgtgatatggactaaaatttagtccatagatgcaaacaccacataagtcccgcagcactttgcatccgagattcacgcatgtacacacaggttatggtattgaagcacctaaacattagtttcatatttatctaaaataagaacaaaatgattcatcaaaatattatgaatcgggagctgtgtggcctacgcacgttacacaagttatggtattagaaaatttaagggccattttgaattgcaggaatgaaaaaaatagagaaatataaaaaatgtaggattttgataggaatgcaagtacaaagcagaagattatagaacacaggaaaaacacgtttgattagaccatagaaaaaacacgcgaaatggatgagagataggggcagcatgggtggcacccagctccctaacctctaccaccgtcgtttctccatccctcttcctactccgctatccaaagcagcctgttggaagaccaacgagcatcagacttcccatcggcttagcaccctctccctttgaggagctctgcccctctttctatagggagctccattggtatagtgaaggcaacaatcaattattaagggaaggcttgggctgccgagatgatatcacccaattccaggctctccttggtcagatccatcaagtagcctcgtgggcggtgaggcagaggaggcttgagacagtgcccggggtgcaaatggtagtctagtcgtacacagaactggaagtctgctgacgaagaggtgttggtccggtgtggtaggccatgcactaccaatgttttgttggtgtggtacctaagatgatgggcaacggatcgcggcaactgggttgcaagggttccaggacaaagcctagcataacaattcactaggctgatagcggctacgctttcgagcacgtcaacccacccggggacattgtcaagataactctttcctccctctctaggcgagaatatctaggtgaaaatcatgtccattttcttggacgggcggcaatagtgtccttggcgttgcaacctccgtggatgtatcgttttttaagactccgctttgtggtgctgctgtagatcgggtgttgatataggcaacgcatagtgcagcggctaggtgttaggttcccctccccttggcatgtgtatgtgtggttggtgcatgtgcgtggttccttgatgtacaatctagtgtataaccacctaaactgttttttatggatcatagtgttttgtttgtgtaatattgttccctcaattctaataacatggatgctcagagagcacgatcatagaccaaatctatggtcagctagctattgctctaattatcggtatgcatatattaattcataaagtcatagtttacatatatttgcatgctgatcggtcatggtgctacctagctagaagtgcagccgttcatatatatgttgcatgcaaattaaataaaagcagccgccaatgcaagcactgattacatcggaaagatgtcgcactactatgccatcgattcagatattaacaataatgcaagatatgaattacgcatggtttagtgagcctgcacgatctatgaacacgcgcgcacataaattattactcatcactctgcaatcgatcgtatctgtagatagttacagtagttaattggcacaatgcaacaggatgaacagatagatagcaacgttgtccgtggatcgacacgagaggccaagtttctgatatttttctggtccggattggatcaaagtactctgtcgatcgatatatcaacaaaagccacttctactcgcaactctggaaattgtgagccatttctttatgtttctaaaaagaagtgttcatattactacctctatattttaatatatgatactgttgactttttatccaacgtttgaccatttgtcatatttaaaaaatttatgtaattatcatttattttattgtgacttgattcatcatcatatgttctttaagcatgacataaatattttcatatttgcataaaatttttgaataaaacgaatggtcaaatgttggccaaaaagtcaacggcgtcatacattaaaatacggagggagtagtatatatactttcatattatttgatgtgaattgatgaatatctttaattttatctggacagaatatgagaggcattcacaaacttgcagtggtacactgctacttgatcaatcccttttgtgtcactgatcaacaaaactgatagagatcatgatccaataaaagattcgattgatcagtagtcgctccagatcgacctagctagctagcatacataaattacggtgaggaaaaaagaagaggaaaaggattaaagttaattattccatgggctactttgataacaggagagggactgggcagtgaaagtgagatattatttcaggttgtcaagtaatgcagggtggccacgcatgcagtacgtggatttatctgagatcaaacggttaattggtggcttagcaagcttggtgcttgcccggtcggcatcacaattcatttctccgtttgtttaattttgtcttttgcaagagtccaaatcaataagaatgttgtaacaaatcagactcaataatctacccaaaaatcaaactcaacctcacgtataggcttgtcggaacagattagacgttctcattaacatgcatgataaatccaattgtgtacgcctctatctatcgacaaatcaaattcaacctagtgtatgataaagcatgtcggaacagatgtggcgtctcaacaaaacacatgctaataaatccaattatgtacggctctatgtatttatccatgcattgcagatatgacaattgacatgtaagatgtaaccaaaagcaatgaggtcgagctttatgtgtacaacattgaatgatttatctgatgcacactttggttttgtgactctgattagttagctggctaactccgattgcatgtgtggttacaacctcggtacagtctcattgtcaatctattggagaaagaacaattaatgtgctttaatttctgacaaaatgatactccctccgtattttaatgtatgacgcagttgactttttaaccaacgtttgaccatttgtcttattcaattttttatgcaaatataaaaatgcttatgtcatgcttaaagaacatttgatgataaatcaaatcacaataaaataaataataattacataatttttttgaataagacgaaaggtcaaacgtttattaaaaaatcaacggtgtctcatacattaaaatacggagggagtatatgagaagattcggggatatgtgcagttaagcatttgtggacaggaaattctagggaacttgcactgttacccctatgccatcgatcacttgccgtacgtgcttaatcttcagacatgctaactaaaaaatactagaaaattatggcagataaattttaatttatatatgtgtgtgctgggatgactcagccagctgccagtacaaatcattgtcttcaatttccatggttaacttttcttgccaaagcttggccggcttgtggatcagtactgatcgatttatgagaagtgtttgtctccgatcgaacctttcttaattatgaaacaaaatcacccatatttcaaacaaaaccactaaaaaaggtaccaatgagttttttcttcaggttcaaaagtgagggtggttttgtatgttatggtaaaaaataaactaaaattcgaaggctaaaaaggtagtaaatgcatagtaagaagaggttatacatcgcactagagatttaaccactaaaaacgactgaaatatactaatataaaatgtaaatattttactgtcgcaagattatcaaggtattttttttaacctgaaaacagtgcggcatcccacggtatattaaaaatatatacatataattatgtacagaaagaaaagttacataatatcaatccatatcaatccatgatatcgattgaggaaaagtatcaaggagttatatcaaatgtgtatgctaaaaattgtcctctttttatgtgtgataaacatcatcgtgggcctattattttacgcatgcacgcacacttttgtgacaagttcaaagcaacaaaagctagcttattactagctagcccaagtatatatacctaaaccactgtatctatatgtcaatgaagtgatagaaatgtcgtacgaatgaaattggcatccatcgattccaaattattaaagccactgggcgatatatgtatgaattatctagggctatatattgatcatgagagtttggtcgcaatatgtctcagtctagaagcagaatgttgtgcgcgtgcagatcaataacattatacttttatgctccgtatatatttcaaaaatgatgaggttaggcttgtatatataggctcaattactagctagcttttcagtaaattggttaatatgtcaaaatcatgtgcatcaaacatatagtagtaaccttggattaaacattttacacaaagcgagaataaatgcgtaagccagatgttatacctacatggatgagccttacattattggaacggattaatgtcgttttggaggcataaacacttaaaaaaccattttcccatacaccccctctattttcatagggcgataaaaagaagagtcacctgtgaaaggtcgaggctcgcacttgaacattggtttttatagaatgccattttttataggagatcctattttgagttcgtctgtgaaaatccttattttttaatttttaagtgggtagtaagaggctcacccgtaaaaatatggctattttacaagcggagctctcaacactactgcttgaaaagtagagaacgatacaaaaacgaggataatgtgcgagctgtctcataattctcactgctggactcctcatctctctcacttcctactcttgtctctccctcgatctcccactcccagcctacctccacacttctccggatggcgacgggaggctcaggcggtagcacagcgcgcttcgagagtggcagcagccatgccaacagaggaaagcccagcggcgtggccgcgcaggagtcttctggagtgacggtggccatgacagcgacaaccatgagccaggcagatctacccatgagcagtgacgggagcggcagatctgtcacctatggcctcaagagtgatggatccgccgatagatgccttgggagggatggtgcggcgataggagacttccaacggtggagagcggcggatccggcggtggtggagcctaggcggatccaagacaaatcgtggatcttgccgcggctttgcaatgtgggctactacaacgaccacgacttgcgggctactagctatgacaacggcggcataatgtagtggcagcttcttcaagacattgggatagcgtttctttatttttttttatttttcagaaaaaagtttgttgtcgggcattttaatatgcccacttgaaaaatcgctttccgcaggtggcttccatggaggccacttgtaaaagttttttcgcgtgttgatgaactnctgtaccaacgagagagcaattcaattgngccac

SEQ ID NO: 106600 - DNA, 1846 bp, Oryza sativa
  unsure (1)..(1846): unsure at all n locations
ccattgtgggtgccttaacgtactgggcataccaacatatatgtactccctccatactcataaaaaaaagtcgtttaggatagcgacacgatctccaaaacacaactttgacttcttgtttctataaaaatatttattaaaaattgatatatgtatacttttatgaaagtatttttcaagacaaatctattcatataatttttacattttcaaactcaacaacatgagagttatttatgatttatattcccaaggtttgatttaaacattgtcctaaacgactttctttatgagtacggagggagtatatcccaagatatttgggatatggaggaattcttgggacaaagagtttctagacaaactaattttgtacgatttcaccaataggaattttatttttggctcaatttggaatacatatatatagaattggagctttcaaaatcttatgtatgaatttctcttataggatgactcaatgcatagagcttttggatgaaaaaattactccctccattttaaattacttgtcattctagcaaatctcatacaaatcaaggagatgtgacaattacaatgttaacattattaagtacatgccattgttttttttcaaagaagccattaactcttattagtttagaacttgagatgggctgataagagtggtgactgcattgatgaaatgtagagagtgaaggtcacctctaaaactgatttggaatatgagaaggacaagtagtttaataaaaaaaattgaatgctacaccgaaaagtaatatgaaatagagggagctgagtagcataaggtccggtcacttaaaaatttcctttaaatttgtatattttatccaaatcctatgttttattgtagccgacataaatatatattcctaagtttttgttttattaaatttgtattttgtatatgcactccaacaaaaatcttgtgttttccatgttcggggttttcattttgctagtgctaagttctaaagaagcctcaaaataattccactattaatatggataatgtttcgtatttcaaaacgaaacttatgtttaaaataataagttgatttgtggactttaaaatatatcccaaaataagatgattaatttatatccccttacctgccatcgatcccatgaattctttcgcttcactacctcttacatacttatccatctagccatagtatttccttattaattaggacaagtttgaccatcttttatcattattaaattcttataggattttaggatcacatttattgtgggatagatcgattgagtattattattttttcagtcaaacatgtgaattacatgaaaacgttttacaggctcttccacggtgtcaatgtcctagacgaaagttactctaaaagtaggtgaatccttaaaaaagtttgcaacgtatgcgtgcatatccggaataatctatcgatcgatcgactctgaaagattgtgcaagaacacacgcgtttcattcccaacaacaacaactactgtgctgccgctgctgcacatacgcatcgaaacgtcgtcgacgaaagaggtcagaaaccggccagcacctgtcaagctacgcaagctctagcttagctgaatatgggcctgtttggagaactttgagattctgagaagcagctgtttggtagccagtttctgagaatctggaaaagctctgaaacccagcttctttagcttctggcttcttagttcattttttagaatctgtaactacacattctcagaagctgtggactatttagggcagcttctagcagaagcagtttttagagtgntnggtcatgtgnactgcaagtcagcacct

SEQ ID NO: 106601 - DNA, 1058 bp, Oryza sativa
  unsure (1)..(1058): unsure at all n locations
gtggtggnaatgacattgcattgccacaggacntcatcacaggttagtagatagttttgctctctctcttcatttaatctcttccaaataggaaaatatgctgacatggatatcttgtagataacctatagataaccattgcgggtgccctaatacattgtgacagctagatctaaatttggtgaatatttgcacaaaaacctttaatgaagctaggtttgactacccaaaacagtgaattgaatttatcatctacctaccacatactatacatctggaggtaagagaacgtcacacattgcagaggcaaaaagaaagagctaagctctctgcatgcgtgactccatgaatgcagttagcatatctatagctagagccatccagctcataaatgatcagaagttgaggtagcaagcagagagagagagatcagcccttgttttgttgttggcgcgcgtttccttcctcgaagaccatacccctccaggaaaccagcaggattctttgcttcgatgctacctcttgatcttcttgcaaattgcatgctacgtgtacacctctcttgcgtgcatgcaaacaaagtgcacgttactgattaactctcgatccctatgcaaagcatctttttgctccatgcatcgttactgcataaacgatttttttttatgagagccccgtataggttacgggcggtctaaaaaatcgaccaatattttcgtatgcaaaaaccaacttttagaaacgtacgtgcaccacctacatagaaaaatagtgccttttacatacacctggtgcagaaaggccgaaggtcctcatgtgaaaaatctgttttgaccatctggaaaaattatttctgtattagtgcatctagatgtgtactatgtatatactttatatactactagctggtaccatgcatgctatatatgtactccatttttttttaaaagaatcaatttctatgctgattatgaattcgactatgtgcttgtatatatagattcatatagccgattagtatatgatgctagcaaggtacgtaacacacgtgtgcatat

SEQ ID NO: 106602 - DNA, 736 bp, Oryza sativa
  unsure (1)..(736): unsure at all n locations
tgtggtcccntttgaccattgaaatgcacctncnccttggnacagnacnncatcaaaagaatgtttcaattcactgcaacatttgatccatacatagtggcacattatgagtacactaggggaaacattttctgtgaaacaaaaaataaaatggattcgtttaatacaggattttcataatatgtatgtgaattgttgcaaaagaatattttaattcactgcgacatttgatctatatatagggaaacattctgagtgcactacactactacaaaaaggcaaataggagctcgccactataggtgccggcacaccaaaaaccgggacctataatgcctttccctcccatgcgcccacccccatgcgccacatattcaaaaaccggcacctttatgtccaaataggtgccagcttttaaatgaaactcacacctaaaacctgtgtcaaagaatctagacccaaatcccgcacatttaattttctccctctcacactagccgttggccggccccacacataggtgccgggtttgggtctagaaccggcacattaatagagccagaccaagcccatcggagggagccagaacgacttcaccttatcgtcggcatagtgtcattcgctactatcacacaacgccttcccccagcggtcattcagtctctgacgctcctactgttatctcatacgtctaatccctattccgctacctcattcatgaccggagggcggcggt

SEQ ID NO: 106603 - DNA, 707 bp, Oryza sativa
  unsure (1)..(707): unsure at all n locations
ttgggtannaaggtgaacgatctcagacctcataaattagtatttatatagtggtagagtgcattatgtttaacatgctgatcaaagagttttactaaaggagttatggtctaattttagtgaaggtgcaaagtagactaagtggtatgctagatattttcagacttagctaggtggtagttcgagtttaaattttttttgtggttggttgtatcgtgatcctgagtgtgaaaaaacatctaaaaaaataaaataaaaatgacaccgttgcaactccatacagagaaacaggaatggaggcggcggcgccagccatgctggctcccttctccctggggcggggccagcatggctggagccctccccctgccacttcggttcgcgtgccccatggtggcatgaggactacccccagaaagcctcgccccttcccctttggatgatggggatcaggcactctcttgtccttaattggtactgtttgggataaaatttttgtcgacgtctatttccagaataatttcctttatgcgaccgaaatttggaaaaaccaaaacaatttgctctaacagtaatatggatattgccagaatgtgtattatgtgctgcattatttttttgttattggcatcaatatctaatccgacgggaccttttcctctttgtaaatttccattccgaatatccacttttctctgccagaaact

SEQ ID NO: 106604 - DNA, 843 bp, Oryza sativa
  unsure (1)..(843): unsure at all n locations
gtcgcaacggtgaggaatgtgtaggaaggtagtgaangcatttcaacgactcgatacggaattaggcttcgtatgcatatacggaatcgtcttgaacctcnntaccnccccccccccccagtgggnnttttgattgaccatcgcatagtgacacngcnacggagnngnngnnacganagaaagggcgnccgcggncancancccagaaaaccagaccggagaacctttttatttcttcaacatgttaaccccaccggcttgttgaacagagaaagtgaaactatctttcaactgttctaattccgtattagttacatatggggagaagtcaattcctgcaataccctcttttagcaaacgttcatactcagcttgcatagcatctaagtcatcgtaagaagcaagggtgtttaagtcttctgtgttagcctttttgtcaaagatacctgtaaagtcctcagaacccaatacagtattaatgattgaatcagaagaaatcttttgttctgcttgtgctacccagtcagcaaggctagaaccatcttcaccccaagggaaatcttttacttcttctggggttaaggcaacccattcagtttctccaccaacccaacgttttggttggttcggagttttagaagagtccacccagattaaaccaacagccggatttgttggtgctgttggggagtaaacccaagcaccccctttaccggtaatagctgtttcgatgtcttttggggctttcatccacgtttggtggtttgttacccctctactagcattggagaagacatatagaaagcagagcttgggtttttccccaccagtcttacgaccaat

SEQ ID NO: 106605 - DNA, 1119 bp, Oryza sativa
  unsure (1)..(1119): unsure at all n locations
ggtttccggcctttaaggccttatccccaggtggggttcaacaggaattgttaaaggtaccaatcntcccttcgcctttgaaaccaattataatattagggggtggcttggccaggtcattaaatgcattcatttagggccgtgcagtttgacaattgtttctttaataatgcaagaaattgccattctctaggggacctttcatccaggaattttttaatccccttaaataataagtttattcaagacaagcttggggctgccgggccaaatttgaaaaagcccaagcaatacaagcctgcctttcagtttaagctcggcgtgntcataggcggtgccnctcatntcannnnnnnnctccttctaagctccnnnnnnnnnnnnnnnnntnnnggggtatgatccaaatattttcttccattcacagtatgcttattttggaatgcaacccaacgaatacttcgaaaaaacccccnctcttttgggggggggttaaaaatccttttggggggggggccttaattttaaaattcaccccttaaagtgaaaacatccagcgcttgtctaccgggcatgaagctttgcatgaggatgttcgtggcttgcgcaccgatgttggagacttgaatgcttccgtggggagattgcacacttgtcacgcccgaaaattcattagtaatttccgaatttatttgtgcataaaatcatcgggggggaatcagccgaggtncncnnnnnnncnnnnnnaanaccacggacattcnnnnnnnnnnncgnnacatacttacaaagaaaagaaaacagcagcggatttaacggtctagcgatggcttcagctccactcccacaggcacgttttatacccaaaaaaaaactccttttgggggggngggnnggtttaaattaaaaaggcccccaaaaaaaaccggttttcctttcctcccttcttggatcccttcatcttcaactgaggtttgatgattattgcaagaatgagcatatgacatactcaccaagccacacagcaaatatagaaaagtgcacaaggataccaaaggatggcataatataggcttgatganctnctgtncctagtagtagttactcaaangggcacaa

SEQ ID NO: 106606 - DNA, 888 bp, Oryza sativa
ttcgcgagcgaggcaacggaacgtttcgcgtcccccgcccgaccggcgtgcgtgtttgcacggtgtatttgggaatgggagaaagctggtggttagccctagggttccttacaagggcatagggttatatgcttccctttattggctttcggtgggtttctctgttattaaaaaagggggggggaaaaaagggtttttaaaacctctaaatttccctcaaaaaataaatctattttggtttccttatcttttgaatcgtctctctctataaaggtgacggagcatatgtctaaaaaatttggtagctcaaacttagtgtgattaggggtgaaaatggagcgggtatttcccgaccgcccgcccgacccgaggctcgcgggaggaatatgggagaaaaaatgggataccgagttcgaatccgaattcgttagaaaaatatgggttacgaaacgggaagacatgtatccgtccgtatgtcccgtattataaaatatgtatgtaaatttattataaatctacctagaaacatgataaaagatcggttaatcattattttaatgttcacatgtaatattgtataattttttttcttgatgtatgtattttaatactttaatgaccttatgatatttaatatctatgaattaggagataccacaatatgaattaattttccccccgggggttttttttcccccccccccccccaaaaaaaactacgatttgaggaaataatatgggaaggatacgggatgagtgatatattatccgggattatccgtatccggttccgaaattaaaaagaaaatatgggttatcgatatgggaatgccataatctgaccgtacccgcccgtttgggccctaagtatcaccgccagtaatctta

SEQ ID NO: 106607 - DNA, 1063 bp, Oryza sativa
  unsure (1)..(1063): unsure at all n locations
acaataaatatacggatgttttataatacccctttagttttttcaaacccataaattgaatatattttcaaaaaaaatttttcttgagttaaaaatgttactagttttttctccaactatagtaaaactaaaagcagttttactttgcacaaaaatcaaaacgttttataacctacagaccccccgcggggaaaaaaaaaagggggggcaaaaaaaattttttattccaaatttaaagctgggttaaattaaattattattcctccccggtgatgctacatttggctctcttccatggtgcgttaaaagtttgatacgtgtatatatgtgtgtgcaattatatatattttatatatataataaaagcttcaaggttggagtaagtcaacgggattagttagatttgtgatggtaattagaagtagcaacaagtggggagatggttgtggttaatgatgtattagtagctgtgcttttgtcagcttgtgccagtatcagtgtgttgtatgacatgtgtgatcatgtctttgtgtgtggactgtttaactgttatcttctttaatttaataaaataatcgatgtgatatcactgatatatggaggccctgctttctcagttttcatgtgctatttggcatcttttctgtaatgcaagccttggtttcatgcacggttatggtgattagctatgatgttgaacttgaattttgcagtaaccaaaacttatggaagtagtggactgcttcattgccttggctaattcacaatttacatggttaaaccgttaaaacacaagagggcgcattcagagcaagtttaatggtatagccaactactagctccaaatcatctatagtcaatgtaatagccaattcatacaatagttgcttattacttcctccgtttcacaatgtaagttattctagtatttttcacattcatattgatgttaataattcatacaatagttgcttactactacctctgtttcacaatataagttattctagcatttcccacattgatgaactnctgtaccagtgatagtcatcaatnggcccac

SEQ ID NO: 106608 - DNA, 1207 bp, Oryza sativa
  unsure (1)..(1207): unsure at all n locations
cgcgccccttgattgaccttgctgacngccannccccattttaatataaaaaaacacttgttgaacattatgcaatggtaaaagggaaatagaagcgactaacatatttatgctgttaaaatgacagaaacacgagggtttatttggtaacattgaaatttatacgcttgtaaaaactttatacctgtttcttttttcaccccataaacccaaagcaaaacagagaatttaaagtccccctttatttattttacacacacgtatacctaactgctgttgaattaatgttgtaatttgggtaaattaactatgaagaacaatcctttgaacaatagctctcaacatcttgtactgaaatcattgggcgtgcataatctaaaacaacaaaactaactagctagtcaagccgtccaaccaccttattaagcacggtcatcaacctcaaaattcttaagtgcactaggctttcattcaattctgttcaaggattggcccttttggttttttttcccttttccccaaaaaaaaagtttttttttttaaattactgctatatataatcaccagtgctagtcagtgcggtttcaaattaagtaatattctctcctttccatatggatatctgctccagaatttggagtctccaactgtcataccctatacgataccaaaatttcgtgcaaacataaaagaatataaaatatttttatacaatctttaatgataaatcaagtcacagcaaaataataataataattaaataaaacggatagaaaatatattaaaaaattataggtgtcatatattaaaacccgaacggagtacatttcattaggttttttttatgggcattgtattgggaattaatatgcaagcactgacgagagcgtggtaattcttttcttttttttcttatattttgaagaccatgaccaatatggtgtacatatcgcaggagttagctgcacacaagacaataggagttatttttccgcccggggtttcccaaaaaaaaaaattttaaaatttttgggggaaaaaaccccaaagtaattagaaccatattgaaggcacgcataataagatcatcttagcggtggaaactaagactagnggggttacctgctattaccagtgncgctagatagctaggaccgaaccagcgccattgttaaatngggcaataattgagactgaggagnatata

SEQ ID NO: 106609 - DNA, 784 bp, Oryza sativa
  unsure (1)..(784): unsure at all n locations
ttggtcttatggccgtcgcactcccccagttggagaactatccgtaaccgccatggcgtcgtacgtcgatcgtcgcaagaacaagaaagcaagtgcaatgtggtgtggtggtagtagttcaagttagcaggtgtatatgtgtgtgtataaatatgcagagaaagtggatgcagacacggagagcgcgacaaggttcaaaaacgatgaaagaaaggataatacatttatctccacaaagattcgtgatggagagaccaagtaaagcgaaggaaactatgcactagtaagtttcaacctcatctacaactctaaaaaaacaaataaaatcatggtctctgctcaggttggtagattctaagtattaggcttaacgtgtgtgctcatatattttttaaaaaaaaccttaataaataatatatctccctgctatgtgtggctcgcggctatatcagtatcggtaaaaaaaaacaatatagtgcaagaaaaaaagtgttttaagcacttgtaaaaaccttgaaactaattaaattaatgattatatacaacatataactcttaaagtcgttcacttcatcctctgaacttgactaaatccttaattgtcatgagcacgaccatcaaaaccatgtgctcataacccaccattatcaagttttagttggcaatttaattaattaaccaatcacgattgaccatcgtgagcttccattaaatatccataagtgatagtgaagcatgatttatcccattaatgtgatgaactgctgtncgactgtcatcatca

SEQ ID NO: 106610 - DNA, 747 bp, Oryza sativa
aagtgcacaagtcaatatagccaaaggtccctataagctattgtgtcctttaacacaagcacaaattaaagcacacaaagagagacattagctgttaatccctaacctcactagctaatttctaaaaaaaaaaacacccggcccgtattgtgagcactaaagatttaaatttattgatatatatatatatattgaaaattatatgctactaccgggagtagctactccctctctatgtgccctcaattcgatcgctactaatgccaatgactgttaccgggtctaatgaatcgaatactcccacccgttattggattatgggttattccactaacccgatccagtaagcggagagagtaactactcccggtagtagcaaataggtgttatatatatatatatatatatatatatatatatatatatatatataggacactcatatggggcaccatggtgcccgggcaccatggtatctaatgcacgaaattactcaaattttttaaaattttcaaattatgagtatatacctagttataataatttgattcatacctatacttatcaataaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaag

SEQ ID NO: 106611 - DNA, 1612 bp, Oryza sativa
  unsure (1)..(1612): unsure at all n locations
agggaagcccccaataataagaaggtgcttcggggtggcccacacgaattaataaaattggtgatcccctcaaggcatgccactccgattatagtaaaatgttattaaaaaaaagttaggtcataaagccttttccctttcattttttgttaacacgtttcccacacggttaaacagtgtgttaaccaaaaaaaaagcccaagcctctctggtaaaagtttacaagtttccccctcacncanctaannccnaannccnngnatcnnnngnncnnnncnnnncntctttcattttagtatctacatgtgtatatatatatctacgtacgtacgtacctgcatatactatacatacatgcgtgtgtatactccaacctagctagtatgagtgtgaagggagtatactatattatattatttgtgtgaataatgaagctctgcaggcatgctgagcatggctttgctggagctagctagcatatgtaaacatgtacctaaacggattgaaatcctctaacttattttcatctgcacttatgctcaaagtcagatagaaataaattagaggttcctcttccgtacctagacgcgatcatgcacatgtctctccctgcctgcaggctgcagcagatcgataggcaaattaaagtggtcagcgtaaacaaatattgtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttattgataagtataggtatgaatcaaattattataactaggtatatactcataatttgaaaattttaaaaaatttgagtaatttcgtgcattagataccatggtgcccgggcaccatggtgccccatatgagtgtcctatatatatatatatatatatatataacccctatttgctactaccgggagtagttactctctccgcttactggatcgggttagtggaataacccataatccaataacgggtgggagtattcgattcattagacccggtaacagtcattggcattagtagcgatcgaattgagggcacatagagagggagtagctactcccggtagtagcatataattttcaatatatatatatatatcaataaatttaaatctttagtgctcccaatacgggccgggtgtttttttttttagaaattagctagtgaggttagggattaccagctaatgtctctcattgtgtgctttaatttgtgcttgtgttaaagggacacactagcttataggtacttctgcctatattgttgatggctgcttgcatcgangtcacaaagnccacggggggggggggggnaaggaggcggaaatcatcctaatacaccaaaatacgaggaagattatcttaatgaccgattcaacaactcgcggtagtagccttgagaaattaagggt

SEQ ID NO: 106612 - DNA, 737 bp, Oryza sativa
  unsure (1)..(737): unsure at all n locations
ttttgtggatgcgcctacnagatggtacagnagttcatcaatgtgcagctatgcccctgctttgattctgatagttttctgaacaaatccaaagggaagggaaaaataaggaaaataaaaccaaaagtcctgaccatttgtactatatccccactaagttgagactttaatcttggctgttctgcaaccttctattgcatcagtgtgtggtagctaatagtaactgatgagcatttaaatcatacttgatcatattttttatttttttaagataatagaataattacatcctggcatccaaagatgcacaaagctataacactttctacatgaccgtatcattttgttccacatataacaagagaaaggacaccagactgaaaaacaaatattgaagagttgatgggagatagaccactccagtggcttgttgctccatatataatagttaggcctaagaggcatcgggagctttcctgttacaaactagcctcctgctactaagttttttgctcagcatttctcaagatagttgacatgactaactagataggtgacatgctgaattccataaaagagtagataaaatgaagtagcagcaacatgtttttttagcttgatgttaagagagatgaaacaagaatatttcatggagttcagccagcccaatggttggcttgctattgtatggtaggcttggaagacgtcaggagctctcatacatcttattggtaagc

SEQ ID NO: 106613 - DNA, 660 bp, Oryza sativa
gtacgtacgtacagaacacgggacgtttatccctagctcccgcgaactgggtacgtgtccggtgtcaccttccactgttccctttctgtcccccggctttcgcgtatcagtgcgtctgctttgtgaaaaaaaggcttgaattgcgtggcgccgcacttttcacaaaggttggcatttgaatccacacacacacggatgaattatcgcggtaatgctatgtttctaaagcgattttttgcaatcttttgccgctgttttgttctcaatcactgcttgctcaattgctattgttctcaggtagtaatcaattttatatctattcttactgatctgtataactaggattacaatgtttgcttaacattggaaattcaaatcccttaaaaaactgtaactatgttccgttgcatgcaagctggtttatgaacttatgatcctctaatcatacctgacagtttatgtgcaataacgccaaacatgcaataacccacaaacctgctaaaataatatcaagctgatccttcaacactactatgccccttgggaagttttcttctattaagctttaaatccattgaacactaggagcacatgcattgtattaaccatttgctgtcttgtgatgactaaaaataagcccaatattgttgcatggggatc

SEQ ID NO: 106614 - DNA, 962 bp, Oryza sativa
tttttatctgaactacttctgttttcaactggttttcatgaaaattgaaaacaactccagagcagttttcgatcagctaatgattttgtgaactccacatcaaaccgatactattagttcatatatctaaagaagttcaaagtattgctgccaatattaagtaatttttctattgcaataagaaataaaaagtttatcaacatgtgcaagtagattttgaatagatagatcttcatgaaacgtcagtatatgtcaccaatagggcgatcggcatgaaaccaacgagtattactcacaacggtttataactaataaaacgatcaaagagtcccattggttgtcctaataaactaaaaccaaagcaaaattttaaattttcaaacttaattttgaagtttattttaagatattttcaacgtggtatctttttcagcgttggtttttaagtcgttaaaaacacatatataaaatttttacctacaaattaataattattctctaataagctgttttgacttattattactactattataaaaactgaagatgtttttggcggtatttgagtatgtcatccgtgtatgagtcaagttcgtaagattaaaataaacttcacttgttacaaccgcatgaatattttttttagttaagtaatatatgggcaaccgatgaggagccaaatatatctcttaagatattaaggtgaaaaactagtactccttaccaaacatgcaaggtgcaggtgcaagcaaaggtgattttaccaaccttctggttggaccgatcgttggctgttcgcgcttcccttgctgatgaggccgaacagtttttccccccgcgaggtcgcggactcgcgacagcccgtcgtcccggcccgccccggcgcaggtgattgacaaatgggtcccacacggacatcctaccccacctggcaccatctaacggacgaatcccccctccca

SEQ ID NO: 106615 - DNA, 760 bp, Oryza sativa
tcccaattttatttaggttctatgtcttgcccttgctaatttaacaaggtttaaatgcagtaaattttgtagctcggattgacttaagtttgtaaaatagtgagcctattagatgaaagtaaattaaacatgttcaccatagtttcatgcgtgctaaatatatagttataaagaaattctaaaaatcagacttcatagacgattgtgatgttaatatcactatataaacttgcaagatcaaattaaaatcacaaaaaatattacacacagtgacatgttttaattatttgaccttttttcacgtagatcgagttaacctctctatgtttatagagggacatataacataataatttattctatctatatttttaaaaatatttaaaactttttgaaccacgtgttaaaagaaagtgtacattaaaatcctttttcccaacttttgtgacattcatctgtgtaacttatcacagaggtacatacggtgcatgcagtgagagatgactagctaggagtatattctactccccatctcggtcaaaactcaaaaggggtcgtgttgggcagttataactgtataaaggatagctagatgtatagggcgagaagcgagataagcatggttgcgttaactgaaccacagaaatgacattcctaaatttctcctaccacgtggagagagactcaatctgcactctttttacacgtagatgcatgtttctgtttttttcctgatctcaccaagggagaaagtcgatcg

SEQ ID NO: 106616 - DNA, 671 bp, Oryza sativa
aattgtctagttaaacccgacagtgcgtttataatttgggtatagttaaacccgacattgcatttataatttgggatgaactcgaactctcatagatggcataagccgctagagtccagaacaagtacaaaaaggatttaccactagagtccagaaccggtgaaaggagggtttgattacaagtaacagagcaaaggcgaattccaattcaaatagataagaaacggcaagaacctcagccaatctcttctctatctatccctatctcttcttctactattataaaaattactagcaaaatgcccgttgcaataatgtccgtgcgttgcaatgggtgaaaataatctatctattatatgataaagatagcttagcaatgatactgtgtttgctttggtcgcctaaaaattttacattgattaatgaaaaaaataatagttgtatttgtatatacataatacaataattatatttagtacaaatgtcacaaaactataattatttggtcaaatcctatcatgtttttaaaatatgttacaaatatattgtgacattatacctcactggaaccgcgggtaccacgataaccgtcttaccgtggggtcttaccatggggtggcggtaaccccatccaaaacaggttggtgaacctgagcacatctagcttttaa

SEQ ID NO: 106617 - DNA, 674 bp, Oryza sativa
aaaacatccatcttaattatggaacatatgctgtatgactccagcctccaatgctgtagtgcaaatacaaagacacatatgattgtgcattgactgggataacaaagttatctactatatttgaatttgtgtttcacatatggaaagcaaaataattatttgcaacaatccccttaatgaatcataactttgtaactgttgctcacaggtagggacatattctacaagcgcaacacaccttggtgatcttgttgcaatgaatgatttggaaagagtgcaaagttaggatattcaatggttgtttgaattggacaatagaggatattgtttgggtgatccgtgaggaattatgggtgtgcaaggcagccgagagtctgttgtaaccgcgtagaggggcatgctccctcttgcagtcttacaagtagcctctgagcaaggagatcccaaaaaacatggaagatgaggtaaaattcttttcttttttcattatgatcaccaaaattgcaaaacaaaaaagatggcaccaatgagaggtgtccattgggcacattcccatcgtatcacactttgtaagtggaacaagtattgctattagataagatgccataatggtcttactgaagtatatatagaaaagtggcagtacaattgctcaccaaacaccattcaaaaaa

SEQ ID NO: 106618 - DNA, 1296 bp, Oryza sativa
gaaggcaaatattggttagttggaatatgcacaatatattagatcatctaaatatccaatggttagaaataatggtctaccgaattaagtaaaaatcaaaagtcagatttttttttcataacttccactattttctctaatttgtatccctatactttacacatattcataatttcctatgaggaattatccatcaaatagtaaagtcaatttttctacataaatcggtagagtcattaattatatatggttctatatgtaatgtcttttctaacttaagttttctctcttttcctatggaacttcaagagttatgtgtcttaggtaccatttagataccataagttaccaaccccaatttccagtacgttattttataaataacaattaaatttgtcatggaatggtaatgaagaaaattcattaaaaaatcacaattttgaatcgttgcaggtattggtccgctagtataccacccttataagtttctcaaatatatcctacgtatggtacatgcccgtgcgaatgtacgggctaccttcctagttcgctctaatgatgcttctcaagaatttataacgtattaccaagtgagaataatcaaccacctactattataaaagcaagagctttttttttacagctatgtgtaaacgttttgtgcggaaaatgttttttccgtctacatttaaattaaatgaaaggagtagtatttgataattttcaatccaacatcctctcaaactaaaaagcacatgaccaaccgaatataaacaccccgttattgagagtaattaaatttctttacaacttcagtgtctaacgatgaagaaattactgatctgaaccatttgatcatcgataagttaatggattcaccttttctttgggtgtgtgtaggggtgcacaggaagctcgtggctcgttagctcgctcggttcgtgacaagctcggctcgacttgtttgattttcctaacgagccgagctagaagtttagctcgctagagataacaagccagctcgagctggctcgcgagccctaacgagctaggctgccaggccacaaagcccataggcccatttatttagaaggcccaacagaccaaaaaccaaaaccctagcttcccttcccccttccctggtggtggcggctgagatccccgtctcccccacatgccagcgccacgtgacacggcccacgcccaacgccgctgctctgcgcctccaccctagcgaccgacgccggcacctaaccccagcgcccgacgccgccggcccaccgatctcagcctctc

SEQ ID NO: 106619 - DNA, 733 bp, Oryza sativa
tttgttcttccatttaaatgttcattcagaaatgtcttgtaaaaaaaggagcgctccataatcgtttccaaatgattgacgccaatcactattcattttcgaacatggaaacttagacatagattgatagtaactataccataaccttcgcaagatccaatctgcacaatcaggatgagcaagacgttgcgcccaaaactatcttcattaaagccaaaaaaccctctctaaggtgaggacacatgttcctttccagttttaaataaatccctttttaaatctagaaattatttttaaattaaaaaattcataatttcctattcgtaactctgatctactccgttcaagtctttattttttttctaaattgagatctacctaatggactagtagttattaataatactattttcattttagtagtttgcttggtttttctcttttgcgaatagttgactacaacagaatttattttggatgaggatttttaaagattttaaagatgaggacagatgtaagttaccatttgatcatattgcttctactttccaaaatgtcttactgcaagattgcattgctagtgtgcatgttaacttgactggcctcggttcgtgtgacgaaccgacagatctacccaataattgcattactcatgtaggatgttgatgacgcttcaccccgtggttccacggaagccatgctctcgggcttagtaccaatgatcccactcaca

SEQ ID NO: 106620 - DNA, 731 bp, Oryza sativa
attatgttgtatgagatatgctaaaaaaaatgttgtatgagatgtgaaggttgtaatgtgtttttagaatatttatgtgctgctgatgatgagagaatgtaaattgatgataggtaattgattttgctaaaattatggatgaaatatttgtattttgctaaatttagcatcagccgaattttagttgggctgaaatattgcagtagcccaatttgaactgggctgaatgataactaaaaggccataaaaacaccacaaaaaaacaaattggcccaaaacaaaaaaaatccagttggtcataaatgggccgaaagctctaggaacccgaattggaccaaaaacacatgggctaaatcctaggtggcatcgatgacacatcattgtccaccttggcaaacatgtggcacatacgtggtgattcgaatccgtgatcctacatggcagataatctgtgacggaaaaacatcctatgtggcagctatccgtgacggttatttttcgtcacaggaaatgcgcttggctggactaactaggcctcgggctctatcgtgacggtttaaaaccgtcaccgattctgttaatctgtgatggttttcgacaaaccgtcacgcaagtcaatccatgacgctcaatccgtgatgatttctgaaaccatcatagatgttgtttggtgacggtttttcagtgatccgtgatggaaattttccatcatggattaacaggattcttgt

SEQ ID NO: 106621 - DNA, 610 bp, Oryza sativa
tccactacaagaatcctgttaatccatgatggaaattttcatcacggatcactgaaaaaccgtcaccaaacaacatctatgatgtttcagaaatcatcacggattgagcgtcatggattgacctgcgtgacggtttgtcgaaacccatcacagattaacagaatcgtgacggttttaaaccgtcacgatagagccggaggcctagttagtccacccaagcgcatttcctgtgacgaaaaataaccgtcacggatagctgccacataggatgtttttccgtcacagattatctgccatgtaggatcacggattcgaatcaccacgtatgtgccacatgtttgccaaggtggacaatgatgtgtcatcgatgccacctaggatttagcccatgtgtttttggtccaattcgggtcctagagctttcggcccatttatgaccaactggattttttttgttttgggccaatttgtttttttgtggtgtttttatggccttttagttatcattcatcccagttcaaattgggctactgcaatatttcagcccaactaaaattcggctgatgctaaatttagcaaaatacaaatatttcatccataattttagcaa

SEQ ID NO: 106622 - DNA, 658 bp, Oryza sativa
atgtttccttcgtccgtcacaaataaaaaaacagcaaaaaaactaaaaaaaggaagtccggttccccttaaaaaggaaaaaaatcggagaaaaaaaagcaaaaaaaaagatatccgattccccttaaaaacggggaaaaacaaaaaaaaaagtccgattcgaaaaaacagaaaaagtggcggaaaaaaaagatccgatcccttaaaaagggggaaaaaattcctattcccacgcacatttttttttctgttttcttcatttttttcgtttcttttcagttttttctttccttttttcgtttttttatttcttattaatactatgtatgtatacaaactaatatatatgtatacaaactttatatacatttatatttttttatacattcatatataaactttgtatacatctctatcactactcccgtccctacttaaaaaattcacataaaaaaagtctattcgattccctaagaaagtggaaaaaaaaggttcgtaaaaaataaaaaatgaacgagaaaaaaaaaataaaaagggcggaaaaaagcgtggcaaaatgttcgatttctattcgtttatgtagcccggatatatatctcttcactatctctaatataatttaactatttaaaaatagatgttttcatcgtactactaaa

SEQ ID NO: 106623 - DNA, 682 bp, Oryza sativa
cgtttgttgcggatcatacaacagctgaagcattggctttgaggaaaaaaatgtccgagctcgcgaagaagaacagatatccccatagattggggtcgagcggatacgctggtcacgtcgatcaatggcgggagatcgagcaaagatttgccgtggccggtaagcccctgctggtagaccccatggttgaacgtagcaagaactgggtttgggcgcgcagcacaggtcaagtctcggataagggagacatactattcgagactccagacatagaagaagtgactactaatttgcagcagatagtcgagaaagaaagatcaggacagttcgtcccacggagggagcgagatcagcttactgcggcgttggggacggttgaacactctggacgtgtaaggggtttgtcctcaaagacaagttggaaggtcgggtttccacaagacgcaccaagttataagaagagagacaaatacaaagaacaactatcggacaagatctatacacaagtgaaggaacacttctactcgttggcagctgaaaacccgacagcctttccaaggttattccctgatagccagcaacccacacaatccgcacagcaaacaactaatgtacccagcagtgtaggctcagtgcagacaactatcttccatgtggatagtataactggaccaacttcgtg

SEQ ID NO: 106624 - DNA, 680 bp, Oryza sativa
tattggtcatcttgtctctatgccaactgcgtcggctaccatcaatggacaattatgactacgacagaaagacaagctatatgctcaggggcttactagctcaaacacaagtatcataccttcaatttggacttgttccggatacatgcaacatgaattcatgatcatgggtctattttctatgctcaaagactggactatttattatttctcgtaagggttatcaaccgaatacttgcgctagtcgggattcaattattatatctattttggagtatcccataagggataatcactcagatcataagctattcatatgagctacacttggtctatatcacccggaagatatattactcgggagcatgttacatgcgtcatcctttaaagggtgtcgaaggcatattttttggcctagggctaatatgttctgcaacccatatttttaggtgtggcctatcacgttcttttagggacttaggcactttttgcttagggcaaagtgtgcgtgatcaagtgcccaataccttaaaatccttttgtaccgtagttactcaactttttagtagttggtacaatgcatcttaaaaggtgtcaaacagtaaagctttatatagctgccccgctgacttttttatataggttaaggtactgtttgggtttttaagcaattgattgga

SEQ ID NO: 106625 - DNA, 701 bp, Oryza sativa
tagatagatagatttatgctctgtaggcttgtgaaatttactctgtaatatatattgtcatttttaatgttttgttcttttttggttgtcaagcaaagaaaaatgatttatattcaaagttaggaagtgtttttcttatatatatagatttgatgggttcatcggtttaaacaatccaaatacttaaatctaatagttggtgtacatgtcggaagttatacttttttctatgacaaagcctctcgaccccaaaatataaacttctagcaagtggggacaactctcttgttaaatttgttccaacgtcgtcggtgcgagtgtggccaccggcgtcgtggttctggtcgtgtccgatccatgcttgcaaccttctctgccatggagaatgccagaaaccccaaatcggctagccaccaccgactccaagttggcagtggtgctcttcgtctagagtcacaaaaatggaacgagaaggatgctcctcaaactcttctcccggcaggtaaagacagagaagggcggcgaggaatcggtcaactcagtagtatagccccgaatgagagatggttttgacctcagtgcggggtagaggtgagattgaagttgccgagtgctcgctttatttagctttcgcagcgcccctgtaagttccaaaaaagctgcctcaacatagtcagcaagatgcttaggcggtggggctt

SEQ ID NO: 106626 - DNA, 686 bp, Oryza sativa
aaaacaaaagttgttttctattttaatacttgatccgaaaaaggcccaagtgcagagagagaaattttaatttgttttctatttattttaatagagtaaatgaactttgtggtattaaaattagttattgagcttcgaaaattcacggtaaatttcaaagaataatttagatcacgtagaatatttaaaaaatatttcctttttgaacttctattttaccaattcgagttcttttttcctttttgaaacgccaactctgagttgctgggccacgctatgggcaacatcctgggcctactcgagtgacatttggacaaataaaaggcaaataaaaatattttaagtacacattgggaccaatagaacaagtggttcaaatggtaagacgcattcctaccgtcagctaagtgtgggttcaaatcccacatgttgcagatttttacccatgcgcaccatatttttttagtttgccatattatgcatcatatacatataacatattaacaaaactattttgttcaaatttaacaaatcgtattttgggtttgattcttcttgcaatcacatttttttatttttctttgcgctaaatatgttttatttttttattgttttgggctacctaaagtatgacgaatttaaaatcatacattgtgacagtcctgataaaactgtcacgagttagt

SEQ ID NO: 106627 - DNA, 643 bp, Oryza sativa
atatatgtactgttcagtaatgagttgtattggtataaatttgatagtaccggccagccagtcctgacggataacttcttctgggatggaatatgtactggtccacctcttttgcggtagtacttgtgtgctctgtttgaaggaaacaattgttttattagtagttagaagactggtgatcgacctaaacaatttatagtaatgaaatgttatcacttacaaattcaaaatagtgaggaattccataaatgtctccttgtcatagtgtgcggggtccaatgatatgatcaattggtctttcggatatacaaggaataatatgtagtggtctctacatataagataggcttattggagatagaaaattccgaagaagataaattaattaaacaaaaagaagagagagcttacgtgaactggtaggggaccattaagacatctttatcggcgtgcgccaacattgctattgccaagtatgttgctacttctagcttcttcctcttgtgcaatgtcttcacatattcttccttttcttccggggtcttgccaaccaattgctcgcagtcctctctcagctttacggggggttgtggtttgcatattctttttgggatccacgtatccaaactttgctccagttcta

SEQ ID NO: 106628 - DNA, 544 bp, Oryza sativa
atgttcagctgaaagcaaactaaaaaaaaaaggcactcctcagcaaggacgcgggttttaaagtaggttctacacattcgagaagacccagccggattggagtggttgtgcgccggggcaatctctgcttgcgttttccaataagttctattgctttgacacatttagtatataactgaatagaaaacggaataaaagcggataagatagcgtattaggccgacaagtaggaagcatagcggggacaagttattaccggtttgaggggacaatggttttctaggttgtttcaccaatctgttgaattggaatggagctcacgaccgtgaaacccctcgttgtttgatggcacctatcttgttcccttcagggagaaatactactcacttttcctctatcaaaaagccaataccgacgctcgcttatcagcttaccagttcaaacctccttgctctgccttttataccagatgcctcctctcttaaaccaaggcatactctactggctttccttctctaaactattctttatctgctatctatgc

SEQ ID NO: 106629 - DNA, 857 bp, Oryza sativa
caccaaagcgctcatgactgtgagtacggctaatcgattagtttttagaactctgcaaagtttgtacagctttacccacatgatatgaacactctagtttgtctcgtgttggccaaagcactaccacactctacacattgagagcggtctagaggtcataacgaagcctttacattacttagagcctagccttgcaccagcacgatacgtgttcctccatcctaggcatacttggaatatgtctagaaccgttaagtggcgagcccacgccttaaacttaatgccgtggtggcggacacaacgagaatccaccacgtggcacaataccgttgtattggacacgcttagtcacctaaactactacttcgggtaaataggaagctcctctgaattattcgaactcatacacaccggccaccagaatgcaaggctagttctaaatagattaatcagcttaggccatcctatactagcacatgtggatgtacgaataactttaagttggtgacacaagttatgtccttatagacttgggcaaacactccccctatcggtatgcaactaacaccatatgcacaccacttgctgcccaagtctaaaatcacattttacacattttagtttacaaatacccatcacattcattttattccagcaaaggttcatgtgtccaaaatcacattttaatcacagagggtatgagcatttgcatatttctaagcatggctaagcaagtagttgcacatagagcatatataaacccaattgagcacaaagagtgtactctaaccattcctagtggttcaatcagcaaggatcacaattattcaaggtagggaatgcagcaaataggtcat

SEQ ID NO: 106630 - DNA, 696 bp, Oryza sativa
tcttaccggaacatatctctaaaggaactatttaaaatatcttaattaatagatacaattaccttcccaggactcaatccatacgtgacaatacttgggcaacacgtcgatcaaacctgaaaacaatcctagaaccaactcatcggcatcggctacatcggctattctttgttcgatccaatatcagccgatgtaggcactagccgatgctcattgtagccgatgcgtgctctgttcctgagaaacgatcctctgccaaatccgcttcgatcttgacctcgaacttgatgtataatttaccaaatttggtcgtcaacaatatagtatttctatacatctaaaatttatacacctaaagtttatagacccaaagtttataagtcaaaagtttacatacccgtttcaaattttaatttgaatgtattagtttatagacccaaagtttataagtcaaaagtttacatacccgtttcaaattttaatttgaattcaaatactttttatatagtatttctaaatataaatttttccaactttgtttttttatttttttaaaatttatggtgtagtaggaagagaagaggaggaggaagggggagaggagtgtacaggggggatggggttcccgcagaaggtgactttttcaccggggttttccaccaacgaaaagaacgaacaactggcagggcaactttg

SEQ ID NO: 106631 - DNA, 2573 bp, Oryza sativa
  unsure (1)..(2573): unsure at all n locations
acttttttttccttaggtattttctaccaaatggtgatataattaaggaattaattttaagattactcataattatttatgaccaatggtgttttgactatgaaattctaagtttattttgcacatgattgattaagccatagtaaactaattatatgcaattatcaatgcttattatttaagatcagttgcaatactgagtaaattatttctagataaatggaaccaacgggaagtttatctagaaagaaatgatttcattaagattgttatttccttaattattgtctacctaacgatgantgtaaaaaaaattaataagggaagaaatcaaagtattatcaattattattttctctgtcattttttatttatgccattagtgcattaactccttttatcacttctaccttgcggtgatgtgatcgaggatctaatctatccgtaagcttaattcctttaccatttctgcccaacgctgatatggctaaggattttaattttaattctatggcatcactaatggcatcatttcctaatcatttctaccgtatggtgatttgatttgggattttaaattatttactttatcacttctaccttttggtgatgtgacttaagacattaatgtttattccctaatcatttctgcccaacggtgacttgattttcgattataagtaatctcatctattaattccttcgttttttctctgcccaacggtggtacaaagcgaaataaagattaagttattattgtgtaagttaatgtgctattgtacgtaatttgcacaagcaaccacaataatagtgccacttaattttatttatcagttaaagtctatggaattattattattattcctcattgacttaactgagcctaaggcttatttgagtatgacttagcattaacaaaggattccttgtggctcccgcagctaatgccactaattttttcctaaactcaagaggcatctttagccaatataatgctatgtttcgcatgtcactcataaatattgagattatcatccctgttagtgttaggggtgaattttgagcatgacattgcgaaactgtatctagctaacgttgagatgaactttagaagtttgttaaaactaatgcttagtataatttaaaaagtagcacaagaaataaatcacatggcgtgcaaacttagtgagatgtacatcgcacatttcatatgcgccacttgtccatttcatatgattcttctcccattagactacggtcattttcagagttgtaatactaagacaaagtggaccataattgacttggttcatcattccgcaaatcaataagaaatatggaagactaaggagcaaactaagtaagattctgttaatcttgtcatttgatggcaaagatgaagcttcactaagggggagtgttgcaacttccaaatttaatgataataaagctcatattccttgcaaggggaattcaaactgcttctatgtcctatgtatgctactcttgaaattttcttgtgtaagttctttgcaagaaatagggacatgcttaatgtcctgatttaatggcattattttggcttgaatcattatgagacgttgtcgaaattatggccttattttttcggccacatttctaggggagaatatacgtctcattaaggtcgagacacttcacccttagaaatttctgacatctattattacttaaatgataatttactaagtaaaattaagtgattcaagtttatgaaaaataagatattatgcttccattaaataaataatacaatcagtgggagctcatcaaaagctctaataagagaagattattctacctcatttatgactcatagctccattatgtggacgctagaattttgtatctcttaatttgtgacttgcacaattaaatatacataacatgacttgagggttttgttatggaaatacaagtcacatatagggtacagacttaagaaatccatttgtggacttaatcaaacattgatgatgttttaaattccgctgcgtcattagtgaactaagcctaaataagaatgaggagaataattattctataatgatggaagtaagacgtcattgaaattgtgccattgtcgcttatgtcacatacctaggggagtttgaaacgtctcatgagatagagatattctttcccttaaattttaatggcgttgtttagctttaagtgtaaatttcacaaagttaagatattagccaacaaatgattttttatggctatgtttacccattagcgacctccgatttcctttaagaaatttaagacactaaagctaaaatcaaatgaagttatgagatcggattatggtggtaaacactaaataaagcttgttcaccttataagacattaaaaataagcattcatccaaatggttttcgaaccatgtaagaacaaattgagatggatgaacaaaataagacattaaagtgttcatctaaatggttttcgaaccatgtaaggataattgagattgatgaataaaataaagaatttagtagaagtttctaaatgagtcaaaatagtgg

SEQ ID NO: 106632 - DNA, 1572 bp, Oryza sativa
aaatagattaatcagcttaggccatcctatactagcacatgtggatgtacgaataactttaagttggtgacacaagttatgtccttatagacttgggcaaacactccccctatcggtatgcaactaacaccatatgcacaccacttgctgcccaagtctaaaatcacattttacacattttagtttacaaatacccatcacattcattttattccagcaaaggttcatgtgtccaaaatcacattttaatcacagagggtatgagcatttgcatatttctaagcatggctaagcaagtagttgcacatagagcatatataaacccaattgagcacaaagagtgtactctaaccattcctagtggttcaatcagcaaggatcacaattattcaaggtagggaatgcagcaaataggtcataactaacttattccaaattttaaataccgatatagtctaagttcacatgcaactttgcaaacaaatattttcattcctcaaatcatgggatttaatgtgttcaaaggatgggaggagaaaacttgccttgatattgagaaatgttagtacctaatccactccttcaccgattatgcaattatctaaataaaggacacgttatgcatttaaactccgaaacaggtaaaaatccaaaatgctctaaaaatgcatgatttgtgcactgtgagttggtactgttataaaatgaatttaggtggaagaatttctattttatcactttttatttgtgaattatgaatttttagaagttatgtcggtatatagtagtataggtttagatagtgctataaaatatttttgcacagtggtttttattatatttgacttctcagaggtatagagatgtgttttctaagactaacacatttggtttcacaatttttagagttattatgaattctttatgcattttacaagttataacgtattataggtgtatagtgtcctatatgcacaggcctttggtatttgaggttcagaatttattctactttgtttgtgatgaatgaagcaaataattttgttaactagagggcccttatcattttagttcatattttataatctagaggggttctatatggatgactttataaatatcaacctaggaattatcatatgagctaagttcctctaagttttggtgaatggggatggaactatggcttggttctaacaagttttattttggtttgttcatagctagagtgtatttcaaatacctctacacatttattttacttaactatcactaggtgattaactcctaggttatctatttaaagattagagctaaaacatatacaaaaggtgtcatattttattttactatgttgaagttcaatattttctgattctatagaaacttggttcatttcatttggacaaaaaatgaattttctacaaattttacaaattaaaggctgttctatgttagtaaatccttacatgaatattttgaggcttttactacacagtaagtatatagttttatttttataacttggaaatacatgttttggtggggtaccgagctcgaattcgccctata

SEQ ID NO: 106633 - DNA, 1091 bp, Oryza sativa
agttcctctaagttttggtgaatggggatggaactatggcttggttctaacaagttttattttggtttgttcatagctagagtgtatttcaaatacctctacacatttattttacttaactatcactaggtgattaactcctaggttatctatttaaagattagagctaaaacatatacaaaaggtgtcatattttattttactatgttgaagttcaatattttctgattctatagaaacttggttcatttcatttggacaaaaaatgaattttctacaaattttacaaattaaaggctgttctatgttagtaaatccttacatgaatattttgaggcttttactacacagtaagtatatagttttatttttataacttggaaatacatgttttggtgatcctaccgaacttaagtttacccaaattgaagctaagttaaattttatatgaatttctaaagtttagcttatctaaaactagtcattttaaaaataatagctttagaggcatttcatacaaagtaagtatttaccttttatttcacctaatcagagagtgcaagatgatgaatctgtagaatttgagtttattataaaataagttaaattgaattttctatgcattttataagtttgtgtttgttttatgtatgatttatcctagtcaaatttttgaggcaaagtttaaacagtgagtgtcaagttttatgtttctaaattaaagttcataactttgtgaatctatagcaactggaatcatctcaaaataagttatatttgattttatatgaatttcgcaactttgggtgtttttctgttgaaaataaaatgtttagatgatttttctttacattttcagatttttataagcgatgggtccaccctgtcagtgagagaccaatatgcaaaaaggcctctagggttctagagaatagatcccgaggtccctagtacgagcacatgttttaaccaaattcattaagagtccttgagttttacagtttttactaatagattcttggtcccacatgtaagtctaatatattttacattttaaaccttacaaaatttaaactttctctaaattaggt

SEQ ID NO: 106634 - DNA, 954 bp, Oryza sativa
aaataaattttaaaaataattttaattttaataaattttgtatggttttgtacggttttccacagttatcgcggtaaccatacttaccgtggcatggtaaccccggccggcggtttgggaaaccctacaacatatacttcatgagaaaatcgaaatatcatcatgaactgacaagtgagcattggcatcgcaaaattcaccccttttgtttgacgtgtctaagagattgcagcttggggaaaaccgtggaggatccacctattatatgagtctaattcaactcaagtggcatgtgttttcataaaactttagctgcatatctccgctatatacatgtcctgggtataacacctaccaaacattttagttgaactacgtgacttgatttagaatagctacattagcgcaagctgagttgagttagataagttacattagcacaagttgcactaacaggggatattttggagagcaccaactagaaaatcagaagtaactaagaataaaaccaacatcctaacaacgcatcttaaaaaaacagagtgaagtgaaacaaaagaggctatcacaacattctgcacgctgtttaacaacagggcagctaacaggtagcttaaaatcacgagcttacagccacaaaggcagctaacttaacctcggatcatacaaccagttaagtacttaactagagataaaagttattggcagatgtaacgcatgccttcacctactttcatggttcttatttttcccccacaatctcagccagctcaccaatcttacctagagttcagatcgagttctcctgatctgcgccagtcctcttgcatatcagagttcccattctcaggttcattttcatcattaaggaaatcttcagatggatcttcatcgtccctttgagcatttccccatccatcttcaccttgctcttgcatcatctcatgactaggg

SEQ ID NO: 106635 - DNA, 671 bp, Oryza sativa
ccggattaattttacgagtctttacaattatttgtaccataaattatatatctatttttatttttcaaataaatatataattttaatatctatattagatttattgcgttctagacctacatccatcttgagtgctccactaaataaaagaaaatattaaaatttgtcattgaaaatcaaaatatgctagcttattttttaatgaaactgttaaacccattaaaagtacattattagacatctaatgactttctaccaacttaattaatttcttcataaaaaaactttattaattcctcacaacatacacctgggggctatttacatatacgaattgatcttgatgcttttgtaaataaatgatattttaaatttaaaagataaataaacgatcttaaaatgatcatagcatctaaatcatacatatgattgctcctagcactcctaaacacttctaagtcgctatgtggcattctattaattacaaaaacactcatataatcgaccatcggtttccacttaaaccgatggacccaatttttataccatcatatctatcttttcggaaaaaacaaattctatcagaatctctgtctggctcactgcataacatgcatgtgtgcgctcctataccttttaaaccggtagaaccattgtttctacaagtgtta

SEQ ID NO: 106636 - DNA, 568 bp, Oryza sativa
cattccaatttcaaccaaacttttaattttggtcgtgaactaaacacatccttgtttcaaaatggaagaatggagtaggtcgtactagctcgagaaccgcgtggcaaaaggagttgtggactgactgtcaaggagaagctccaggagtaggtgacggaagagatccagcgcctaagattactcatcatgatatgcctctcaaatcttggtgatgtcatccaatagtagctggtggggtggcattttagctagagaaggataggtacggggagagtgttgatatctaatctgatcttcgcctgtcaatcgcgcttgagatgacctgtttttgatggtctgatgtgatcccaagatcccatccgatctgcagccctggatttactgaagccacctgctgatgtagagtagggatagtgttttatccgttcttgctcgttttgtcgcctcctttctggcgcagagggaggaaacaggaaagagatggagtagtaagtttgaggttgatggataaacaagatcaggttaatattagaacagactgattagtgatcactgatgtgatgggttg

SEQ ID NO: 106637 - DNA, 665 bp, Oryza sativa
cactagcagtttagtactgactgaccaacaccaccagagaccaaacatggcattgagggctggtttggttgggggtctaaattggtcttactaatttttggcaatgccaaattttatcaagttttggtatggctaattttggcaaggtaaagttgcgtttggattgaacccaaaatagcctaacttaactattgaaatgatctattttcttaggcatgccaaaatttgacttcaaaccaaatagacactaaatactattaaaattactaaatattaataagactaatttaggcctcaaaacaatccagccctgaaggtagggcagagaatccggagtgagatgcaaacaaaaaaaaacctgaaaccacgttcatttcagctcaggcttcaggcggtagctgggccagaaaaaagggagaaacgaaaaagggcagggcaggaccgcaggagacggtgcacttccgctgacaggtggaccacagactactggtttactcgtagtatgatgaaagaggagtagacgacgagtagttcttgacgctagtggtggtggagcctggaagattcgggcatgtgtagattctaatttttttctttaaatttttaactttttcatcacaataattttttttacatataaatctttaactttttttgtcacatcg

SEQ ID NO: 106638 - DNA, 653 bp, Oryza sativa
cattcccaattaggtggactgaggatcaatcctaagatttcattcgtggcttgtacttaactaaaaaaaatgtttttttccctcagtgtttgtcccaatttcactatcatattaatctgtttccgcaaaactaatataataataatattattattacagatggttactgatttcaaattttagtttttccaatttctgtcggtgtgacattgaagttgacagtttagttaaattcataaatatgaaaatttcctaattgtttccgttcatttccgaaaatagtaatgaaataattatattgtttccatccttagcccgtggtgattttattaatctcaagatatatcagctaagtcttttggatgtactcataggggtagcgtgtacatgtcagcatgtgagcacctgcgtttcttccatgtttgaaaaaacaaaacaaaatcttatgcttttaaactttatatatatactagaaaaaaatgctcgtgcgttgcaatgaccaacgggagaagtttattttaatcttattattattgttatatggtttagttaagataaaattcactgtgggagttcgcttggatatatatatatatatatatatatatatatatatatatatatatatatatatatatatatatatatatata

SEQ ID NO: 106639 - DNA, 709 bp, Oryza sativa
cagaaaagatccatcataaaaatataattagttgactcaatcaaatagtatgaagtaacagttttgatataaagtacatgtagagatgggaagccaatcaactattactagctaagcatcatgtttcatgcatattaaatccatgataagaaggcatggaataagttatatacttgttcaagcaaaaggcacatgcactttttagccacgtaagtagcacaatttcttgtatggaagtttcttatctcaccatgcaaagaggatatgctaccagcatggagcgtggaagtgctgaggtgaagtaccaatggatggaatgtgtctaaagtttatggtagtcatggataacagggctgggagcttcgcataagtttcaggagataatacatagatttcaccacatgaatctaaaaagaagaagaggataagtcttgaacaagaagtgtatatatgttgcatccttttttgtattcatgtgactaatagagattaacatcatgttcagtgcatatgaaaatgaaacttcaatcttcccaatcttaatacaaaagatatgtgctttgcatattctcatatgaaatgtctctgtgaagtgacttagtgaaagagagaactgatgcatatatatttggtagtaaaaaagaataaaattctggctaaagagaaaggagtgcatatgaaaatgtctccgtgaagtgacttagtgaaa

SEQ ID NO: 106640 - DNA, 2196 bp, Oryza sativa
gggaaatgaactacgtgtatgtctatataatccaaaccaaagactatcttaggataaaaatattcgtctgggatttatccatgttattatgagtaaatttttactatgagtacttttcctacaacagtttctaggtatgcattacacacgaagtttgcactacacattttttttcaggtttaaaagcagaaggcactaaccatgtaactaaaaataattttaggataaaaatgttatgcaaaattgtactactagtctaaaagtcaagactggatagaaaaagatgaaaaaaccgcttgtacttctacggatccaaggattctttttttggaaaattagagaaattcaatccaaaggaatagtttttatgtaggtcatttggtttttagatttgattcaaatgaatttcaaaggtaggaaaaaaaccttcacattttagatgaattcgagcataaggtctaaccttatgttttcatattcttttaagagtttcccatgcaacttctctctcccttctctatctaatatatcaccatacagtcttaattttcatatatatatttcttttttaatcatgtgttttttctattcctataatttttagtttctattgttccaaagaaacctataatcaagtactactcccttcaaaatttatccagaatataatactcctagcacacttgctcttttatcttaaccaatcacaacaatatctcatttaatatattagtctacattctctttttaactaattataacattattctatttaatttccatgtacttatgcctgactcgtgaagttattactatattttaggacaataagtaaaaattttaaagttggctatgtctaagggcatgtttaggggagcatctagctattgtagcttctctcagaatcataggcttcccaaacagttcagtttttgatctagattctgataagctgtagctgtagaattcagaaaatgaactagaactcagaagctggaaaacctagcttttctagattctcataagctggctaccaatcagctgcttcttataatcttaagctccccaaacaggccctaaagctcaaacaaacatttttttataatggaaaaatccattcaatagaagttatagccacttattatattgtctttgacacacatgagccaaaagtagtatctaataaataatgacgaaaagacaatttagccattaaaatgaagagatacaacttattcaaaactcaattctatatctccaaagttgacaaatatgtgcatgattgttgtctctaatttttggcatgcaaaaataaattaattgattgtccttatcacacctttgtaacttggctcaaaaccgaagccaatatataggatttagatgtagttttataaaagaaaaaaaatcattcctactaaactatatagccatgcataaagtagatactccgagtaaaatatatcttttaatacattcaaaccaacttctaaacagatgagtaaaactatttaatatcttcagatcaaaagtaacaaacataattatccaaagaaattttagaaaaataacaaacaaattaagaataaataatggataatttcatcatgcataaaaaacaacatttagtattaccatatcaaaatccttcttactaaattatcttttattagaacaacccttttagctgaaacataccgtcagcatataactctctagtctttacctgttccactgtgaaacgagagaggcttaaagagagacgcagctttagagcagatataatagcaggctataaactagctataaacatattttaaagagataaagtataagagagaagagcagtgaactacagatctatagctagctgtagcacggacagctttagagcaggtataatagcatgctataaactagctataaacatattttaaagagataaagtataagagagaagagcagtgaactacaaatctatagctagctgtagcacggacttcaaaacgtaatgtgtgtatgacaggtagggccatgcattaatagcatagtaagcaactattgtatgaaataactattacatttgttataaatgatttggacctagtagttgtctatactattaaacttgctcttacagtacacagtctaaagtaacggcagagttagctaaaaaaatgtcatgatataacgggt

SEQ ID NO: 106641 - DNA, 648 bp, Oryza sativa
aagatgttttcaccggtattttggtacgtcatttgtgtttgatttgggttttaaatttggtcgtttttaaatacctattcgtgtttgagtcggattctaagttcgtttgcttttggaaatgcaaaaggagtcgtataagaaatctttttaaaaacttgcatgctaacttgagataaatgttggactcctaattgcagctcatgattttctagaaaaaataatcaagcgaattcccatagtgaaattcaccctagccaaaccgtataacaataattaggttaaaatagcatttatctgttgcaacgcacaagcatattttctagacaaaactcaattttgaagattattttagaatttttttaatttagcttccttctaatatttgtttttaagtcgttaaatacacacacaaataagcatgtgattaattgagggtggattatttaaaaaatatttgttttaaaaagtaacttctacgtatattttatataaaaacaccatttatcaattttaaaaacatactagcaaaaattgagaaaataatcaagccgatcctttagtcaagagcagacccgaagaggctagcatggggtagcgcctgacccagtcagcatctagctcagttgagaacttgagattcgtgagata

SEQ ID NO: 106642 - DNA, 1786 bp, Oryza sativa
atagccaatctaatagtcaattcatataatagttgtttaatatactattaatatatggtcccatctatcatacacaccgcgtcttatagtccgtgctgtagttggctacatatttgtagcccgctgctcttctctcttatcttttatctcactaaaatatgtttatagctggctaatagtctactattatacctgctctaagcgaagttacacgtaagcacatttcagttggtcctctgcatgcattcacaaataggagtatataatatatcgaatcttcagtcgagcttatgaattccggtcctttggtgcattctcggcagagcattgcaaacgagattgtgattaagaaactatgcattccggtcctttggtgcattctcggcagagcattgcaaacgagtaagaaaatatgctgacataaaatatgctgacataaaaatcttatagagagcctataaatctctacaagagatccatgtcaacatattttcttacttggaagatattaaatgaagagagagagcaaaactatctactaacctggagatagtctatagagaaaaacgaggcaatgcattagagagctatagataccgatgtagacatactattgaggtgatttactattaatctagtctattgctgagatgtacatgttttatagagagcaacttactttaccattgcgggtgctcttaggcagtaccagtttttattaacggatgcagatggaacggtccagatcagccaggcgcactgttcatcgtactgtagcagaaaacactgtagcacagaatactgttggtgtggtcactgtatcgctagatgactagatctgagccgttgatcacagaaatggatggctgaaattgcatgcagttcttaagttgcagtcatagctataactgcacctgatctgaatcggagttagcattggtcgctggactggacgaccaagggggttcggaatttgtttctctatccgaaccccgcgggtcagaaatttctttccctatttctcctagttattgcagcctgtattgtcaccttcttcgacgacgtttctatgtcccaggtcttttattgagggtttccttttctatttactattataaaaattaaagatgttttttccggtattttagtatgtcatatgtgtttgagtcagtttttaagtttgttcacctttggaaatacatattcgtgtttgagttggattttcagctcgtttacttttagaaatataaaaggagtcgtataataaatctcttttaaaaaactcatactaacttgagatgaaacacataatcctaattgcagctcatcattttctaaaagaaatattcaagcaaattcccacagttaattttaccaaacctaaaccatataacaataataaaattaaaatagaatttacccgttgcaatgcacgggcttttttttctagttcagaaaaaaggtaaaattgcataaaccactccaattaaataaaaaacatgaatattatgaaatggtctgatattaaataattagaaggggtgaggacctagacgggctagcccacctctgttttttcctgtcttctgcggtgctacattatcgccattgttgcaagcatcaacaattccaaactgtttacatttcatttgagactctgggattcagtgattttgcaaacctggacgagtgagggggtcggacttttattctccgaccgattttccttttcttttttttgttgtttttcctatcgagggtatggtttagagatttatcgctttca

SEQ ID NO: 106643 - DNA, 694 bp, Oryza sativa
ataatagtctatatttaatatttataatcaatatccaaacattcaatgtgatagggacttaaaagttttagtacaatctaaacaggtcatataattgggtccatagccatgcatggtaaagtacggactttgcgacagttgagctcccatggtcgctcattttccctaataaaccaaaactacgtgttctttgcgacttaaaaccaaatgttgaagaagaaattacgttgaaaatagcttaaaatcttcttcaaaattgagtttaaaaatttaaattttagcgttggcttattatggcaaccaatagagctctttgatgtttatgttctctcttcaggcgatttagcagcagagaatgggaggttgcaagctgaaccaaattcttgcttctgccgttctgacttcagcggcacatatgtacgagtgaatagcactagtatcagcgagaagaattccaaaaaaaaaagaaaaaaagtggaggtagactatgtgtttatgtgtttagttccaaagttttttttccaaacttccaactttccatcacatcaaacctttcatacacacataacttttcagtcataattttttaatttcaactaaattttaaactttggccggactaaacacagcctagctagaggaacacgcttgcacagaaagtgccggtgctattgacatcacagtccagtttttt

SEQ ID NO: 106644 - DNA, 1954 bp, Oryza sativa
atggggagtgatttccccctctttattgcgcgcggggacggcgggaggcggcgggattcgcggcggcggcggcgctagggcacgggcaaggcggcgggagcggcgcgaggtaggggatgacgggtgggccccacccgtcagcgagggtggcgggcgggcccgcccgtcagcggcgcgcgcggggagggggccgattgggccgcgggggacaggagagagaaagggagggaagtgggccgagccggcccaagaggggaaggggggggggaaaaagactttttagggtttttctttttataaaacccttttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggattttacttattctatgcataattttgaggatgtattttagagtcgtttcgggacgcgacatctaagcagcggaaaataaaataaacggcgcagacggctccactccacaggcaacttgaccagggctacacctaatcctccacaccatcagcatcattgtagaactcttcctctgatgaatgatcgcaaggtgagtatatgacatactcagcaagccacgcagcaaatatgcaagtgcacaggataacaaaggatcgcataatagggtttcatttgcaaaagcagcatttagcaaacatttgagaatttaataaaacagttaagtaataattaaacaatattaatccaacactatacaacatacccggctgtacagatctatctccaaaccaggaatataccattccaaaccaggagctaaacaaattattaccagttatagtatcttgcattatgatgagaggtgtgagacaaatcacgaaagacattgttagaccccgccataacccggggcacgggtattcgaataagtttactctgattagaggtgtactactgtacccacaagacacacgcccacatcatgtaccatgtgcctcaataccaccacggtacctcggaaaggagttgtgacaataccccttatacaacacaatccattgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggctaatgtttcacaaccgaaactcgtgaaccggtccttaattgtcatgagcacgaccatcaaaaccatatgctcacaacccaccattatcaggttttagttggcacattaattaattaaccaatcacgattgaccatcgtgaactatcattaagccatcattaaataaaagtgaatcataagttatcccaatagtgtgctaatgtttctaagcagggctaagcaatcatatctaatatctagctgaaccaatatatatagcccaactagtcaaattttaataacccgaggtatcaaggagtaaagtaatcaagaacaaaaagggctataacaaacaataggttaattccacccaatgacattcgtaaatagatgcaatagttgaatagaaacaacagctttaaataggatcaacatgctcaaagggttgttcgggatctgtgtgacttgccttgctggccttggaactcttcaaactcttctcctgcgaaaacggactctccggaaacgtcggaatctaaacagaaagaagcaaaaacaccaaaacaatacataaacaagcatgaactgtacatgtggatatttttaacatgtagatctcaattttaaaaaaatttagagacttgaaccaactaaatccgagctaagatgaattagttatgat

SEQ ID NO: 106645 - DNA, 670 bp, Oryza sativa
caagtcggctgtattattagccttactctaagcaaggcgctcgacgtgggagcaagggaaagtggatccctcggagctcttacctcgaggggacagtgacactgtaaaatcaaagtgtttgattattattttgtgatggacaattggtatttcagattatttgttttgatatttggagataattagtgaaatggttttgaagatgattggattttcaggttatggacaggattgagttgtctaatgattgcagtcaaaccggctgggttaggccagtcagaccgaggctatgcgagcagtcagaccagttagcatgcggtctgatcggccgacgttgtgtcaatttcagtttagggttgattatttggatatccgtgaaaaattcatgtttatggcttagtcaacccaccgtgacacgggaccactcaaacggtcaaccgaaccggcagtttaaaacgactctattagtaaataacgacttgggatgaccgaatgaacgaggctttggactatacttcgtgcgaacgaacgattagcggctagcgaatggctccggcacaaccagtacacttaactcagtttgcggaaatggcccggtacgacaacgataggctagtagtgattcgagcttaccgctgcggctaggcaactcggctaccaagcgacaagc

SEQ ID NO: 106646 - DNA, 743 bp, Oryza sativa
agatcgtcgggtaagaaaccatctataaaacagacaatgttaggatggtgaagaagagccgctccatgtgcatctcgcaagttaggatggtgaattgaaaagaaaaaaataagaagaagagcctctccatgtagttgggccacatggcaccacaacccaacagtgtgtgatcggaccagtgcaaacatgtaaaagagggaaaaaagaaaaaataaagagacaaaaaattactttttaaaattcttcacaaattatccagggcaagtattgtgaccacatatcttatgtttcgagaaactaaaaataatagatagaaaactaaatgacagaaatatctgctccttctttctaatattgaatcaaactctataatcctaataactattttttaaatattgtttttttttgcttacattataaaataaataatatctagatctttcaaattttagaaaaggcaacgattatgataaaacaaaatatctaaatttttatgccaaatctaaacacaaggatactcaaaatcgtaaagaagaattgaaatattagtatgttaattatgtggtttttagaaatcatacacacaggctaatcaactgacactggtggagaaaccatctttcgtccgtcggccaatttccacaatagtcccggatgcaataaaaaccggggctaaagatcatctttagtcccggttcgaatgctgtcagggcctgtcaggcccccccgggatctttagtccc

SEQ ID NO: 106647 - DNA, 756 bp, Oryza sativa
tgtgttgttggggatctgtgatgtttgagatggatctgtgatgttatattgggggggtgatgtatctgtgactagaatatatctgtaatgtatctgtgtttcagagggcatggctagcaaatcctaagactagccaatatttagcatttatttattttttctgaaattaactcatcagtgacgggtcggaacaaaaatccgtcaaaggtaacctaacctgtgacggactagcaaataaagacccgtcagaggtgacctacttgtgacgggcctttacttttggggccgtcacaggtagatcacctgtgacagcttctaactacggagacctcaacctctgacggcctttatttaaagggccgtcagagatgagtcacctgtgacgggtcctaactcgccctagtctagcggagaccaacacctctgacggccttctagtaacttgcccgtcagaggtgggtgtcacctgtgacggatgtccacccgtcaaaggtgactggactcaccagtgaccactgatcactgaccatgcgcgaagccgtcaaagatgagggttggggcccgtcacagtgtgccattggccagtgttgtgtcggctgatgacaaacatgaaagtagatatcatatgattaagtggctgatttagcatttctcaaggattttggtggtatagatttcagtgtatctaggtgctttagactcagctttgcttactaaatgggcggttaaagtagagtttcataataacagtttgtg

SEQ ID NO: 106648 - DNA, 607 bp, Oryza sativa
acatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaattttcactagagttttccttctcaactattttataaaaacttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttactcgggcagctggaggaggaagaagacatatatataggggtgggactttagtcccggttggtagcaccaaccggggctaaagatcaccgggatctttagcc

SEQ ID NO: 106649 - DNA, 1206 bp, Oryza sativa
atccctcaacaccaaacaagtattcaggcttgtagcgcggcatctaaagacaagtgaaaggagggagttaagacatctatccaattaatagcacaagtttttggattaattttagaaattcaaagtaaaaggtaaataaataaagtaaaccaagtttgcaagataagttggaaaagtcagaaacaatattacaagttttatacttttgaataacaggttccaaaagaaataaaagaaagttataaaatcaacttgctaaatttattttattgcagcaagattaaatgaaacaacattgtaaaacttttgctggaaaatgagccattagtatagtaatagatgtacagtactaataacactggaataaattttgaatgagaaccattaaaagagattatgaagtgcatgtgccattagtttggtttaattaaaagagaaagggagaagaatagttctacttttccaatatttttagagggcttctatgggtaaccatttggcataacctagggtcaagggagctctgataccaacttgtcatgcccggaatttctatccaaaattccaaacgcttacatgtgtgtaaaccctcgtccaggaatcagccgaggcacacaataacaaattgataatagagtacagttattactctaattattaagcgtataaaatatcattacagaggtagatagttcctctcaatcaataaagatctaagcagcggaaaaagataaacggcgcggacgactccactccacaggcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaataaaacagttaagtaattaaacaatattaatccaacgctatacaacataccctgttgcataggcccaaccattttgaacaaccatcccggctgcacagttctatctccaaaccaggaatataccattccaaaccaggagctaatcaagttttaccagtatagcatcttctattatggtgagaagggtgagactaatcacgaaagacattgttagaccggccataaccgcgggcacggctattcga

SEQ ID NO: 106650 - DNA, 599 bp, Oryza sativa
tgcctgcaggtcgactctagaggatccccaggatgtggtatgcaagttatctattaattaggaatagtttgttagtttccttttatctttacggaagtgcgtttagtgtcctataaggactttatgttttccttttatttttaggaaagtttctttcttgtcttacaaggactagtatctccccatgggtataaatatgtacactcggggtcatcgtaaactatctctcgatcaataatactctcggcgcatcgccaccctctttaccgaggttttccttatcattcggcggaacttggcacctgatgtggggttgcataaactttcgatctccggcgaaggggtaagtcctacgttccaccggacctggcaactatattggcttcatcggcgtaggtcaattgctgcctcagtacgttcgatctcttggattgctctggttcggtcgatatattcacctacttatctatcatatgtctctattaatctagtcttagcatatcaatgtagctatatcggacgcttctagctttaaggattgcgctggtatcagctaaatcgtgttgctagattagattaacttagacattcaccaccct

SEQ ID NO: 106651 - DNA, 737 bp, Oryza sativa
gtaccccaagacacagccccacatcatgtcaccatgtgcctcaataccaccacggtacctcggaaaggagctgtgacaataccccttgcataacacaattccaccgcagcgcacctttcgtggatcataatcaccaccttataaacaaggcatggactccccagcgacccccgtggggcttatctccgccacttctcagtctggtgctccgcaatgaaccatgctatacaaaagataaagccgttgcccacgctggcttgtggttggcacggttaatgtttcacaaccgaaactcgtgaaccggtccttaattgtcatgagcacgaccatcaaaaccatatgctcacaacccaccattatcaggttttagttggcacattaattaattaaccaatcacgattgaccatcgtgaactatcattaagccatcattaaataaaagtgaatcataagttatcccaatagtgtgctaatgtttctaagcagggctaagcaatcatatctaatatctagctgaaccaatatatatagcccaactagtcaaattttaataacccgaggtatcaaggagtaaagtaatcaagaacaaaaagggctataacaaacaataggttaattccacccaatgacattcgtaaatagatgcaatagttgaatagaaacaacagctttaaataggatcaacatgctcaaagggttgttcgggatctgtgtgacttgccttgctggccttggaa

SEQ ID NO: 106652 - DNA, 1912 bp, Oryza sativa
gtcgtcttcgatctcctttgcttgcgtggtttccaccgcatctccagtaggtacataaacatcttgagactcctctttcatagcaatgacctccggagcgttggcttctttcctcacccacaccttcttcacctttttcacttttttcacctttgatccaccggaccgattcttttgtgggaaacggtcctgccttgggttagacgaatgatttagcactgtcctaggtgattccttccatccttgataatacggcataggtggttgaggcatccatggcatataatacataaaaggataaccatatagtgacattgaatatagataccatggcatcacaaccggaggtttgtatggagttggtatggttgatggctccgattgctttgatgtttgaccaaatctcttcctacgagatgatcttggtctttttgaatcactagtttgattatcaactcgttgaccagctaatcctttcttgtacttagccataagcatctcaaaagtgagcttcagttttttggtcttttgggaactagatgactcatcctttgcaactttacgatcttcggccttcgcatttttgatcctattcttgggccgaggatccccaataataacacttgtccctttctttttgtcaacatcaatagaattaatagggagaggatcactaacaatttcgatcttagccatagatgtaaccgaaatagtttcacaagtgaccgatgaagtatcaatcggtctttgctccattaagcttgcatctttgaaataaccatgaaactcatgctccatttgtgaccatgtagaaattgaattaggagcaagtaaactataccatgtagatgcaaagtttgacaaagaaagaggaaacaactttaacttaagcaaatcatcattaccggccttaccacattgatcaataaattggccgttatgctccattgttgttctagcatcctctcctatgaattttgtgaagttgagcacctcaaatccttgtgggtatgggaccgaatctatgtgttcaggatacggtctttgatatgtatgtacagctactttggattctatctcactactatcccgcaagacattgtcactatcttttccaacatccacatgaccgatttgtaattcggtcttaggtgacaaagctatttcacttgagcttgtgatacaatccgaaccgtcatttagttcggctatatcttcgatggcattattctctaagctagcaacacaatccgaaccattacttggttcggctattccatcattgtctaaactagtaacacaatccgaaccaacacttggttcggctatattggttattgcgttatcgtccaaactagtaagacaatccgaatcaacatttggttcagctatactcgttacagcatcattgcacaaattattaccacaatccgaaccattgcttggttcggctatacatgatattgcattttcatctaaactagcttgcaagctattatcattcactcggctttcctgagccagagcttcatgcaacacatgatcaatatcaagaaatatctggccattcaatttctctttatagaatcaagcaatccatcatatgcaatgttggccaaatctttgtcagttattttcaaattgaaacatcggtttttaacatctataaaccttttaatataatcagcaacagattcattgtatttatgcctaactgatgttaaatcagacaacttaaacttagtttcattagcataaaaataatcatgaaattgttcttctaattgagcccaagtatgaatagaatttaaaagtatcactattagcctcaccacattgcgccagaaattgacctaaatgctcccatgtggtcttaccatcctcaccactaaacttggcaaattcgggaact

SEQ ID NO: 106653 - DNA, 550 bp, Oryza sativa
tttgcccgcagcccttgacgccataccttattgtactatggcgaaaggcatggcgtgtggcaaaagctgttcacccgcagcccttgacgctgtaccttattggtactatggagaaaggcgtgggtgtgatgaaacctgttcgcccgcaacccttgacgccgtaccatattggtactatggcgaagggcgtgggtgggcgaaacctgttcgtccgcacaccttgacgccgtacctcattggtactatggcgtagggtatggcgtgtggcgaaacctctttgcccgcagcccttgacgccgtgccatattggcactatggcgaagggcgtgggttggcgaaacctgttcgtccgcagcccttgacgccgtgccttattggtactatggggaagggcgtggcgtgtggcgaaaggtgtgcaaaggcttgggtggcttcgtagccccctaacttagtcttaaaccactttcatccccagcccttgtcaccgtaccacgcgggtattgtggcgaagaatgtgggtgtggcaaaaggctctaaaggctagggtggt

SEQ ID NO: 106654 - DNA, 888 bp, Oryza sativa
tagattaatttaataaatgttttgaacttcatgtaatggaaataaatttgtgtgttgaacaattaactgatttcaaaactagaaagatcattcatggtcagaaggagtaagaactgctacccggcccaccctgtgtccatcccgtgactcatacccagaagccaggaagctagaagaagaacgttatatatatgtttgcgtttgagtaaggggataaagtaggattgattgtataatcaaaattttaaatgaaaaaaataaatattaataatggttagagttatccaaattataaaaacagattgaggaatatccttttctagggtaattgaggaatatcttcactacctacttattatagaaaaatattgaagtgtttcttttatcatccatcatcggtggcatcgcgtgataaggatttttgcatgtttgggtggattttgatatatgagaatttgaacaaattttgaacaaggaaatactaataaaaaaagaaagtaattcgaacggaaaaattggattcgctctcaaatttctgaattgagtttgagcaaatttttggagaagttcaaggtacaaatctaatattcatcctaattttagtttgtcatgttgaacgatgcacaggcaccttttttttaagttacattaacgtacaggacggtttcgtaccgtttccgtatttcatgacactaagcacattattcatatatgttcataagcataacaaaggacaacagggaagtgcatagaaatccctgcttcttgaaaattttaaaaaagtatatttcccactttgaatcctaaaatctaataacataataaaggacaacatttaacgtggcctcgaaatctgtactttttgggaattagaaatgcccctatatt

SEQ ID NO: 106655 - DNA, 663 bp, Oryza sativa
agatacagatttaatgcacccaacaagcatgaattgattgtgagatcagaataaaaactgatagcattattatatttgttgccagaatatttttctccaaatcatattaatgcaagttgtgtaagctaaacaaactcatggcataataacatatttaagcataataaaattaagtaacaccagtttagcatcaagaagacctgaaacaattccaacaggcgataagtttcttagcatctacagaaacatatttatacaatctgtgaaagctaaaaacacaccacagtataccccatccaagcataagagtagcactgatttagcttttcaactagacttgaaacattccctacaggcactaaattcactagtattgtggactgtggagtaatgctgatattgtatcaattatgcttcatgggcaagccaagatcaggcatgcttcatgggcatcccagctgggcagatgcaatgggcacaatctgtcaggcacactgttaatcatacccagaaaaaaatgagctcagtttctctaaataattcataacgacctgaatcccaacagggtttaggaaaccaattacaacatatagtacatacataccgaatggttatagtgtaattcaaagtaatcgtgacaagaatctgggcgctggaatacaa

SEQ ID NO: 106656 - DNA, 589 bp, Oryza sativa
ctgtgtttagttcgtgggctaaatttttttttaagtatacggacacacatttaaagtattaaacgtagactaataccaaaccaaattacagattccgcctgtaaactgcgagacgaatttattaagcctaattaatccgtcattagcaaatatttactgtagcaccacattgtcaaatcatggcgtaattatgctcaaaagattcgtctcgcgatttacatgcaaactgtgcaattgattttttttcgtccacatttactgctccatgcatatgtccaaacatttgacgtgacgaaaaagttaaaagtttgaagaaaaaagtttgaatttaaacaaggcctaactctgctcgaagtccgttttcaacgtaaactatatgcaaaaccggtgattttttgtcaactttggaaactggacatgacatcctaaaccaggttttatgatagttttgcttgatattatagtgatttttcagtagcatgacctttgattatgtaagtttcatggttgtgaacctaattgagtgatacatatttgcatcaacaacataggtatatataataattaataagagtatgagcaaggaaag

SEQ ID NO: 106657 - DNA, 648 bp, Oryza sativa
aaacactaaaattgtggaattgttttgtttagcccaaaataactttgctgcatcagcctgtcaaaaaagttcacttaatccccaaaggtattcatctattagactcttaagtattgaattccttgtaaacaaactcttaagaatatagatatactctctccattaacaaataactagcaataatcacgcgctacgctgcgtgctcgataacaaaagcaagacaaaacatatatagttgtcaatattccgtgaaaacaaactggcatacacatcaggttttccataaagattcaaatatgaattgttcctattgatctgtctatgcactatttgtacaatcatatgcatttcagcaaaattagcaaccatacaatgaacaaaatgctgtaaccatacaatggagtggatgggagaactgaaacggtgctataaccacaatcataaaaaggtggttctttatttgcaacatcatcgcatacttctcttcatcaaccgttgcaatcttttaacatagcagttgctttgcaatcaataatatgtaagttctacatggcatatatatatctccctcttcaaaaagggttccataaaacatttcatggtcagaagatgatatcttaatgaaaatatcctggccagtgaatctat

SEQ ID NO: 106658 - DNA, 702 bp, Oryza sativa
tacttaaagcaatgaacattttttccctttgtgttgtactacgatttccatctattatatgcacatgtacctatttgatctaagccactgatccatgttctttgtttgctgctcattattagttcaacatgaatgatttatgtggtcctatttaggtttagttgtttttgctatgagcagtttttatttgttaatttgttgcccgctatttttgtacacaggatgataatacatatgcatcgatggtattctttgcggatgatcttacaatggcaatggttctcacgaaagattctatgtatacctgacaatcttggcatactatcacatccaacctttcaatttggccactctggaggtaccatttttttattctccattttttgacttaatttcttgatctgtatataatagcaagtatttaccgtttttattaacttaattccttaatctctatgtagtagcaagcttattccaggtctatgtattatacattaatagttttttcttaattagcttcggcttatattgatttatttttcagcatgtactggcttcagtgcctaaatatatagggatctatttggagttgtcgatgcgcttttgttgttttctaccagctgatgtactgtatggttgtgtgattgctcatcaagattatttaagttcagttccatgctagcatctgttgtcatcagataa

SEQ ID NO: 106659 - DNA, 739 bp, Oryza sativa
  unsure (1)..(739): unsure at all n locations
ctatttttctaattactgattcgaatttactatttatttaactttgaggttattaattattatatgaaaaaaattcggagtactagagcctggggcgcgccgcctggatacaattcattcattagcagctaataatagcgatggatatccttgttaacagagtatatttagagcattaaagcagagttagaggatgtgcaattgtgatgttgtagtgcaacatcataatagcacataatttggtgtactgaaataaatagatacgtagctcacttgttagtgatggctatgactattgacaggacatgtttacagcaaaatttgttagggacaatacatagaggacaagcaacagtgtgacagcgtaataacataatatgtttaggcaaaagatgcaacagtgctggtgctatgaaagaaggattaagatttgtttgatcagatcaaagaaatatcaaatggtaactttataacaccgagggcaatggtgtactgacaaatgttgcacacccagatccaagtttatggaagtgacctcaatggtccatatcatatctactggctatttctttaaagccacagcttgtataatcgngaatagaataatagaacaaactaacaccttacattatggggatacccagaccagaaatatcaaatggtacctttatacaccgagggccatgacagggaggaggaccacagaggaaagattttatgtcagtagcacagggacttt

SEQ ID NO: 106660 - DNA, 626 bp, Oryza sativa
  unsure (1)..(626): unsure at all n locations
cgacctgcaggcatgcaagcttttgaggatccctatgcctattaccaggagggtgatgagnnnnnnnnnnnnnnnnnnnnnnnnnnnnnnntcgttgcctgtagcaatggcgtaccactaccttaactccactaccttacctacttctatttttaaaatgtattccagaccactcaatccaataatttaatactatacctagtaacttataatataataattcatactaaactctcatatatatacacttaatatttcacctataagttcgtatataccaaactacttaatccaaagaaataatacagtttacacaaataattcctgttataaaaacaacaatctacatatctattatcacaaccataccactgtaagaaaaaaccaaaaagcacccccacccctttttctaaattaaccaaaggacaaattccccatttaataatactttcaaaaataaaaattctatatttacaaaactcaataccaattttatcttactcttaactattttctttacaaaacacattttactttcaacttactttaagttttttttaaaattagaagacagatcccaatttaccccccacttagaaataagcctacccctctcataagaatcc

SEQ ID NO: 106661 - DNA, 652 bp, Oryza sativa
  unsure (1)..(652): unsure at all n locations
ctaaagtttagagaccaaaagtttataagtcaaaagtttatatatccgattcaaatttgaatttgaattcaaataattttttatatatagtatttctatacatctaaagtttatacacctaaagtttatagacctaaagtttatatacccgtttcaaatttgaatttgaattatatctgaatcaaatttgaatttgaattcaaatattttctatatatagtatttctatacatctaaagtttatacacctaaagtttatacacctaaagtttatagatccaaagtttataagacaaaagtttacgtacccgattcaaatttgaatttgaattcaaatattttctatatatagtacttctatacatctaaagtttatacacctaaaaactatagacccaaagtttataagtcaaaagtttacatacccgattcaaatttgaatttaaattcaaattttttatatatagtatctctcccttatccaagaaacaaaaggggacctctctctctcccttatccacactcacagaaacaaaaggggaccgggcggccctcgggagaggcggcggcggaggacccgacggcccttcggagaggcggcaatggtggttcggcggtaccccattcttnctccccttctttcttcccttct

SEQ ID NO: 106662 - DNA, 675 bp, Oryza sativa
aataacataaacatatcctattcacataagcttttaatatatgttttgcatatcaattagcaaatataaccgaaaattttagaaaaaaaaattatacataaatttctaattacacttgtatgtaaattttatcttcaaattcattatattttaactgtaagaaaaaaaagataattctgataaattttaactgtaagtttcgactcatcaactctccaactgcccaaaaaataagtccgccatttttacatgcatcatcaatccatctaaacatacaccttacagttttcagtttgcgacacaacatacaacctgtgaaagtcctgctgataggggcaggcaggcactaggcagcgagggatgctgcggtttggtatatgggccatggcaaagccaacgttgggaaaattcttttcctcaatggcaaggtgtacaacatattatacctttctaggtgaaagaatccaaaaataaatcaatataaatggctccagaatgcctcatcaaatgttgcatttgtcgtacccataaaaccatgagctgggatcactgcttttggagacctcgaccgactggaagggcttgaactcctctcgccattgctcatcgccgaagctcccacctgtgtcgtatctagcggggccggtctcactaggctcaggtgactgtacaaca

SEQ ID NO: 106663 - DNA, 989 bp, Oryza sativa
  unsure (1)..(989): unsure at all n locations
agcgcgcgtattgngatccactcttctcctctctttctctgattttgtgcgaacatccccgcgtgcgctttctcttcctcaccaccccccccccccaagagnnttttgaattcgactgcgcctgaccanagccgaatncgagctcgggacccggncagccattnnngnnncnncnnaaaatcatcaatctacgtgcgtatatattaatgatgatctccattttcgtttttgtcttcaaatcttcaatgtacttttttttgtttaaattaatttttattaaaaagaaatatcacatttagtacaaatttaaaaagtagaagaatggattaaaaaaagtttagagacaacttttaaaagaaatatcacttttttataaaaaagaaattagaagaatggatttaaaaaaacttgagtttttttttaaaaaataaacaacaagttgagaactaagggtaagttttattctaaaatgtcacgtgtttttttaaaattaaaacaacacttgagcttgtaaaagaaatatcacttttttaaaaaatatttaaaaggaataacacatttagtacatatttaaaaataaaagaatggacttaaaaatacctgagctttgaaaaagttaaaaccgcaagttgagaactaagtaaaaaaaaagtttagtaaaaacataaaggagagggttcgaaccctggtcactgtaacgccacctttcaaatacctaccactgagctaagccaaacctaattgttgcttttgcttttgcttttatttagccagtataaaggccagcgccgctgtagaacatatattctgatatatatatatatatatatatatatatatatatatatatatatatatatatatatgtaaaaaacagagagcatcattaaatatttatatgtactaatgtacgcacgtagattgaagatttgaagaaaaaaaaaaagaacgaaacaaggctgccgtgatagggagtcgaaacatggtgt

SEQ ID NO: 106664 - DNA, 1087 bp, Oryza sativa
ctctttcgaaacatttaattagaagcaggtatcgaaaaaaaatgcaataattgtgtcgtgaactctctataataacaatattttgaaatgtatgctttcgaagaaaatataagagattaccaaaaagagggagtatgctaaggcaccttttgatatgtgggaataacatagaaaacttagcctcagtttgaaacgtattattgaataaatttattttcggggattatctacttaattatagggataaattaaatactttaataaataaaattgaaaaataactcaaaacaagtgggtctaaataatacaatagattttttttcaaaaaatgcattttccgaagcgtggagcaaataatatgttcaacaatgtgataaataatatgagaaaaaaaaactaagcctagaggattttagtcctataagaaagtttcctaaatgggtttctaaaacaaaggatcgaattatatcgtttattttgaaatgaacgattctatggagattttggaggaaaataaatatgaggttctatctcatgtttccttattcatatgactctaattcttgtgttctttctttgtgtcaactaaataaacagtttttaggactttcttgtgttttcaattcctatagaaattcaatgagcatgacattctattctattttgatgttttttctattcatgcgtcttcacaaacatttcaaatggaccctctaatttctcaaaatgagccacatctaagtaattatcctttacaagtaaagtccaatatatataggtttgtacttttagaagttaatttatgccttgcttggttgtgcattggattgaaatacaaagaaattttgattttttttaagaatagaaattataaaaatagagttgtgcaacaaaagctataaagaggaatcctaaaatcaaattctaaaattcaaaatcatctacgcgactatgcattcgaatgatattatatgagtacgactttacctttcgttactgaaaatgctacaatttaacgcatgcattgatcaattttgtgaaataaatatgaattaattctactcgaagatttggatatgcaaaaaca

SEQ ID NO: 106665 - DNA, 646 bp, Oryza sativa
agtttacctttgaaatgaccggataattttgaacagcgagtatatctaaattcatagtaataaaatacatgatatattcttggacggagcgagtacgatgtacaaaggtaagagcacttgtttgaactatttgttaggtctaaatatataatatcttcagtcataaatattaagaaaaaattactagacaaaagtaaaaccaaaaaactgcctaaatattatgcaatatgcaccatgttagttaacggaaagctacaaaagctgcctatgtctgatcaaaactacatgtcttatgagacattttacctcacaacagcttggtgcttcaatttactgaaacaagacacgaaacaacaggttgtcttcttcataattcaaaacccaatcagctatttaaattaagctaaataagaaccatcggattcttgaataaatacgaatgataaataagaaagtgtttccttacatccgtcagtccatcacacgactatgtacatttgctactatcgcaatgctgcatgttactgcgataactgacaatacccacgtgctaccaccaaacctgaaggggttagcctgaagctgcatctgatacttccatttaattgtctcaacaaaatggccatgtaatggttggtgaattctg

SEQ ID NO: 106666 - DNA, 521 bp, Oryza sativa
ctgtagctcttttaagtaaaggccgggatatgtattccattatctaaaaaaaatattttttttcaaacgcgcaaaagaattgcacgttagtatattaaaagaaaagagagttaaaagagagttttagttgcacaacgcaacatagcagacctgccattgccgttccatctaatatatcagcagcagcaaaaatgcagaactgaaaattaatcacaaaaaacccggtctaattaatgagtcaaacgggtgaattaggctgacacagtgacacgtactcgacgggaagcgactaatccccagaaaatatataattcactgttgacagtacctcaccgacataattagccgtccccgtttgttttactactgttctccagacgcctcaaaaacaattcttaacagttttccaagagcaatcgcatggactttcctcagaatccccatctgatttcgagccccaaagcccttgatttccacggccacattgatcgtttcccgcattccgtggtgcaattaagtta

SEQ ID NO: 106667 - DNA, 728 bp, Oryza sativa
ccaaaaaatttcacaatttgaccctttgcaaaaaaaaattttacaaataaaccatcaccaaaacttatttcaaaaataacccttggcgctgaacttagacacctcagcgccaaatagcgtggcgctgaatatacgttggcacgctgacttagtctcccatccgcggtggcacggcattcagcgccagttgacatggcgctaaggtgtctatattcagcgccaggtgatttggcgctgaccaaaagagtcatttttaaaataagttttggcagcggtttatttgtaaaaattttttttgcaaagggtcaaattgtgaaaatttcagcagaattccggtacaaagtcgcggggaagttatcatgaccacacagactgtacgggggagctagcgtatggttgatgcccaatcttgagcaggacacacccatgcagagagagggagagagagagagagcggccgtactccctccgtaaaagaaaagaaagataaaccttaagttttcgtatctaatgttttattggccgtcttatatgaatttttttataactagtattttcattggtggtagatgataaaacatgattaatactttatgcgtgactggcctttttaatttttttcatatttttttcaaataaaacagaacaaaaaaacgtttggcaccggaaccccgaatttggttttttttaacgggccgggtcctttgaacaagaacccattttttgct

SEQ ID NO: 106668 - DNA, 882 bp, Oryza sativa
tgatgatttcttctcttttggagtttggatgctactcccactcaaacgtaaggtataaaacatgatcatgatcatcacaagcaattctgttttttttcccttttctgacaataaactactccaatctgccaagctttacaccaaacagttcatccatccaccattaatttatgaccaagtagtaggcagtattacatggcaccaaaaccgcccaattttttaaaaaacaaaataaaacaaaaaagaaatttaaaaatctaatcgatttacttatgccaatatacaccaacaacaaatggaatgcacgttagctctctctctctctctctctctctctctctcaccaagtcactctaaacctcttgctcagacctgatgtcaccaactcttttaaaccgactataactagctagttgagagagtatttaatggcatacagcctaccgttatctgtagggggtatttgactttgacaatttaaaaaaaactcttgtatcttaaaaattttttataattacacaacaagtttcctgtagattttgcccccctcaggtatttccccttatttcccattcaatatttcccttttaggcttccaaacacaaacttcctttttaaagaacaagtttttagtccctttttcaagctgaaaatctctaacaactctccatttcataaacatggtgaatcccaaataaaaaaaaaaatgttttatagacccttttcacctcgaacccaaactattaaccccttttggccccaaaggcgtgcttccctaaccccgaatgaatttaagtctaaaaatttcttttttcccaaataatagtgcgttattccgccaacaccctttgctatctttttctcaaaaaaaccaataccgcg

SEQ ID NO: 106669 - DNA, 631 bp, Oryza sativa
tcctgcatcaaagatcatcaaacacatttctcatgtcaactctcaatcggttcttgaatgaatccacaggtcgagtgagattaacagcttgtaagatgcaatgcagactctgttctgcaactctgatgctctgatgtatcctgctactgctgagattctttgttcagacttcatacacctggcgatgatcagacacaccaacctagtgattgcttccaatgagggatttgattgattattgtgcagagttaatcagatgttgggaggaataattgtgggagatgagagaagatgtttgtccccagtaatggtgccggatcaagccaaaacaaggtgacctggccatggacggtcactgcagcagatactccaacagctgtgccactgcgcgtacgtgttggtaggtgaactcacagacaccgttgctctggccgctgacaccggcgtatctactctgctctgcctctaactcgccgacgacaatgatgagttcaagaccatcttcccttccaagggttgataccttaagacagcaaaatgacaccgtactgttatagcgaagtaactctagaaaatccttgccgtcggtacgtcaagaagaatacggtggctggttggttggctgccatgg

SEQ ID NO: 106670 - DNA, 1298 bp, Oryza sativa
caaaatgaaggaggcagatcatcaaaggtcacaggccatatatattctacctagtttggaaaagggtagctagataattagataggagagaacaagaaaagaatttattctgccatgctctagcctggcaagaattggagggggaccaaggtctaaggaccaaagcttaattagcttctcaacaacacatttgcacctaataaaaagcctccaagagcagctggaaggcttgtcaagcatgcagtgagactacttctgaagcaaacctacaaaagactaaagagagagaggcccatagcatcaaggcatgcatgcagaacaggaatagtgcctagatgatcagtgtgctccaccattgtagctcatggccagtattgcagcttgcatgtggtgttgttgtccatgatcactgtataccgttggatatcgctgtgatcatcttttcacctgcctaactaattttgggtcctgatcaatttttcagaagatttgcaaaggagcgagagcgagcgagcgagagagagagagaaagagaggtcacacacactggctttcttcgagaattttctttaatgtactcaatttttataatgtttgagaaggttaattaattcatcctttagtaccaatgaataagtttagcaaattgtcaggaatactgaccactacactcaatcttactctttgttctgcagccactcgaccctgatcatctccatggattccctcaatcataggttgttataaaaaaagccttatatatgcaaacatatataatatttctgtcatatagatcattagtgggttaattcttttgggtggcagagaataaagaggatgatttagttaattcatcgatatgaccaatgttatgatcactgatctttattccctaatattgcgattatgcatctccatgtggaaaaacataacaatcatactagctactattcaccatcaattttggtccagccaagaacatgcaaagtctagctagctataaggccagtgatgaaccacaccactatgcctaacacgattgcatgcatgcctgaatacacgcatgcaattcagtgagaccaaaaaaaagaagatgatgtgaacttgcaactgactatgcgatggaaagatgtaaagagatatcaagatcacaccggcatctttcactctattttgttgtttatctccatgtccatggacactccatgtgtgatgcagaatatgctacatcttcggatatatatcatgatgatacataattggtttcatctgtcgtttcttcagagaagagaaaagaa

SEQ ID NO: 106671 - DNA, 669 bp, Oryza sativa
gtccttcaattcatacaaaagttgacaactgtttgacctactaaaaggttttttaaaaaatatatgaaagtttggtgtctttagccttcttacaaaatatttaagtttgtgtgtatatttcaaaattatctttcatatttttttagaaacttatttttatataactatgaaggaggaatcacatacataaaagattgccgcatcaaaataaattatatagcatgtgaatactatgtacataaaaaaactctattagcatataaaatacgaatgatattttttttaaattaatacatataaaataaaaatcttgaaatatacacacttccattttatgtaagtaggctacataaaaaaatcatattttttaaaaacttatagtaggtcaatcaattgtaacctcttgtaagcattgaagggtatttttaggtattctgtgaaaaatatccacccaatggtgtgttttagaaaaaaaaacaaagtccatattataaagggagacaaagtcgatagcgaattgtttaactagagtaaactgaatggtatataatggattatctaaaaaaaagcaagcatattaatacttcacctttttcagggatcgctggtgactgccagctccattcttgcaaggattcataatttcacatcattgctttggaaatagat

SEQ ID NO: 106672 - DNA, 665 bp, Oryza sativa
aaagcttctccaattttgtgtgtacggactaaatctttgtgtcatcggcaggtccaaacggggccatattcttgcttacgaaagcaagcaagcagcgtgcggttttccggccgagcggcaaggggatagccatgaaaaagaagaggagattgagttgagttggagctaggcgcccgagcttttagctatctgcctagctttgtttgtgctttgcttgattcccgcgcgcaggaggaggtagaggtagtagaagccgccagcgcgcgcgcgcgcgggggcgcatgtgcgcgcgtcgcgtcgcgtcgcgcgtcgctcggggacaaatcacgtggacggggtggggcgggcggctgcgacgtcgtgcacggcgcggcgtggcgtggcgcggaggcttcgcgccgttcgttcgcggtctctgagttaaatgtgcgggtcgcggcacatcagatgctgcctgctctgctcgccgccgcccacacacaccggccgtcacggtgttgtccctcccagctcccagatgtggcctgaaatctgaacgtttgaatgtcttaatcgctcgaaacgagtaaataataaatgcgtgaacattcaattgtgggattttctaagggtagagattttctaagggagtatggcatggtttagttcccaactttttcttcaaa

SEQ ID NO: 106673 - DNA, 657 bp, Oryza sativa
  unsure (1)..(657): unsure at all n locations
caaattatcaaaggtatggggcccaacgccatgggtaaatgttctccagtttctttttcgaagataaacggtattggtcagctgtttcccaagaaaccgaggaatttgtttttttttattggtcagggggagggtggaacagaaacacccatgttttggtttaaaaaaaaaaatgggaattttgattacctccctccctctctcacagatgattccttcccaatacgcgggagggccccagggttggcctctggcctgtttaatcaaagttcaggggaagggagtggcctataaaaagattcggttccatttctcttttatcgctaggcctgctttttttttattatgcaatatgaactttaatccagccttgttatggttgataggagaaatcggttttataaaattttacggtctttattggtgcacggagggttcataattattagatcagcctatatattctatgttgtatagtagtagcgagntcgtcatctattaaaaaacggaggtagtacatactttgtacgtgccccctttcacttcttttctttttcctttttctttttcactctcatgagataaaaaaatcaaactaataatttcagccaatagttgtaaaaatatatattatttcgagttgcactctacaatata

SEQ ID NO: 106674 - DNA, 634 bp, Oryza sativa
ttttcaataaaatacatctaatataatggtctaaaatattagattcaccaatttaaatgaaaatcgatggtgacatttacttaaatttatattgaggaatagattttatctttaaatagtagaaaggataatcaattttttaatggtcctacgtatgttttgttcgctttattgatttttatagtactaagtctgtgcgtaatttttttctttcgataaacagtacgtaagattcattggtttttagtcttacgaatgaacatacttgagcttttgtgttctttttccggcgaacaataagataaacggtaataagattcattgttttttaagtctcacgtacgtacatacctacggagtacttgggtgtttttttttctttttcccgtgaacaggaaggtattagtttcctcttaaataaaatacatctaatctaatctaatggtctaaattatcaggtccaccgatttaagtgaaaattgacggtgagattaggtattgccacgtggccgtatatgagcgtttgcagaagtgtcatgtggtggcttgagagcgtttataggaagtttaatagacttttagttataatagatagatagatgacactaatttagtattataaatattaatattt

SEQ ID NO: 106675 - DNA, 635 bp, Oryza sativa
caggctagctctcaacgctggcggctcgcacctcacctcttcacacattagcttttcccaaatccaagctgttctaggctagctagctctggctacttcttctcttcccatgaaattattaacgactttgacacatgcatgtgcgtactatatacctctaattaaacaattcataacattgtatatatatctgctcacatatatatggagattcgatcatgataacagtcgttttccagggacctattttaaactctccggagcatctcgattgttaaatgtgatttcaaatagttaattaataaaaaaatctggaaaattaggtaatgtgggttatagtgacatataagtatgcaaggttaaatacgatctatacgccttttttttatccaaattgcttgtgtttagattgaatttgacctggcatgtttttacctgttagaggcacatgtgacaatatataatatgcctagtctagctagtttttttttaaaaaaaaatttacataaatgtttagagagactatatatacaaaaaaaacaagggcatatggacttgagggtttaaaatccactttccttaccaccttttgggctcaaatatgctatgattatcgagcgtgcaccactgaaacc

SEQ ID NO: 106676 - DNA, 635 bp, Oryza sativa
atacggtcaccttgaaaaataccactggaagatgataaaattattataataaaaaatcgacgtttaaagttcaaaactttaactgaatcttctcatgcataaggtattaaatatttatgaccagtggaacgaaaaatactccgttgagatgtactccctccttcaaaaaatatgagacatatttcatttttggtttctccaaaaatccgagtcctatttgtagtcactatgtgctaaattaaattgttgatcggaaaccaagaagctattctagtacttattgattacatgttcattggttttgccacatggtgagtgagttaattgcttcttggttttgatgaaaaagaaataggtctcagattttcacaaggagggagtactacatattaatactcaaaagttcataaacccaaagagcattgctagtcattagatacttttggttctattatttcacatattaaacaacatatttcagttatcattatttgcaattaaactgaatatggctgtttatgtttcacttatgcttcagattctttcacttcatttatgttatgaattgaacaaacatggttggttactttttcatttaacgatgctttaactagaaggagaacctttttattagt

SEQ ID NO: 106677 - DNA, 517 bp, Oryza sativa
atgttgccgttctgtcggcgtgtccttgaaggcttcattttaggagcttttcccttgttggatggttatgctttgtttaggttcagtttgttaataccagggtttttgctgatttttcacaaattaactgagccattgtaaggcttttgggtccgattttttttataaattagatcaactctcttcttctacagtggaatcgcataaactcccacccgttccctcgaaaaaaagagcactccaatgcatcatatctataacaatgtctatatatcttaatttcttacgtatacagtaaatacatagtactctactacgttcatcaaaaaagtgcatattataagttgctttgagcttttcgtagtcaaacttttttaagattaaagaatgatttagcaacttatagatttttaaaaaaattgtgcatgaaaaattcaaagtgacttataatatgaaataaaaaattgtgcatgaaaaattatatgcataatattataaatttagcactatgtcttac

SEQ ID NO: 106678 - DNA, 846 bp, Oryza sativa
ggggtacggtggagatggcagcgacggccgtccctccccctctccttctccccatcggcctcgatggccgtccctccctctcagcctcaagatccggcggcgtcctcccaacggcggtggcttcccgcggccggatccgataccggcggcttcctgcggtggatccagcgatgacgtagacatcaccgatccggcttcaccgatggcgccgacagcttcccgtggatggatttaccgcgtcacatgtaatcggattcgattttatttttcgccccattttttcgcccgagtttgtttctttttttgaatcggacagatttaattttttttcgtctttttttcgcggatggaggtggccattgcaggcggcggcgtggaggcgacactcacctccccttcctccctccacgctcctggatatggccggaggaggggagcgatggtgggggcggccactgcaggtgatggaggtggagctcctccctccctccctagcttccagtgttggatagtatagaagagaccgaagcttggcatagtacacttgctcgaagacgattcatcccatgaagacgtgtcgcagatgggcgcttgattgggtgatcaggccaaccacgcacagtacgacactggagtgagagatgccgcgtagaccgtagtcgatcacggcattgtcgaggaaatcgttgtagccgagctcttgaacggtgattaagtcaaagttgcgcggggctagacgacgaagacggagcagaattaatgctgatgtcggggacacgaagagtcgacgacgcaaacccgttcattgaagggaaaaaaaaaacaaaaaggtacagcaagcgcagc

SEQ ID NO: 106679 - DNA, 724 bp, Oryza sativa
cactcgttctcaaagcatcaagcaaacattccatcgaaatatggtttcatctatccctcacagccttcttggaacactcaagtccaaccccctattatgatattgtgattggctgaaaatatcatcactaaaaagagcactcaaacaaatatccagcctagcaagtagttaagatgcatggcatggtggctagtccatctatcactcaaatatttttctcaaaatggatagttgtgaccctaacaattgagacagaacaatagaaggcactagcactcaacacacatacattgttttattacacttactatgtaggaaaagaaaacaggcccaacagacaagagcaacaacaaaaacctcttagcatcgtcatcacatatgaatacaaaatcttaatgatatacaaataaaaacatagtgaaaggcaacacaagatcacacacatacatacaacgccttaatgatgacaaacaaccatggtgaaaaattaacacaagtgtacttgtacaaagcatatggaaaggtaactctatttacgcagatgagcaacgatataaaccacatcagggtaccaatacaacaagataaggaacatctacaacaggcattaagaaatatgggaatcataatcatttgcaatacaaaaataatagttggatgcaagtcgcaaacccacagccatcctatatgtgcatgtgtgtcaagttaatcattgttttcccta

SEQ ID NO: 106680 - DNA, 645 bp, Oryza sativa
cgaagagacaataccaagcatcaccacctattcacaagtcaacctcagcgtattcactaaaacacgcatataaagtaacgacaaaagttgcacctactgcctcatcccaccaaaacacaataacaaggaatgccacttgaactataaacaatattactacttcaaacctttatatctcaaaatataaaaaggctatgactgcaaaaaaaatacattttagaaatctacaaaacaagacctagttcttttatgtagaaagcacttttttgttctgccatttaaatggtctaattcacacttgaatgcaggcttcagaatctgtacagaatttcagaggatacatagaaaacaactatatccggagttctacccatccgatcaaagtgtactttaccaacatggaaagctcacagaaaactctaaggggcctgattgattccactgtttaacctctccaaaaacagttcaatctacaactatctagattttgacaaaaaaaagcaatagtcatactcaaaaattcatatcgcttattccacttgagataaaatcattccctttggtcagaagatagatcacgatgttatctacaacgtttctgtggacactttgttcagaatatatcattttgaccatgtaattgat

SEQ ID NO: 106681 - DNA, 518 bp, Oryza sativa
gttcatggcaacactgtacagcgtccactttgaaaggaagagagcaactgcattacatttagtcatatagcatgaactcagatttgttcttgtgaaataccccctccagtcgggaaaacaaaacatgttattttgcatatgcatcaagtcaaatctctactccctccatcccaaatatagctacctttagcattcaaatgtcatcccaaaatatagctatttctccaccgacttcctcacctcaaccagtcacgaccaccatctcatttaatttcttcacctactttctcatctcaactaatcacaatcatccctcactttactttaattttctccttaatatccgtgtccaactataaaagtccttatattttgggacagagggagtaacgctttgtgcatttctatatatacataaatacatccatatatacatttaaatatgtattatattggaacatgggaatcatatttgtagatttgtctaaaaaagtgctttcattatattagaattttat

SEQ ID NO: 106682 - DNA, 682 bp, Oryza sativa
attattattatattcttgttgtttattaatgggtggatttgggttggacatgatcctatgcttaatgcacaggctcgtaaagtccaattcaattgcacagtgtggaagacaacccatcaaataacttttcgagcagagtgtgagtaaagagtccacgcaatccagtgagaacacaatggctaaatataactatgtgtgcatcattgttatttatatgattttttatgattgcttctatgatttaaatactttttctaaaaaatcaacaattaaatattatgaattatatgtaaggatgatccactttttcaacggtttgtacactagaacaaattatgttcatctatgatgtattaaaaatacattaaacattgtctaaattcgattagatggtaatatagaatatattttaaagcacttatgtgaaacattatttggcttgcttggattatttttctctcactgaaggcatcagattgtttatgtaatggttttagttattcattttgggttagttcttttttcttacatagtttatattttatctattcacatttgcaaaataatgtataatggtgcaacctttgttgttgaataattttgtaatgtttttatgtcagttgagatgaagtttagaagggtagggtgttgtccctcgataaaatatcgctgaatagtttat

SEQ ID NO: 106683 - DNA, 634 bp, Oryza sativa
cggtgatgtaggttgtttgatatttttcttttgctcgtcatctctattgacatgaacgagaatgtttttacattttttcgtgcttgctagatgatggatggctgcgcaacgtcgggctcatctctataccataccgctacatccttctattattccatcgtcgactactactcgctccctggttgccctctccactaccagtctgtgttaccagtcagaagacacagactgttctcttcatccttatagcaagatccagcaaagccaccagatggatttttagctgaatcattttttttcatttctagtttgattcacctgtgagtaattttatcgcttgtgtgtgattgagcctgtaattttttcacttgtatgactattttatgatacagatcaacaatactcttagtatcaatttttactcttatactgtacattgaacatatcagtaaacatattactatatggtggctacgagatcatggctatatcgagaggaaggtggtaattgttttactcgcagaccaaggaatctcagtttttactcttatactatgtattgaacacatcagtaaacatattactacatggtggttacgagatcatgggctatatcgagaggaaggtagtaatt

SEQ ID NO: 106684 - DNA, 1034 bp, Oryza sativa
gggataccatggatcatgcttgatttgatcagctcaacggtgatttgatgctatctagattcatccttttttttttaagttcaacactgtacacatttgctggacataatgcatatatgttgttttcagcgtgacaaatacaatgaagaagaacctaatgcatttgatttgttcaaggagttccactacagcaagaaaaaaaatgctacaccactgctgtatagtaggctattgtaagataagtttcaaactttgctctttgtaatgcttatttttaattctctcatcaacaacaatgtttgctccttgcttgctagactcaaatggaaaacaagctgtctacaagttcgatgaagaggactcaatctgagatggaagcggaaacttaatcttttgatcagtcaagttcgatcaagttaattcatgcatgatgctatatcttttgctactacatgcattttgctgctattgctaacttgtgtcaagtcaatttttgactaagctaagctatacatgcttgcattttgctgccgcagcattcattaagctcctagacttgtatgcattgcttggaatctctatttgttgttggcttgagccatggtaaactgcaaggttgtatgcactttgaatgttgtaatctgatgttggatgaaaaatcatgtgatatgatattgaatggaaaaatgatatttctatttgatttgctgctgcaactattagttgcatggcctgtgtatatgggctttagttgtgaaattaagctgtatatatgggcggtaagcgatgtagtagtgggctgaaaagggcaccaaaaaatggtgacaaaattgggctgcaaagctgctgaaatgggttgtaaagctattgaaaatgggctgccaaatgggctgaaaaggagctgcgaaaatggatggaattgggctaaaaattggcccatctttgattttggcctgttaataaataggttgaggtagtgtctacgtcatcatccacgtaagcaaccatgtaagcatccatgatgatgtggcatt

SEQ ID NO: 106685 - DNA, 543 bp, Oryza sativa
ctcgcgacgaaaagggaataaaagcgcttcgcctcgcccactgccacgccccccatctcttctcccgactcctgagagaagaagaaccgctgcttctccacccgtcgcggagccccgtgtccatcctccggcgcggcggccgccccccagcgatccgcctcaggtgagagcaccggccgcaccccctactgctctcccctcccctggagatcggcgtcccactcactcccatcccccacctcatcggtggattggattggataccagtaggggggcgatcgctcatcgctgcttgggtgcatttcttctggtaggattgggggatttactgcgtgaccgtggtgtgatattatgttcgtgttcagtgcattgcttcttcttccaggaagagatatcaactctcttttattaatcgacacgcgtcctgtgtgttcttctttttatcgcatcgtaacatccgtaatgatgcagggtgggtatccgcgttgttagaagatactatatggattggaaaatctatagaggattgtttcattttcttct

SEQ ID NO: 106686 - DNA, 614 bp, Oryza sativa
aaaaacacgggccacattttacttgattcagtcaattttttttactacctccgttccaaaataagtgcagccatagtttttcgcgcccaactttaaccgttcatcttatttaaaaaaaatttgaaaaaattttaaaacataagtcatgagtaaagtactattcatattttatcatttcataacaacaaaaatgctaattatgaaaaaatttcaaataagatagatgatcaaagataggcgtgaaaactcatggctgcacttattttgggacggaggtagtagtgattagtatctctgtatgttatatctaattaagcatgtttctatctcatctatctcctcttctgatcaattacttttagtcttaatttcattataaaatttgtattataaaatttagattgtaattattgaaatttgtaaagtgatttacggcggtgtaacatttaaaattcacagtataaaaacgatttgattggtttttattgggaaaatatagcgccattgctggtaaaaaaatatagaaatactctttttgggggggaaaggaagagacttttttttagtattaactattttaaatttcaaaaatagattaatatgattttttaaag

SEQ ID NO: 106687 - DNA, 693 bp, Oryza sativa
tcaaggtttaagtttatacatctgaaatctatactttctataaagttatagcccacaattaaataaattatatatgatgttgtaaatatttgcataacattttaacaaatctatctattatttttataatttttaacatataattatcaatatgtttcatataaaagcacgggtatcatttgattgtttcatgataagtactaataaactcttatatttcattatttgtgttcccttttttactctggttgtcgagaaaaaatatattgagaattgctaattcctgcagtaaagcgcggggaattacctagtgacatctatttgtgaatcctaaatatgtttatacttttaaaacaacattttcagatgtataatttttaacttttcatccagattattacaaatctacaattaaagctatgttcgcattgcacttttttttcctttctttttataaaattggtaggttattgtatatattttgcaaaatcactgagaattgttgtgttgtttaatggaccttacttggatttgttaatatatatgcccccccactttaaaggatggtcgatcgtcacctgtacatttcacgacattcttatgatcctaagttaaaatcgccgatattactatatataacccgtttataaacctaaggaaaagttgtgctgctggcagattggtaccccaaaa

SEQ ID NO: 106688 - DNA, 603 bp, Oryza sativa
atatgggaatgccataatccgaccgtatccgcccgttttcacccctgtcgatatccaatcttagattgctgtattttgagacgaagaaagcagctcaggttctcttatcctgttttgccaccatgctcacgcggcaaagaactggcaccaatcaatgagaggagaggaagcagacatatactccctccatttatttttggctgctcctatttatctcaaaataagttcttttttagataaacattacatcggtatttgtgaaagtagaggccagataaatgcattgggagcagataaagtgcaaataattgaattagaatttgataaagtggatgtattctagtcttttcagttttatgttgatatgtgtgagattggtgaaaaatgaacttattctgagaaagtattatgtaagaagttgaagcaaacttatcagtttgacatcttcggcagcctaatccatggcatttgcgcgaggcgtctctacttggccggtgcaaaataattttcgtgtagttttaactttaatgatagcgccatctatgattataaaaagtttaatcttaaaatatatttctactcttataaaaattgaagaagttt

SEQ ID NO: 106689 - DNA, 525 bp, Oryza sativa
cctggtcattgtgtttacgtggaccttttttttttaaatcccagcataatatcaatttctagagtgtcaagggtaatgatgaacgatcttatgccacttgtcaagggtaatgatgaacgcaagtcctctcaactagtttagcaagcaccaaccttgtcaaaaacgacaaatgatttcaccttgtctcaatcggaaaaggacgaacaaataaattgggtttaggttcttagctgggcacttttcaaaatttgtggttctacttgaaatcttgaacaatttattcacatattaataaatattcaaacttagtcaaacaatatagattaagctatatattcaggaacaaatataagcttacaacttttgctagttttaatgtcccacaaaatttaagaatgtgttatcacaaattcacaacagcttcataatcccccagaaaaacagagaactaaattttctccaagttgttctctatattttaatagagagaattatgtttttcttatctcctctctagtggatctc

SEQ ID NO: 106690 - DNA, 1109 bp, Oryza sativa
aacaccccttataaatttctcacgaaaccctctctaatatgggagttcgtagtacgcgcgtacgcgccgcgagcagaactagcgcgcacgcggcacacgttttcggaaggacgcggtagccttactaactctgttagttaaagataatgatggtaattaacaatagattttttattttattaggagagtttttttactaatagattgaaaaaaaataagttacatttgaaaacttttgacttaagatttaaactttgaactcaaattttgaaaactttcaactcaaactttgaaaaatttcaatttgcaagaaaattttttaaaactttcaactcaaatttgaaaagtttcaacttgagatttgaaaactttcaactcggatttgaaaactttcaactcgagatttgaaaatttttaaattaagatttaaaaatttttaagtcaagatttaaaaacttttttaaaaaatgaaaacacttgctactggaagattaaaaagtaatcaggaaaaaaagcaaaagaaagcggaaaaaaaagaacacagccgtgggtagattaagtgtgcgcgccgcgtgggccgtatgggccgggagtgcgcgctgacggcgcgcgcgtgcgaattaagattatcactgctggctggggaacttggcttaccttaaggcataacctccatctctatgtataccaagaaccttcgactttaacttaaaggacgtggcagactccatttgacgatattactcaatccatcatatttctttttctccaaaaccgcagacggacttccattcagactcctgcgagtccatgagtgggccggctaggaccagggcgaccgttgcttgcttcctagccgactcggtttactaaccaaccgaaccaaccgaaacccgtgcatgcaagctgacgtcaacacacacctacatgcatcaacatatgcatactgctcgccaccagcccggacacagtgcacacacatatgcatgccatgctacagtaccgcgagaactgtagcaatcactcaatttttcttccagttttccttcgcgaacgccgacgcttgcacgcacatctcgtgaaacccgttgcgaagatctctctcacac

SEQ ID NO: 106691 - DNA, 553 bp, Oryza sativa
cactctaaaaatttgcttagatattacaaatggtgtaaaacaaattataattcttttcatcgatattctctgatctattttaggtttttgttgctgtggaatgaagggtacacgcagacgtacccaccatcgagccagcctcctttggggtatcagaactactttggcaaggagcagcacccacctttgtattacctgccgtcgcatgaaatcaaaatggaagcaaaattagatcgcagtatactgcatatgatatattccatgtcaatgcatgcctggaatatatcatattgtaatttacatggaatatatcatatgcagtatactgcgatctaattttggaatatattgcattgacatggaatatatcaatttgattagtggtgcaaaacttcctggctattgtaatttacccaaaaactgatccaacccgaatccaactactgtcagaaagaatgacacaagcatttttttctgttgaccttgttggtttgagtttgggaatgtgttttttctttttcggttggtcttggagtcacacatggattgatgg

SEQ ID NO: 106692 - DNA, 778 bp, Oryza sativa
cttgcgtgtctaccttacaatatcacaaaaaattattttatatatttacattaactttggcgtatacttatgaacacctcccgtagctggtgctactgtcgcacctacctttatgctgcaacatccatagccaaatccctgtgatatcacaactacctagctaagaaaatggatctttctcgcgatgggccaggctaaaccatcaagaaaatagggaaaagcatgattaaatatttgagtaaattttgtaaaactataaatattttgatcatactatcacaaaactacatatttaagtagtatattacagcactattgatttaactgttataaaatcagtccaaaatcaccattagaaaccaaacgcaaaagtaacatcataggagaaccaatcaagatgacgacaccgagacacaatatttgttaatgaggtttagcaaaagtctacatgcctatgacactgattacggatactcatttctgatccagcatattacaacgtttcaaagttacaacgaccctctgtcaatgccgccgacaaccgttcccttttgtcgatatgggtacaataggtccgaccttctatgagacgatgcatgcactggatgcctcgtataggacagcatacaactcacgcctcctggtgcctcccaagcgtagagatatcatcgcaataacaagtcactggaatgatctatgtccatgaactcatattgctgtcttatttgctaatcattttgccctgtccactcatccatcatccattttgtatctgacg

SEQ ID NO: 106693 - DNA, 719 bp, Oryza sativa
tgcaaacatgcatcatgctaatgtcgtcctgagcttccagattaggccctgctgtattgatcaatatattcaggtcagttgaggctctaaattaattctgatgataatttttattctgctgtatttgacgggcctcatgcatctgaagatctggattactgtggccgaattcgtgttctgattttggggtgtaaaatactgaaatcaataccgctgtccttgctttcatggggggtatttggtgatttggttacttcgattacatcgagttggaatgtcaatgctctctgaacctcgaatttattactgggttaccgcattagattattggcttcgcaagctgggccttgtgcaaatgatcctgcgtgaaatatgcacataatttgcttccccagacgagtttctgctaactattctatagatcatttgcataacccagcagccagctgtttctctcttcttccttttttcccctctgaacatgtttacttaggtcaatttccagacattgaaatgtcttgcaagattaaaattcaaggttactccgctcattctgttttgagagagttcaaggctagaagagtaaagttagtaagcaaataaaaatgatgcaaagaatatacttgatcagagctaagaatgctctcataagtcataagtctgaactcccagaaataaaacgtcaagctcttcgaaacatgatatatgccatttaaacc

SEQ ID NO: 106694 - DNA, 709 bp, Oryza sativa
ctagacatataacatatatatgtaataatgtggacaatactagaaagtcttataatatgaaccggagaaagtatgtagttatgattatacaagagaacaaagaaaaatacatgatgttggtgtgactctgaaatataattgtcaattgtattctaagtctgacaccatcaaaacatgcacagatcataaaattggcgaaataacattcatattagagtacttttctaagccaagattcacaaagtcatgccatatacagtaattgcatgtgcaaaaattataacttgactcaagcaaaactaattacaggaaagacattattagaaagcaaattcttcatatcttctggtaaatgttgcttctttttccttccccatctcctaggaacatgtctagtataaggagccttgtatatgaaataatcgttcctcttttataaggaaaatcaacattctcttcaaataatcgttttgacccttctgatcatgaaaatcaacattatgcatttcccacttgtcatatcatccataacatcatccatatatcatgtgtaccaaatagaatgaacagttaagcaaccaatgcaccataaggaggagaggaacacttctctaaagtaatatatagcaccgtacaaaaaatggcgggcactgtttgattcttctatatgtcactaacaatgcttccagactttgtcagtgaaaggcta

SEQ ID NO: 106695 - DNA, 796 bp, Oryza sativa
gctacaatgctatttaattttgcacaaataaacgaataggcacagttagatgatcatgaatttgggaagacctcaaaaatcttacgagatgatcaatataggatggagggagtagagatgtgtcgggggtattagaggtatttctcatctctattgactcaatatatgtcattggcgctaactcaatatatacacaacaaatctattccctatttctattattcactagagttaacatggtatcagtgcaccggattcatctgtccagttgacgtcgtcttcttccagctgtgcggcctgaagaagccagcaagatgcagcagcaggtttgctagcatcaaatgatcaagagctcctaccatcaaatgcagaattcagcaaattcgctgtaatagagcagctcctggtgtctcccaagcctactagctagctcccatatcgataaccaactagccattggaatgaacaatctccatctacatgtactcctttatatgtagagcaaacaggagtcaggacatggccgtatctgaaaattgattgttttgttcagtacagctgagctcaatgcataataaaccactagtattattactctgtattagctaggcagtactgatgcaaacagaaaaaaaaactgagaccaaattaacgaggtgacagttctaattggtgccaaatttattttgtgactactaatttatcagataaacaccaataatgtcaggaagtggtgttttgcgtaggaaacccctctttgaagtcgaaatatgtcttttaaaaaagtcgaaatatc

SEQ ID NO: 106696 - DNA, 510 bp, Oryza sativa
ttgatggaactgatggtttgggtgttgctgatttgggagttggtgacattgaaacaaccactgattgcacaaacacatcaaatatatgtataagttttatgagtctattagtatatgttctttaggttatttttttttgtactagtcttgtatctgacattctgaattgctgacaaatacatgtatgaaattttaagttttttgctgtgccaaaggaataagatgaagtttctgaaatttgatatccactgacaccctgctgaaatcaaacatggcactattattatagcagcaaccgctgactgctcactcaaacacatcaaatcctcaaacctcagctgcgatgctagctcatggagcttgagaccgtgtgttctgcatgcagagtactcgagcatattgtaattttggtgcagtactacagtggcatggaaacaatgtgccggcgtcccttagtcatggctctgcccagccaacccgacgaagtggtcatatgcttagtgtgtaaaa

SEQ ID NO: 106697 - DNA, 797 bp, Oryza sativa
aggggtgggacttaggccccggttggtagcaccaaccggggctaaagatcaccgggatcattagtcccggttggtataaccaaccgggactaaagttaagatctttagtctcggttagtagcaccaaccgggactaaagatcccggtgatctttagccccggttggtgctactaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaaga

SEQ ID NO: 106698 - DNA, 691 bp, Oryza sativa
gttgatttcttaacccgcagcctgtcccttgccattcccctcctctacgtgagctaacctggtgcactcattcttctctaactaggatacctctcgatggcagcagtgctatctccactgatcgtggccaggatgtagaggtgggtatgtattcgttgatactctactgattagaatttgacgaaccactgtcattcaatctgctgacacatattgcagttaatgtctgttcttcctgcctgtataaacactgtttgatgcatgtagaaatgtgtaccttgcaatgtcatgcatggatcaaaatcagacagctcaagataaggtattacaagcacacttaattgaacaaattcgacatgctgcactttgattgacaattttgagggcaacaccaatcttgatttgagtgaaaacttgctttatgtttctatttgttccatttctgtcttttcacatgcaagtgcaaccttatttttttatgagacgttgctgtacaagattaccagcattttcttcccaatgaacaatacagaatgttgtttcttattaatggttctatccagcaatccagtcttctataggttgtcctgtttttgagcagtattcaggagggcagatccctcccttgaatttggaagtgactagtatattcaatgcgtgcgcatatgcaatgctctttgcaggcacacaa

SEQ ID NO: 106699 - DNA, 538 bp, Oryza sativa
aatttttggagagggccgagtaggtcccgtggttttttactcctcatctcgaggatgtttttccacgtaaatcattgtattatttgtgcaagttgctttgatcctttataattacttctgcagcatccttcacttctagagatgggctaagtgaaaggtttggaactgtcaatgtcatacatgaccgtcttccaaatcatgcatggtcgtgtgtatgtgttacacactagtacagatccttctatctgtgacgggctctaatatgcttagaaatagtgggccgtcacaaggaagtcatctcaatcgggctgaaaagtgcccgattgagatatggtcgcatagacatgttagatgggtataaaacttaagcccgtcatggatgacacctatcagtgacgggccacaacttgaggcccgtttgagataacaactaggcccgtcacagatgactcatcagtgaccggctatatacttaatctctatcgggcattaactaaagcccgtcaccgatgactatttttccatttttcatatgaaa

SEQ ID NO: 106700 - DNA, 672 bp, Oryza sativa
gttctggctagatgtttggtatgggtcttgccctctgaaaacaagttttcatgagatttttgagatatgcaaccaacaatcaatcacaattctgagctgaaacagataggtataggtggtttatcttttaggagaacttttggccctctggaacttgaccaatggcagcaggttaggacaatcctagaagagctagagttgactgactctcctgatattttgaaatggggtttgacagctagtaagagatttactaccaactctttatacagagctatggcttttagatgggtgaaagatgagatgctacaactaatctggaaatctccctgtcccataaaaattaaacatttcctttggttggcaagtagagataggatccaatcttgtgaacaattgaaaaagaaaggttgggatggttcagaactttgtatgctatgcaatactattgaatctaccaatcacattcttttaactgtccaatggcaatttttgcttgctgcatttgtagagatgttgtgaactgggatactgtcccctgcagctttgaagagtttttcttgctaataaaacataatgcttgtagtaatagaagagctttggtttctttgcttgctgctatctgttgggttctttggcccacaagaaacaatatgatattcagatctaaat

SEQ ID NO: 106701 - DNA, 1777 bp, Oryza sativa
ataaaggttagtagtcatctgtgatgggcgctagttgtggcccgatagagataggtcatctgtgacgggctatagtttgactggtcgtctgggttaaagctatcggtgacgggctttacttagggcccaattgagatatattcattcgtgacggccgtttgcccgattgagataactcttcacatcagtgacttctagcctgtgacggatgctgtgtccgattgagatggggcttaccgtccgattgagatgagggtatccgttctagtgatatatgaagaaactggaatgataccattgtgaagatggtggactacgaaggaaaggggatggtggaggctcctacttaagcttgtggaggctagctgatggcaacggtggcatcctagcacatggcgaagtaggtggaggctctcacctttgaggaggaggcactcgctccaggtcctcgttgttggtggtggagattagtgcgtattctcgccaaggatctggtcccatgcagagcctagtgagccgcgtggtgaagtcaataaagtgaaatggcccctcttgtagggagcaccatggtgttgagagtggatcatggaacatggtagaggagacacaacgtcagcgatggggacaaaggaagatgtgtggttgagaaggtgcactggtgtatccatgcggcgtgaaagagacgggctacggtggttacaaaggagcaggagtgtacaagaaaatcgagtgagacagagaactaaagtggtggcatcgatgactagagaatgaatggcactagatcttggcaaatgacggatcataggtggaggcagccattgcacacttgagggcaagacactcgctccatgtccttgtagttggtgatggacattagcgtgtattctcacctaggatctagtcccctgggagagcctcgcgagccgtatggttaagttaatgaaatagagcggcctatcttgctggctagcagcatggtgttgagagtggatcacggaatgtggcacatggggtatagtgtcaacggtggcgacaaaggaagagacttgacagaggggatgcagtggcacggatagcagaagaggtgtgatgaaggcgtaccggtgtgtccgtatagtgagtttgatacggatcagagtggttacattggagcagtagtgcataaggagatcgagcaagacagagagaaattagagaggacacgcgggtgaacaactaaacaaacatcagtacgtaacgattccaaaaaatataatagaccctttattgatagaaaaatgtccgaattacactcttgaactatagaactatagagacatgcaaattacccctcaattcaaataccaggtaattaacattctagttctcggggctaattcgcaacaggtcagatgtaaccggaaccgtcactgatcgtgatgcactatatatctattactacatcgatcaagtgcagtgtgtgctgcagtagtcggcgcaggacgtcaggcatttcctcttggtaactcgcaggcagttatcgcatgcctcggcgggtgactgcccgtcgcatttgtcgccgcacgcggatgtcacgccgctgccgtcgcacgaagcgccgcatatgatgtcacagtcgccgcagaacctcgccgccgtcgccgggccgacggaggaggaagacaggatcagcgggatgcagacggcaacgacgatggctgccttaggagaggctgcacggcaagaagccatgtaaaatggtgtgttggtgattcacaagcaaagatggagatag

SEQ ID NO: 106702 - DNA, 675 bp, Oryza sativa
catggttgaattcaagcatgaggcaagcaataagaatcaaataataaaaaaagccagatttggtggagaaacgtcccccaaacatttttttcaaaattttttgctataagatattatgacttcatggacactctgtaaacgtcagagccgtcctaacaattttggggccagtgaaaaatataaatgagaccttattttctaaaaaagaattgattaatacataagggttatatatttggaacggatattcacagccactgtttttttaccactgtttgttctttgatatgcactgtctgacaagcacgtcaggaaaggtagcatcgacctaatactcttttttaagactggttttagatcgaggggcaaaaaaaatttttaaggtgtcacattgaatatacggatatacatttgaactattaaacatagtctaataacaaaacaaattatagatttcgcatgtaaactgcgagacgaatttattaagcctaattaatttatcattagtaaatgtttactgtagcaccacattatcaaattatggagcaactaggcttaaaagattcgtctcgcaatttacacgtaatctggataattaagttttttttctatatttaataccttatacatgtgtccaaatatttagtatgatagggtggaaaaaccttgctaggg

SEQ ID NO: 106703 - DNA, 894 bp, Oryza sativa
cacacgtacagggacgaaacgccacgcgcagatgtgatagcacccgcgtgcggttaggttttgctcggggagggaagtgacggctagggtttctcacatgatgcaatgcctctgccggtcacacccctcacgaatatatcggatccatcactcgggcctccaaggcccgtaggactcctattcggaaccctatccgaattaagctcatattggatctccatccaatccccttattccggcccattaagcgtgcgaccctgtaggttcatgtatactcggctgtaacccgaaagctccttttcggtccacgcgtcaacagcggcacctagcagaacatattgacccactgggcatacataaagatcatatcggctgaacctctaatgtatacttgtatgaacccctttgcctcacgatatcgattaagctcaaggctagatatgtgcaaccctcttatagctcaatcattcactcgaacctattgatagattatatatcttgtgattgactcctcaatcacctttggcatggtcatggacttccataatctacaacatcgaggggcccagagatatctctccataggaggggcaaatcccatcttgattattcatatcccactacatgtttcatagcatactcaaaaactacttttataactacccaattacggagtagcgtttagcagtccctaagtaagctactacacatgttgggaaccatgataatatcaggtctaaggattcaacaccaacactaaatgagatcactgatgacacaacacatatggctcttgcagtgtctcaagttgggtctatccaataacatgttcactaatatgtgtccacattattaatttggtatctctataccatgatccataagacttgatca

SEQ ID NO: 106704 - DNA, 1177 bp, Oryza sativa
ataattacattattagatagctttggataatcttggagctaggcttgtttagaaccttttgtttttaatttctactatctccttgttggcttgttaggtggtgacattggtttgcagatatgtcggatgaatgaagatgatagccgataatttggtcatctacttttgcgcgtattggagtttgttagcttattggttgcattcttctgcttacatgttctgcactcaaatatgtgctgcctctttgttatatttttatacttcacattttagataagcttaattagaatcaaacaattagaaccatgtctatcaataacttttaaaacttttagtttgaaaacactagaacacacgacgtttgagtagtcttaaagaatacttttacaaaattagatgtttactacttttattaattacaacagaatatcatagtcaaatatatattttggtgatgatgtcattgtccaaaacattgaaaatcgtggaactggagggagtagatcttgtgtttctatttcttgtagtagcagcggtttgatctctcctattattattgatatttctttacataatatcatcacaatagcgagacttggtttaagctatttttaatacggtgttgactgaaaattgttgttttttttatcagttctctgtaggtttcggcgaacccgcacggggcgatttttatttcttaaacgaaaatcagcatcatcataccttctcttgcttcgaatgcatggggaactgagcacgcgcaatttatcagtaggttagattagattctttcctttcaaagccaacaattagcattcatggtcatgtaatttactgattagggatagctagctactccttccatccctcaaagtaatttcagccagggttggaaattatagaacgaaatcggtcatttcggacccctccgatacgatattatttcggcagaatttttttatttttttattttttttcatgaattttggtaatatttgttcaaattcaactaaactttattcaaaattacggaaatttcagcatttcggcgaggtctgatcaaatcggctaaaccaaaatttccaaacctgattttagcctataacttttacgttaagtatatattgataacaaagacaatttagaaatttgccatgaaatgaaaaataaaatttta

SEQ ID NO: 106705 - DNA, 756 bp, Oryza sativa
ccaacaacctctccaagtgactctctaagctaaattttagctattctagccaaaagacgtctttcaacatcctctccaactggatggctaagccatccggctagccaaaactctcaccctccctccactagtcaaattaggaagctaaaaatcactagccaaccatgggcctcatacacattccacctccatctccttcggctcttctccaggacggcgcaggcggccacgacctcgacgccgccgccgtgcaccgctgcaaccaccagcttccggcaccgctcgatggctgtgagcgctacctgcatctccaggatggcgcagcggagcccaccagccgcaggcgcggggtcgccgccgcccggtgaggaggggccatggcggggttcccggggcagtgcgggccggcaggggagagcacgacggcatgcgcggctaggatgcggtcgaggagcgccatggcgcgtgggatctccgcgaaggcgtccgggctgagggcgttgagctgggcggagcggttgaggcggaccttgtaaaccaccgtggacgggtcgggcggcgtcacggcgagcgtcttgaacccacgccggagctccgcctcgagcaaggcgccgatgccgccgaggcgccctcctagtgtggcgagggagggaggaagcggcggcggggcggctcgacgagaaagaggattggagagaggggaaggaagaagaaagggggatgagaatgactggtggggtccattggttaatagag

SEQ ID NO: 106706 - DNA, 1579 bp, Oryza sativa
agatgacttccttgtgacggcccactatttctaagcatattagagcccgtcacagatagaaggatctgtactagtgtgtaacacatacacacgaccatgcatgatttggaagacggtcatgtatgacattgacagttccaaacctttcacttagcccatctctagaagtgaaggatgctgcagaagtaattataaaggatcaaagcaacttgcacaaataatacaatgatttacgtggaaaaacatcctcgagatgaggagtaaaaaaccacgggacctactcggccctctccaaaaattccactatttgataatgacagttacacaattgtcaatggagttctctctggattacactgttggacacaccaccaaggccaacaccgtattaagctagtgaccacaggaagcacaacataacaagatgcacaatttgcgttttattctgtccagcaaagcagcccggtaagaagtgttgggttacgcgtaggctacgatagcataaatcaaaattttctatcgcgtaaaccaggaaccatgcaagtattagatcatagatcgttaccactcgacgcgctgcgcagcggaagaagacgctgagaagtcgaaggaactctcgcgaagtagcgcgcgtcgatgtagaggaagtagtcgatcgcatcagctcgaccttctgctcctcgtgcgttctcctcaccgtactcccacgccgatcagcaccacaaaccagcggcgcctctaccggtatccacacgtacaaggacggaacgccacgcgcagatgtgctagcacccgcgtgcggctaattttttgctcggggagggaagtgatggctagggtttctcacgtgatgcaatgcctccgccggtcacacccctcacgaatatataggatccatcactcgggcctacatggcccgtaggactcctattcggatccctatccgaattaagctcatattggatctccatccaatccccttattccggcccattaagtgtgcgaccctttaggttcatgtatactcggctgtaacccgaaaactccttttcggtccacgcgtcaacagtggcccgtagcagaacgtattgacctaccgggcatacataaagatcatatcggctgaacctctactgtatacttgtatgaacccctttgcctcacgatatcgattaagctcaaggctagatatgtgccatcctctaatagctcaatcattcacttgaacctgttgatagattatataacttgtgattgactactcaatcacctttggcatggtcatgcacttccataatctacaacatcgaggggcccagagatatctctctataggaggggcaaatcccatcttgattattcatatcccactacatgtttcatagcatacccaaaaactacttttataactacccaattacggagtagcgtttagctgtccctaagtaagctactacacatgttgggaaccatgataatatcaggtctatggattcaacaccaacactaaatgagatcactgatgacacaacacatatggctcttgcagtgtctcatgttgggtctattcaacaacatg

SEQ ID NO: 106707 - DNA, 732 bp, Oryza sativa
aaggcacattctttccacaaagaacaaatcaatacgtagtgcaataaactaatcaaacatgcatctctttctccacacacaacatgacttgttagagcaattcagagcgacaacattcaacacatttcatcaggagaaccgtatggtatatccccgaggccacgcactggccatcgtcggcaccgcgtgccactgacaagccatggccgctgcgccaggctacacgcctaaggacgtactccctctgtcccaaaaataacttacctaggatgggtcacatcctatcctagattgagctattttgggacggagggagtagaagcaaaacttagattttttttataataattattaagagatatgatctcagccgtagaagaaaaggagggtctatatttggccaaatccacctggtggggtcgtccacaactccaggagatctgaacccgcactctacctagtcacgtccatataggcaagatgggtaagcagatgggcaagacaaattcggatggaaaaaattccaccttgaaatttttaaaaaaaattcaaaaaatttattaattacccaaaagaatattctatacggggaccgaaaatgcaatccaaaattcaagatgggtaatcagatgggcaagacaaattcggatggaaaaaattccaccttgaaattttaaaaaaattacaaattttattaataacccgaaaaattattctatacggggaccgaaa

SEQ ID NO: 106708 - DNA, 755 bp, Oryza sativa
tataggcgaattcgagctcggtacccgtagagcttaatccagtttccaccaagtttcctctgttaaaactttcccttgttaggttcgcagccgcgcgcgagcggagtggctcggtttcgagggatgcagctcggtttggctagggttaggggcggcacggattgaaggaggaggtgatgcgggcgagcaggagctgcgcaacggcggtgatgcggtggaggcggggtgggaggaggtctcgctcgttaagccgccactacagcttccctcttgcacagcaaccgaggcagcgttgaagtcggagtcagcgttggaggcagcggtggcggcggcgcaggtggagggaagcggcggagcgagcgggagcggggagggtagcgccgacaagtggcgtggggaggcagagggaagaggcgcgcggcgtgaggagcgcggcgcaggcggagagaagcggccgagaaagcggtggtttgtgggttttctcgtttctttttctttttctttctcccggacgacgtgggttcggtttgtggagacgtgataaggagtgggtccaggtggctgggtgggttggatccaggattgtaggattgcaggattgtggatgaactcatactttttatattagtagagatgtaccaaacattacataagtttgtttggtgcgcggtatctccacatgtgtacttatctgattgcaggctctatctgcacccacgtccacgtccatacatgcaataatcatgtggtttatg

SEQ ID NO: 106709 - DNA, 544 bp, Oryza sativa
cggcgccggaggtgaagaagatgaaggccgatctccccgttccccgtgtctccggctgaggttcttgaggcttcttgaagaggacgtcgaggcgacgacggtggcgccatggcttgctccggcgtgctccggtttgacggcgacaaagacgatgtcccggtgatggcgtctagtcccggcagcccccacggcggcacggaccatagagttaggaaattaacgggggaacgacggaaaaggcgacgggatggcatggattcaatttcccaaaattccagcggcacctagccaatatcgtaaatagtagtggtatttttctaatttgatacatttacaatagcatggatccaattaaccctagtttttatcataggtcatttatataacaagttttgtggaagattcaaaatatcatttttttggcaatttatgtcccaaatatactaccaagcataaaaaaaataaaataccaattctatttctgccgtgaattattatggaagtaaagagaaaccgttcaaatgataaggaaggcaaaccttgc

SEQ ID NO: 106710 - DNA, 749 bp, Oryza sativa
atcaagttaccttgattcaagtattatgttaccacgctgttgcagttgctctctctgaatttcattagtagaaaataaaccttccatacattattttcttatttggcctcttaaaatcacaatttaacatggaaaggtccaaggtgaccaagttgtcgtatgtatatctagtatatgagttaaatttaattagtgtgtgtgaacaatgccaaatgtgtcttttagcgaacaaatatcagtttatttgttttaagcaatattagaaattttataattgttctttttctatcgaaaacatgtgcaattagctagtgctctacatactgccttattttattctcattcttgagcacaataccctatctctgttactatgtggttacatctctaactcaagttcctcaatctgttcagagtgctgtttcttccagggatttgtttggtactgtatctccatatcaggctccaagcagccttcatacatttggaaggcaggtattaatcacgaaacataatcttattttgctgtaaatttgttttgggtttattaccggcttctggatttatgttgaactgctactgcatgacttttatcttggcttctttgtttgattagtgaatgatttatgacatgaaatgtttggaccttcaatattgatcactgattgactcaccacataattttgttgctttaaagtacacgatacaatgttaattgcagatttttttgatcggatgctgcctatttt

SEQ ID NO: 106711 - DNA, 510 bp, Oryza sativa
ccatggccgctgcgccaggctacacgcctaaggacgtactccctctgtcccaaaaataacttacctaggatgggtcacatcctatcctagattgagctattttgggacggagggagtagaagcaaaacttagattttttttataataattattaagagatatgatctcagccgtagaagaaaaggagggtctatatttggccaaatccacctggtggggtcgtccacaactccaggagatctgaacccgcactctacctagtcacgtccatataggcaagatgggtaagcagatgggcaagacaaattcggatggaaaaaattccaccttgaaatttttaaaaaaaattcaaaaaatttattaattagccaaaagaatattctatacggggaccgaaaatgcaatccaaaattcaagatgggtaagcagatgggcaagacaaattcggatggaaaaaattcccccttgaaatttttaaaaaaattcaaaaattttattaattagccgaaa

SEQ ID NO: 106712 - DNA, 703 bp, Oryza sativa
cagcccgtcaagcactcttgctcagccgcctggaggcagctctggcaagcctccggcgagcagccgtcgcactgcggggcgcacagcttggcgatggtgtcggagttgacgcacgaggcgttgcagatgtcgtcgcagttgctgcagaacatcttcgccgccgccggcgcgacgagggaggaggacaggacgaccagcgcggcgaagacggcggcggcggcggcgacggtggccgccttaggggaagcagcgccgggagccatatgcttctgcgtgtcaagcttgcaaagcttgaggaagatagctaggtagctagagagagaagaagacgagatcgatgactatgtgttagtaattgacaaggtaagccgcagtggtacgaaaatttatacacaggatgcaattgcaaaaaggagctatctatagcttagcctaattagccctatcactaaattacatgtgtgagtaacatgcaccagccatgaatgctagtaaatgaggttggctttgggaggaaaattttctcatgtaatttaatctcagcagctataaattaattgtgtccggtttcccatgtaatttaagctagctagatcttctgatttatttaagccaatacataagcctatatttggcatacgatggtctgacttttggatgagtctaggacgtacgtggaacttgttaattactccctccattt

SEQ ID NO: 106713 - DNA, 684 bp, Oryza sativa
atcatcatatttaaacatcatgcaaacatactatatctttatagtttttataatttaagagttttttaaatacaaacatattaaattatcatccaatataattcacataatgtttcaatgtatatctttattatgttttatgatatcctatatacttatatagttcatccttagtttgtgcttaaataattaatctatggtccaaattatttttctccttttttttctctaattaagtcatatcacatcaattatttttagcctttagataattaatctacggtccaaactatctccctactactagcttactttttacatttgaatcaccattctacatactatataaatttaaattatcataaactacattaatttatttaatctgatgttatctagctattttacatgttattttttttattgttatcatactgaattcccgcagcaatgcgcgggtttcacctagttggatataatagttactccctcggtactcataaaggaagtcattttggacagcgacatggtctttaaaacacaactttgacctattgtttctataaaaatatttattgaaaagtgatatatgtatacttttatgaaagtatttttcaagacaaatctattcatataatttttacattttcaaactcaataacttgagagttatttatgatttat

SEQ ID NO: 106714 - DNA, 1036 bp, Oryza sativa
gacccggagagaggagggggctcgggcggctggctaggccgtggccttcggccggcccagcggggaggggaagagaagagggaatgggccggcggcccattcgaaagagaaaagagaaaaagagaaaaagaaaaagaaaacgaaggaaatgaattttccagggattaaatattgcttgtgctaaattttaattggttaaaattatttctagagctctgaaaattccactaaaaatcttgttagcgtatttcgacacgtagaactcaagaaaaattccacatgccaattccgattattatttgcattgatttattagggtttactcttgttttacaccggtattttcttgagaccatttctaaattcaatttaggcttgggagaagaacttcaggatgtgacatgagttcatctgtgacgggctctagtttcggcctgattgaggacagtagtcatctgtgacgggctctagtttaggcccgattgaggtcagtagtcatctgtgacgggctctattttaggcccgattgaggtcatcagtcatctgtgatgggctatagtttacgcccgattgagatgagtatcatctgtgacgggctctagtttaggcccgataaaggttagtagtcatctgtgatgggcgctagttgtggcccgatagagataggtcatctgtgacgggctatagtttgactggtcgtctgggttaaagctatcggtgacgggctttacttagggcccaattgagatatattcattcgtgacggccgtttgcccgattgagataactcttcacatcagtgacttctagcctgtgacggatgctgtgtccgattgagatggggcttaccgtccgattgagatgagggtatccgttctagtgatatatgaagaaactggaatgataccattgtgaagatggtggactacgaaggaaaggggggaggggaggctcctacttaagcttgtggaggctagctgatggcaacggtggcatcctagcacatggcgaagtacgtggaggctctcacctttga

SEQ ID NO: 106715 - DNA, 616 bp, Oryza sativa
ccttctccttctcttgatcctcattgacttgcataaagtatgtacactagtaacatcgctactcatttctatttctattttctccagttactctctgcccctatctgtagctttcccatcaacattacaaatgtgaaatgtgatgccctgtacatggccaaggtgaattatactctcagaaatctttggtgcctagctaaagaacaaactccagttttcagtttttcaatcaattcccctcccccgtcccaccccctctctctctctgtgttaaaataaaattcattgccgtttctgatcaaatacaaaagaaaggacaaataagaagcggaaggagcaaatcaagaagacgatggacgtgacctggtggcggtgaatcggcgacggcgctagggatggatcggcacggggcagatggggcgacggtgaatgctcgacgacgagcttagggtcggcggcggcgccaatctggcgaggctggaggtcggatatggccgaactggtggaagcgtggacgacaaatgacgcggggcaggtatggcggattggagcggccatgctgcggggcgaagtccgtggcggaggggacaggggcgccgggcgcaaccatgtgcga

SEQ ID NO: 106716 - DNA, 510 bp, Oryza sativa
tacggtactgtcaaatccatcagagagtatagcatttgtttgacttcttatcttactttccaaagtagtactagtagtactacttttctccatcaaatcatcacagttctacttttctcttgaatggagcaagctcgtggctgagtttccaatagcaagctcgagaaaaggctcgaggctcgaacgaaccgagcccaagcttaattccaagctcgatgtcaaattaggctcgagtctgttccgagctcaagcctacatagggaagttcgctcaagcttggctcgttgacagccctatacatgcggactgaacacccaatttagttacttcaattaggttatttgatatttcctttgaaaaccaccatcttacagcattctacttgcaagctacttgcacatatactaattaggtgagattgagaagataagtatatctcagctttgctgccaataaatatcgtcggctgcatgccccattacactggacaccactccggctagtcaatta

SEQ ID NO: 106717 - DNA, 724 bp, Oryza sativa
ccacgcgtcattagcactaataacaacgctaaccatatggattaatctagttatagtttttattatcaaaataatacataaatagttaagttgaaagtttcgaaaatatgatgaaaattttcaaaatctgagttgaaagttttaaaaaaaaatcttgaaagtttcaatttcgagttgacagttttgaaatttgagttggaagctttcaaactcgagttggaagttatcaaatttaggttgaaagttttcaaatttgggttgaaagttttcaaatttgacttgaaagttttcaaattttgagttgaaagtcttcaaattcgggtcgaaagtcttcaaaactcgagatgaaagttttcgaaattgatttaaaagtttaaattttgagttaaaagtttttaaattttaaattgaaagtttaaattttgagttgttttaaattatggttgtgacttttaatttttcatctataaaaagttttaaatttcacgtatatattttaaatctttagttaaaaaatacaacctcatgaaaaaaaaggaaagattaattaaaaaacataattatcggaaactaattccgtcaactaatataatcttgattattttctccgaatctagcgcacttgagcacgcttcccggtgttccctcgcgcaaaaaacagaaatagaagtaggccgaagagaaatcacgtacgaggacatgggcctaaaacgcacgctagatg

SEQ ID NO: 106718 - DNA, 583 bp, Oryza sativa
attctacccttatatatcatatcatatagaaaagaaagaaaagatacaaacagaaatcgtaagtgacaaaggaatttatacgatcagtgcttggctacagcaatcgcaagtgacaattctataacgatcatacatgtgtgaaacaactatcttctttttttctttcttttctattggtacataagggtagaatggtcatttcattcataccgttgcatgtgaggatgatttggcatgctcacgtgacactttttgtgggtccaagtactatattaacccaaatgattaatttggagaactagtttagacaatttaaaacctcaagtactaaactaagtccgaaacgaaacttcagagaccgtattagctattcacccttttcttttccccacaagctcttaatggcctctacgtacccttccatctgggaattgaactattgatgtataaaattcctttgaaaccataatgtgatattttgcatattccagatagggcgcaaattaattaggaacaaagctaaatttcggcggagtacgtaaacatatctgtgtggggtaccgagctcgaattggcctatagt

SEQ ID NO: 106719 - DNA, 656 bp, Oryza sativa
atcatcgatctcgatctcgggtgcatcatgcatatgcactcggtgcaaattaagcagcaaaagtctgaactgcattgcatatgcagtgagccccagggagtcgttgaaagacgcacgcatgccgacgatgaagatgctgcaccgatcatcgtccggcggcctcacccgggatttccatgtcgacatcctgccgcagcagggagagagacatgctcatatgcagcagagcgtcgatcaaaccgctgaaaagacagaatgtatatatgtaacccataatcattcattattctgtccatagatttagttcgtttttcttatgaacttatactgaattaattggtaggggtgaaagacacggtgataatccaggaggtcgccggcgagagatcggaagaggcggaggaggcggcggagcgtgtcgcggcagattccggcgacgaggctgcacctgcaggtatacgacgcaactgcaactttcgcaaaggactggtttttgactcgcctgtagctttcatggagaaaatctgacctctaaattgaacccacctgccagtcgccgacgaggacaacgccgtgaagaccacggccgccgtggaagaaaccactgctcgtcccgaccagccatgtacccatcacacacctgcacgcagtcaaat

SEQ ID NO: 106720 - DNA, 684 bp, Oryza sativa
cgatttgagctgcaacaccagaaagcatatgctccaaataaacgattggtaatcaatgaaggagcaaattagtggcaaactaagctactgatgcaaatcaagtatttcttcagcactgcattaggctctcaggctatgaactatgggtattcctgatgagaattaatcagtatggtcaatcaaagcaagcatcagaatgtatgatttacctaattattttacatcatataacctgcattttatggttgattagtattactccacctttgcaatatggatgaactgataaagcattaggaactcagtagcagaagctaaatgcagcaaacatgctctatttttttaacgcaacctagtgaaaaactaccaccaaaatacagtagtaacatatgtaattgctaaccaaaaatgaaagcatgatggcttcagtttacttgctaccgtgacatcaattaaaaaggtttcaaaatataaatatgacacctgtgagcggaatcgattgatgttccgttcagtggtaatcttagggtgggttcccgtctgtgcaaaatgtaaatcggtcagatcatagcaacgcatcagcacgctataaagaagaataggctaaatgaccaagtcccacaagaaagagtaaaaacctcgatagcatactgctccgcaggaagaccaaatgcatcccatccc

SEQ ID NO: 106721 - DNA, 504 bp, Oryza sativa
  unsure (1)..(504): unsure at all n locations
tgtatcggtatataagacgagagtaaaattttaaatgcattttccttcttactaccattatcttatcctatccttacattttantagcactttactttctcccctccctccttgacaaattgaaaagttagcctttatacatttagaccgttgttcacggggatgagaccagtcagtggttggtgtacgccactctctttctatctctttgcatatttgccaacaaatctgtacagttgtggttataacatttaaaaactgtttattcaagaaaattgtttccttttaagatggaaaactataaggagggagtatatttcagaattttaatattgattatatataaattactttctttatataataatctgtaagaaaatgtttttttgtttaattgttagtagatgaacatgcatgatttgtattgcattctgaatatgtatcccagttgggtatatgatatattcaatcagtacatattatcatataatatattttttagat

SEQ ID NO: 106722 - DNA, 800 bp, Oryza sativa
ggtgtttttttttaaaaaaaagacaacctaacggagggattttttttatgatgtggcaaacgatcatcagctcgtgctaacggggtgaccgctggccggatggcaattttgcaagcaaccctactgttgcctctaagggggtgtttctttaccaggctagagagttgttagatttagcgctggataaactcatctcattttatcagatcgaacacatgggaacaaagagtcatgctgagtgaagctgtcccaactcgttggatgaaacatgtgcgcaaatatagccgaacaacttcattaagtgcgacttcttcatgttcccatgtgttcaatctgataaactgagatgagtttattgattgcaaattatctctgtcatgaaagaattggaacgacttcattaaacgtggcctcttcatgttctcatgtgttggaactgataacatggggtgagtttatcgagcgccaaatcaaacgatcccttagtcgggtcgaaaaaaacaccctctcggagagtgataaggggactgcatgcaaaattgctgcatgcccattggcgcgactaactagtgttttccacatgaaaaaaaatgcattttagatggtgcttttttaatataaaaaaccatcctaaagggcgttatcgagtatagaaacataaaacttgaaaactcaaatatacttttataaatatttaaaaataaattacagcatttgaacaggcatacgtacctggcctgcattgtttagtgaaataatgtatagctaggaaacacaatatatgcatgcatggtgaggta

SEQ ID NO: 106723 - DNA, 756 bp, Oryza sativa
ccttgcctgctgcttcagcattctgccaaaacaaaatgaagatgactgtcaattaaacattatgatttaaatctgaccctagttttatctatgccaaagcttgaattataattcttcaacacttaagaagaggggtagtgtccagtcagcagtacttcaaggcatgttgctaatgaggttagtagccatggcatcaatatacgtggttataggttgttactgttgccagcagcagttaagaccactgttggttttagtcttgcacttcagaatgctgcatcttttagaatctacttaggcttgtaccaataatgcattcggtaattgatttcaaaacctctctatattcattaattaggcaattcactcagggagactctgaaaataatactaaactgagggactctgaaaataattcttaatttgaaagttacaactatcaaagttcaacaagagccaggtaattttcattggttaagacaaaagaaaggaagcttgtattggataagtgaaaccactatgaaataattctacaccaaagaaaacataacaccaaccgtgtatacattcggaaattgattttgaaaactctagattcattaagtaactaattagacaattcactcaggtttgtattgaagaagtgaaacttagaagactgtaaaaataattttctagaaaagaaagcgttccggaagcatggatatcttaagcttgtctcagattggaatatgttgaaagcatcatagcacaggg

SEQ ID NO: 106724 - DNA, 500 bp, Oryza sativa
tacatgaaacagttcggttccatcaaaattccccgtgaaattcctccggtccgaataagccatagatcagacatcaccattcaccaatgatagcagcaattctctcttcatgtactagtagtctagtagtacaactcatcagaaaaggtagctgatctatgtcaatgtaattaatcaatcacaggttattagtactccagcataggtaaaccaggacgtaagtacaattaatgaaactaatgcagcaaagcaaatgctaataatggccactttccaccctgcactgcaacctagtctactcccctcacatgtcgcaccagctgcagcgccacactccactcctcctgacgactccactgtctcctcttcaactgaatcagaccagaccacgccgcagctgagctgcaggagcgcgcggccagagccttcgtggcgcagcagcacggtggcggcagagccgtcgccatgaaggcggcggcgagggagaggaagccgaggca

SEQ ID NO: 106725 - DNA, 722 bp, Oryza sativa
tcctgtttgccaatgttgccttgcttgcttgcacgtatctgctactactcacctgccattccggctggccttgcatcgctccatcacattacaacctgttcgttcctcctctcgttgttgacatcacaggtcaaagttggcgacggctactcctctcctaccggcccaagaacaatcccatgtgggcccaatcatacgtgggcttgttgtctcggcccatggattgaatattactatattgtttttttatggaattattaatatattgtttatattgtttagaggaaacctggcattttgtgtgttagtgacaggtgagaaggaggcggcggttagttgcgcaactgaaccgacgactcatcagtttctgttggacaaccaaactctaccaacctctgctacttgtttacaacaacaacacactcaatgcaaatctgtcatctctaacaacgacatgtgcatatgtgctacacaatgtacttgtacaatttctagtagttgttgggtattctaattgtactttttttaaaaaaaaaatgaacacttatttgatcgagttgaaactagagatcaccaaatgcgaacacaattcagtgctaataatgaatcgatttcgttccattccatcctccattatgtgcatcaaagggaatacaaagagaagtagtataatgtaactgtaatcctgatcaaataatcgatcgatttcttttttctgtgaa

SEQ ID NO: 106726 - DNA, 549 bp, Oryza sativa
aaaaaaaaaatttgaaactggggtggtaaaatgttggtattcacaggaaccgttggatcgagaacgtgcgataaaagaagacaagcgaacgcatcctgcctcccaactccattccgagtttctgataaccagatggatttactgggcaaagccaatgggatgccaaaaatgacaacactcatcgaattttggcatgatgtagagggatggcatttcatgttgtacagttcagttcattgccatccatacttctatgcaaggtcaaacagattggcagtctcatacttctatgcaaggttaatgttttacttgagcaacattggagaacgttaatgctttacttgagcaacgtaggagaccgcggataggtaaggttgtatttccggtgcaaatcgagctccgaaatcccagtgcatcaaactaccaactgctagcagtgcgttcctgcttggggtacaccaccatgattcatgtttccgccaactcttcgtcaaagcttcatccgagtttggtgttaatcaagatcaacaagtcatattagtttgatga

SEQ ID NO: 106727 - DNA, 738 bp, Oryza sativa
aatagaaaatgcagttcaatttttctggatgaaaaagaggaacatttcatcacggatcgttcagatgacaaacctgaacaccaataaataaacagaaacaaatgaaaaagaagaaaccatattatccaaattcaaatgccttgtcctgaactaataccgcggcaaatgggaatctctttgccggattctcctcacaaaccagcaagcagggcaacgacgaaaatgacaatgcaacagcagcaaggaacggtcgaagcggtggttagcacggcaatgtcccacaaacaccgttgagatcgacttaattgcagttataatttagagtaaatttcacaaaactacatatactctagccaaattatcacaaactacagatttaaaatgatgtatcataaaattacagatttaacaataaatttatcacaaaattacaattttaaggtggagtatcacaaaactatagatttagtaacaaagttatcacaaaactacagattttggagtttaaatctttagcattagtgttatatttgagttataaacgtctaagttttgtgattgaattgacactaaacctatagttttgtgataattttttttactaaatttgtagttttgcgataatccactttatgtctgtagttctctgaaaaatttagtggtaaatctgtagttttgtgataatttgaccaaagtatctgtagttttattaaatttactatataatttatttactta

SEQ ID NO: 106728 - DNA, 599 bp, Oryza sativa
tacagaagctatttggaatatagttgggcccacatgtcaacggcagtcaagagtagtattctgagaacatccatcatgttaatgcacaaatttgtaattttgtaaagaaaacaacaaacgttcatgcaaaattccaaatactagtactttcccaaacgtcctccaaagcttataatccaataaagtcatactctcaacataaatgaatgaatgcagttcgttgaaaaaaaatgaatggatgtactatattcacataaataaataaatgaaagcaattataatcagaaaccaacaaaatgtcactttgatctctaaataagaacataaaatcactttgtttttgggaacaaatattttgtgcttaccaatcggtttggcatttgtcgagtctcttttggagaactcttctgctgagacggcaccagacgtgttctttggccgctgccactcctgctccctcttcttctctgcatttgccgaaagaattcacgttagaaatgaatcggaacaccaatgtgaaaataatactagcatgcaaaatttgcaaacaaacagaagtaaagtaaacgtttgtgcttggactgatcgatgcaatctgt

SEQ ID NO: 106729 - DNA, 903 bp, Oryza sativa
tatgttttttctacgttttacaatcatctattttacacttacatttctatcaaaatcctacgttttctcaatcctgcaattcaaaggggcccttactatttatatgcgttatttttttctctctaaatggatgaatagctgaatatatggcctgtaataaatagttgatggtacaaatacattaattaaataatataaagttaataatagatttaaaataattttatgagaaatcaatattatatataaagtttctacaagaattaagacatacttcatctatcccagaattgtagtagcaattaaggatgggataacactatcacaaactaggcaggtaattatctaggatgagattgattacctatccagattactacgtattaacttgtccaaattcatatcattaggttaggtcaaataacaggctgattcgtacttactaaattagggctaatttcatctttaattgctactctatattagaggttttggaagcgtgtgccggcgagatgaaacggtttcgttcactacaaaaaaaaaaaagtcagccttctccatcctttacacactgaaaaaacggaagtacttgctccctctgtaaaaaaaaaagacaaatcctttctgtgtctaacgtttgaccgtccgtcttatttgaaaaaattataaaaaaaattaaaaagacaagtcatgcataaaatattaatcatgttttatcatctaacaacaataaaaatacaaattataaaaaaaattcatataagacggacagtcaaagttggacacggaaacccagggtttgtctttttttttttggacggagggagtaggccagaaaacaagatgacgagaagaaaagaaaaaaaagaaagggagaggagaaaaaaaacggaaaagaacaga

SEQ ID NO: 106730 - DNA, 1010 bp, Oryza sativa
  unsure (1)..(1010): unsure at all n locations
tgcgtcttgatctattgtnccgtgtccccctcctcctagggggccttgtatttataaccataggtgtccccttgtctaagtagaactagggaaaccaatatggatacaatccgagtagtccttgtcgtttccatgtagaactctagtcatgcttccttatgtggaactcctcctatatccgaaagttgtttccgtataagacatggtatatggtgggtcctgtcgagatttagtcaactactattaggtatgtggtatccacaaccctgacatatagtaagtaactattgtatgaattgactattacattggctatagatgatttggaggtagtagttgactatactattatacttgctcttagtacggtccgaccgaaggcaatttgtgactcatgagacaacgaacccaactgtttacttggtcgaaatagctaataggcgatcagtcgccgcgcgaggagaggggagcgcgggcagcatgcggtttctttttttgttttgttttttttcgcacggtttccgggagggacgtggtttctttttttttctttttagggcaagtactataaacccctacatattgcccctaaatttgacatataggattagatgatgagttggaggagagaagttaggagagagagaatgaaccaccccatatgcaaggggcaacctccacacaatctccaagaaaaatataagatgatatgagagtaaactaatactggggtttgtgtactagaagtgacatgttgtacttgttaccacttaattaatgagaagatgatatgatgtaaattagatgtgacactcacctccactataaaacttgcccttatgcgtgcggttttcttttttttttcttttcttccttcagtatcgtactttttgtgtggcgcgcgttttttttctggtttttttctttccggatctttttcttgttttttgtttttttaatacatacatatacaaagtttgtatacaaattttgtgtgtataaatttttat

SEQ ID NO: 106731 - DNA, 677 bp, Oryza sativa
accaagaatggcactgtatgatactagtatgagtaccagtagtatacagtactgtgcagtattatacctctttgttcttgttgctgcttgtcatctcctgacacatcaagtttttaattatccaggaaagctagctgttgagtaaatctgcaagcaaaacgactactgtaactgtatgtaattggattaatctactagtgagctggttgagcactttgccagtgttgacaggggtaggtaggtgcccattggttgtagggaagttgcacatactgaattcagacaaactgcttgtgaaaattttacagactgaattcggacaagttgcttctgaaaacaaagaaccgaacgaacggttagtggacagtgatgacttcacggggtgcagaaccatgcatcaactccttcctagaatagttttgatgaccacatcgcaaagcaaggaaatgttgataagacagcaactgctaaccacgaaaggagaacaccaatgcagattctgagattcagaagcgatctcctacgaatttggaccaaacaacaaactgcatcacaaagatagaagaatatttcagacttgttacaactgaattttgctcacaactttgtaaaatctgcatgtaattcagctattatcgtatcactcaaatactgaattcactgggcgatgttgagtg

SEQ ID NO: 106732 - DNA, 653 bp, Oryza sativa
tcctaagtttgttatactctaaggctcattaaggtgtttataacaacaacagaaaatataatgcaataatagtaatataattaatttaaaagaattcgtgcagtctatcgtactccaaaggacgagtacgctaccaaaataactctctaactactgggattaaattgttcaagggagggtgcatgtcttgcaaccttcgggctcgatgtagtcgtacaaaccgtctcctcctggcgcggagatttcacttgctccgactaccggaccaacgtcagtgctttctatttacgcaacaatcatcaccataataaataacagaaaagcaaagataaccaaaagaaaatagtatcacaaactgcaacaatgggtgaaaaggatttaaagaaataattttagggatttttggaatttcggtgaacggcgtaccctagggctaaaattagggtcgcgacaacgggtgatcggattgcaacgaaactgatacggttggattcggaataattctaggagtttggaataggtctcggattttgatttcgagctcaaacggatggtcaacttgataggaaaataaaaatgttttttcttatttatttttcaacaggaaaatcagatttcctattcatctcgttctgtgcacgggagccggtcgg

SEQ ID NO: 106733 - DNA, 996 bp, Oryza sativa
taaattttagtcccggtttgtaacatcaaccgggactaaagatcaaaaagtacccctcagcttttaaaccgggactaaagatgatttttagtcccggcttttattggaaccgggactattgttgaatttggccgaccgatcaaagatggtttcttcaccagtttgtacatatatatatatatggccctccttaatcaccgatcttttgagactaatcacgtatatgactttccttaatcaccgaattttgagactaatcacgttggtgaatttttttttatcgtttgccgcgcatgcatgcacatgccctcgtttgctactttgttttggcccaattgaagcttagtaattttttttgtttttggaatttattttaattttgttttaaaattcatctatttataaaaagtttgtatatcaaaagtttttatatataaagtttgtatatcgaaagtttatattagtaaagtttgtatgtataaaggtcaagttgtattaaagtttgtgagtagagatattagtaatttgaataggatttattaaaaagaaaagttcaaaaatttgggtaaaaaatctgttgagtagaagatgttactataaaaataaaagattatgtatgccttagttacacaataattatatggtaatgctttaattacaaacatcacactattttttttagcaaaatatatgcataccgtcaacatatgcaaatgattgtacctttaagtacatgctagctaattaaagtgtcggcctgtatagttgcatgctactccatttcttatccagttgcatgtgtgcatgcgatcgatgcgcttacaaatcatgatgctaattaagagtgtataaggtcatttccaacctatgacactagacatagttttcataaacttcacatcatcaagaaactagtactagtactagacactactcttccaatacaaacaccactattctatacttagatttaatgctacttatttcacatgatgt

SEQ ID NO: 106734 - DNA, 553 bp, Oryza sativa
tatataaaaaagagcttttggtgtaatatttatccaaaatgatcagaaaagattatagatagttaataagatggtgttaatatgtatttaagaaaaaaaaaagaattgaatatggtgctagtttaaagatggatgtaattttgaatttaagagatatgtatagggttctaattttttaaacgaatatggatggtagaaatagtttggtacaagagttgttgttaattaaagacgtgtataatgtgaattatatatatttttttaatttgttgttcgtaagttttaaatgtttagaaaagatccttcttttttcactttttactgagttgatagtttatttgaaataataagagaaaatgtgtgaatttgtactggatatgacgtagtttttagtaagtaaattttagagttgttttctgattttgatgggaatatatatgcataaaaaagtatattggggtatagttatagtttataggtagtttgggtctaattctttattcctagagggggggtgtttgtgcgtaaaggtgagaagatggaatttgaaaaa

SEQ ID NO: 106735 - DNA, 568 bp, Oryza sativa
acactctagatgtactataattacatcctaattacagctgtaattatatgctagttgcactgtaaatactccatccgtcttagaatatagtaagagattttggacgaatgtgatgcttcatattatcaaccacatctatccaaatatcttggaacggagggagtacactatacttatactatttaggggattttctataacatgttagatagttagtccccaaaataattgtgaggtcttttagaataaggctgtgtttggttccaccgtaaaaaaaatatcgggtcacatcggatatatggacacatttgaagtattaaacatagactaataacaaaacaaattacataatccacatataaactgcgagacgaatttattaagcccaattaatctgtcattagcaaatgtttactgtagcaccacattatcaaatcatgatgcaattagacttaaaagattcgtctttaatttacatgcaaactgtgcaattaattttctttttcaatatttaatacttcgtacttatattcaaacgttcgatatgataggaaaaaaaaattacccc

SEQ ID NO: 106736 - DNA, 549 bp, Oryza sativa
atttattttttgttccaccgagaaatatttcatcttgtgtacttataatatttcactatgtatggatcaaatgttgtagtaaactgaaacattctttcgctatttgctgaaacattgtttttatataaggtgaaacaacacccaatttaaatgagtgaaacattccgatatatctggtggaacatcgtgcaacatttaaaaataattcaataataaactatttttttcccgtcgaaatatatccatgtatggtcttgttttgaagatttaattgcaataaatttaatggtgcaatcggatcatgatttggataagtaatttaagagaaaaatcagtttaaaatagttttgcacgtaaatcatacgctgacgtcagcgcccgatttttttccaaaccaatcgggtgcccgagccgtagactcttcctcatatatcaacacgtgtgtgacaaatgattaaacattaaatttaaaattgcaaatagttaaggccttggttagttcctattttttttccaaaaacattatattgaatctttgacacatgcatg

SEQ ID NO: 106737 - DNA, 566 bp, Oryza sativa
aattcacaatcatctggacagtccactagcaaaatgtcttgtgcatgtctacataatagtgcctagtccacttaccagaaaatgctaattttatgaaagtttttatcgagagatttacatgtaagatcttcatatatcaacctaaatatttaaaaagacattgatactcaaaagttaaaagtttgagtgcatctatgcccaagccgacatgtatttgtgactggcggtagttctttttggccttgtgcaaggattaatttgtaaaagctagaatctgcagtttttgaagagagaaggatgagattatgagaaaaatgttcaattttcattttcatcattagaagtttaacttaactggattattggactcacataccagtggctttctttatgaaatgttacattagataaattgaattctttaagtatgaaactgattttctttttgctttattttcaggggttaaagctacatatctcctcgcagttgctttccttgagatattgcgctttagctgcaatggcggcatactttcagccacctctacattgaataaatcaaatag

SEQ ID NO: 106738 - DNA, 536 bp, Oryza sativa
tcatcgggctatgtgatgtattttgccaaaagtcttcacagtttatttatgggggatttaactacaataagtgggaaaagattatttgtttagatcttggtttaaaattctaatttgactgagttgctggggcatcacaataatggtaaagattataaaatgtttttgtgaagtctgtttgttttacttcggatcgagttgtcttagccccaggccccagcatgctttgtacctttcctccatgtatgaaaaatagtcatgagtgttaacatttttatgtattgttcgtatattataataacatctaaaatttactaaaatgtacttagtatttatttgtgattaggaaaatcaatcttgctttgataaaagtattattccttgcatttcatttgcataaaatgttgttacgtgggtgcatggtttgggattaaagacgtacagactaattatattagcgtatgctatgttttgattaccatttatatgtaaaataaactattaaaatgagttttaacattaaaaggcagctaaat

SEQ ID NO: 106739 - DNA, 552 bp, Oryza sativa
cggccggctcggctagttgaacggggagggggagggttagggttagggtttcatccatttcaaaattatctgagccgtccatcaaaatgaacagctgagatcgatcaagggtttgggccgcaccacttgggccgcacgcgggccaacagtctagcaagcgagaggaagagtatagggatataaattagactttggtcacttgtaggctgaagaagaaagtgggccgaaaaaggcccatagagataaaagaatttttatttagatttttatttaaataaatacttaaatgatgtttgtattatcaaaattagcaattaagctacgtaaattccaagaaaatttcaatgagtgtaattaatgatatagaaaatttaataaaaattaaatccaaccataacattttatttctcacacttactttacttataaattaatttaattatatacctacctacttaaaaaatacccaaatattacagaaaatttatatttcatttaattagaatttaatatgttctaattcaattttatctttttttctttcacgatgcg

SEQ ID NO: 106740 - DNA, 651 bp, Oryza sativa
tgtgctgttggcatatttggtagcaaattaaatactagtattaaagtaccacgatttgataggcgcatattttagctcggaacaaaaatgcctccctcagctctttttttttctttttttcctttggtatagatttgtgctccaagataccctaaccctagaccagtccaaaaataaataaataaaaagaatggtgcccagaatctcggttccagtgacttcacttcgaacaactgtgcaattaaatatgttctctatttctagcattaatataatatataagtttccctttaaaggctgtgtgtagttcagcgcaaagtttggattttggttaaaattggagatgatgtgactaaaaagttgtgtgtgtatgacatattaatgtgatggaaaaggactgaaatttggatccaaactttggatctaaacacagccttaataaaaatcatctgctaggtttcgtcctttaaatttatttaaatttcactcattttgagtatgagattctaataattggctgtaactttttgagcaaaagtcggaatgctctgttccattatctaaaaaaaaatgtgtattaaagcgactgcaatagaatgatataaatggattatacgagttgtcacattgtacctgtgcttatgtagtggg

SEQ ID NO: 106741 - DNA, 650 bp, Oryza sativa
  unsure (1)..(650): unsure at all n locations
taatcccatttttttaaatagttaattattttattgactaccgggtgaagagatctattatagtatatttgaccatattaaagataaatattttctccgtttcaactatagtcgctttgacttttttcctagtcaattttttattatgaatatctaaaatattaaattaatttgattaaatataatatattttttatgttgaaaatgttattatattttactattacaaatttgatcaaacataaaaggaatttactatagaaaaaaagtcaaagtaaaaaacggagggagtatatgagccgcgtaaatacgatgctcgttaatccaagcttaagaacaaatcatattccacgctcatttgctccttcaactccatggagtatatactttgcccttggattaattcttccgcgtcagtcactgacatcgtcggtcaagcgcgcggaggtacagtacacagccgcacgcctccatgacattatttgtctcaactctcaaccgctttctgctcatgtgccatcgcgcgtgggccacccgcaccgnacgacacagccgcatccatgactactccactagtgatcatcatgcgccatctatcggcgcgtggcatttatctacccgcacgacacgacgcgtcaaagcataactcc

SEQ ID NO: 106742 - DNA, 659 bp, Oryza sativa
aaccgataccatattggttaaggtttctatcttgtaataatgccccacatcctatataaggtgggcactgggctggaagccttctaaggaatgattcacaaacagatcgtcagatcaatactacacccggcggattcgaatcctcaaacaggagtggggtattttctctcattgagagggcctggacctgtctaaatccttgtctctacatccatctacttttaggtctcatgcactatccctttatattgtcgaaattttgtttggacacatatttttgcctctcttttcttgttcgatcgctcacttccatttcggggagccattactgcacggccaaacagtttccttttccgtgaaacgaagcctcccgaggagatggatcgatgtcgttcgctactaatccgaactatacgcgaatcccatcacagatgccgcatatcccgtccaaaatatctatatgcggtcctacttcataatcgcatcgcgggtttctttttatcatttgttatttttaccaaaggaccacagcagggtttttattttaaataatgacctcagcagggtttttttttttggtggttaagtaaaaaccgctcctctcagattaccaaaaaaccaacaaaggggcaaagcttgacaactttcgatcaaaaccg

SEQ ID NO: 106743 - DNA, 1500 bp, Oryza sativa
gcatttattacttgatataatagcttgatgagtatattgttatcacccttgctttaaccccctcttttaaatcaatttggagtttttgccgaagccaggagtttaatcatataaattagtttcattccaacttagttcccaggtatagattagatagatggtttaattctatagcaaaacattagagttggcttatcctatagcttctacagtaatagttagccacaatcttgtgaataccctattattttatgtaaagaaatttccattggagccttaatcaaatgtatgcgatgaagattcagattgttgaacctgtatcaatctactgatccaggggttgatacagtttaaaaatgtcggttacccaatctttaattttaggacccgacaaggtgtgtgggtggggccccctgtgatttgccagcctagagcggccgtaccgctcgcgccccctccccccagagccggccctgactacatgggccttaaaaggccaaatggcatcttatgacgatttctgggcttgatggcgacgaaaatggacgtcatagactgtatgacgacagaaagatcatcactagattaatgacaaaaagataagcattctttatagaacgccattagagatgcatgataggtgattcgtcacacgaacgttagatttcacaacatgacttaaaattcaattttcatgacgtaaattagcgtcacctagactggtggagaaaccctttttccacccggttcgtaacccccctttagtcccggttatccaaccgggactacgaatccgggactaaagatcgctatctttagtcccgggtgaaataacctggactaaagatcgatctttaatccggtcagccacgttgccagctaagccatcttagtcccggttggtgtaagatcgatctaccaatttttttcttatttgcatggccctattgctgcatggtttagggtttatgttacaatacatatatatgcattttatatatatatatacatatatatatatatgtatatatatatataggacggctctttcgtacacccaggtgtatgtacacccttttattaatggatgatccattagcattcaaattaactgtgaaaaaaattaataatattaatttccaaatgactgcatgcaagtggcatagctgcacaccggattgggtgcagacttgaacaagatcgttggcatgcatttgctttcaaatttgataacgtaccttagatatccccaccttttctagtatgcaacagtatatactgttttttaagccgcagtatatatactctttgaagtgatgagcagtactatatactagttttttttgtgtattagcagtacgtaataaggagtaccttatatttttgttgtagcagtgaatacatctttttttaattagcagccgtatatacttactccagaactaacgtgtatatatatactgattatgtctttttattggtacgcgcagtatatactac

SEQ ID NO: 106744 - DNA, 660 bp, Oryza sativa
ctcgtcgccctctacgtgtccatgtgctccaaattcgcagcgacttgctctagctcgggcgaggttgccatcgtagccggccaccattgatgatgtcatcatgacatcatcggtttttctttttcccgattttctaatagattaaatcttcggaaaatcataactaaataaccgtagatccgtttcaggtggttcaagttgctaaatttttctaaaatcaagatctacatgttaaaaatatccacatgtactgtttatgcttgtttttgtactgttttgttgatttttgtttaattgctttagtttccgacgtttcggaggagagcgtttccgttgaggatggttccgaagcgtttgcggaagcccaaggcaagtcgcacagatcccaagcaaccctttgagcatgttgaacccgtttaaagctattattttatttcaactatgcattgttttcgaatgtcatcgggtggtgaaccttttccaattaattaatggcctacgatgactttattttcctatgggttataatttgattagcatgaaccttatatattggattggttcagctaaatgctatatgtaagtttgcttagccatgcttagaaacattagctaactaaaggggttaaatatagattataatatactatattattatta

SEQ ID NO: 106745 - DNA, 1314 bp, Oryza sativa
tgtagattcttgaagttatgaactttattccaggaatataaaacttgacactcactgtacaaataatgtctctaagatttatctaagataagtcatgcataaaacatgtacaaacttataaaatacatagaaaattcatttcaactcattttgaaacaaaatcaaattctacagattcatcattcatcatcatacagtctctgattaagtgaaataaaagtaattacttactttgcatcaaaagcctctaaaactattatctttaaaatgactagttttagataagcaaaactttagaaattcatgtagaacccaatttagcttcaatttgaataaacttaagttatgtaggatcactaacacatgtatttccaagttatgaaataatattatatacttactgtgtagtaaaagtctctaaatattcatataaggatttactaacatagagcagcctttaatttgtaaaacttgtagaaaattcatttttagtccaaatgaaatgaacaaagtttctatagaaccagcaaatagttagcttcaacatagtaaaataaaatttggcaccttttgtagagaacatagatcaaaaccttaacttagtgaaataagaatttaaacacatagtgttgtttaagtaatacataaacatatataagtatatatatacactttaggtctaattaaacctaaataaaaacttgattgaccagtgaagccatagttccatcctcatccactaaaacttagaagaacttggctcatataacaatttctaggttaatataatatattgctagtttagattagagcatctctagtttataaaatatgaaccatactagtaaagaccataaacatgtgaactaaaaatgttttagataaccaaattattccttttattcaacttaaacaggaagtagcatgttctgaacctataactcaaaagtcatgaacatataaaacactatacaccaataacacgttataacttgtaaaatgcataaagaattcattataaatccaaaaattgtgaaaccaaatgtgttagtattagaaaacacatctccacacccctgtgaagtctaatctagtaaaaatcactttacaaaagtatttcataacactacctaagactatactactataaaccgataaaacttctaaaaagttcataactccctaatggaataagttaaaataaaaattctttcacctaaattcattttagatcagtaccaacccactgtgcataaatcatgcattttagagcattttggattttcagctctttcggtgtttaattgcatatcg

SEQ ID NO: 106746 - DNA, 642 bp, Oryza sativa
aataataaattaatccgtaaatggtctgattataatatagttaagtactttgggtgtccaattagtttcaggatttttcttgaaattatttgagcatgggaagtatttttaacaattcaaagatcattttggtgattgatttatttggaaaagcaataaaaatcctcctcctcagcttgggcccttttgggaccattccttcctcccttctccctgttcctcagcccagcctaaagtctgtttggcctcccccgcgatacagtgcgtcttaaagctccagccagccgtctagaggccgtgttcttcccgagagccgccgtctcctgcatcaaattcgatgcatccgttgcttcccttccaaattgagtgcaaaaacggattcctccctatctcctctatcatatccctaagatgcctcatcaaattcgttatctatctcacgaattttggtcgtttttatccggggaaactcaggataaatcctaactttcttcaccgaattcatccgttcccgagccgatctccttcacctttgcctataaatagcatcccctcagccttctcttctggttcccgaagtttttcctaaccctagccgccttcccacgctcgtctttttcttcggcgccggcagtcgctcca

SEQ ID NO: 106747 - DNA, 781 bp, Oryza sativa
tttttaaaaataattcattattacgtcataattcaattaaaatctatataaatgatttaatccgatttaatctatgaaaattcataactaattcatcttagctcgcatttagttggttcaagtctctaaatttttctaaaattgagatctacatgttaaaaatatccacatgtactgttcaggcttgtttatgtgctgttttggtgattttgctcttttctctttagagtccgacgttcccggagagtccgaatttgcaggagaagactttgaagagttccaaggccagcaaggcaagtcacacagatcccaaacaaccctttgagtatgttgatcccgtttaaagctattgtttctattcaactattgcatttattttcgaatgtcattgggtggaattaacctattgccttgttatagcccttttgttcttgattactctattccttgataccttgggttattataacttaactagttgagctttatatattggttcagctagatattagacataattgcttagccatgcttagaaacattagcacactattgggataacttatgcttcactattatttaatgatggcttaatgatagctcatgatggttaatcatgattggttaagtaattaatttgccaactaaaacctgataatggtgggttgtgagcatatggttttgatgggttgtgagcacacgattttcggttgtgaaacatttaccgtgtcaaccacaagccagcgtgggcaacggctttactttctatatagtatggttc

SEQ ID NO: 106748 - DNA, 756 bp, Oryza sativa
  unsure (1)..(756): unsure at all n locations
tatatgagctagtgtctctaagcatggctaagcatcctattcactttagctaaagccatataatgttctagctaatcaaattattaaccaagtgacaaagaatagggaatcaatagcaaaagggctataacaaggcaataggttatttccacccaatgacattcgaaaataaatgcaatagttttatagaaacagtagctttaaacgggatcaacatgcttaaagggttgtttgggatctgtgtgacttgccttgctggctttgtaactcttcaaagtcttctcctgcaaattcggactctccgggaacgtcggaatctaaagagaaaagagcaaaatcaccaaaacagcacataaacaagcatgaacagtacatgtggatatttttaacatgtagatctcaattttagaaaaatttagagacttgaaccaactaaatccgagctaagatgaattatttatgaattttcaaagattaaatcggattaaatcatttatatagattttaattgaattatgacgcaataatgaattatttttgaaaaggaaaaagggattattgcgtcagcggctcgggttcacggtggaccaggtgcacggcggcggtctacggaaacgaacggctgagatcttatcgatctaccgncggtccacggctagcgtcagcgctgacgtcagcggtgacatcatcaccggcggcggctccgacacggatgctcgccggctaacgacggcgcggcagcgcaaacagaaggca

SEQ ID NO: 106749 - DNA, 803 bp, Oryza sativa
atcgatccattttctttgtttcttttttggcatagattgaacacttggtggtgcgctcgtcggcgttcctggtgtctagagcaccaccatcgccccactttgtcattcccgtcaactcgaatcatctccggttgtaccattgcgccactgacattgcctaggtcccaggagaacgacgcccacatatgatctagccaatacgccgccacgaacgccgtcggtcgccgttgctctcctactgcctctgcttctcttgctgccgagtcaccgacatgtgggcccagctgtttagctacttcattaggtgctaaggactttaattaggttctttttgtaaaattgctttgtttgccatgtgggcttttggacctaaatgcaattcacctaatgcccagggacctttttgtatagggtttagggcttaccctaaaacatgaaattactatttcatgcatttattacttgatataatagcttgatgagtatattgttatcacccttgctttaaccccctcttttaaatcaatttggagtttttgccgaagccaggagtttaatcatataaattagtttcattccaacttagttcccaggtatagattagatagatggtttaattctatagcaaaacattagagttggcttatcctatagcttctacagtaatagttagccacaatcttgtgaataccctattattttatgtaaagaaatttccattggagccttaatcaaatgtatgcgatgaagattcagattgttgaacctgtatcaatctactgatccaggggttgatacagttt

SEQ ID NO: 106750 - DNA, 564 bp, Oryza sativa
agagagagagaggtggggagggcgttgccgctgtgtcattaaggctgccgccgtctcccctcccgctggatctggtggagggaagggtgcgccaccaggcccccgccgccacctccgccgggccggtgagagagagagagagaggtggggagggcaccgccgccagagcttgcgggtgggcagggctcgcgggtggggggagggagagagagaagcacgggtggataagggcgacgcagtcgtcgggataagcggtcagctcggctcgatttttttcgatgtcggttttttaaaaactgatatctattataaattaaaggtgctggtttttttactatgaaccgatacctttctctgacacaggttttagaaataaaaccagcacctatttagaaataaaggtgtcggttttttgtgatttcaacccacggaggtgggaaaatggtctataggtgccggttttagtatttttggaacctatcgtgccgatatctatttgatgttttatagtagtttgtatatgcatattctgatcggtgtcgtctctgaccgaaaatcaatgtt

SEQ ID NO: 106751 - DNA, 1465 bp, Oryza sativa
agagtccatatagaaattcaattagaaaatacctgaaattgggaattaaaaataagaaatattagaagaggagactagagtccatatagaaatacaatttagaaagaaattcggaattaaatatataattaaaggaatagaagaaggaacctccaagttcgctctcatggcctagaaattctcacattaatcggagaaaaagaaaagacagagtccatatagaaatacaatttaaaaatagctgaaattcggaattaaaaaataaggaatattagaagatgagactagagtccatatagaaatacaatttagaaatagttgaaattcagaattaaaaaaaggaatattagaagaggaacctagagtctatatagaaatacaattaggaaataactgaaattcggaattaaaaaaaggaatattagaagaggagactagagttcatgtagaaatacaattaggaaataactgaaattcggaattaaaaataaggaatattagaagtagagtatagagtacatatagaaatacaattaggaaataatataaattcggaattaaaaataaggaatattagaagtagagtatagagtctatatagaaatacaatttagaaaaaaatatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacatgggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaataaataatattggaagaagagcatagactctatataaaaatacaatttacagaaaattcggaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgcaaaatttaaaattatgttgtcattttaatatatttgaataatataatgagaaaacatatatgctattatatgagagaaaatataatgatgctagccgcgcagattgcgcgggccactatgcttgttattataatctagcactctaaaacaagtgtagttcagaaatgatagaagaaatgaccacacaaaggtaaatttaaccaaaacaagatcaggaaaacacattattgaagtctatttgtgaatctccatccataattggtaaaaagctgcataaccgttgtctcaagctt

SEQ ID NO: 106752 - DNA, 909 bp, Oryza sativa
agtctagagtccatataggaatatatataatttacaaataactaaaatttgatattaaaaataattaataactcccgcgtatataaattataatataaatattacccattagtagttttgtaaagttattgcaaaatttaaaattatgttgtcattttaatatatttgaataatataatgagaaaacatatatgctattatatgagagaaaatataatgatgctagccgcgcagattgcgcgggccactatgcttgttatataatctagcactctaaaacaagtgtagttcagaaatgatagaagaaatgaccacacaaaggtaaatttaaccaaaacaagatcaggaaaacacattattgaagtctatttgtgaatctccatccataattggtaaaaagctgcataaccgttgtctcaagcttacgacatacagcttttaaaagctcaccgtcttcattacacctttgtagttgtacccaaaaccggagtcaataggttgccctgaaaattacctgcatatccgtcctcaggtacgggaacacaagatgtgcatctgctcaccagtagcccaggccaacgtgccaattttgtccatcatatttcggctgagctgagatagagcatgtattgtagcgtggagctggcacgcagccaatgcacgtacgttgtgtatatatggccacattggtaccactgcgttgacgacggatctgagatgcatattgattgggccttttgtggtcttctcctgcacaacgccctcgcccagggcaatgaattccagtcttgtccttttcacttgtccttttgtctcaaagtcacgactcactcgctctgcactggtagaactaactgtaagtctgtaacacaccaattgtttcgggcccaagctagagcaacaaccaaa

SEQ ID NO: 106753 - DNA, 508 bp, Oryza sativa
tcccccacttccccctcccagtgccaccttccctcacccacccccctgaatccctaaccctaaccctaccccgagcttattgttgcatggtcagaaaacgcgcacgcttccccctgccgcgcatgcacggattaggattcctgaacaaatgaatactacgagaacaagataaatgcaaactaaatattatgaatggggaattaaacacaagaaattgttaaatacataatggatacatggtcgaatatatttagattatatcaacctagataatcaaacaaatgaactactgagatatataaatgattagtctttgactaagccatcaagaactaaagacaagatgaacagtacatggaaaaaatttaactaaacaaaacacaacttatgaaggaaaatagaaaaaaaattaagtgctttgattcatggaggtgggaggtggcacacttgagatggaagtcatagaactaatccgttagaagacccgatggcataagtttaactcgat

SEQ ID NO: 106754 - DNA, 796 bp, Oryza sativa
tggtgtgtgtgtgaatatgtgagaagaggggaatatgttttaatcctggcgtgcgctttgctaacaagtactccattttatattataagtcgtttgacttttttcttagtcaaaattctttaagctcgactaagtttatagagaaatatattaatatttttaatacaaaataaaaatattttcataatatattcaatctaaatttaatgaaactaatttagtgttataaatgttgctaattttttctataaacttaatcaaacctaaagaattttaactaagaaaaagttatttgacttataatataaaacggatggagtaacagttttgccaaattggcatgccacgtgtgcattgtgccgcctaaaccgctcggaataatgctcggggattatttgcccaatttaaatagctgggagtgcaaaacgatactcaagttcaaaggtaattcagtcaacctcaatgctttaggggtaatgtagactattctgtatttcttagctattctcactttcatatatatactcctgtgtaggcactgaatcttatgttgttacttttcccctctaataatacatatcttcatgctggacatctataaaattgagggtcaaaaagatatatacaaagtttttcatatttattccctacagaattgagtgcgttttggtgccactaagaggtccgcgaccatttatcagtcaaaagggttgggctaaaagtggcgttctgcttcattcatcattgggcccaaaatggactatgaagtatttacccaccgacttacaacccatca

SEQ ID NO: 106755 - DNA, 1735 bp, Oryza sativa
atttaattatagtcatagaattgcaaaatttaatataaattatggattattcttggcaatttctataagaaatcaattcgcggtaataatttagatgtagttaataactaaacaaatagatgaattcttatggattattatagattatttttttgggtaatccctataagtaatcaattcacggtagaaattcggatttaattcctagggattttagccgtgtattatatttaatcatctagtcatagactaaattaaatcatataatatttctaggatttcgtccgatatttagctcgcgatagaaatctctaacctattatatggatataatgctcgggtagattaaattaaaaacttatgacaacaaaacatttatacccgcaaaatagtttgaatcgaaattgggtttgccttagttcgcgaataataaagttaaaataaaggaatcgactttcgcattcgactttcatttggatttatttggattttgtttgaattctaatcgaattcaaattgttctttcgcacataattatagagaccgagggagccacggatccgggtgaaggccaagacccgcaagaccttgagcaaggcaagtcatcactattccttgaacatgttgatcccaattgcgaaattgttttgtttacaaataaaattgcatgcaattatgaacatcctacttgtaattatgccatgccttgattattgtttactccttattccttcggaaccatgtttacgtatgagtctctagtcaattatgacaattgcttagaaatgctattctagaatcatgcatactcatatttatcaaatgctatatgcttgggcaattacctttgggaaggtagttgagatgcggcatgtggagacatgagcgccacattgccatgatattgatgacatgatttgtgaaaggaaaataaagttaaacaactgttttcgactggggcggctggaggatttgggtggtgtccggaaaaggctagtgccatccctggtcaattaaggaccgagccatgaagttaagcatgaaacgaccccccgtacaaccgcacttctcgtatgggtatagacctagcggagtagatagctgagcggaggcagtatccatgcgtagtggtcttcttttaggtgtgtgatgtggcaagcagtctgctggcggatgcccggttcggatgaccaggtgaatggcggatgcccgttccggatggtcagaggctggcttggcaatactacatgaggatacccataagagaacaatcatgatggactgggttcaacgacaagaagcaacgtaggagtgtgtgtttttcccttcccgggagcgccagaactcctctcactgctagaaacgtatgacgcctagagtgcatgaggatgtaaagttcatggagcgggtactgccaatgcaaggttatcgaaaagctttgccgtgacgcgtctcatgtgttgggatgaggctcatgtgttgggcagtcgcggagtgcgggtaaagtgtacatccactgcagtgtgagtaaactaaatctattcgaatagccgtgctcgcggttaatgagcaccgggacatgtattacacttggctagactctaaattctttaacttgagtgggatggaatattgcatgataatttttatgctgatggagccacttcctgagaggcggaaacgtggacgtcctcagaaaatcataacgactcaatgacgggaagctatccttggg

SEQ ID NO: 106756 - DNA, 1613 bp, Oryza sativa
ctagactctaaattctttaacttgagtgggatggaatattgcatgataatttttatgctgatggagccacttcctgagaggcggaaacgtggacgtcctcagaaaatcataacgactcaatggcgggaagctatccttgggatcataatggatggtggacagaaccgtcattgtttaatatgaacaatggtattaaaacttgattagtctttgctaggtcttaggcttgtgaaaagaattacaaaacttgctttgcgcaaatgaaccatagccatcctttgaaatcctctgtcatgtgcatcattgctgtggtggcttgctgagtacggttggtactcacccttgcaaatataaaatttatcagaagcgggagatgaagcttcggaggatccctatgcctactaccaggagggagatgaagacgaaggcgcccagtaggtcttagtacggtcgttgcctgtggcaatggcatgccgctgcttaaattctgctgccttacctatttctgcttttggatgtattccggaccgctcggtccgatgatttaagactatgcctgcaggcttatgatgtaataattcgtactagacattcgtgtatgtgtatttggtatttcagctatgaattcgtgtgtaccagactacttgatccagggaaatggtactgtttacacgattgattcctgttataaaaacgggggtccacatatcggcatcggctagcattgctatatcggcttattggtcgattggctctttgatcttatatttatacatcttgtcagttacaagatcaaactgactgtatgcttggatcttatcaatattttggacctacactagagctaagtagatcttccaggccattgtgttcgtcgacttagttcatgccaacatagatctggcaccatcggccgagcgcggatttttcgtcaacaccgtcctcgtggagcacaaggcaccatgagcagccgcactgtccacgttgtggctacagacgaagatatggaactcaagctcgatctgccggtgcccgcgccattggagctcgatccatggcttccgagctcgatttgcaccaccggggctcgatccaccgccgccgaagctcgattcgcagaaaggaagatggccttgccaccttcgtctcggcctgccctttctgtcttcgtctactgggccgccggcggggaggggagagggaaacaatggtagtggagaggagagaagccagcgaaggggagaagtgccagtggagtgtggaggagaagcgacggtggtggagaggagagatgttgtcacaggggagaagcggtggtggactgaggaggaggagcggcggtggtggataagggaggcggccacggaggggagaagagacgacgcccgtggagcgaggagaaatggcgacgcccgtggagaaggggatcgggtgagagagaggggaggaagggaggagaaaaaggtatagggaggtgctgacatgtgggtcctgcagtaggttaagggtatatatgtaatcctttttattgttacagggtgtaaaatataaaagttctaattgattactattatagggactgacataaaaataactagggtctaaaataaaaa

SEQ ID NO: 106757 - DNA, 1241 bp, Oryza sativa
tttttgagaatctgagctgagattgttgtgtgatgtattttatttgtgtgtgatgtgaatatgtgattgaattttgtagaagttataatgtatttttttaagtttttttgatgtatttgaagatgatcgatttgtggatttgaaggcaatttaaggatgattgttttgggattttgggaacgggatagggttagggtgaaatcaatatattaaaaataataaagagaagaaaataataaaaaagcaactggatctgcctctttagtcccggttaccaaccgggactaaaaatcgatttttactcccggttatctcacccgggactaaagatagcgatctttagttccggattcgtagccccggttgtaaaatcgggactatatagggttacgaactgggagtaaaaatcacttctccaccagtgtgacaggtttttttatgtaagctatatggcacttgtgatgattgtggatacaaataagagtcatggaactcacccaaaattagagaaagcgcctggattgcatatttgcatgatctttatacaatatcgctgataagaaatgcctctacgagaacgacatcacgggcgcatcagccacgcagccaatgtggccaaacaatatagttgtctccttgtaacccctaaccctttcactatacacggaagaaaaacaatggagctaaattataataatagtatacataccctatagcaccgctggaactcaattttagtctatgtttgcaactctccttactatcggattgcaaactgggacccgaatcgggactaatgatccatcttggatattttgtttcaggtagtaacaccaacccaaactaaaaagtttttttcattgtttttttgccgcttgcgtattgattttccctaattgagttgcaaaatctaaaaaaaaagcatcacaaatactaaaaaaaagcatcacaaatacagattcacatcacagatcaaatacatcataaattctaaaaacaaaatacatcacatcatagataataggaaaaagtacgaattacccccccgaactatcgcggtcgtccgaattacccccttgaaccacaaaaccggacattcttcacccccaactatgtaaaccggacgaattactcccctcgacccaatccgcggtggttttggtctacgtggcatcccagtcagtgtttttaataaaaaattgtgggacccgcctgtcatactcttccactttcccctctct

SEQ ID NO: 106758 - DNA, 579 bp, Oryza sativa
ctataaggcgaattcgagctcggtaccccatatcacaacatatgcaatacagtccgaatactattaaagtgcttcttagagtattttggacagttccttccctgtggtcaaatgcagattgatgggaagccgtgtagatatagtattctaaagatatgtgtatacccatagtgacgccacattgtagctgtagcatcaatggatcgtataaatgttgattcaagataattttcttttctcataattgtatttgagatacaactctttcttctagttttacaaatataattgtataaaaccatatctaaatttgggcctttaaatcaaagcaattctggaggaattttcaaggattgaattcctatggaaagacatctatcctatatggtcatttagaacaagggaatggctctttcaaatcttttgaaattccttaggattgtctcaatcatggaaattttggaggatttcctacatgaggatcaatctcctggaaaaaaaaacctttgtatgtctatatctctgttttaattcctgtgtttttcctacgttttatccaaataatcattcatttagttt

SEQ ID NO: 106759 - DNA, 634 bp, Oryza sativa
gatgcaatatcttacagatatgcaatatatgtatatatcgacgtaattaataacttctacgcaagcatttaatgtataagatattgttatatcttacaaatatgcaatataatgtatgagatgttatatcttacagatatgcaatatatgtatatatcgacgcaattaataacttctacgcaagcatctaatgtataagatactgttatatctaataaatatgcaatataatgtatgagatattattatatgttacatatatgcaatatatgtgtatatatcaatgcaattaatgacctatagatagtagcattcaatttccactatagacctcccctatttaaaacccaagcatcctaatcaaaccactcaccaccactatcaacacaactcttgcatcaccatctgagagaaaccagggagatacacacaagcaatagccatggcgagacaacaactcctaggtttgttcttggtcctcgccattatggtggcggtcgtgtggggcgaccctagccggggctgcgaccaagaccggcaggacatgatccgggagtgcaagaagtacgaggggtggccggcggagcccaaaatcgagccgtcagaggcgtgctgcgccgtgtggcaaagggcc

SEQ ID NO: 106760 - DNA, 585 bp, Oryza sativa
atagaagaggtttatcattgagggcccaatggtgagactgttcttttatgagcccaaaaataagatatggcccattacacccgactctatccctcctttccttttttttcttgagatttttttccagcttacatatgatatattggcttgtaggattgattcaaaagaacttcttagggcccctttgatttggaggaaaaacataggaattttagaggattttaattctataggaaaattttctataaagccatttgaaacaaaggattgaatcctatccaatcctttgaaattcctatggaatggacaatcttatagagattttggaggaaatttagcaagagtttcaacctcttgctaactttcctttgagtctatctctctcatccaattcatgtgtttttcctgtggttcaatcaaacggtcattcctgtgtttttcctgcgttttgcaatcctctgttttacacttacattcctatcaaaatcctatgtttttcatattactacgttttctcaatcctgcgattcaaagggggccttaggataggaaaaacccttcatattttagggcccctttgaatcg

SEQ ID NO: 106761 - DNA, 1378 bp, Oryza sativa
catgccattactcatcagaattcagaacgatggtcatatttctaactagtttagcatgaactgtaatacatattgcaggagagttaagcacacattcttgtcatcaatccgtactaggcatgaagactaattgtcaccaaaaccaatattttcgttaaaaaaccctgtttcacttttaccgggttttcgaagtatgtaaactgcgtaaaaacacccattgtacaccctgacaatttcagttttttcctgtcattctacaactgagagcaacataaaactgcatttccggcatcgactgaaaattctactctatgcctctaaaaccaacacactgatcttcgctcgatttccctgagcctgtcagaaattcagcatgaaaggattcactgaatcaatccctcctccgatgcctatatctcctacgtcacgatgcatccggatctgggaatgtcaaccgatgatccgctgcagtcatagcagagaaatatgcagttagacagtgcccaaacagtactactcctgcaagtaaaaaaaacagtgcaagcaattctgcaaatgaagatactactcggagttcccgtctttcgcactaagcactggacgatcattttcacaacaaattgaaactaccatccttcatatatgcaaaccatctgctgttgcatgataataatcagaacaaagtgaaattagcatccattctatatgcagataataagaactcgaaatggtttcagacaatccattttaggtgacagacccaccacaacaatagttctaggccagatcacacagtattaacataccatttagctactactaattcttcttatctacatattcagataaaatcctattcccaagaaagcatagtacaccaattgcatacaattttcttgtgacgcctgacttgcattccatcaacagaaaattcctcacatttgtcagcaagtaaaaacaattcctactgcaatgttcacttctgctgttctactacaatgttcttcagaaaactcctaactcagcaagtaaaaacatgactgcattttccacaaacagtgcactgagaactggaaaaatctacggtgctgagataaccaaaaggaccagaaaaggagatatatgccattcagaacaacataaactatgttcagaaaattcaggaacatgcatatcgaaatcgaagctaggctgcttaccttcgctgttgcgcctgagagcgacgatgtgcagggtctcccggctgtgaggcaggttgatgagcagcggggtgagccgcccatggcggccggcgcggacgcacatcgtgatggcgtagcccacacggttctcgagctcgtttctcaagagctgcaccgaacttccttggtactgaaac

SEQ ID NO: 106762 - DNA, 2117 bp, Oryza sativa
actcctcggcttctcggcgtggcgtggcgtggcgcggcacggcgtggcgtggcgtggcgaggaaggcgagactgcgagagaggcgaggcggtggtgcatttgaaagcgtcgcgaggagaggagggagacgcaggccgctctctgacagatgggtcccctggtcaaatgtggtcaaccgtagtcagtgacggatgtgcccgtgcaaaatgttgaatttgctcaaacgagggagcgcagattcaggattgagtagactctgcaaaatttttaagaaaaaaacgagtttctgaacttgttctgatcgctgctgcaatcaaaacgactctgttcggtttcaaaaatgtatgaactctgaagtcacactgcctctgcattcagctgcagtgtttcaaagaaaaaaaatggtcaccaccatacaaatcgctcaagataaaacgcaatatagcaaacttggcccttaaaaaaaatgcatcaatctgttttgaaaggaggaagtaatcagtctgttgttcgcttctagagaactctcttgtcatatttttttttactttttgatctaaaatttggtctagggtagacaatcaccgactcaccgtaacaagaaatgtagcatctccaaacttcaggagattcagttactgtcatgactcttcagaattcaaaacatttggcattactaactgtcaacttaatcaatatttttgtcatgactgaatttacagagtgaaattagaatctgtccagttcttttcaaagaagtgaatttacagagttattaggaagattccatggatgatcgatccatcagtccttcagccggttgttcttaacttttggaactaatagttggtttagggtaatcacaggaacaggtaaagaactactctactagattctgcatagcaaagcagcatctgcaaaccggcaccgtgaaagttcccaaatagatggagagggacacgctattactcatcagaattcagaacgacgtgcataattctacctagtttagcatgaactgtaatacatgttgcaggagttaagcgaacattcttgtcataaatccatactaggcatcatgactaaattgtcaccaaaaccaatattttcgtcagaaaaccctgtttcacttataccgggttttcgaagcatgtaaactgtgtaaaaacacccattgcacaccctgacaatttcagtttttttctgtcattctacagctgagagcaacataaaactgcatttccggcatcgactgaaaattctactctatgcctctaaaaccaacacactgatcttccctcgatttccctgagcctgtcagaaattcagcacgaaaggattcactgaattatggccctcctccgatgcctatatctccgacgtgatgatgctttgggatctgggaatgtcaactgattatccgctgcagccatagcagagaaatatgcagttagacagtgcccaagcagtactactcttgaaagtaataaacagtgcaagcaattatgcaaactaagaacttgaacaggtttcagacttgaaaccccacaattaaggtactacgaggatgccgaatctcacactaaacactgatttgacaataatcaaaacaaattgaaattagcatccattctatatgcagataataagaacttgaaatggtttcagacaatctattttaaatgacagacccaccacaacaatattaccataccattctgatactaccaattgatgttatccacaatattgagataaaatcctatcaattgcaaacaattttcttgtgatgcctgactagcattccatcaacagaaaattcctcacatttgtcagcaagtaaaaacaattcctactgcaatgttcacttctgccgttctactacaatgttgttcagacaagtcctaactcaacaagtaaaaacatgactgaattttccacaaattccacaaaacttactgaaaactggaaagatctacagtgttgaactaacaaaaaggacaagaaaaagatatgcatgccattcagaaacatcgcccacagcattgccaacaatttcagaacagcataaactatgttcagaaaaattcagaagcatgcatgcatatcgagatcga

SEQ ID NO: 106763 - DNA, 1048 bp, Oryza sativa
agggagacgcaggtcgctctctgacgtgtgggccctttggtcaatgaggtcaaaagaagtcaatgacgggtgggcccgagcacagtgaatgggcgtcgcgaggaggagaggatagaagagtcacgggttgccagttgcgcacagccagatagccaatgactggtggggtcaggcacagtcaatgactggtgggcccgaacacagcgggtgcaataggattagccatcgacgagccgtgctaacttgaacggaactacggaagatgtgtgaaatttgctcgaacgaggcgcacatttaggattgaatttgagtacactctgcaaatttcgtacagaacgagttctgaacttgttctggtcgctgcaaacaaaacgaacctgttcaaaggagtgaatttacagagttcggttattctctttttgcttaagggtgattaacatgagttactatgatatgtagaagacttcatcgggctcattaacatgaggattttcttggccgtgttgtttttgcaaaacaaataaaattcgaagtctgaactccaaagtcatacacaacattcaactgcaagtcattttgttgccatttcagtggtacatttgcttcaaggtgatataatatacagtagcaaacttggccacgaaaaaacttcaagcaatatacaagttaatggtgaactgtcttgtttgtgttatgtacggagtagtacttttgcatcaaacaatctgtttagagtaatcaccgcaataggtaaaaactaccaactactcggtacctaggtagtagaagcaattactcctgaaccattatctaaaaaaagcagcatctgaaaactggcaccatccaacatattgctaagtagaaatatattactgctgatgctaaacttggtagaaatatgcatgatgtgactgaattctgatgaatgattacagtaactgaatctcctgaaccattcaggatttcaggtagtatccctttctgtttgggaattttgaaggtactagtttgatatgtggaatgtagttaatttagtaattctttttac

SEQ ID NO: 106764 - DNA, 4016 bp, Oryza sativa
ctgaattttctgaacaatgtttatgtggttctgaattttgctgtgaattctagtaacggatggcatggagtgggcagtgtctctgtttttttgatttttttttgtgtcagatcagcactgtagattttctagctttcagtagtttgtgcctgtttggaatttcctgaaaatgcagtgatgatgtatttgcagaacttatctttcagtagagttaggatttgtctgaagaatactgtagaacagcagaactgcagaagtgaaatatatctgcacttatctgatgaatattcattccagtcatcatcagacaattgtgtgcaccttgggtttaactgaatgctgtaggattcatctgaatgttgtagatttttcggtgtgaaattcagcattcgagtagcattttaacatgtgaattactggcactgtttttacttacaagagctgtaattcttgtgtattactctttctaactgcgtgatttgtttgctatggctgcagcgtatgatcagttgatattcccgaatccgaatgcattgccgtcagccgaggccacagatgaagacgatcccacgattgagtgaatccttttgtgctcaagttctgacaggctcagggaactcgacagaagattagtgtgttggtatagagtggaattttcagttcagccgatgctggaatgcagttttacgttctctcagctgtagaatggctgaaaaacctcaaattgtctgtgtgttcagtgggtgtttttcgacggtttacgtactttgaaaccggtaaaacagggctttctgacgaaaatattggttttggtgacagttagtattcatgcctagtattgattgatgacaagaatgtgcttaatcctgcaatatattgctattcatgctagacttggttacaaatatgcatagcgtgtctgaattctgatgagtggttccagtagctgaatgtctgaatctcctgtagcattcaggtttgttctagtctatgtattttggaattttgataggttccggtttgcaaatgctacatgctagtatctgctggttctaaacttactgattaccctaaaccaattgttggatccagaagtaaagtacacaggattaagactatgtctgatgccctgaagcattcagggtttgtcccagtccttgtaagagtaattaggaattttagaaaacttatttttgtaaatagtcccttccactcttgtaataggtttttagttctatttataaaataagttttctacaaggtctaaatgtaaaaacaacttcagatatgcttccacatcaggaagtggatttttgtccctcgagaagacatcccatcgttttgtgtatggtgttcaaaaagttatcaaaaaatttgaaaacaattgtcaaaaaaatcaatatatgatatatcttttcacaaacatacaagttaaaatttgacttatacaattcgaaacaaaaataaaaaatttgaccgtgaattactcattctagtcatagtcaaatttattaccttttacagtgtttgcattcctaaaatggcatagatctaaccgctcacgatgaaaggtatcagaggtagaaaggtactaaggattaaaaggtaattgataacagggcaattatgtctaacaacgtatggacgtaccgaaaggtacggtgtaagtggatttgaaggtaccacaaggtaccgcgtaagtagtttttaaaggtaacgtaaaatatgatttatgtggtgggacaaaaattacattctcttctattcggtttccaatcttcggtcgttctgtttgcgtcggttttcaaactttggtccgatttacgtggtacatatcatattcgcatgatcttgataattatttccagttagtcattaatttacatagcaatttggtgatccatcgtttgatgaatgtaatcaaagatcgaaaggacaacaaattgagaagatttacgcacctacaaagaacaaacaaagttcaatgaggaagatttgcgaaaaaaaaactaaacaaatcgtctgacagatcgggaccgtgcggccacttctagctccggcgaacataggtagtcctggaccacttcctcccggtcctcttcctccgccgcccctccctccaaccaccgcctccggccacacgtccaccgccggccctcaattctccacctttcaacttatcgaagaacacgtaaaccttacgtatgaacagaacgtatctaagaacgatgcaacgcaacaggctacaagctaattccttcgataccttctcataccttttcatatgtgtaaaagacacatttgtcattctaatatcatcatatttatattaatgccacctattacaatattttctttccataccttgcccctcgcagatcatcggctcacgtcgccccacctcctttacctcgcaaacatcgtataaattgaatttgaatatgcatgtttgtgaagtgacatatcacatattgatctatcatactttttttaaggaaattttttgatgactttttaagtgacatgtaaaaacggggcatatccaaatagagtttcccttccacatcactgtcctttgtaaaggtgataagctcacccaaggatgctcaaattacatccagcacatccatggccatctcaaacgcaatgaaatttctgcgggttgggattaagttcaagttctttaatctcaacctgccgaaatttattttctttgcaattacccatttgagtaaatttaaagcagcaaataatcatgtttcaagcaaagtgagtgtttttcttgtgcggtaactgaagcctcaatttggtggcggagacctggtggccttctgcgtgctctcaacacagcttatttcgattgcttatccgccaaaaatggtggagcttgaacgaaaaattggagaggaccaatatgatagtttcatttaaaataggaatattatgctttgtttaaaacttgagcatagagagtcaacaaattcagtgtaacttttctaagactgaggagacatgattaaagttagcttttactcctatcgttccaaaacataacttaatgtaagaggagatatgacccctcctaatacaatgaatgtgagaccctgtttagatgggactaaaacttttaagtccctatcacatcagatgtttggacattaattaaaaatattaaacgtagactattaataaaacccattcataatattggactaattcacgagacgaatctattgagtctaattaatccatgattagcttatgtgatgctacagtaaacattctctaattatggattaattaggcttaaaaaatttgtctcgcaaattagctttcatttatttaattagttttgtaagtagcctatatttaatactctaaattagtgtctaaatacatagactaaagttaagtccctggatccaaacaccacctgaataaccctttatccagattcgttatattaggaagggtcacattctctcattggttgagtagagtgatcaaagaaacaccatccggactgtgtattagattggtgctactaatgatgaaacaaaagatatagtattgggtaattttaacatcctcgaaaaagtaccgggaattaccatattttctagtataaaattaatttggtacctctagatactaaatatctcgagataaaaaaaatagtataaaatttagatacctcgagatactttttcaagtacgataaaatttctctatagtattactttgataacgtgctacatcgaaacaaatgctacagtgcccaaaaataaaaaaaacatatgcatgaagccaaacagttgatgaaatatggggatagctaactttgaattcagggattgcagaagtgtaataaatgacctaataatcctggataattaagaacttaaatctagctcgttaattaattatgctttctccttttggcacaaggcacatcatcatctgcaggcgcgtgaccctccccgtcctcttgaccctcctcctcgtcctcgtcctcg

SEQ ID NO: 106765 - DNA, 1071 bp, Oryza sativa
aaaaataattttttagtctaaaatatttaatacccaattaatcataaaatatttaatacacaattaatcataaaatatttaataatcataaaatatttaatacacaattaatcatacgctaatagttcacctaattttgcgtatcttttcaatcttctccttttctcttctctcgagcacaaccttagacacaggtttatcctcaaaagctgtttatttatggaacataaggtgtacttccttaggtcaatctaagcggtaatgcgctttgcaatagatggagttttctcttctatcgtgaaggttaatataagttatatcataggttcagtttaatgttatggaaaatagcatggtcttcatacgtgattataaaataaagtgtgtgtgtgtgtttttataattgtctgcgcttgcattgtgtttcgcaaagaaaaaaaaatcaaaaagtagaacctttctagaaatctttgaaaaccaaacaaatgatatatctactatactactatttgtgtaaatagggatgaaaatggtagcagtaattaccaaccaaccggacggtcgtttctgaagtttactgatcagacaatacggaaatggtaattcctagaaacgaaaattgtaaaaaatacagaaacggtatcggaaatggttggtgatttaccaaccgttttgtcggttattgtattttttttggtaattaccatttacatatttcggtaaattaccttttttataaatatctctggcccaagttatctccaatggcccattcccttagcctgaatataccagtcccagtgtcccacgaggttgtgataacgctaaaccatagagctgctcctagtttggtagttcctcacaccgttagttcgtattaatatgctttatagacttacaattatatgtcattgaagttataactattgtcgaatacttgatcatattatcatttatcaatctattatacatgtttgtacgtatttgtgttgaatagagtgaggatgaatttgtctcatgcaaccatgctagattgctatctaaatgtgtgatgttatagttcgttgcctc

SEQ ID NO: 106766 - DNA, 655 bp, Oryza sativa
attaaaaaaatttatgaaatatgcaaaactatatatatacatgaaagtatattcaacaataaatcaaatgatagaaaaagaattaataattacttaaattttttgaataagacgaatgattaaacatgtttaaaaaaatcaacggcgccaaatatttaggaatggagggagtatttggtactgatttgcatgctctgctatcgaatgagattccatccatgtgttgtgtccgattactctgtgctgtgtgcgcgagtaagctaagcgcgcgtgattatactggtacatatacatgccttagactgctagtgacgccgtggtgggggggtacgtacgttcgcgtgatgggcttatgatgcgttaatgatagaagaaggggggattagataggaggagtataatgccggcgccagctggagtccaaagcggcaacttgcgacttcgctttcctgacagccaggcatggacagcaaccctcttcaccgctcatctcaaattcccgttttgccccactattttcttctggtttttttttctcatctcattgctatggaataagggggaaaatatacagcgtaaagcacatatgtaacggaaacttgaaaactaccgttggttaaaaaatataccgtctgattttcgtccacttacaacg

SEQ ID NO: 106767 - DNA, 1142 bp, Oryza sativa
acatgatatcttacacttctcaaaggaatttttttttgaacggaaacttctcaaaggaattcaaatcatgaggtttgagctcatccttaaaaccctccaaaaagtgaagaaaaataatgattcttatggagtttttccaaccaaagcctatagaccagagggctacatagaaaataatcctacaggatttgaatcctttgaaaatcctataaaaatttcatttcataggaacccttaattttcgtatgagcagggtgaaaaaaaagcatctcatgattttagtggagtacttaaatattagaaataaactaggggtaaatttggcgtatagaatgggtttactgtccaatctctctagacggtatgtggccagatgtttaatccatagaaatattgtgacggttcaaaagctaatttcgatgatgtaaactaaaataagaatggattcatacatgttgtcaaacaagaaatcaaaggtcatggtcgtgaatagtttctcaaatttatgtacaatgtttcgccatggaaaaatcatgttgagttatcgttccttagacccttaccatcggttgtgctattagtgggcgctaaaccgtgttctaccaattcgtggtttatcacggacaactaatgatatagtctttgctgatagaattttttttcaaggatgtacaataccaccgcgaatttagggtgctcatcaggcctaacatcctctctttatggcctaacaaagtcgatctctgaatgttttttccaccctttcaaacacacacacatctatgcaccatgatggaagtggctggccaaatttatatagaacttgtggtgaattggatcgactagaaagatttttcaaagctctgctacactaaataaaattcagaagactttgaagtccttttgtccaccgtcagtcatgggcatacacacccatataggagtggagacttccactcttccagcctgtgctcctagtttttggactcagctggcaagcataattatcctcaaaatttacatttcagtctatattttctttcagataatccagtcactacttttaacctatcaaatcctacatggtcctgactgtggattggattggattgtttggatataacggggatcctctagagtcg

SEQ ID NO: 106768 - DNA, 704 bp, Oryza sativa
gaacgctcggtgccgagacggtgcgtcgcgtcgcgtcgcccggccgcgcggggagaaagaggatcgagcgatcgcgacggcgatggccgccgcacaaaaggtggcggcgtgcgcccggtgccaaggcgtggcgtggcgtggcgtggggaggaaaacgagagaggcaactagccgtggaggaatttggtggtggtggatttgaaagcgtcgcgaggaggaggacggaggcgcacgtcgcggtctgacaggtgggccctctggtcaatggtcaacctcgtcaatgacgggtgggcccgtgggcaccgtggccacgtaaaacttgggggcgacctgcaaaattcatgcaaacgagtttctgaacctgttcagatcgctgctgcaatcaagatgaatctctccagtttcaaaagagtctgaactctgaagtcacactgtgtctgcatgctgcaatgtttcaaaaaaaaaattgaccaccatcatacaaatcgctcaagataaaacgcaatatactctctttaataatgtcaatctatcggtctgcatgtcaatagtgaactatcctagactcgctgagtcatgtgttcttcactttttgatgtaacaattggtttagggtagataatcaccgtaacaagtaaaagcagctactacctaactagattccacacttgacattaccaaacttcacgagattaagttactgt

SEQ ID NO: 106769 - DNA, 2093 bp, Oryza sativa
cgattactctgtgctgtgtgtgcaccttcaggaatgtttgctaagatgcattatgcatgtagtacaacatatacatgcctgttcctagtgctgctactgattatagagattctacagtgcagagttacaatgtttctgtgactactgtgaaaaaccttgtgctttgtctgcaagtgatatcaactgagattagtagtttctatctgaccttgactggactttttgacaagccttgcatggtgcatggtttgagttgactgctgtaatttgtgcagattatgcaatcattaggtgctatcctgtttgagtggaatttcattgtttctatttggctggtagctttgtgggaataagttgtttttagaaaaggaggattgctaggttcagtgtgtggattgtggaccttggaatcgattgttgcttaatgctctaaaaaagaaaaaaaaaacataaatgcactgatttgtagccactgctgggctggcaatcttgcattgtggtaatgtggcatggcatcttcggatctgatctaatcttgtagagattgaaaggggatgatattctgtgcccactcttgcaccacttgggaaaaaaatgactgatggatttcctgccgttcttttcggctggactgctgcattctcttgctagaatatgttttcaattgtaatattgatcaaaaagttttttttgtctgattttgcccatcatatgatctgatctctttgggcaacgtactcgaatcatacatcatatgtatttatcagttcacgagcttatcatacaacctggatatatatatgtcttggaaagggatcctctgacttaactgctgtgcagttgagtcactgacatatgggccatagcaaagtgggactcacatgtcagtgactcaactgcatgtgcagttaagttagaggatctactttcatatgtcttacggtgaccaagatagacatgtaggatgtagctagctttgcccatacaacaatgacttacaaaatgaataaaataaagaacgaaaaacagagaaaatgaatataagaacaggttgcgtcaatcattgaatggagcataagttagtgactgagtaatttattcagtaggatacatttagtggtataatccattgtaggcagagtgctttggctaagacagcagttggcctagatcagcttaactcctgcttgcatgttactgctattagtagagtgtagaagcagttggtgtaggttatattagctgctgctcttcaatacataatgccaaaacagttggctacagtctgcattacactaatgctgcttacaagataattgcatcagtgctgaatataaaatgagaaaacagaacatctacaaacttttgctgaagatctctacgacagttaggtttttatttgaagttttctcatatcattttaaattaatccagcacataaaatttcagttctggtacaagaacagcaacatttatctctttcttaaaaaaaaaaaagaaatcacgctgagggctttcctgaaaaaaaaaataaaattgtgcttcaggctaaggacttgttcataagtagaataaaaatcagggattttggtgctatgctacacattcccagacctcgctataaaacagatccgatcactctcctgatcggcgccggcgttaattccaagaaaagaagaagagaagaatctgaaaaactttaagccgctatgggtctgcaggtatgcagatcactctctcaatccaccagcatcatcgtttctacgcttaataccgctataaagatgaagaaatctttaccatcgtctgctccctcgtttgtttgattgattttattctgtgtgtaaaatgtattgtaccttagatttagcctagaacaattcttgttcttccccttccctttgtggcgtaaaagaaattcttaatctcccgtctcctccgctccttgcgccgcaaagacgagtcgctgctgacaaggggaggggcggcgagcagagcagggaaaaggatcatgatgagcatcacatcctctttctgattcatctctctctcccatcgggtctggaatttgcttgtgttcgttcggtaaccct

SEQ ID NO: 106770 - DNA, 1966 bp, Oryza sativa
gctccgccggctcccgcgaccgcatcgggaggaagggcaccgtcgccgacctcgccaacgcccgccgctgctccaacagggccccagcccccgtccccgccgccgccgtcgatctgtaccactcccacgaattcatcatccataaagtcgccggaatctcgtggtccgaaggcggtggcgaggagtcgcgagagagtggcgcgcgcgcggtggcgagtggcgtggggaggaagacgagagaggcaagtagccgtggaagagtttcttagcgacggttgcgtttcgacgccgagggaggcggtggcatttaaaggcgtcgcgaggagagggacggagacgcaggtcgctcactgacaggtgggctccctggtcaaccgaagtcgggtgggcccgtgcacagtgaacctgtgatcgatggaaggttcaagatttacagagtctatccgcttgttttcaaagatttggatttacagaggctgtgtttagatccaaagtttaaatctaaacttcagttcttttccatcacattaacctgtcatacacatataacttttcagtcatatcatctcgaaattcaactaaaatccaaattttgcactgaactaaacacatccttaggaacttagtaggattccaaggtggaaatccatcagtccttcgtccggttgttctttaagttggaataagtgaaatgatatatttgtaaacaaaaaataatttgctcaaaggaggcataaattcaggattggatttgaacgagtggactatgcaagattcatacaaacgtggtctgaacttgttctcatctctgcaacaaacaaaacgaatctgcccagctctttctagtgagtgagtttaaattactgtcgaattttacaaacaaaaaacagagttctggacaaaatttgttaggacgatcccatagccaccattagaattcataactaatgcttgatcgcctgatcggtccagtgattcagaactcagcagattcagttacttactgtcatcactcattagaattcagaatcatgcacatttctaacagtaatactatagtatattgcaggagtttaatcacaaatgcatgtctggtttcattgaacaaatgctgataagtcagaatagtgcggcctcgatcgattggcccagtgattccaggaaaaattcggtgtctgaactagccctcatgacacactcactgtcactgcattcagctgcattgccatcttgttactttcaggttgatttcagtggttctccactatttttgcaggcttgcaacaccagaatacaagtcactcaagacaaattgatgtgctattaacttttcaagaactatctcgtgtaccttgctgatctaagaattggtttaaggtgatcacaggaacaactataacaagaacgatggcctgttctacttgttgagctttgatggctcatggctccatatgcacattggattttaagttggtctaatcccgatctcttggaggtacggaggttgagagactcggaagaaatagacgaaattcctgatggtgattatgaacaattcctgatggtgattatgaaccggatgaacctgatgaggatttacagaagaaattatgtgttatactccttatttagttgataatgataagcacaagtttgctaagatgcgcagcattggggatcatgctatgttcttgttcggttacacaaggattcgttccgggccaggaatgataggtataacaagagatttataataggtacaataagagatcgggatttattccgggtcgggaaccaatttacttatattagctaggtacaacaaaaagttttatacctcttaactagtgaattgattcctgatctcttattgtccctatcatgagtaaattggttcccggcccgaataaatcctggtctcatgttgtatctatcataaatttcttactatacttgtcattcctga

SEQ ID NO: 106771 - DNA, 1258 bp, Oryza sativa
aactaactataaccatagtaaaagaaattaccactactcactgattcgagcatggataacagtaaagctaaaactaactggtgtggaaaaaaggagaaaaaaaaatgagaggtgttagctctcatataacaattagttctacacgtgttccaatatatttacattaaatccatagtgaaaaaaaaagagagttgagaaaaaaatagagttaattttagagttaatttattactccatccatctaactttaatagtcatatttcatcttgacacatagaccaaggataaacaattctacttatcatccattactagtcattcctcgtaaacaagcgattcattaatatttacatttctcgatgcccatgtagccaatcttgtgtgaaagaatggagagtcacgcattaaatccgaaaaagtcattaagatgataggttgttggcttgaaatatgcctatcaaaaataaatttttcagatttggaaatatgactaccaaaagtagattagatggagggagtatatatgtaaactctaatataaattaatagtcaatagctttactattaaacttgttgttaggaattgagctgattgaataagcaagcaaaggttatgtgccgtgctgttgctgctgctggtgctggtattagaaggggaattaagtgagtagcagtggagctgtgtgcgcgagtaagctaagcgcgcgtgattagactggtaattgcgtgattagactgctagtgacgccgtggtgggggggtacgtacgtccgcgtgatgggcttatgatgcgttaatgatagaagaaggggggattagataggaggagtataatgccggcgccagctggagtccaaagcggcaacttgcgacttcgctttcctgacagccaggcatggacagcaaccctctccaccgctcatctcaaattcccgttttgcccccactattttcttctgttttttttttctcatctcattgctatggattaagggggaaaatatacagcgtaaagcacatatgtaacggaaacttgaaaactaccgttggtttaaaaaatatacgtctgatattcgtccacgtcacaacgagtaaaaattttactcatgaatgaatctgcgagtaaaacttttacctgtggtaacatggatgaatcttaaacgttcatttttcgatccaacagtaatttccagattttcactacatatgtggtttccaccatatattttcctggattaagggtgggttctaaattgcg

SEQ ID NO: 106772 - DNA, 517 bp, Oryza sativa
cccattatcggctttcaatttatacagtcttgtaaataattatgttttcgatattatatccgtttcaggcctaccgtttttattccgtttccgaaaaataatatgaatagggaaatggtttagcgtgtttcctgacccttttttatccctacgtgtgaatgcacgcacggttgcatgagacaaattcatcctcactctattcaacacaaatacgtacaaacatgtataatagattgataaatgataatatgatcaagtattcgacaatagttataacttcaatgacatataattgtaagtctataaagcatattaatacgaactaacggtgtgaggaactaccaaactaggagcagctctatggtttagcgttatcacaacctcgtgggacactgggactggtatattcaggctaagggaatgggccattggagataacttgggccagagatatttataaaaaaagtaatttaccgaaatatgtaaatggtaatgaccaaaaaaaatacaataaccg

SEQ ID NO: 106773 - DNA, 626 bp, Oryza sativa
atatatcaagatggatagaatgtaatcaaacctgcagctgtttgctccgagaaagaagacaccgagaggatgcaaaaggctgcttctacattccaccccaccctgtggggtgattttttcgtcgattaccagccaccaaataaatctcaggtagcaattaatcgcaaatattttgttttaaaacaattaattgcaaatatagcgctgaagaatttcagtaacccgtgcattcacgcgtgctatttatatatactatgatatacaaacattgtatatggtatttaacgaacaatagatactcccaaaattttaatatacaacattatgcataccaattaatatttttatagttttttatcttcttaatttagtaatcttgaaactcaaaattaataaattaatacacagttgtatttttcatggattatttattttagtgtttaaatgaacagaaaaatcataaatatggaattaataagaaaactatacctgatttacagtttcagttttagtttttcatgttgtttaacaatataaaaacttgaaattaataataattggcatgccatccctgacttgcactcatatgttgttcaacagtttcagttttagtttttcatgtaatg

SEQ ID NO: 106774 - DNA, 706 bp, Oryza sativa
taattgaagtcgaagattactaaacataaataaatatataagtgtaaagatataatggtagaaaatgacctttgttgaagcaatatcatttgagagccgtacacatgttgtgaaagacttaagaagttctggataagtcaaaaggcaatcaagagtttcctttgctacaaggtcgcccatcccaacaaaagaagcacatgctagttcaaaggcaccaacagtctttcttgaaagttccaggtgttcctctattgtttttggaatgtaatgatcatcacgccattttatctcttgagagaattcttgaactaacctcttgaactatattagaggtgtaaaaagtgtagtgttaattcagccgttatacgggcataattttgaagaaatatcattttaccaaaaaatatgattgagtcattagaatgtcataaataaagtggttaccataattttctcttaggataaaacaatcagtattgttcgttgagttagatatattctattaaaacatacaatcaaataaatatttatatgtagaatataactaacaatgaagttgtatatagtttataacacaaattgtatcataatcatgggataataactatatcattatattccaatctatctaatactcgcttcatccaaaaatataaggcgcctgattcacatggtcatcaacattgcacttttgaccattaatttg

SEQ ID NO: 106775 - DNA, 612 bp, Oryza sativa
gcgaattcgagctcggtacccaatttacatagtatttccggttttttgttgatctgccatgtaaattctagactaaacaaacatctcaaatacataaatatgatctagcatgttgacaaagaaaattgctgtacataattttataattatgttaaaaaaactataatgatgtgattgtagcatgcattggcatataaagggaagaaaatcaattttctggcatttgttttcataggtggtggtctagcatacatatccttattctgtggagcacatccagcagcttaattattttacattgtgatagttccttgagtcctttatagtgcacactaggcctgtaggccatgattattgacaattgctgacttcaaatttgactaaatattttaatgagttacagagtaaaaaatactgtagtgcaaagtttcctattaaaaatgctcctagctctaatgatctgaaagagtaaaatacatggcgggtctttaaactagagcgttggtattacttaggtccgtaaacttgaaaattgcacatttacgtccatgataacgaaccacagtaggtctgaacctcatttgactgggggctgactgccgacgtggcgct

SEQ ID NO: 106776 - DNA, 812 bp, Oryza sativa
cccccattctttgggcaactgccgcatgtgcaaccacagattggagcaacagctgctcttggaggcacacagccaccaacccaagcaaaccaagcagctggttcatttccaccacctccacctccattaccacttatgccacaatttgttcaaaatactggaggaatgtttggaatgggaccttttgggatggtgagtggctctgcgccacctccacccccattgcccaacattatgtcagcaggttttccaagactaagtgtgcctccacctctgcctctgcctacacaatctcagaaccagagccagccccagcagcagcagtctccacaggcaccacagcaatcgccgacctcgactggattttttcaaccaccaggtgctgggttcttcccaccagtgcaggttcagcaatctccatctgcccaacggcaatgatgattctacaacaattgttgggctataaaggaagcaccttgtgctaactttgtatattaaacaataatccctgaggattgatctgatagttggcgagtcctgcatcgtgaagcaggattaatgcttatgaattgggaggatttgtaggataggcttgcggcttatgtgatgtacaactgttccttttggtctgaggagtttgttcaactcttcttgattatgtgaagttagttagactttacttttgtttgcatagccagatcttattgttagtcctgaggcaaacaaatgtcggcattacatttgttacttaaagaggtgcccaagtgaaagaacttttttgggctcctcaatggtagaacttacctgtggct

SEQ ID NO: 106777 - DNA, 660 bp, Oryza sativa
cccattagcctgtgaaacagatggggagaaaaaggaagccgaaaagagcccacaagtatcattcacatactgatttgaacgacggacaataaattgctgttaattctccaattgcttcttctcggtgaattgaaggatacagcagattaactgattaagctagcttacctaacggccagaacgtgagtcatccagctgattaagctacaagctactaagctagcagtgtagtggaactaatgataaaactagcgacacgatcttaattgtactaaagaaagctgggttaaaactatctacaagttgataaaactcatctgcaaaacttttgctaactaaaaatgtagagcagaatccagaaagaagcagaaggtagccgggccggatgcttctaattgtgcctgggattgaagttggtcccggggttgtgcttcatgctggcgtcgaactccaccttgggctcgccgttcgcctgatgaacgccattgactcggaaggtgttggtagccattgccgccgtcggcgccgctgccctgggctgctgttgctgcagcagcaatctcctgctactcctagcagcaacagcagctactgcattgttgttgccgtcacgcaacaagccggtgctggtctttggtgatgcagcagcagttacagcga

SEQ ID NO: 106778 - DNA, 641 bp, Oryza sativa
atattcagattgcagtgaacacataatgaatataaagcaagcgctaacaaaagaaatcttcgcgcgcacacacaccccaatccctcctctttccctgactagaagtaatgcagacaaaattataacaccggcatccacacaaaatagtggtggaaaaggaaacagtggaatgagaaaacatgtacaacataggagttattttctgaaaccagaaagaagatttgcatgaagatatatgaagaaccaccatagttaatacagtgcagtgtagtgtgaacaatggtaaattcaactgaaaagactagctgcagcagttaggtaagggtgactaaattattgatctcatcctaacatattttgatgccggcagagaaagtgacgcgataagatgaactgacagagctaaataggcaaaatctgacctcaaaaaataatccaaatagtgtgtcagggatctttcgtgaaacctcccatgaagcatcaacctctactagtgctgtctgaggcaggtccagctttgaagataggcatttggaactgaaacaaaaaagaagcaaggagcagaaggtgcaaaagaatgcatctttggaacccatgccctcggtcctgcctgccgaacaacagtaggtcagtaaaaaact

SEQ ID NO: 106779 - DNA, 508 bp, Oryza sativa
atttattcatcaatgcgattctacaccaaagattcatgtattttttagtatcatgcaaacaatccattttagcaaagtcaagctaaaggagtgatttcctgaaaaaggttcctggggagtagcgtatcttcaattttcccaacaaaacacgcctcagatccagatcggtatacccaacataaacatcatgcatgtaatgtaatgtaatgaactatgaattttttttaactaaggaactgtgattttcttaacgaaaccacaaacaacaagcagataagcatgaggaggtaaatctatggaagcattacttgattacttaattactgactggataactgttgaaggagcaaactgcagaagctgcaactccagtccagcggtttaccatcaggggttgccaatgccagtctggcagacaagaaaaactatgccataggcagcgacagaaagatcgtcttgactaactggatatcacaccgcaactgcaactggtgtttcatatcaatat

SEQ ID NO: 106780 - DNA, 667 bp, Oryza sativa
ctatagggcgaattcgagctcggtaccctaaaaaaagaacaatttgtgtggtgtgcaaggtaacacaccactagatgcatatgctgatgatatccattagaagttacaaatggtggtggtagttattgttgaaacctgaaagggagtttatatcacccatatggtggttttgtagctctagcatggtgtggactgtggatcatctcactttcttttcaaagatattagagaaatattactgatgtggtgtagtgcgcataatgattaaactgggcagttggtttgcaaatgggatctaaatgtaaatctggttacaacttaccccaacaaacaaacattctagtaattaggtatatttacacgggatcggaaatgtttgcaagattgcaggaatagagatacaacttgtagcccacaatggcagccatacacaagacaacaatgattaagatggcaggaaagtgatgtgagttaaaatttttttagggaaatgacaaattacatacacccaagagaaagaaaggagagaaacaaaaatagtgcgatcttgaaggagagaggaggaacagagaaacttaaactagaaaaagaaaagggaagctctacttgttttatttgtgtacttgagactaatgaaagtcatgtgtggattcgcacttaatttgcc

SEQ ID NO: 106781 - DNA, 2265 bp, Oryza sativa
  unsure (1)..(2265): unsure at all n locations
caccgcccccgccggcccggcgccaccgcgcctccactgctgcccctacacagagaaagagagaagtggaagaaatagagaactggagaagagggagccggccggccttatctcctcctgtgggccccgctgggagagcagatatatatatagtggcagaagtcatctcaaacgggctaggacttaaagccgtttgaggtgagtaacctcacctctgacgggccgtccggctgcgacccgtcacaggtaactagtcacctgtgactggttaggacttaaacccgtttgaggtgaggtaacctcacctatgacgggttctattttcaacccgtcacaggtgactagttaccagtgatgggtcgcagctggatgcctcaccgatgacggcatcccgtatgacccgtcaaaggtgacggtcatcagtgaccattttgtttgcccgtcacaagtatcccatcagaggtgtgaggatctggtgtagtgtacttacattgtgaaacagaggaagtatatatatatcactctcatgcatacagttcatatcaaatgcggatatataccttatctgtgatggctcatgaaggctatctctattagttgaacagattgatagagacaatttgttagtgatgagaaagactcatccagccgatagtgatgtaattatctgtaatggttataattgtgattgtgacaatgtatggttgatctagctggccaagatgagggggctagagctttaaccatctttcgtacttcatggtatttgttatttgatccgcccattctgctagatccaagcggctcaagatgcaaggtatctagtggtacttcaagggtcgtaacaacctgtctctagaaccgtatagcccaacccatccgacgagaggatccacttatacttttgtcatcggttcatgtaaaagggttaacctggaatagtatggttggagggacaaaccattttcacccttactaaactagtagtgtgatacatagtaagcgtgtgcacctaacttttataggccacacaagtgaatggggctatgtcgatcgactcctctgcgtgcagatctgagtgatagccaagaagaagtgacacatcatcagccatcctggtgatttcatggttggcctttgttatctagcaatcatcgttggtaatgagcgcgtggttgcaatgtttctgggaccccacggatgcctctaatcgggttggagtaagaaacaaggactaattaaatgttctatatctcagaattcatgtccaaattcaggggctgctggcctcaacaaattaaggcacagttggatattcggagatgtattatatatatgcagcatatatatgttcttttttctcattgatttgatttttttatatcatacttactagcaatcatgaccgtgcgttacaacgggaattaaagaattaatattagaaattgctttgcaccgaacattcgatgctacgcattattgtcggacattgcacctctactgtagagttgacgtgaatgctatctttatccatccgatctatgcaagcccatacacacaaaaaatcattctccaagttcttctactttgatatgatgtgatttgccaactttagcctaaaacataaaatcacaattatgatcaatggaacactccatgatagaaccgaactggaatcgatctccctgatcgcatgcgaactcgatgtggcgcgtcgtgcgggagtatagcaacgtacatgggcaggacaacgatctagtgttgaaaacggctgcaccacgtgagagcgggagatggacacacggtcccaattcaagacgaatgcgtcagcgctcgctcacggaattatataaaattaaaccaacttaaacacggatgatgtaccaagtcttnnnnnnnnnnnnnnnnnnnnnnnnnnnnnnnnnnnnnnnnnnnnnnnnnnnnnnnnnnnnnnnnnnnnnnnnnnnnnatacnnnnnttaatttgagtgtcattcttgcgaacgtactctgcagacgggatacttnnnnnnnaacgtattagatatagcactacacgggtcgggtcacacaacacctagtatccatcgtttacggctaggactactggggtcaccaatcccattttctcccctagcttttgtttctgagtgtcaatgttggcctaatagagtgatttcgccattggtgtcctttccgatcttaatgctcaaaccatgctaccatgcattaacacagttgtagataagggccccttgagaatacg

SEQ ID NO: 106782 - DNA, 1920 bp, Oryza sativa
caccaccgcctccttcccgggggcagatgtccagcttcaccgccggcgcaatgtgccgctcgtacgccgccgccagcttccccctcacctccttcagttccgcctcactccccccgccgttcgccgccgccgccgccgcgccaccaccaacatccccatcaccaccaccgccgctgatctgcggcgcgatacctgcacgagcaagaagagagagaaaaaaaaaaaccgcacgtgagaccgtgagctcgacaagtgtcccgccattgttcacaaaagatttggaggtgcaatacaatcatgagcgcgcgcggcgctgtcgggcgcggggaacgcaaatgcgccgcgccatgattgggcagctgctcgatcgatccatcgatcgagactcgagagtgcgccaagctaagtgtgtccccatccatgtccctctgatctccacccaactaagctattgcggctgccgatcgatgccggccggcatgccgctatcgctcgctcgccattgcgcacgcaatgtaatcaaacactaccgcgacacgaacgcgtgatggcgatcgatgatcaagtgtgagggctgttcagattaatgctattttaaaatatacattttttttaagttatcaaagatatgcatacatttattttttttaactttggtaaatatataagaaatccagctaaaatttcagcaatattattaacttactaaaattttggtactagtttattttgactataatctaaacagtctataagtattaagtattgctatcgtcaggggacccatggaacggcatgcgcgcaccgtatcaaggacacaatctctcaaacacgttggctcgtgcttctcttctcagtgctcaccaagctcaccctcctctctctatctctgcttatgcttttctttttctttacttattaaaaaatttatgagcccatggtatgtgtaagtataaattgtttgattattgctttatgttcacctttttgcaaggtggttaactgaacaactgtggggagaattatatattatgaacaagtgttgaaggatctgattcctctagcttttttatatgggacgaattgtacgggagaataatcctgtgaggccctgtttggaatgtggggaatttttcgttttctacaggaattgaaatgtttgcttgtgaaatttccgcaaaatccgtttatttgagggttaattagactctgtattttcttcagtggttggactctgtttgcagaaaggtaccctcacagaaacaacacatggtataattccaattccaaagtataaccaatgaaaaaaaatgctaataaaatggaatatgccatactgtgaattgagtccagttaaccacacatgtatgtgacacaaattcttatagggcgacctttcaagatcactgcattacttttcaagctcaggacttttagctgataatagtggtgactaagggctacgagcctatgatcaagtgtatggtacatgttctaaatgtcatggagatgccaagaactgatggttgcaatgcttgaaacgattttaaaaaaaaaggaattgatgttgttgccgccatgttgggaggcaaaggggagaatcctaatgacaaactactgaagggtgaaaatctacacggatgctcgtccatcgtttacttttcagcttataagtcgctggaaaaaaataaatattaaaaacttatttttagagttggttttgggaattttcatcatagtttatttttcaacttccgcttttatatcgctaagaacatttataaaagttttacctctaaattattctttgatcacttataaaccgttacgggcttataatcagctataggcgaaacgttgaaacacaaatgtgtatcatgatttttcgacgatataaataaaccttctaaaaatctatga

SEQ ID NO: 106783 - DNA, 1410 bp, Oryza sativa
acatcgttaacttgttcatctaaaatagagcaaaacttggtttcgtttttttaaaaaaggagggaaaacaaaaccctaaaaatagggtctaaaaacaagggccaaataagtattgtacatcaaataaatgaatacgaaatttccaccattgaattaatacttccaccaaattcattgaacattgactatggaagcttttgataaaaaaaaaacgtgacctaatatcaaacaattaaaattaaaatggatgaagcttttaatcaagatcgtttacatgcatatcttgatatttgaatgcatatgttacatttgaaaaaataatttgtgtgcatttcttttctgctgtttattactggaaagaatcagtgccataaaatgctctatctgaaaaagaaacgcaggtagtatcattacctttatcatcacttaggccttgtttagttgggaaaaatttttaggtttggttgtcatatcacatatacggacacacatttgaagtattgacaaaacaaattacagattccgccaggaaactgcgagacgaatttattaagcctaattaagccgacattagcaaatatttactgtagcaccacattgtcaaatcatggcgcaattaggcttaaaatattcgtctcgtaatttgcacacaaactgtgtaattagtttttcttttccacatttaatactccatacacatgtccaaacatttgatgtggtgggtgaaaagtttttgttttgggaagtaaacagccccctatattattgagaacccggggaaaacatgcattagggcattcccaacccaatgactaggatggtgtccatagcattaaataagttgtcacctaggaaaaaaaatgatgtggcaagtgaataaatgaggaaagagaaggaaaccatgtcttacacgagacatggtttctacacaacatctaagacatcatgtgagataaagtagcattaaattgaagtatggaatagtggtgtttgcattggaagagtagtgtctagtactagtttctatggaaaccatatccagtgttatgggttgggactgcccttataaaaaaagcaattaaggcgaaacattgttgatctgttcgtcacggatgagcaaaacgatgagctcggcaagctggaaggcatcgtcgttctccgcggagagcggcgacgtcacattgctcttgccgaacccgtcctggcattccttcaccgcgctcgccgatttctccagcgatgagatcgcctcctggaacatgcctgccttcaccgtcgcgccgacggcgggctgagattacagtatgccgccgtacaccgactggcatgactagaggcaccgcgtcgcagcggcgtcgccgctgccgttccggagcttgccgtctatctcagacttggtgctcgtcgcgt

SEQ ID NO: 106784 - DNA, 1439 bp, Oryza sativa
cgagctcggtaccctgatactctctccatcccaaaaaaaaaacttaacttctagagtttaaattttatcccacaaaaaaccaacttctaccatcctacctatcttcaacacataaaacgagaagttttatctcttaaataatctttacctacctatcaccagtactaccttttctattgatgagggtcattttagtcattttacttctcactaaatttgccttgggatgctaggaatcctctttttatgggatggagggagtatatcgtagtttcctttctgctgggattattatgtgtcaatctgttgggttctttctttttaagataatggaagctttattgatctcactcaaaagtttttgctgggattagtatgtgtcagtctgttgggttctttctttttaagataatggaagctttattgatttcactcaaaagttttgataacactcccagcctctgcactacgatagtgcacacagccaacacactcaaaagaagagaaaaaaacagcttgcaagatcaagaccctacaaggctacaacccaaataataggtcgtcacctatataccgaggtataaaactcattgacacttgctttaaatatagacaagtcgaagtgacaaaaccctacaaattgggcttctcgagaataacccatgatcagagccaatgtagagccaatgtgtaattaagaaaataacctgcaaaggagaagaaacagttttcctataaaaaccacatcatttcttgagagccaaattacctagcaagttgttaccgtccctattaggtctaaactctttcttttgtggggttagaggtctggtcgttttggtgtggactgcgccgcatgggaagcaacaacatattagcgctgtagcgtgtccgttaccggagatgaatgctcttggttagtttatgagctttgtataacaccctgtttattcctgtttggctttctcccgagagctgggtaatggaagttacattttatcaaaaaaaaaaagagtaaatttcactttgggcctgattttttggccaaagttttaccatgaaccaagtctaactctactttttcagttagcaccaggtatgattaccttcttatatagtttggaccgggtaccaatacttttgggccagcacgttggcttgagctggtgaactcagttcagggcagagagttatcgagggagactagcgcacgggaaaggaggaagatagtgtcgtggaggtggacttgctcaatgcctcgatctccaccctcgcaaccggtggctcacggccgtgtctccggagcggcatggcgcggcggcggcgtgctcttttctggctccgaattggcatggcggcgcgctcttcagctcaagtgtagtgctggcggaatgaatcaatgtttgtttctgaatgagtgtgcaagtaagatggagctg

SEQ ID NO: 106785 - DNA, 676 bp, Oryza sativa
aattaatgtttatgtggtcacgtacttgcatctttttcttcccctcttgtcctttgcagcgttcaataatttcattgccacccaaattcatccatgtaaaaaattttattcacataactaggcacaattaataattcaagctagaaagagacgaacttggtccgatttgtgctagtacaaatacgaaaatacggtcgtattttctcgatcccggtcatgtctagcccgggaagcaacaaccgagcggttgcccgttccgcctttccaccgctcgatcgaagatgacaagatccgtcaggaattcaggctacagatgtcacgttgtgatgtagcttgccggcaagcccatacttgtcttgttcatacttcatagcatcgcaggcctatttaaggatgcaagcagcatcacagctaaattccctcctgagctccgctaacactatcgaagcttcacaaattctgttcacgcacttgtagctgttgcctctcgtctccaagtgttggaggcaaaggcgtacttcgatccgcaggtcgaaaagttctttctctagcccccctaatcatgttcctgttgtcgtgcagtttacatgtttgatgaaatgcctgagagaaggccactactttgcttaccttctgttcttgattcattgcatgggtaccgagctcgaattcgccc

SEQ ID NO: 106786 - DNA, 657 bp, Oryza sativa
cagtggggccacaacattttttagtgtgaattacttatgggtcccacaaattttttttttacattctcatgtcacgtaagcgccacgtgggacgaaaattaggtcaacatccccatgtcagcgccacatcagcaaaaccaccctccaaaactgctgagagagtcaaattgcactggtttcaatagtttggggagttgtcttatccggctatgcggttgagggttacggattagacttggatcacttttaagaaagtcaaagtggacttattccagtaaaaaaccggcacacgtggaccggctggattttggcccatataaacccattttactccccccacacacttcttttctgctcattttatactgtgaattattgaaaacggttcactctactttctaacaatatttatgttttctattatttatattagttatattttacactttaattttggtatgatgatatatgtgatacgactttacataccaatatattttttgattttttttaatcacacctcgcatggttggaaaatatcgaggattgaaagttcaagcaaactttcatgaaatttttttgaaaatatttgtcaactctaataatggtgtcatttatggttccaaaatgtcttagcttagaatacaacttatataa

SEQ ID NO: 106787 - DNA, 711 bp, Oryza sativa
ccattttttttttggttagaactactcaactctctttattattcatgtacttcaatttcgggaaaatctgtcctgcatatagatggaaaagttcacatgcgtaccaaaaccgatttgattgagattattaatgagtgctgaagaagttgattgggtggtccaagccaaaaaaaaatttataaagttacctgatccaaaataaaaagattattttaaaggagatccaaagtgaaacttggataataaaatatgacctaaaatgaaattcatacacacactacactgccttgaaatcgtttcagagtttcaggattttcatggtcaggtcttctccagcgtcgtcacggcgtggctgccgaagcccagggcatacgacggcaatagtgtggagattatggataccccatatctacatgacagttataatttagtcagatatacggtaccaaatataaatagaatatctttatgaggactcgggttagttttgaacttgtatgtcaaggaaatacccgagatcttagtcggttacgattgtattttatctgtaattacatattccgttagggatatggactgtactttgtaaagcggaccctttcccctatataaggagggtccgtgtgcctctcggggcacgattcttttttccagtttatacgatcaataacacactcggcggaataatccccggacaggagtagggtatta

SEQ ID NO: 106788 - DNA, 544 bp, Oryza sativa
aaaacacacgctgagccccctacctggcgcgccagatgacggagctcgtggctcttcaccgggagaccgcgcaggcccccctttgccggttcggccgggggcttagggtgaaatctcaagctctcgctctccctctgtatctggaaagatcgtctgcccgcaaaacacacgagacacggcgatgtatacaggttcgggccgctgccaagcgtaataccctactcctgtgtttttgtggatttgtgtatgagtgagctaccaagtgtcagccaacttctcccccgttctcagctctaaatctggaaaagaatccaaaagaaaaaagaagaaccccctctctatgggcaaggtcctccttttatacttcaaggggataccacatgcaccctcccctttccaaactggacttttcttctctttatggacggagattggtatggttgctgtccgaatgacactccgatgggacagcccacacctacctccactcccggcggagacaggcgcaacgtgggatcggggctgcccgttgctgacgcgacca

SEQ ID NO: 106789 - DNA, 562 bp, Oryza sativa
cggtagtagtagataaaaagtttatctcttcggatccgcttggtaccaaattgtagttttctgtacttgggaaatgaggaatggagttaaatggactgtagtaccattggtttcccttttctttccctttaattttttatgtacatcctcttaatatacgatgatattacacttagcataacggttgaccatccatcttaaaaacatagtagaaatatgttatatttaaagtacctcaaattataaaatgagtaaatttcataaaacgtgaggtcttgagccatctgtaacacaaaatcctaaattttacaatttattttcatgccctccatgtttcggggtaaaatgtttcatactattctagctacgagtatatcgtccattttactaatacatttgattataatatttgtaaaaagtgtaaagatattttttaatgcacatgttatgtgatcatggttttattgagtgaatttcactttagtcccctatgttatcgaagtttcactttggagcacttttatctgatttttttttcactttggatcatctattttttttg

SEQ ID NO: 106790 - DNA, 612 bp, Oryza sativa
ctatcagagaagcacggacatctagcgatgagtgggcttgccaaaaggtggtggggtaaagaagatcgagtggtgaatggcatcggtggggaaaaagagaaaggtgctggagcaaaaggtagagacgttgttggacctagggggagggggtagccggggcgccaaaggcatggagcaggttaacctcttgattgtttgaaatgttcttcatcctcgtcatgttcttcgatccaccggtccaagggacggtcatgacgtgtggcgcaaatcatggtagcaggtgaggcgtgcggcaatacgtagatgacaacgagcatgaccttggcgtcattgatcctggtgaggaatgtggcctcactacctcaatgccggaacgccgccgccgctgccttccgatctcctgcttcctcccacgccactatagcctccccgagcttctgctctaaccgtgactctgaggacatggatggagcctcgtctctaaggccgttcccagtgcatcacacaaatttgaggaacctcgaggtgccatgtaggctagagctacaggtccaacctttgggttcttcacagtgcaagtggctctaggagtagctttaattttgtatttta

SEQ ID NO: 106791 - DNA, 1382 bp, Oryza sativa
ttgatttgattgatggccccagatgagctgagccttaagaactaagatacatactttgctaaactagtatatactccgttttaaattatttatgattctagcttttatcgtaagttaaatatttgtattttttgactattaattcttaaaacttcatgtggtttagcattttagaatcaacataagaaacactttcataatatagcatccgcatgttgttaaactatccgaattttaaaaaattgatggtcaaagatacaaatgtataatttaggataaaactaaaactacatgtaatttgaatcggatggagtatatttcttgcggtttgagtaagatcataccgtttaattagatagaagagaaaaggaagaaacacccaagagcctagtatatcctaaggcacaaagctacagctataaattactcgtcatgcagacctacatttccctaagtttcattctttcccgcttacccagcacacgttcatggacagccgctccgccactagcccactatactttgcatcctaattaatcctcttgtcataattaactaaaccaggtcacgacagctcaatatcataatcattatgctactgcctacttatacatgaccagggatcttcagaaagcgttcaaggatacgatttatttcctttgaaataatgtataccccttaaaaaaattttgaaaagagatgaatgacaacagctagaacataaccttggagtaggacaatcaaacaaagtttcagactgcttgctaacgtttggtgaataaaattataaaagagacgggggcagaaaactctcagcaacctcgttggacgatttcgtttttgtcgtcagcacaattgcactgcgtcaattaatggacaaatgaagaaagcgaaggtacacggacgactaggcaagttgatagcacaccagttaaaacgaaagctaacagcacaagcacacgacttgactgacttactattaactacaggcaaggtcaccgaccaacggcaactgaaacttacttacattgttcttttctgattaactacactggccatgttcgaatcaaattttatctcggttttcattagcatatttttcaaactattgagcggtacgtttcgtgcgaaaattttctatatagaaattactttagaatatcaaatacacctatttatcaagtttataataattaaaatttaattaatcatgtgctaatggctttctcgttttacccaacttcatcttcatcactgatgcaggggaggtgccattttggtagagcaagatcaaagatatgatcaaatttacgcttattttgtacaataataacagacacttatctgtaaccacaacttcatcagttacatctgaaactgag

SEQ ID NO: 106792 - DNA, 788 bp, Oryza sativa
agtgggagtggtcgcttgcttgccggatatatatgctgcccgcgtagcgtagaacgcgtgaaaagagaacaaacagccaaacacgcgggaaacggtcatctgacggtattctttttattttttttcttttataaagataaatctcacgatatcctgttcatactctggtactattaaataatttcactatctttttttctattgatagttagtactctttttttatgtatgccaccgttgctttttcgtataacgtttgactatattaaaagttttagtgtaaatatgtaaaattagaagttaagatttctttggtgacaaaacaaatcataacaaatatttacataatttttttaataataagaatggtcaaacgtcatgtcaaaaatcaacgacatcagacattaaaaaaagagagagaatagtactccctacgtcctaaaatatgagtatttttaggttgtttagaaaatcttataaaggttaagtaaaaagatttcctttccattaaagtagtggtaaaatattaaattatttagattctcctcccaagcatttgattggttgaaaatgcatgaatttttatgcattggtacatagtgacgtaagcgggatgtaaaagttgccacatcagatttgtacttacgtgaagaagggaggacagaagaaaaaagaaaagcggactagatttgtagccaactacacgactggcttcaataaactatgtgacggagatggatggattatgtattattgatgtaatatatattacaattatgtagtatatg

SEQ ID NO: 106793 - DNA, 620 bp, Oryza sativa
tgactgtgaaccaaactaatttggatagagtctagttttaggcaccatcagaatggtcctggtggttcatgaagtctttcctaaaaaatagccatagcttgaaaagtttctaacgcttcaactgaggtgatattctgtcattcccaattgcttttgtggtgctctgtatttaaggattatggctgttcactcattactaatagaagttacaattctctctcatgatatccaacaaattatttattttcatgcagtagtttcttaaattgcagtagtcccaaatcccaagtgtgctagccgctaatgcatatagcgcagtgaggtgttttattaaatttgatttgctaccagctttgttatgttagaaaatgatagtgctgggtattctgacacgttgcaaggaaccaaagatgttttcccggtgacataccgatatactcttatgtgaaaggaaatactaacatagaaaggtcatcagtctgcaaattaaacgacttaaggaaaaaagggaattgcctttttacatctagtatgctgctaggacctttttgtcctgggtttctgatatgtaatgagaatggcagaagttgcttgcttccctttatgcacaagaaattatt

SEQ ID NO: 106794 - DNA, 795 bp, Oryza sativa
tgatcttgattgattatgtgcatatgcattccttcatatccatatgtatgcacatcttgagggggagcttattctatattttgttcattataagatctctaccttgatttgaaattatctttcatctcatctctttgtattgtttatatcggattattatctatcacagaagagagaaaagattgaaagatcttggattaaacaatttgtgtaattgttactttggtgatagatgataaaccgatgtttatgggattaacctctcttttacataagttttcaacaaggttatttcccgataatgagatgtggtagatatgcattctttggtgatggaccttaatcatgacaagaatgaaattcatggagataaagcgatatgtatcacttcttatctcctactttttgataggttcatatatatgatttccatgttattgttatataagtgtgagactaatgtttacttgagtcttatcttatttagtctcctttacattgagaacatggagatcatgaagatatgtgtttttttgtttatcttcatcattactacatatgccttctctatgtgtataggataaacccccattggttcttctttacttatgcatacacttgtctctcttgtatatttctttgtatgcatatacttagggggagcaaatcctatacatttattgtgcatgttttagatccatgttgttcacctattatttatatcggatctttgcacttgagcttgcatacgagtatatgacacttgtgatgttaatgaatactcaacaaacatat

SEQ ID NO: 106795 - DNA, 1134 bp, Oryza sativa
atcttgcccacgccgttgacaccctacggccagccggcgaggcggacggcggcgcgttggggcagtggcggcggaatgtgcgatgggagggcaacggaaggaggggagttagggttaatgcctctgcacgaatattaaagcatatccgatggtccaaaatttaaaagatggaaggtgggactttctgtcaacagatatatatacagtgccatattttaatttcaattttagctctaccaaatttcaattttagcgtataaaaaaccttttgaggggttaaaaaagggttaattagatacatgctattataaattctgtggtttagaaaaataacattactattcaataaatcgtaaagatgccactggtactttggtgaaactctctcatcgccactctgtacgcacgaatcggcgttggcgccgtttgtagtgtacggtatttacgtatggactgaaatgccccaggttggaccaggccgactccaggcccggccctgggggggggggggtcgagctgtgcagtggcatagggcccacgaagtgaagggacccaaccccatcagttttgctatatatttgtcgacaaattttctcctaaaaatttaacagatgtaattacagtacaattgtagtgtaattacactaacttgcatgtaattacactgtaactatagtataacttgtatgtaacttttaaaaatctctccgtaatatgttatttcggtaaaatagaggtcgtgggaacaaatccttacacatatgtgtatgctgtgttttttttcttcctcaccaaaataaatcttgtaatagatctaacgattcaaaattacatgaaacttacatacaagttacactgtagttacatacaaattacagtgtaattacatacaaattacagtgtaattacattacgattgtactataattacatatatcaaatttttagaagaaaatttgtcgacaaatatataggtggtcccaaccccatatatgctgtacataatagcctatagaggaattagaaagcccacccgcccaagagaggaagagacacatccgtcgtccgtcgatttggcttccttccgcgatcgcttgttctgttcgcctcatcacctcgcctgttcgctgttct

SEQ ID NO: 106796 - DNA, 625 bp, Oryza sativa
tagggcgaattcgagctcggtacccgcaagcacagcactgcagcttcctatctcctttatttggtcttccattgcttcttgttgctgaggttgccttcctattgcccccttcccttttccactcttctaccaacacttgcttcaggctactgagggctttggcttctcggtgttgtcgctacaggtgagcttggcattctgtgcatttttgcgttctactgctaatctggtcttgtgctaagctccactattagcctcttgtgtggtcataggtggctcctaatttagcttcttgtgtgaatctgatcgtccaatctttttctaaatgatctgtaaattcgctttgattttggtctgattagattattttgtttatttctttgttactttcctctcttttatgggttgatagtatacaattatagcccaaaaatactgttgaattcagagatcttcattgtgataactgactgaacatttaaagagatggtgcttttccacctacctgttgaatgttaaaccattgcagatgatttttttttttgaacatgcaatttctatagatctctaactaaggaagctggaatgtcaccttatttgagcagtttgattgtattgcacatta

SEQ ID NO: 106797 - DNA, 673 bp, Oryza sativa
attgcttgcattcatgattttactgcttttctgtcatatattgccccattctcgttgttcacccaaaatctacacacaagcttatttttgtgtgcaaagtgctcaggatagattttttttaacaactgtactttagtacttacgacaaatcttttgttttcgcagccaaatctgctacaagaaattgatacccagaaagtaagttggaatcctcacaagcattgcttggcatttgtatctgggaagaaccaagttacagttcatgactttgaggagccaggtgagatctgctgaactttcttatgttgtattaataagatagatatgatgaactgaagcatgatggctatatgaacatttattcttgtatttaatgaactgaagtatgtttctcaactcagctgaagccaacaactaatcatttgtattctctgaacagataataaagaatcctacattctaacaagtgaccatcaaaaggatgttaaagctgttgaatggaggccaaatagtggaaaggtgattgcagttgggtgcaagtatgtcctactgccgccatatactagagcactattaaagatttgttttgatattcttttcatgtcataatacctagtggcacaatctactattagattaacttttattattattattttcaggggagggatat

SEQ ID NO: 106798 - DNA, 680 bp, Oryza sativa
  unsure (1)..(680): unsure at all n locations
tataggcgaattcgagctcggtacccacacgtatgtatatgagcgtctgcacgtataccgaaatctgcaaaaataaagaaagagaaagaaatctgaatacgaccactacttgtgcacaaacggaatgcgcacttacatcaataataatgtataaaaacagaggaaatatctgaaatgaaaaaaaataatgaataagtgtatcaaaattgactcgtatggtggccagcttgaggccctgacgcacaaaaatacaaaaaaaacagaggtgtcatcttcagttaatgctgatgatggtgattagcaacccaaaaaacccatctctgcgctgcacttcctttcgttccccccctccgctataaattacaaaacttcaggggctccacttcgctgcctctccttctcctcctcacctgcacctgcaccaacgcgagagatcatggcgaagagatcgtctcctgatcctgcatcatcttctccatctgcatcatcctcggcgtcgtcttcttcctcctcttcctccgaggattcctcttcggccatgtcgatgccctgcaagaggagggcgaggccgangaccgagaaaagcaccggcaaggccaagaggcccaagaaggagagcaagggaggtggctgatccttctttcaatggcggcggcggcggcaagaggagtctatctaca

SEQ ID NO: 106799 - DNA, 612 bp, Oryza sativa
tcccacctatgactggcgtggcttggtgccacgtggcctggttcagaaacccccggtgtccctaatagttggtggtgggaacccatgtccccacttctctgacactattcgtttggtctctccctcgtttagggtgtgtttagttctacgttaaaattgtaagtttgaagaaaaaagttgaaagtttatatgtgtaggaaagttttgacgtgataaaaaagttgaaagtttgaagaaaaagttgggaactaaacccggccttagtatgagcacgtttcccaaactgctaattaaatggtatgtttcgtgtaaaaattttctatataaaagttttttaaaaaaataaataaatctattttttaagtttgaaaaatactcaataatactaatgctatcttgtttactgtgctgtttaaaatccgagccaacaatctagttcgaactaagccttaataacgttgttagcataagtgacagttatgatgctaccatatctatttaaatatggaacaattaatggcaggacatcatgatgaagcctaagcagcaaaattggtggcaaattaagtgcgaatccacacatgactttcattagtctcaagtacacaaata

SEQ ID NO: 106800 - DNA, 596 bp, Oryza sativa
taattttcattaccacatatatgtttctctttaacaggatatggcctttgctgaatcaatatggacctttatgccaggaaagaagggatcagttgttcaggggccaaacactagaactctaacaaatgctcatgatggtatcttggatgatattaattgtgctcagattgctgggaagcatgtgggagatcattccaattgtgctaatgtcatcaaggtagatatatgctataactttctattaattctttgtatcttttcaattttgatacatgttaactagtgccttttccataatgtctgttccacatgtattttcacgctttgatatgaatatttgagtacatagatttgaattatattataccatcttttcctccttagaaaacatagcatgttatggttaaaagtattgatgaaacttcctagctttccatttgaaccatgacaaactccccattccagagatgcgctttcaatgatttcagatggtcatgtatgttgttggattgcagtttattctttgtattgcagcatttcaaaaccgaattacatctgtgttcgctgcacgcagttgggacctatctcagcgcacg

SEQ ID NO: 106801 - DNA, 553 bp, Oryza sativa
ctcagaaagcaagatagcagcaaaatggtacgtgctgttaacaccacaagtatcaaagcgtaataaatttggtaatatgggcactatgcattatcaatacagaaaaaaaatgcccaatgaacccatattgatgctgactgcatccctgcttaactcacatcactgtacttgcaattaaacgattaattactaaagcatgtgtctcgttgcacctgagagcaagtttaatagtatggccaactattacccaaatcatatatagcccatttaataactcatctaaacaatagttatatataaatatatactacacaattaaaatatggtcccacctctcatacacacataacgctttggagtctatgttacagttggctccaaatctatagaccgcttttattctctctcttatcttatcttctccacatgtgcatatagctaatttgtagcctgttattgtactcgctctgataaacaatttgtcgtggcctcttatcccttgatattaggagatttgcccgttacttctgtcggagtttgtgtttaacaatct

SEQ ID NO: 106802 - DNA, 1113 bp, Oryza sativa
aacatttttgttgaatgttccctttattctgaacgagaacagccatttttgatgaatatgcgaatgctactaatcagtttgctgttgctcaagtaaacatctattcataatgattttcttagtttcatttcaaacatcaaaggggatgtagctcaaatggtagagcgctcgctttgcatgcagagaggcacggggttcgatcccccgcatctccactctaaatcgactattttagttctcttctccttttcttttgtctaattaaattttgtgctcttctaaattctagtctaattcagctatgtgttcctctaattttcttctaaattttcgtctattttatttctctttctttttattttgtctaattaaattgtgggctcttctaaattcttgtctaatttagctatgtgttcctcttattttcttctaagtttttgtctattttagttctcttctccttttcttttgtctaattaaatttgtgctcttctaaattcttttctaatttagctatgtgttcctctaattttcttctaaatttttgtctaatttagttctcttctctttttgtgtgccatatgttgccttttttggtctagttatttaattttctgctcaccaaaattttcagcgccttattttgtacgtgaatgtgacacgatgaattattttgacttttttttgtttaatttagttttttgagcttgtaaatttgtataacattttttatgggattctctttagtagtagtccctccgtcctaaaataagtggagttttacactgtttatgtctcacgtttgaccgttcgtcttatttgaattttttttatgattaacatttttattgttattagatgataaaacatgaataatactttatgtgtgactaacttattttaattttcttataaattttttaaataagacggatggtcaaacgttagacacggattttcacggctatacttattttagaacggaggtagaagcgtctttagtgacagtgactgacagcttggtcccatcccacatttcaacgacatcggctagagccatggctataggtaaacggggccatcgtttggccaaacggcatattggtaaacgga

SEQ ID NO: 106803 - DNA, 606 bp, Oryza sativa
ccctattttgaagtttaagtactaatttgaccttgttttttcaagtttgtttatttgaccccgtttttcaaaattgaagctaccgtttgaccctattttcaaacaccgttagggtttcatttagatcaaattaaaaaaaatgaatttacaagcctaaatgactaaaatgcctttattcactcattccttatcctctccatgctctctcaccacttccttcattagagcacaaatggctggagagacggcggctgcgttggctccacggcggcggcatgacgaggaggaccgccggcggcagcggcggctgcagaggggcgatgacggctggaggaccgtcggcggcggctgcgttggctcaagggcggggggcagctgggctcggcggcggcgccgcacggaggggacaagccggcgcggctgctcatggaaagaggtagcggcggtggcggagggatggcagctgcggggcgccgtggaaggagcggtggcgagcggcagtggaaggatggcgccccggtgctagtggcgcgcgcgcggagaaagcagcgccggtggcggatgcggggcgcaacaggagcggcggcgagcggaaggagcagcggc

SEQ ID NO: 106804 - DNA, 784 bp, Oryza sativa
acctctatatgcatgataataaaggtccaatcgggccaacagtatggctaccgaaggaaatcaggatcaagggagaggacacgtcactccagtctccagacgtgctctcgtcctcgcctgttcctcttctatttcccccagacctcctcgttccttcaatcctttcctgagacaagcgttggtgttgccacccctgtctcttctgatttctttctgtgatttgtttaccactcggaccagttttgctgacttgcctgtaattcgttttccctcttctatagatctggttcagagctaggagacatataaaggctcagattggtgattcttactaacagtaggctgctggtatgattttcttggctataatgtaggagtatacagaactaagatacagttttggaaaggttctaaagactagtatattttgaggtgttttttcagatataaaaatctgaggtattcatgttttgttagtactatttcaaattctaactaatttgcacatcaaggtactaatgtactccatattttgttagtacttgtgttcggaggtcaaggtagatgtgtcttgtttagcccatattttctgattgttatcccgtagaatagattgctcattttagccttagttcgtgcagatgattgtagatgatcaaagcttttaatacgcatcttgttgcataaggttttatttgatatatgcaacaacctagagaaaaaatctgtctggtatgccatcctgttcttgtctttgattctgttctttgagttggcttcaaat

SEQ ID NO: 106805 - DNA, 1416 bp, Oryza sativa
cacccctccctacaaggagccgccgccgcctagccaggctatcaccgattcctcctccctgtgagaagctgccactgccattgcctggttgggccaccactgtcgcctcctccctacaaggagcagctgcctgactgggcctccttcctacacggaactgccgctgtcatcacctcctcttcgccgcctggctgagctgctattgccttaggtttgggggcatgaatttggatttgggataggaaaatgactcaagggtattgtttgcatatggcaaaatctccacgggtagaaaggttaactgttaagttgaaataatattatttcttgttttgttactttttagtttagcaatcctggacccactaacttctataaaaaatatttgaaaagaaataatgaaaaccaaaaaatagggaaaaacaatatcggaatcaaagtagcagcaagaataaaattgtcccaattcaatatgatggatgaaatgaaacaaaaagacgattatatcttgctgtttcaaattgctatgtgatgcaaaaattatgaaattgtttcaaaatcacactacaatatgtaagtaaaaaaaaattaaaaagccctattttaatctggttggggtaacttccattcgaaattaatttactagctgaatttgattgcattaattacgaactctatacttataccagtaaacattggtccttattgtaatacaatggttgacatattaatggagtctaaatagttcttttttttaagaaataaggttataggacccggctaattgttaaacatttatgtccccttaatgcacatctttataaaattgactaatgcgtgcatgcagtcaagctttacaaagtttcgcaacgatcacaaacaagtatcaacatttattatatgacattgaattattactagcctttagggcttaattgatcatcctcttatatttatggcctaaaatgtaaaggcgcaacagagttttgaaagtaatctacgcgtcttgagccaatccatcttcttgatgattttggtttagcttatagcaattatcggtgcaaataccatgtgtatatggaataacatgaccaacagtattataggtggcaaataacaattaacatcggtaccattagttgtggcatacaaaatcaaataacaattaacatcggtaccattagttgtggcatacaaaatcaggaaaaggctccagggtgttggtctgaccggctataggtagcccgatctaaccagccaggtacttggtctgaccgacggctataggtagcccgatctaaccagcctggtacttggtctgaccgacagttagtgagatggttagaccggccacaagaggcatgatctggccgaggtagggcgcagtctgaccagtcatgatgagcacggtctgac

SEQ ID NO: 106806 - DNA, 780 bp, Oryza sativa
ttttgtttcttttttgcaagtagcagggcagaatgtgttaaaagagaaaaacagtaataggatcatagtaccagtggctgacttgcaagaaaccaaactttttgcaggcacaataaatccatctaaaattcaggagcctaatctttgggactagaaccgatgagtgagtattcctaaaaaagatggagttgtacagtttttattactcgaccatggaagatcacaaagacacagaagttagtatggttcaagggcgcatctgctataatgtgagagtccaagattttgctacccctgggctaacagtacagtgttctaggcttaattttggcaaaaaaaaaaaaggaaagaaaagaaaaaaaaacacagatagcagcctctgagatttgacgaatattgtcaatttacagtgcttagattacttttagtttttccgatgacggtgcttagactacaagccggctgtacaatggagtcatacaagattatgggttcagtcttaatagtaactcttcaactctgaggctaaaaacctaaacaagcaaatgctcaacataataaacataaaaataaaggatcgaactatgctttgagcaacaaattatattgtacatttggcatcatatcagcttgtcgtggggcaaggaaaacatacaaaatcttgtaatttcacaggcaaaatgttcattctctagttcgttcagacagaaaggtgttaaattcaatcgtaatggtcatacctaatatcaaaaagaaaatatcacaagaatcctctcaaac

SEQ ID NO: 106807 - DNA, 695 bp, Oryza sativa
tcacagcaaacattcaattcttgtagaaacgaaaaattcccacttttccaaacagggcctcacagatttattctcccgtacattcgtccccatataaaaaagctagaggaatcagatccttcacacttgttcataatatataattctccccacagttgttcagttaaccaccttgcaaaaaggtgaacataaagcaataatcaaacaatttatacttacacataccatgggctcataaattttttaataagtaaagaaaaagaaaagcataagcagagatagagagaggagggtgagcttggtgagcactgagaaaagaagcacgagccaacgtgtttgagagattgtgtccttgatacggtgcgcgcatgccgttccatgggtcccctgacgatagcaatacttaatacttatagactgtttagattatagtcaaaataaactagtaccaaaattttagtaagttaataatattgctgaaattttagctggatttcttatatatttaccaaagttaaaaaaaataaatgtatgcatatctttgataacttaaaaaaaatgtatattttaaaatagcattaatctgaacagccctcacacttgatcatcgatcgccatcacgcgttcgtgtcgcggtagtgtttgattacattgcgtgcgcaatggcgagcgagcgatagcggcatgccggccgg

SEQ ID NO: 106808 - DNA, 586 bp, Oryza sativa
tggttgattgagtttcacatcatatcccaaaatagtaggaaactttggcgctaatgagcgcaatggctccaattccaagggtagtttgccattctctgcttcatcttcagagttctccatggtgaactcttggagaaattctggcagcagcaaaagcagaagtcaataaatagtctgagcatgatacttgtatgtatcagcagatgaatgatgtctcagaacttgatatgttaagaataagtacgcgagataaatataaagaaaacatcgttcagtgcaaatacaacgtagagcaaagaaattgaataaaaagaaaatagatctgcaaaatcagaaagctgcatcaacttctgaacaatcagaaacagaacaatctgcatattttggccattgatcggtcggctgagcactgatggctcacttaaagataaaaatgtgtcaatgcgaagtctctgtggcatatgaatcatggatgttctgtccggaatctatttggctcacataagcattaacatttcaaagttctacttgttccccccttacgaattaaccaaaacgaatgcaggctctacaatgacgaagatgg

SEQ ID NO: 106809 - DNA, 690 bp, Oryza sativa
tatcccctcgacccaatccagaatggttttgtcctacatgatgtacgcgtgacagtccagtcagcattctatttattaaaaaaatgtaggatccgtctatcgtactcctcttctactcttcctctctctctcactctttctctctctcttctctctctcctctctctcactctctctctctctcactcttcctctctatctctcgtgggtcggcggcaagcgggcggacatagagtggtggcggcggcggcgatcaccatgagcagccgccccctcttcacctgaccctacgatgtatagggttttcacaatgcgcgcggcacttgggctttcccgctggcttcaacgaggaaccgtcagggctcaactcaacgataatggacaaaaaaatttccgtccatgcaagggctcagacatggggatccaatgtccccattcttttcaacatagtggctggtatgtcacccatcctattgaaagagccaaaatcgaggcccctatccacgggggaatcccacacttaatggatgatggtttgtccatcttccaatatgccggccatcccatttattcgttgtgacatgactttgacacggccaaaaacatgtagccccttcttggcgcgttcgaccatctctccgcgcttaaaaaaaaccttcttataaagggcaattattcttcttggcggct

SEQ ID NO: 106810 - DNA, 565 bp, Oryza sativa
tccgggaaattaggtactcttattggatcaattaagcttgtattgtgtcgtccatataatctcaaaatgtatttttcgaatcctcaaacttattattctgaatattatacaggttcaaacaggccccaactcgctttgtgcgtggacgtagcgtaccatggtggcacctactatgtattgtagtaagtgtaacatgccatgacacaccgtacaactttagagactgtgtacttcaccttttttttaagaaagttaaaatgtgcattcatttatagacaaaagactctcactattatagaaaacgcatgaccgatgcggcgctgatgaaccctggttattggtgccagtttcacaaatgacacctttgaggtgcacacgagcttaaaaaaatcggctcggtgcattcaagctgatacatcaaggttgcatatccttgaaataccccggatcccaaatgatgcctcaaatcacccaaaataatgccccaaatccatgaacacattaactacaatcaataaactcaaacaaacaacacattcagatccttaagatgaagaccctagat

SEQ ID NO: 106811 - DNA, 1076 bp, Oryza sativa
  unsure (1)..(1076): unsure at all n locations
tgccctgccccctcctaagtcataaccacgtgggctcctaatgatgatgcccctgccgctagacccacactactgccattcttgatgtatggctgatgccacttcttgctgtcctaaatgtactatgtcaattgatttcaaccattaattagatttcagtcatactgtttagaaatggagctaatccatggatattcatcctgcattttcactaatatgttaagtagctaaacagaaaatcaacacacgaactcaggaactgatagatcaatggggattccaacgaattccaccgctgccgccgccgccgttcgtcgccaagttctattacttaatcgataatcaaaacagagattgcttcctccttataaatatatatctctctctccctctcccttacagaccagccaagggccaaacagcacacacacctactgagcccattccggcccactcatgcgtacattagctttacgaagtctttttcccctccctccagatgcttcctcctgcaccctgctaccattgccctgagcaccagcggcaggcaccttaacattcccccctccttgaaaactggcttgcccccaagccagagctctgggaagacgagtgcgaaggtcttcccaagtggcttcctaaacagcactgtcagaccactgaattaatacttgtggtatagcagaagtacctgatttgcgaactcgggtgtcgaggacagcaacaggaactttcttagtttccatttgagcaggaatcatacgagaagaaacacctttgaagccttgggcagacttgaggttgagtaggaccaattgggggaaaataaaaaaccaaaggggggggggaaaaatttgtgggggggggggaaaccccccccaaaaaaacaaacccgcttgcttacgataatgctaattgatatgccacttcttccaccttgcgcaataccttataggggccaaaggttttaaaacnnannnnnnnnnnnnnnccaccnttcccccagtnngatttnnnnnanngnnnnnacnnnnnnnnnnnnnnnggtttcatgttttttgcattataagnctacc

SEQ ID NO: 106812 - DNA, 1142 bp, Oryza sativa
ttaatgggtaagaacgcccatatgtgttctcctggtttacatgcagggcgggtcctgactttttagggtcctggtgggaaactaaatttagaggccccttcccatactattatcaatagttacatatactgaattaatcctataaacatttaaattgcattcagaaataatatttaaatagccaataatgcacatgttaccttaaaagtttcttctgcgattctatcatatcatccacccttttctttttttcccttttctctcactacccgttgcatactttctcgacgacatggcctgataattcaaaaaaaatatagtagtttaactcatataaattacataacaaaattacaaatcaaaattacaaatcaaaatttaaaatcgtaccaattagttgatcacaagcgtctagatgcacaccgcaagtgagtcagaaatacacactagtgtcttcgtcatgtctaactattggaacaactgaataaacctaacatacgactatacatcaataaatgcttatttacatattaatagataaaaatcacaatagtaaatttcaattttttatttgacgatcggttaacagccaaagcttgtatagcaaattctttaatctgacgactatacataactgaaccagacgaagctaatccagctgctaccatgtaaatgcacaggcacataggatcctagctaatagtaatacctgaatcaagattcaagaagcggcaggcggcaacggctgcatccgccaggcgctcacggagtcacagctggactgcaacctcgtacccctactggcggtcgaaccgtccgtatcggagtcaagatggataggaaaaaaggggggaagcccggggcaacccggcgccgcccgatgcggtggcctttgcgcccattgcgcccgggcgattttcgggccgtgaggaggaaaagattagaagagcggcggcaatcgcgggatcgcattatgtttgtcttccgcttccggcttctggcacggggcgtatgcttcccttgatgctaagcctgggtggggcgtggccgagggagggggggtggtttataccaccataccactatatattccaccccccgggggcccgggcctaaggaccaacgcggcgagcacttcttac

SEQ ID NO: 106813 - DNA, 658 bp, Oryza sativa
ataagagatggttttgtagatatggttcaggaaatctggtcaaatgttgttagataaaaaagttaaatctggtcaaaggaaaagaaggacttgctgaaaatttagattttgttagataaaaaaagttgaattaactctattgagtgaggatgagattgatacaagacgttttttaggaatatgttagctagtttgcttagagaagaggaaattaaaaggtatcagcgagctaagactaaagatattttggaaggtgactcaaatacctaatattttgcttagagaagagctttttttgtcttcgtgaagcttcttcttaaactttgtatgaaagccagataagtgatatcccccaagtgtctcaattagaaaacaattctttagtagatgaatttacggaaaatgaaattaaagatgcaatttctcaaatggaacataataaagctacgggtccagatggattttctgctaagttttatcaagtgttttggaatgttatcaaacctggtttggtagatttatttaaggattttcatagaagtctaaatctttaatcactcaactttggtactattattttacttcctaagtgccaggaggctattaaaattcaacaatataggcctatttgcttacttaatggccattttaaaatttt

SEQ ID NO: 106814 - DNA, 986 bp, Oryza sativa
ttgaatgccataaatgcttgtatatatttgggaatggaggggtacaccataaaagataaaagatactgtataaatgatgttcataccatcctgctcatcaacaaaaatatatactacttgataaatccaaagagtgctagtggtggtggtggaacccttctcaattcacagagcatgcatgatacgaatgcaatgctttgtataataatataaaacaacatttttcacaaaatatgcctctccaaatacaagctgcaaaggaaatagggtttctataggcatgtgattctttggccaaatgatcacaggaaatagaatgtttatctaaggctgtcaaaaaagctcgaagctcacaaactgttcgagcttggctcaaccaaagctcaactcgagcttcacacgagccgagcccgagcctgctgtgagattcgcaagcctcaccgagccgagcttgaatagctcgtcgagatcagcactcatgcatggtagcattagtcctatagacccttctgctacttggcttaaattttttttatttgtctaaatgctatgctacctaacacacgtcacaacaaagcctcatgtatgctcaagtgctactagtacctactactatcctatactactgtagcacagtaccatatagcctatactactgccctacaaaagcctgtgcagctatactactatggtgtgaagttttctacatcgccatcaatgctctgttaccaacaactaatacttcttcccataaaggtgtgcatggcacaacttcttagtactagaaccattagttttgtgcacaattttttgctttcaacctattatacctctcaagctcgtgaaagctcgaggcttggacgagccgagtacaagcttacctctaagctcggagaatgatgaggctcaggtcgagctcgggtcgagtctctactgagctcgagcttacacagacaagcacgctcgagctcggctcgaagacaacc

SEQ ID NO: 106815 - DNA, 529 bp, Oryza sativa
cttgtaacatacccaaaatttcaggacttaaaatttcttgtcaaaatagttagaggttagcttctccatttttaagagtcaaaaatttccgttttaatttaggtgatgaccaacttaaatcattgcatgattaaaatttgagaacaaaataaaaccttttcattcccaacattagactagaaatgtcaccaagtatatgagcatacatgtgcataatgcatgcctaggctcgagtctcttgtgcatttggattttggtcttgcttttcataatatgtctcatgagcataaactaaaagggttaaaattactaaacaaaagttaatcttgggtgataacatgtggacttaatattaaactcaaatatcatcttctcagcccaaaagaagtttaatgtaatccctgtaacaatattaggtgcaattatgaagtgggaacacatatacaaagtaaagtaatcctaattctctaaaatattatgtgcaagttaaaatcatggaaaaaaattagatagataatgtttagcacaa

SEQ ID NO: 106816 - DNA, 548 bp, Oryza sativa
ttcatctgtgggttttagttgcttggagagtaagggatatacctggttaagtgagtatgtggctagtaatggtcgaagttgggctttggtagaagaatggctaggatttacttgttctcgagtcgatgctgaaataggatagcatatcggctcgtatttcatgtataggttatgagtagttggagggtaaatggttgggatgatattgtagctggcgtggagtctagatagcaagctgattgaggtaggataaatatcagttagggtttaggtgtttgctagtcgttgctagagttgggcagcatggcgactagacttagcatcttctctagccgatgtcaacagacagtataacggctagagggataggaggtttgtgtgggtttagtggggcggaagtgttactccgacaaccgtgagtggcggcggagcggctaggatcacacagagcccaagagctaactgtgcggcgtgctgtggaggtcgagggaatagtgaagctccgaccgctgtacgcatcaaggcgtggggtgccaggagcagcattt

SEQ ID NO: 106817 - DNA, 777 bp, Oryza sativa
agtccatatagctaaagcataccactcctcctctaaatatatgatgctacttagttcgaaacaaaagaacacgaagggaattaagggagtagtaacataccttgggcgatatataggattattccacagagatttcagtatggtggatgcatggtgatggtcctgatcaacgccggcgccggcgatggctgacacgatcgacggacttatatatattagaggtacttctccggccggccggccggcagcgagctagcagctagcagcttcttctgatccctcctctctctctaatagctatagcttttcctttcttctgcagctagctagcaaagcaaaggaaacgaccttgagagattcaacgatacaatatttatctacctatggactagttttcttcgatcgatatctgtagtgtagcaaaggaaccttcagatttgaggatacaataatacttcagatataaggagtatttaattatctatagttggtactcaaattgaagagctgaccctgactttgcgcgcatcgaccgtctggcgcgagcgcgactggaatggaatcatccacgtggggcgtaaccagtcttcactctctttcagaatgtaaacgaaagcagctagtggtcgatactcgttttccgtaactatacttaagctgaacccctcctccggcatgtaaaacggagcacgcattattgcatgattaattaaatattagctattttttttaaaaaaaatggattaatttgatttttttaagcaactttcgtataga

SEQ ID NO: 106818 - DNA, 766 bp, Oryza sativa
tagtaattttattgttattagatgataatagatgaatagtattttatgtgtgactaatatttttaatttttttcataaaatttttaaatatgatagacgatcaaaacgctggactcgaatatctatagctgcacttattttgggacggaggtagtaatatatatacgttcttttgcgtgcttcgagaaacactgggcaataataagctgtaccgaatgaagccttgtcttaccgtggactcagtcaactctggatgaggaagtttcttagatggcgagagaaaagagccgccgctgtggagtgtaggacggattggtaggagtaataaatttaatgaattgaatgcgctgctaacgacaaatcattgtgcatacacactacaggcactgttcaactgttcacctgcaccacactgtagacggagacacggtcaagaccgcgtctcgatattagaacatgagttctcgttcagggggtgattacatacagccgggtaaagtttcagcgttttacatagcatattatataaggtattgtatggggtcttcgaacactaataaaacaactaattacagattccgttagtaaacaacgaaacaaatttattaagtctaattaatccgtcattaccaaatatttaatatagcgccatattgtcaaatcattgagcaattaggtttaaaagattcgtctcacaaattagtcacaatctgtgcaattagttattttttagcctatatttaatacttcatgtacgccatcaact

SEQ ID NO: 106819 - DNA, 789 bp, Oryza sativa
attgtaggggcaaaaatctgtcaaatatcaacgaaaaaatcacccgtgtgatgtttagcaaaatcgattttcttgagcctgggcaagctagcaagagataaaaactatgggctgttcactttgttgtcattttcaccctacccaaattttggtaaagttgtcaaaaaagtggctacatttagtttgctgccaaattttggtaactatttaagaaatcctgtcaaaattttagtaagttgccaaatttttggcaactatgtgtaacatactaaaaatttgctattttctaaatatgtatcatgccgattcttctattcttaataacttcctaaacttaagaaattataattagagggacctcctaaaactaacatgcataaaatccctgtctagtatttaaaatttttcgtggtttttattctaaaaattgatcttgttaaatcgaggtattctctttgatttgattttgcatcttaaaccttcttttgaccaaaatttcctttattcaaatttagtctaaaaatcctttttacttttatgaattgtggtccaagaaatcctccaacaatacctttgaacctaaaccaaagcaattccaatttcattggaattaattgtcgacccatcctttgatttcagacctattcttatttatcgccaaatatccaagtttcccattagcctcaaatacttctccaaattcttgccaaataatttgaggctaacatcctatttatttcccttccctctcaatcgagtgcatcaaataaattccgttatattctatct

SEQ ID NO: 106820 - DNA, 1777 bp, Oryza sativa
agtggttcttatttaagtcctcgcgcaggaggcaaacctatgccgcgaagggcaaatataacatttaccgaggcgcaggtaaatgatttgttgagctcaagtgtgtgtgtattgtgaaaacctggttgagatgacgggggtctctcaaccagttctctctctaaaaacctcgggaacgccagaactcctctcgctgctgataacgttacgttcagagcgcatgaggatgagagttcatggaacaggtgccactgatgttagtaaccgaaaagctttgccatgactaagctaatgaatattggcatgtcatggattgcgggtaaagcgtacatttactgcagtaaagtaaacctgaatctattcgaatagccgtgctcacggaattgagtatcgggactcatatggtactttggttagaaacctaattcaagattttactaaatgctgctacatttaaaacatcaggctttctatttctatattctctgccttctgcaagtaatcgtaatcctactcaaatattacctttttatacattcattattgaatataatagcttggtgagtacgttgtactcacccttgcttcaaacccctttttccagagttaaattgaagttcttgccgaagccaggagttcaatcatataagttagcattatttcaacctagttttcaaatctagattagttagatggtttaagtctatagcaaaatattagagttgagacactctatagcttctgctgtaatagttagccacaatcttgtaaattcccctattaatttatgtaataacatctgctttggagccttgttcaaatgtacgcaatgaaaatccagattgttgaagctgtatcaatctactgatccagggcttgatacagttaaacatgtcggtttccgaatatttagttttgggatccgacactgtgccaatgccaaaatttggtaaggtttttttttgcatcaaagtgaacatgccctatatatatatatggaaaattgtaccgtttatctagacttaaagttgattgttgccaagttacaatttatcaatgaaatgttggttgtttattgtcaaggagttagagtacggggcttctatacatcaagaaagcaagattaggatgtggtacaactcgctagtcatctaattaaccttccttggaaccaggaagcaaggtaattatgtaagcaattaatgagtaaatgatgtttatgctgtggagcaatgtgtgttgcgatggcatggagcccgggcagctgcctccgccactgctgccaatacacactttggggtcagtttgagtttggtacgtaaagctcctactcctgcttctgattttctgaaagaagcgtttctgcgactgaaagtgattcactaggttaatcagcagaagccactcttttttactagctccgaaaatcacttcaccgaatcagcctagagcccaacaatcactcctctgtaaaaatatcgtttggaagcagctcagcgagctgtgcaaaacatgccgcccaaatatttgccaatacactacaaattctcaaaacgcatgctaactgaataaggaatgtaaaactagtttcccctaaaaattctcttgaaaccaggtttattaaaaataaaaagtgactatcatttcagagccttaaaagtcttctttaagcccacaatttgtcctcatcggcatggggtagtcgcttcgcctcccaccctcaatgacacgtcggaccgcgattgccccagctgctgctcatcgcgttcagcacggc

SEQ ID NO: 106821 - DNA, 738 bp, Oryza sativa
tacataaatgacttttccaactttaaacacatcagcagcccgtaacccggtaatattttccaacttacacaggcaattgtttacaatattatagagtagatgcagctaaagaaaatgacttgggcggtccaaagtgcaccaaagataatcttacctagtctaaagtaaaaatatgagctagaggatagcctaaagtgaaactttggcaataaaaggtggaccagagtgcaattaactcttgtttttttcctacatttaatacttcatatatatgtccaaacattcgatgtgacagcgtgaacaattttgttttgtgactaagggtgtgttcggacccaagggttcccaacacctctccatcgttttccgcgtgcacgcttttcaaactgctaaacggtgtgttttttgtaaaaagtttctatacaaaaattgctttaaaaaatcatattgattcatttttgaaaaaaaaagctaatttctaattaatcacgcgttaatggaccgctccgttttccgtgcgaagaagatttgttcccaacctccccaagcaaacacagcctaaacagggcctaaacctcgatgcgtttttatcatttctgaataaggtaactaatagatcgtcatagtcttcgtcagacttctatctcgatcgctttcaacggggcacatcagcctaggcggctttgggtcatggacatgtacaggtaggtgcaactaatcatacattttgcaagtttt

SEQ ID NO: 106822 - DNA, 768 bp, Oryza sativa
accgttaagtggtgggcccacgccttaaacttaatgccgtggtggcggacacgacgggaacccaccgcacaataccgttgtattggaaacgcttagtcacctaaactaccacgtcagggtaaataggaagctcctctgaattatacgaactcatacacaccgacctaccagaatgcaaggctagtcctaaatagattactcagcttaggccatctcatactagcacatgtggatgtacgaataactttaaatgggtgacacaagttcggtccttatggacttgggcaaacactccccctatcggtatgcaactaacaccatatgcacaccacttgccgcccaagtataaaatcacattttacacattttagttcgcaaatacccatcatatttattttattccagcaaaggttcatgtatcaaaatcatattttaattatagatggaatgagcatttgcatagttgtaagcatggctaagcaagtagttgcaaatagagcatatataaacccatttgagcacaaagagtgtactctaaccatttctaggggttcaaacagcaagaggatcaattattcaaggtggggtatgcagcaaataggtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaaatgttagcacctaatccactcctt

SEQ ID NO: 106823 - DNA, 630 bp, Oryza sativa
aaaatgctctaaaatgcatgatttatgcacagtgattaggtactgatctaaaatgaattttaggtgaaataatttttattttatcttattccattagggagttatgaattttagaagttttatcgatttatagtagtatagtcttaggtagtgttatgaaatacttttgtaaagtgatttttactagattagacttcacaggggtgtagagatgtgttttataagactaactcatttggtttcacaatttttggagttacaatgattttcttatagattttacaagttacaacgtgttttaggcatatagtgttttatatgtgcatgactctcaagttgtaggttcagaacatgctacttcctgtttaagttgaataaaaggaataatttggttaactaaaacatttttagttcacatgtttatggtctttactactatggttcatattttataaactagagatgctataaactaaactagcaatatattatattaacctagaaattgttatatgagctaagttcttctaagttttagtggatggggatggaactatggcctctctggtctaacaagttttattttggtttattcatagctagaatgcaggggatcctctagagtcgacc

SEQ ID NO: 106824 - DNA, 913 bp, Oryza sativa
caaaccaaacaaaagctagaaagaaaatggtgccaatttgccgaaccagaagctaacacgcgttaacgtacggtttggtatgaccacactaaagtacagtgctgaggagagccaacacccactcatcacttaatctcgcatcttctagtagaatttgctagaaaaatttggcttttttaggttaaatatcaatttgatttcctgtttttgaaaagaaaaacatatacctttatcgaatttattccgatacccttttcgcatacttgatatatgcggttgtaaaatcctttatgcgtgggaccaatgtaggggcagatccagcatgtgacatagagggtacaattataccctaaattattttgtaaacaccctttattaatttgtataatatatgtttgaggagtaaatgatttcgaattaacagacattgtattgataacctacagctagtatatacttaagagaaaatctcggtcaactgatagaaaacaagacatatttgcattactcatagtcactataaatcgataggtattatccatgtaggtgcgggtcatatatttaaataaatacaattctatatttaaattttgtctcaaaataaggacaatccaactatactacttattattgtgacattaatcacatttaattcaaatttctgttcgtcttacagtcagctaccatctcactccgtaccatttgtcatttaatagggggtattttggataattttccttctattttattttctcatctcacttctaaacttacatttacaatgagatggagcgagtaaatgttaaatctcatccaaccaatcgtttatattatgtaaggcacattgatcttatacaccaaggtacatgaaggtaagatcctgttttggatgtagggactaatttttaacccc

SEQ ID NO: 106825 - DNA, 772 bp, Oryza sativa
atcggtttccgccgccgccgccgacgacgacacgtagatcgaggagaggagaagtgggatgagaatgtccatttggcatgtggatgcaatgttgggacaatgaggatggatggatggagaagaaaagagtgacagagggtgagtgagagcaagtgttgtgttggtcactcttgatgatgatcagtggtttacaaagaaagattatggcttatggtgtgtaatcctctgcttttgagagataaagatggctttttctcttctttttttttttgaagtggtgtttataaaacatcaccagttaagggtgctttggtacacttttgtgtttgtgagttggattgatactgccttggacaactatcagtgtaggtgggttttataggggattttggtccaggaaacattcctttggattacttttcaaatcaaaggaagaagagctggcccaaatgtagtttgccaaaattttagcctgaagttgcctttttttcttctttactgtatttgctactcctgtacaaaagtttttttttaagtcttttctcctaatatgaaacggcagaactcctgctcgcctcctcgaaaaaaagtttttttattcagtttatgtggaaaatgaattgttttcagtgaaattcctaagcgccaaagtagccatcaggggtttccttgccttcatacaatgatcatataagcaggggaaaagtacgaattaccccctcccccggcccgaactatcgcggtcatccgaattaccccctaaaccataaaa

SEQ ID NO: 106826 - DNA, 901 bp, Oryza sativa
tacaccataatttgacaatgtgatgcgacattaaatatttgctaatgacggattaattaggcttaataaattcgtctcgcagtttacagacggaatatgtaatttgttttattattagtctacgttcaatacttcaaatatgcgtctgtatacttcgaaaactttatgcccaaacaactaaacacacggccacaccctaaccagggtgaaagcgtccttggagaaccaaaagcagaccgcgagcggtacatcgatcaatgtacagtcccaatttcagagccaaaaattatatttgatttaatatactctaaaaaaaatttaaccgacacataagcatttttatgttgatacgatatggaaaacctttaacagagttcagacacatatctatttgtgcagaataatgtttaacgagtaacatcagtgattgtgtctctggttgagtggggagatctgcattatattacttgtcaccagatgtgatgttagaaaaagggatttttaaagttcctgcaaatatatatttttgtgtgcatatcaaggttgctttgcttagggatcaatgggaaatcatgtgtgtgcatgggaaaggcagaattgtgctgcatgcactcagaaaggtaaggggagaaaaatcagtggtccatcacagacagaagggctaccagggaaggaacatcacatcaacttctttaaaaaaatttctattggcattagagatgataatgcttccctctttactctgcttcctattagggcccttgtgatttaataatttctatcttcattattattgcactttatatgtgataagatcatgtttttttgtctgttatgtttttttagtgatggagaaacaaaattgaatatgataatatttatgcgagtatatattcagttt

SEQ ID NO: 106827 - DNA, 754 bp, Oryza sativa
acttctgacgatttggatgtcgggattgatgttgtgaaagaaacatatctaatcatcatatcagtatggagcatctaaacagtacactacaaacgtggctatgtttctgatgagatccatgcaggcatgtgtgatattcaattaaaaaactaaaaagaagataggtgttgttcataactgatggcaagtctcaaaaactttaatgagaaataaaaaagagagaaactaactaaaaataatttaggagtgtgcaacaatttcctcttctttttgttgaggcaaaaacaatttcctaactggagtggaattgttatggagatatgtaccaaaatcctagatgtacaacttgtgcgttgctattgaagttgcatatatctccaaattatgcgggtaaatactaccttatatttcttgacacaaattaaaatcttttacctgcagagaatatggttaattatttgtttgcaataccagtatatatcttataccttcatatatggaatctgttgtttctcacagaacaaaaatcttcagagttgaatctgaaactgaaaccaaaatgttgagaattttttaggaaaaaatagtaaatattagatcaaagggaattacattcatgatggcgtctctgcccgcatgcttgatgcatcacatccacaagctaagatgcctccctttaattactttgatgactagtttactgctgctattataacctttgcgattgcaaagcacctttgatttcatcctgcca

SEQ ID NO: 106828 - DNA, 597 bp, Oryza sativa
tatcacctcccccacatatttcttctctcctatttccttcttttagttacatggaaaaaatattttataataacaaattttaaacaattatattatctaaatcatataaataatttttatttgtgctcactattagattattttctgtaaaatttaaaattgaatatccaaattaactatattaattattaaagaaattcaatacttttagtcatatatattctacgaattatagctattgttcattgatccatacattttttaaaaaaatataatatattttaaacgttctgattaataatatgggtgggcaagtttgaccgcaagaaaactaaccagttgaactacgctcacttcataatgttggatataaagacaaccataatttttaagctacatttttaaaatactcctatgccttttaaaccggtagaagcattatttctaaccgttagatctatcttatatagaaaaagtgtttattcatggtacatgacatttcaaaaatattactgtgcaatgataatacttcgtcgttatcgtgttatttctaggttgcgtggagtctctcatctactctacataaaatgttcatag

SEQ ID NO: 106829 - DNA, 1227 bp, Oryza sativa
aaaggaggtatagtccaacacatatttttcatttgctgatatatacatcacatgtactgctagtgtgagagtactccatccggttagaataacatcacacgctgctacttctaatattacgcaatttataactgtgagcaggcagatcaagcaacgcatatattagattacttaaacccgtgggatctttggaaggttagggacgccacgtcatcggttttttcaaaaacaccactcacctctgattaatcacgttttgggttaatcacgttttgaaaagtaagtgtgccacgtcattgtatttttttgcaaaaaaacgcctgcacttcctgttaattgtgcgttggttcctgccgctatggtccgttcgatcacgcgcgagggactagcgtgtcccagcgtggctgctcttccaccatcgtgagatcgttggatcagaaacggacggcctagatttggcaagaaccctagccacctcgcgctcgcctctcttctcgctcgtgctgccccaccctcctccctcgtgcgggtcgccgcctcgttatattataaaccaataggtatatagttaatttaggctgtgttcttcccccaattttcccaactcatctctcttgtttaccgcgcgcatgcttttcaaactgttaaacggtgtgttttttgaaaaaaaattctatacgaaggttgctttaaaaaatcatattaatctattttttcttttaaaaaatagctgatacttaattaatcatgcaataacacagctagttttatttttaaacttgtaatatttattcatttaaaataaaacgagtatcaaaagttctacgggaagcaaacataataggtttgtctatttgcacagaactttcgagcaaggacgaatagtcaaacgtactaaaaaataactgcatcatattctaataacatttaaaaggcggtatagtacaacacatacttttcatttgctgatatatacatcagatgtacagctagtgtgagagttactccatccggttagaatgacatgacacgctgctacttctaatattatgcaattttataactgtgagcaggcaaccaacgagatcaagcaacacagattttatttgaaactagcaggtatagagttaatttacgctgtgttattccctagtttttccaactcatctctcccttttttcggcgcacgcttttcaaaccgctaatcggtgtgttttttgtaaaaaa

SEQ ID NO: 106830 - DNA, 537 bp, Oryza sativa
gtgaatgaagttgattaaaaaatgaaattcaatcttggagaccatatcaaagagctaatatgccttacttttctcaatcaaaagattaatatgtacatatgtgtggaacaaaaattgatactgctggtgagcccacttttgttttaggaaaaataaaaatgaagaggggcagtgatgccgttttctatatttttttctctcctagttaactcgatatattattttaataggagaagtgtccattagcaaataaccaaagttttagagtatcttttagcatagccacatttttacggtatctcttggcaaataccataaattttggatgtttagtagcaaattttgccaagattatattgttttgtacaaattacctgatttgctgtaggagggatgattgcaaatgatagtaagggtatcaagcttcttgcaggtgaagttgggtaatttggaaccatgccattataattttacaaagtttgagatatgccatcggtatctcaatgtcgtggatcctctagagtcaacctgcaggca

SEQ ID NO: 106831 - DNA, 765 bp, Oryza sativa
agggagagaaaaagaaagagtgtggtgaaagctgagagagaggcagggaacaaaagtttggactgaaatttacaaaattttgggtctattggatcccatacaaaattatttcacctggaatttttggatttttgcaatattcgtgaattccacaaaaatatttgaatttgatcaatttttgtttaaaaccttcaaattatttcggattaaaataaccgaaattttggaaattgtgaccatatcgatacccccgatgcaactaactaaattaaaaaatggacccttaaagagaggagcaggatagaatgacttagcttgtaactgtcaagctcaggtggatctaccgtagttttaccactgccgctcaccgtggatctgccgccgtcaccgtggaaataaccctcacaccgcttgctccaccgcattgggctggttcgaggtgactggttccattggctgatgcaccacataagggcaggagaggtgggtgctgctcaccaaagaagtgaaaaaggtagatgagagggagaggagttgagcagacggtgtggtagagagtgggtttagggttactgtcagtgcgggtcaggtgggtggacaggaaaccctccctctattattagtgtgagtttttcttaaccgatgccgataggtggcacagttgactgttgacatgttctccattagcgcaaacaccaaacagtaagaaaactatgcagggtgtcacacccacattgtgttaactgtacagttgttgtagataaa

SEQ ID NO: 106832 - DNA, 701 bp, Oryza sativa
cgcgaatttggatgtgtggaaagcttgagtttatgttgtaatttggaatggtgaattgcatttgtaaatttggggtggtgaattgcattgtgaattttataaaatttgaggatgtttggtatatgccccgtgaattttgacctgttgatttgtgaatttttacaaatagtacttttataattcacttttttgtcaccggaaatcctttttcctagatgctggcctaatggagctacttgggaagatatataattttcatatgttgctatcttaagcatgccgcctgtggaaatgtatttcgcaggcggtcagttgtcttcatttttactggcctttactgaggcggcttacgccaccatcagcgaaaaccttttttctattagtgatgaaaacttatgcttgatttgtagtgtttttgcttgaattcaaaaagtagtctactcaaactttcctgaaattttctactcaaatgatcaagctttctactgtaataactttattgtctaaaagactaaaaccttttacttcgatgacaaaattttctattcttgtgacataagttcctacacaaatatttatcaagaaaagaacgcttgtgaagaagcatgtgggtacatgcgagattttttacggcataaaaaatcttaatatcgatgtctatttttttaaaaaaaaatgaggcagcagcttaaatgatgtaa

SEQ ID NO: 106833 - DNA, 630 bp, Oryza sativa
ctagaaacatttgacaaggtgcagcttggctcgtgcttgtttttttcttgaactgaaaacttctgtactttttatctggcaagcttatttacagctgaggaagtgctccagtgctgtcaaaaaaaatagtgaaatggcttctttggatctaactgatcgatgaaatgtttagttcatattctgtttactactagtctattacattgtgttcgaggagtgattaagctcacattccatgcaacacatggttttatttttgtcttttttgcaggaagttataatgttcaattgttatgatacaattttattgacgatggtcagtatgttgacaattaaatgctgcaaactatgaagcaagattatagtataccttatgctgatcacctatatattcatttcagcaatgtactcttgcttcctgtttaaaagaactctagcatttccatttagatgcttaccatttgaagtgagctttctattatgtatgggtcactgggcctcatgatagcatcagtcggtgtgatattctcagtcataaaattctagaaaaggtaacttgcagtatgcttgatagaagttatttttgtcctggtttcagtccacactggccctgcaactgattcagtatgc

SEQ ID NO: 106834 - DNA, 718 bp, Oryza sativa
tcttgctcaatgtttgtttttttgctttagcttgtccattgggatcatactgtccgcgtgccactgtgaacacaaccactggtctttgtgatccgtaagatttttttttaaaaaaaattctgttcttattgttctgcatttgccttcttgaaaatataaacacaatgcttacaaggtgaattttctgaactttgattagatacaagtatcagataactccaaatacaactggctgcgggggtgctgacacatgggctgattttgggagcactgaagagatgttctgtccagccggttactactgtccaacaccaacaaaaaaggaaccttgtagcgaagggtactgatccaatcatactccttgtatgacttatttgacatatattacaaagattatttgattttaaacactaggtgactgatgattcttgtttttttcctccccttcaggcactattgcagactgggttccaccactcaagacagtaagcatcattaaaatagattgatacttcattttcttattgaatcatgcagttatagtatctaccatccagcaagctgaatttattcaaaatctgcagaatgtatcataaagggatcctgcaaggagaagacagagaatgaaaacattgtcattcttggtggttgtttagtggtaaattccatcaacaaagtcatcatttcactatcttgctagcttgatggttgcctcttt

SEQ ID NO: 106835 - DNA, 549 bp, Oryza sativa
cgtatataagatctatcttttcatacaaacataataatgaagaacgaaggtgaaattttctgttataaaaaattgaaaaggacaaatgtgtttgatagaacaacatttaaaattttcaaataaattgcaatgacatttcaaaagggggaattgcaactatattttattcttcttctccttagaaacaaatttaaatatttttttaatacacatcaaacaaaattcaagatattttcatggaaagagagaaaggtgaaattgcctctaaaattttcatcaaacttcatttcaaattttatcttctcttttaacactggtggctagatcagttgattggtgcatgtgcgtgcctagtgttcgaatcttcttcctggcaatgtttttctcttgataataaataaaattgggttggactgattgggacatggggtggagacattaaggagttcttccagaattatttcagaaattattcgaccaaaacagattccaataagggaatatcttaaaaacctacattattaaaaaaataatgttttaataaaaact

SEQ ID NO: 106836 - DNA, 3572 bp, Oryza sativa
tcattggtggtggtggtgttggggtgggggaattctaaaggtggggtcggcgtcggtcggggtggggtggctggtggtggggcaaggaccgatttatataccgcggtgatggccgttttctcttctcctgggcctactgggccttgtgggctggttcggttggactgtctgggccttttctaccgttgtacttgtttggaaaaggtacaccaaaggtccctcaacttatcatcgggataaaaaaacgtcctcaaaccgcaaaacgagatatacggagtcctttaactatacaaaaccggtcacccgaggtcctttggtggttttgaccccagttttggtctacgtggcggctgagtcagcgtgggatccatgcagaccccacatgtcagcttgccacatcatcaccctctcccctcctctccctttctcctctctctctctctcactcttctcttatctaccctataagagcacccgcaatggtaaagtaatgtgctatctataaaacatgtacatctcaacaatagactagattaatagtaaactatctcaatagtatgtctacatgggtatctatagctctttaatacattgtctcgtttttctctatagactatctccaggttagtaaatagctttgctctctctcttcatttaatatcttccaagtaggaaaatatactgacatggatcttttatagagagcctatagataaccattgcgggtgccctaatgcaccaactcattttactcatctttcactcctacactattacatttatcactcaacggttcagatcgtccagtgtaaaatcgaaggatcgagatcaatcctacctccacctccctgaattgcgcactccccccctctctttctcgccttccagatcctcatcccacacgcacatccctctccccgtctctttctctcgcactgccccatctccagtgtgtcgccgccgacgaatctcctcaccccgccgtcgccccttccctttcccccaccgccgatgaaactcctcgccccgccgtcgccccttcccttcccttcccccccaccgttcatcggcgacgatcccaccttcggacctaccggatccctctccaccaacggtagagaccctcatgccctaccggattgatttgataattacaagctccatccacacccagtgctccactcaggtttgatcctaattcgctgcctgctccactcctttgatccctgttccccccttttgtccagataatcgcacacttgggcaaactcaaccaaatttcgattttcagatatattgtcatatagtgttacacaatgagaattcctgctcacaactaaatagctggacgtgctcctattttcttgcaatgctatatgttagttttgagatgcagcggctaagcgagtagaatttgtgagctatctaagtaggatatgatttaattggtgcaaggttaatcgcaatagcagacattttgtagattattattctctaccctctgagtaaaaaactgaaaatagatgtcttagcaaattcttcagaagttcagcagaccagtgtgcgtgaccccgctgattggaaacctcctgtgcgcatatcctgctgtttccagtccatgtcctcagttcatgacctgaattgaaggtaaaagcagtttaccaatatttttactccttaaaaaacaaaggtttttactctgccaattgatttattccgtgatataaatcagcctctattgaaacctatagtgctgaagttatgctttatgaatcagtactattttctaccgccaaccattgcaagtattcattatggtctttatcatggtttatggtttattatgaccactagcaatgcagcgtgcacaatatatatatatatatatatatatatatatatatatatacacacacaccccaaatatatatactgattcctttagttgtctctcatatacaattaatggatatatctaaaaactgaacagtacggggcacaatgcagcaggaaaagggctttgaatgaaaagtatgaacataaatttatatcatgccaaaagcatatattcaagcctagctttcattaaaatacaaaagtactttcctctagaaaaatacgaaagtccttggatataacaatacacgtgcggtgtgtgtgaattaacatggtagatgtcatatcaattaactcatgtgtaatgtgttgcgatttaaaaaagccacttctgcatggttgtagcttttgtgatcttatatgcaaagagaaaggtaaaatgaaaatatcaaccttgctcacattattcatgtttgtgttgattctttttctaagtgtattttaatttgatctttgtttcaggctataggaaacaccgtacctcttatgaacagttatgctacagaagtcctttttgggaatttgggttcaatcacacttggaattaatatagaaatttattttgctataaaatatgaacattgcggccacaaagagtgttaattttcttccagttgattaaaggaaattctccatgaacccaagtttaaccactttgttcctttgctatagggtacagttctttaatttatcaggtgaaaccccgcgcattgttgcgggaattagtatgataacaataaaaaaataacgtgtaagatagctaaataacatcagattaagtaaattaatatgatttatgataatttaaatttaaatagtatgcagaatggtgattcaaacgtaaaaagtaaggtgatatgactttatggaagaagaaaagtagggagatagtttggaccgtagattaatcatctaaattctaaaaacaattgatgtgatatgacttaattagaggaaaaactaaaaaatataattcgaaccatagattaatcatttaagcaattactaagtgaggatgagctatataagtatatatgatatcataaaacataatgaagatatacattggaacattatgtgaattatgttagatgataatttaacatgtttgtatttgaaaagctcttaaattataaaaactataaagatatagcatgtttgcttgatgtttaaatgtgatgaagatatagcatgtttgcttgatgtttaaatgtgatgattgttagtggatgatgatgtgccatcttgttagtggatgatgatgtgacatctttgcatgttaagcttaaggagttagtgggggataactttatagtaagataggattagtgtatagtgaatgatactgtgtaaatgtttcatctttacatgagctaatttgtgtgtgtttttaaatgcatgcagcgtcttgtctcttcttgtacaatggtgaccacaaggttatatctatactaatataaaaaggaagagttgtacctctccaatcctactggtgaaatcacccggatcaatctctaccgtccatccgccatctgatctaatctcatacgtccgttatcctcctaactgtgcacagcgatgagcgattccacctattcagaaatcacgcgatgactacgccgcacaaatccccaccgtcttctccggcccctcgcttcttcccgccgggacaactt

SEQ ID NO: 106837 - DNA, 593 bp, Oryza sativa
cgcaattcgcaatagctcaagttataacgtttcacacatatcatatcagtgaactatatctatcacaatagctctagtattggcagtattagcttctatttgctcagaattacattattttcctaatggcttcatagactaccaaatattttgcacaataattttactgggtatttacattttacaaaaaggtgctgtccatcgtttgtggcactcaaggcctctaaaacatatgtgcaaacattcaatattctcatgtaacactgcagtttaggcaacacgaaactagcagcaacccacatttcagcatatatgaagttggaaagaaaatagcttttgtgataattaattatctaacatttcatataattctgatgctcattaatcatcatcgttcattctcatatcagcattctaattattatagtactttattataaaaaagaaaattgctgaatcataacatcatttattacaaatggcaccactttctctgtaatctacaaatagaaaaaatagagaacatgcataccttataatgcaattagccttgacagagttaaattgccctagtagacaggatcaacattttg

SEQ ID NO: 106838 - DNA, 1174 bp, Oryza sativa
cacaatgccgaaccatttctcttttgaccacgtcccattttgtgcatcacagccaccggaacgcgaccacgccgacgacgccctggagcacgcaccggagcgccgccgcttcaaccatcgtcgtcgtccggccattcttgaccacctcggagcaagccgttgtgccatcgtcatcgcctcaatctcctcttcaatacgcctcaagaaccccagccggagatttgaaggactcggagaacgcatcttttcttcaccggcgccgatctagaatcgcctccgccgtcatcgtcgattaccgctgcctcggtgagccattgttcgattcctcgcgcatacaccatctccttgacctcacaaacctcgtgcatgcttgcttgtagcagctcatcgtcccgttcgagccgtcgtcgttcacccgaggaggagcaccgtcgccgagccgttccacaagtcaccgctgccgccaagacctcgaaaaccctagctcgacccacggtgagcatcctgaaggctagaagaccacatgcatgcatcgttcggaatcgatttccatgcacacatgagctttcaccccaagaaccaccgccgctcacactcgccatcggcgctactccgatgtcctctgaccaagaaaactagaggaatggaatcgcaagaacatgctcttcattttatcttttaaccccaactccaaccgagccaccaatcgccgccggtgaacccgggatcgagctcagccatggctgctctgcctctgtgcgtgtgaaaaaggagtcagggacttcagtttgagaatttaaataactataaggttcattacgtaatgttcccaatcaatgacatatggacctaggactgcgggttgatttcctgaaaatcctaggggcctttttgcatattggcctgatactgacaggtggaccccatgagtttaaaatctgaaaatgtaaaaagataatactaaaagctttatattttcaacaggaaaacatgtaaacttataaaatccataaaaaattgaaaacaactcattttagagtaaatcaaatttctgtgaactcaccaaatcaagaactttagagttattgcataaaactagacattcactgtacaaactttgtctctaaaattggtctaagataaatcatacataaaccatacacaaatttataaa

SEQ ID NO: 106839 - DNA, 590 bp, Oryza sativa
atagaaccagcaaatagtgagcttcaacatagtaaaataaaatattgcaccttttgaacatattatagctctaatctttaaatagataacctaggagttaatcacctagtaatggttaagcaaaatatatgtgtaaggtagttaaaaaaatgcattctagctatgaataaaccaaaataaaacttgttagaccagagaggccatagttccatccccatccactaaaacttagaagaacttagctcatataacaatttctaggttaatataatatattgctagtttagtttatagcatctctagtttataaaatatgaaccatagtagtaaagaccataaacatgtgaactaaaaatgttttagttaaccaaattattccttttattcaacttaaacaggaagtagcatgttctgaacctacaacttgagagtcatgcacatataaaacactatatgcctaaaacacgttgtaacttgtaaaatctataagaaaatcattgtaactccaaaaattgtgaaaccaaatgagttagtcttataaaacacatctctacacccctgtgaagtctaatctagtaaaaatcacttta

SEQ ID NO: 106840 - DNA, 587 bp, Oryza sativa
aatatatataagtccgtcgatcgtgtcagccatcgccggcgccggcgttgatcaggaccatcaccatgcatccaccatactgaaatctctgtggaataatcctatatatcgcccaaggtatgttactactcccttaattcccttcgtgttcttttgtttcgaactaagtagcatcatatatttagaggaggagtggtatgctttagctatatggacttcaaaattaaccatagctgatgtacttgttcttctgcacaaaattaattaacctaacctcgtgaaattgcctagtaagcacaaaccaagatgatttagcaatctccattccatatgagcacacgcatgacatgagagagcaaattaagtcagcgcaaacgccgtagtgcgctgctatgctgaatagcaattaaggttccagcttgcactggttctggatcaaggccaattcttcattaggctactaactaaggggatttaatttctgggtccgaatttagcaagatttgttatattggattatccgagcagcaattgatcgagcttctttctgcgagtttgttaatactagattaatctgatgttttatt

SEQ ID NO: 106841 - DNA, 545 bp, Oryza sativa
acgaacgaagaggccattttgcgtgcaccacatggagtaagcatcttatgctaccgcgatgaagcgtactggatgacacgaaaaatactggtgtacgacatattcttcgaggggtataatgttcaaagggtaatgcgtcaaatgggattgtaccaacaagtcccagttcctgttgggcttcaccttctaccagatgtgcacacgtatgttgttatttcaatcctgtctaatttctgtgctctccaaaattgtcagatataactaacaactaattgttgtatttttgttgcagggaaaagaggcaagctgacaacaggtatcatcgatctatgcactcaaggatgatcccatggatagaggcgtggtcacaggccttgaatgatgtcgtccaggagaccaaggcatacgaccacaacacttacgaacaatacatggcctagtactcatcgcagactcgcattcggctgcttgcacccgaggatcccgacgagcgaagttcaccaacaattgatcaaatatatgatatgcagctagcacccccccgt

SEQ ID NO: 106842 - DNA, 1851 bp, Oryza sativa
gtgtcgacactacgccatctgattgaaagagatccggtaaggcatgcaaacaggattctccttatacaatatttctgatcaagtgctggccatggttaacaccattttcatgatcgtgatattagttcttatttttctcgtgtgaattttcgttgcaacgtactcccgccgtccacaaatataacatatttaagtactgctgtagagattaaggataaggagaaaaggctatggtgcccttcattaagggcctatttgggggagcttctgacagctgtagattcttccagaatcagaagctcccccaaacagtctagattgtcctccagattttgaaaaactatagttgtagaatactaaaaatgaactagaagccagaagctgtgaaacccggcttctccagattctcagaagttgactaccaaccagctatttttcagaatcttaagctccctcaaactgcgttagaggagtagttggggtaagatgggaagaaatttgaatgagatgtgattgatggggcaagtagtacttaaaaatcacttgtatttgtggacaatggagagggttaaaataccttgtattcatggacagagggagtacataataagggaatgatgatttttctttttctgaatgccatatttcaaatgcatattgtttggtacatgcggaactttcaaggagtaacattttttctgttaacaactatgcatcctagaatgtaggctggttgggtagcaggtcagaggccagccattactttttgtcctttttccctttgtggaatgtttggttgatcttcagtttatgttgtggataatgcttagttgatttctgtatatgtttggcaaatgcacaccataatgtgttttgcttgttttatcttagttttttttctctctttaatgggtcattgacccagatccattggattacattctgcatattgaactagtgttctgaagaacctttatccagatttttgaggcatctgtgagtctcccgtggtcctattccatgacccagtgtcccagtcaacgtgggaacctggctagttatcattgtttttaaggcatcgctaaggcgtcgccatagcgtcgcgaaggcgtcatggcactctgctggctccagggcgtcctgacgccataccagccagtgtatggcaaccccaatctcatgccaggagagaatagggggattatggcgaccccaatcccatgccaggagagaagaggaggggggttatggtgacccaaaacatcaccaaaagaaagaaagagagagggagagaggattccatcttatctggaaccctaccagcagcgacgacgtctcagtatccacgactcccataaccatcagctctggttgcggcagatctctttccctcacctccctgctgccatcctcactgctccattcacctcttccttcctctgctcagcttggctcctgtttccttcctcttttcttcgcttggttttctcatgtggcggcggctgtggacatctgatgcacgatgcttttagggtatagatgtttgacctaataggttattgggctttgtgggccggtatgagggttggtttgatgggctgttttgccattttttatattttccataccagattattccctatttctcctctgatcgctagcagagttattcttagggcatcgccacgccataccgctataccgtaatagcgttgaggcgggtgtgcagcgccttagctcgccataccgccttaataaccatgctagttatataggccacattggccaagtctaagactgtcttggagccctacagttgggactgagtcccattttgtgcatgagggtgca

SEQ ID NO: 106843 - DNA, 1875 bp, Oryza sativa
ggttggtttgatgggctgtttgcccattttttatattttccataccagattattccctatttctcctctgatcgctagcagagttattcttagggcatcgccacgccataccgctataccgtaatagcgttaaggcgggtgtgcagcgccttagctcgccataccgccttaataaccatgctagttatataggccacattggccaagtctaagactgtcttggagccctacagttgggactgagtcccattttgtgcatgagggtgcacatgagtgcatgtgttatttgtgttattatttttgcaatcaccctgattacttgatgcacactgtcctcgcctcctcggttctcctctaacctgctatagaatacctatttataacataagtatcagtttttaaaccctaaacccttatctgttgccaattttttcaaagctagaaactgctgcttgtttcactgcaactaaaatacattgccaagtgccaacatctttgtttgtcttgaagagcatttagatcagttggcttacatcacatctgttaaacatatctggatttagcaatttcttggtataaacgatgaaatcttgtgtggctcaaaattcagtaacagtctgtgggtcatcactcactagtcagtagtcatcactatgctattttgtgtcaataactttctatacaaatatatggattgatatacaacaatatttgggttcttatgacaaatgttatgtgggctctgttttttaatatacttttgacagttagatggtttgttaattaattaattaattagtggccttccaattgtatctgatggctgatatctagtatgtactacgatccaacagttgtgacattttttatgatgtgtctccatgtaatcgtagccaatggggctacttatataggaatagtagataagtcttctacttgaataaaattgagcaaacatctttcttcacagcagttttctaacatatttaaagcaaaaagttctaatgtgatttttagccagaattctgttctggcataattccacacaatttaatgcatatacttctttgcttctgaatctttttgtcaggctgctatgatcaatcagaacattgaagagaatctgttcagcatgcttgatgaggaaactgactctgagtatgttttttttttctgcatatttgatttatactgcactaggcaaaatattctatttccctaaataatcaattagtttcctaggatagggattagtcagttggtatcctatctattagtaggaatgttatatggtaattagtaagtgatgtatgctcttggatggttgccaaaattttggccggccaaaactccttggtcattttccatgcattttgttggctaactttggccaaatgtgggcaaccaaaagtccaaaattatggacagttttatccgttgaaattttggtggaccaaatatggtcatgaaccaaagacactcaactattgttcattttacatacatggaaatttatatgtggaaaaggaatacatgatggatttacacaacagagacatttagtcttggcaacaaaacataatagtggactgggagcacaagagcaccagtccttctgggagctttagagttgttctctagactcaggtgcagaacactattctttgccttgcagtagtgcagttccatctcgtgttctggtaatacgtatatcggcacattgctaatttacatgtagctcacgccctcctatttagttctctggctatagcggaactggctatgcacaaaagtgctgctaagcagtataatttttttggtactattatgaactcaggttcataacattgtctgctatccatatggtactattta

SEQ ID NO: 106844 - DNA, 716 bp, Oryza sativa
aagagcatacatcactacttaattaccatataccattcctactaatagataggataccaactgactaatccctatcttaggaaactaattgattatttagggaaatagaatattttgcttagtgcagtataaatcaaatatgcagaaaaaaaaaacatactcagagtcagtttcctcatcaagcatgctgaacagattctcttcaatgttctgattgatcatagcagcctgacaaaaagattcagaagcaaagaagtatatgcattaaattgtgtggaattatgccagaacagaattctggctaaaaatcacattagaactttttgctttaaatatgttagaaaactgctgtgaagaaagatgtttgctcaattttattcaagtagaagacttatctactattcctatataagtagccccattggctacgattacatggagacacatcataaaaaatgtcacaactgttggatcgtagtacatactagatatcagccatcagatacaattggaaggccactaattaattaattaattaacaaaccatctaactgtcaaaagtatattaaaaaacagagcccacataacatttgtcataagaacccaaatattgttgtatatcaatccatatatttgtatagaaagttattgacacaaaatagcatagtgatgactactgactagtgagtgatgacccacagactgttgaattttga

SEQ ID NO: 106845 - DNA, 670 bp, Oryza sativa
gcttgctgtggaactattgtttgattctggcagcaaagatgaattcttttgaatatgagattgtataatttattaggttgaatctgagatgaactattgtttgaattttgttgtattctgattgtatctgttattatttggatctgagatggtatttgtcattaggtttgaatctaagatgttatgagaaatttgattgaatttggtgggctcaaatttaatgggcttgtttagtgggctttgatctgatagttgggttgacaaaatgggctagttttgaaatgggcctagttctgaaatggacctattttaaaatgggacagttaaaaaaaattgatgggccgtcaaaaaaataatgggccatataaaaaaattgctgatgtcagatgccacatcatcagtgacacatcattgcacacgtgtcaaaatgaccacgtcacttgccatgttggttgctaggtggcaaccatctgtgacgtttatttttgtcacaaaggttgggcctcggctagaactacactggcccataagcgttttatgacggttaaaaaacgtcatagattgtgctgatccgtgacaatttccgagaaaacgtcagacagatttaatctgtgaccctcaatagatgacgataagtataatcggcacagacatttcctgtgacgaattt

SEQ ID NO: 106846 - DNA, 1687 bp, Oryza sativa
tgaatttggtttattttttgttacaccaaaaatgtttcatctagtgtactcacagtacttcattatgtatagatctaatgttgcagtgaatgaaacattccattgcaacaaaaaaacccatatattttggaaaccccctattaagggaatttggtttattttttgttccaccgaaaaatgttttacctagtgtactcacaatgtttcactatgtatagatctaatgttgcagtgaactgaaacattctttagctatttgctgaaacattgtttttatataaggtgaaacaacacccaatttaaacgagtggaacattttcgatctacttagtgagacaattccgatatacctggtggaacatcgtacaacatttaaaaaaatcaataataagctaaatttttttttcattggaatatatccatgtgtggtcttgttttgaagatttaattgcaatgaatttaatggtgcaatcggatcatgatttggataaataatttaagagaaaaatcagtttaaagtagttttacatgtaaatcggacgctgacgttagcatgacgtctccaaatcgtcgggcgcccgagctgtagggagccccgtaaaaaggcgatcaaaaaacaaaaaatacccttgaaaacggcgaaaaaaagtctgattctttagtattttttttctttccttttttctcttttttttcccgttgtttccttttttccgttagtccattctttttcgttgtttttccccgtccttttctttatcttcgccttttttcgtccgcttttttatggaggatgctacgcgtcggacgttcgatattttgcaaatatcggacgcccgaccctgcactgccgcgcacctacacatgcatgtatacctgtgttctattatttctactctagttgattagcacgtgtaaaaagcctatatgcttgtgcatgcatgactgctgttcatactctagttgattagcacgtgtaagaagcctatatgcttgtgcttgtctcaagctactttttatttctttaaattaaatttccttttaaattaattatccgatttatgattcgatttcaccattaaactccttgcaattaaatctttacaataagatctcagacggttatattttgatgagaaaaaataaatgttgtttcaccacttgtaaaaaattgtttcaccacttggtcaaatgttccaactcagtctataaaatatttcagacaaatgcaacattcaagaaatactaaatgcaataccgataatgaatgtatgaaacattgagtctccatgagtgagacataaaaatcttggtcaaatgttccaatttagtctataaaaatgtttctgagaaatgcaacatttagaaaatactaactgcaacaccaataatcgttgtatgatacattgagtctcaatgagtgagaaaaaaaacttggtcaaatgttctaacttagtctataaaatgtttcaaagaaatgcaacatttacgaaatactaattataataccaataatcactgcatgaaacattgagtctcaatgagtgagacgtaaaaataaaaaggcaaaattggttatatagcatcgaaagttcacgtttttggttttatagccccgaaagttactggttcactttaatagcacccaaagttcaccatgttcccatttttaacacttccgtcaatt

SEQ ID NO: 106847 - DNA, 1988 bp, Oryza sativa
aatgattctgatcccttccattgcatgtgttttgctgtatgtgcagattaagacaggtccaaccgtgcaaggtgatctagtcactacaagaagctcaagtagctctgatagacaaaaaccactactgcaggaaagatcataggtgccagttcgaagaccctcataggtgctggtttcgagcccggtaccaattacccaagacattggtgccgattactgaaccgacacctatgggcattataggaacgaaccggcacctatagtgatctcggggatgacctggatgctttataggtgctggttattgataggaaccagcacctataataccatataggtgccaattctatggtttttttttgctggcacctacaatgccacatgggtgccggaatcggcacctatattcctcaagaaaaaaaaatccttaaatacagaatattaatttcctgaaacaaagaatattacatattcacataaaatgcataatcacacgttagaaaaatacatcctgacgccgcagatatatgtagtccaaatgaactggaaatcctatgtcctaattaagtgggtaacacctacagacctactccttggttaagtgctacaaatgactggtggatttatggggatccctctcccactggtggatttatggggatccctctcccataaaagcttttcccttggccttttcttttggagccagaatggaaaaaagaaagtgcactgtagaaggtggcacaacagtgttgcatgatcaatgcacacttttagtggatgaagcaagctagctagctaggtgagttggggccaatattaatgcatgcagggtttgcctggttggttctccatcatctggggtatatggtatttgcataattgggttggaaagggatgctggctctggaaaggggtttaggcccattcagggaataacatgatgagcttgggttgaagggacagcaagctccctcaggagcttcagtggggacacataaatattcattattttttttctttttctttttatttttccaccgggagggtatgcgtttttgcaatcgaagagtctatgaataaaatcctcatcaaaacttagagaagcaccactagtggtagtcatgggtgcatgcctctaggatttaaatgttggtgctcaggattatcatgaacttgcaaatgcatttttaggaatttagtgagtgtagtgaattgctgcttttttcagtctttataagcacgtgttaggggtgtgtgcatttgtgttttccgtgtaatggtaagaaaaaaaaatcttccgaccatcatataccaggcaatcaaatcacttcatgccctctggtctagctagccctatcatgtaaaaatgtcattacgagctaacctccgtaagaccatctctatatgccggttcaaataaacctaaacattttctctctaatatcgcctccttcaagcatccactctagtgcggtctccaaaaaaggatcatattgcatgcctacaaaaggttgagtgggtcttgctccttgcaccaatgcatgtttgcttcgcccacttccagtagtggatatagaaaatgtttagagcttagacaaataaattaaagttagtattgctatagggattctatcttctatcctcctaattacataaaattttaatggagcatccgctgacaagtccgaatggctgcctaggactgccaggtcttgaatccgcctatgctcactcatctttccccgttgccgtcatccacttgcagcaacccttgcctaggttgttagcatctcctctccataatttcgcaatggtagagcggctggtatcggatccgtttaaatatcgtcttgtgtatgattgactatatatttctggttcttgcttcttgttcctatgacaaaatcataatttctaaaatttccgatgatgttgcttaattagtttttgggttttgtttctggatattctgatgatgttttcta

SEQ ID NO: 106848 - DNA, 3871 bp, Oryza sativa
ttggacggtaggagaattatatatatggatctaatttatgatattgatatatatgatgttgacatagctagctagatttgttcattgagttacatgcattttttttcttttttcctgtctattggttttccagcactatatatttgtatttttctcctcctgtatcagtacatgaaactcccaccgtcttgtgaggttcgttttttaaaaaaaaatctccaaacaactaggaaattgcatatcaccaaatttacttcatccgtcccaaattatatggcctatatttttttacacggtcttcaataatatattttgaccagcattttatgtcattctattatcccaacaaatatgaaattagcaccacatgaaagtacttcaaaatataaatctagtgatataacatgcataatacttagtatagatatagttagtatgattattagtcaaaaactatcaaatttgattttccttaaaaagtgggcaccctataatttgggacggagggagtactatatattgacctttttcaatagtgtgttttaattattatttttcaaatagaatgatacgtttgcagaaacattaacttcaagataattttgattttatccaaaaaaaatccattttacatccctgaaatttcaaagaaattttaaaactcatacctaaacttaaaaatcagacaatattcattcatccctgaacttttcataaagttcaattttcatccttcgacaagatccaaagtgggtgttgtgatttaaggcacaaaaaaagttgaatttgaaaattagtacaattcaacaaaacctttgaaaatatcacttatttcacatggtatgtacatactacattattttttgtgagctccataaataattatttgcttgcagaatatagtttatagttatgtatatcatttttgcttggaacaacctttatttaggaacgatatatttcacttaggttcaatataaacaaacatgcaactgaaaattgttctagatttttaatgtaaattttaaatttccaaattcaagtgcaatttctgtttgtgggttatgcgcttgaatttttaaaattagtaactgaatcaaaaatattatgcaaaaaattatagctagaaattggacaagttagaacttaaaataaatttgattcaatgtggaattttaattatctcttaaaatacaattttattcagattcatgcactactttatttagtaaaactattcaacatatttttttcttgaaaaaagattatttgggttttaaatgcaccgtggaagttgtgataatttttgaaaatgttttaggttatctattaataaatttctttaattaatgtatatttttcagcgcattatattgccacatcagcagttgtcatccaaaactagtttttatcttgtcaaaggatgaaaattaaaaggtgtgtagagctagccgatgaatagtactacctctgtctcaaaataagtgcaaccgtgggaatccgtgtccaacatttgaccatccgtcttatttgaaaaatttataaaaagaaattaaaaaaatagtcacatataaagtactattcatgctttgtcatctaataacaataaaaatactaatcataaaaaatttcaaataatacgaacggtcaaatgtggaatatgaacaacacaaaactgcacttattttaggacgaagggagtatctactttcaaagttcatgaataggctttaggctttcatggaagttagatgtaaaatataggtttcctaatttgaatagcaaagccttttgaaattcttcaaaatacaaccctttttataacaaatccaaattaagatactaatgaatagttgggccctctttagttcccacacaaaaattttacaccctatcacattgaacgtttgaacacctgaagtattaaatataggctaaaaaaataactaattgcacagattgtgactaatttgcgagatggatcttttaagcctaattgctccatgatttgataatgtggtgttacagtaaatatttgctaatgacggattaattaggcttaataaaatcgtatcgctgtttactaacggattctataattagttttttattagtgctcgaacaccccatgcgacaccctatataatacccgacgtgactcgctaaaactttatacccctggatctaaacacccccttgtaatttaatcatctcctcagattagatttatgatttggtggcgcaagcaaatgcaactgacactgttacctgcattttgaccaggtgcaatgcactaagctgttcgtacccatgtgtatggcgtccatacatatgcatccatgtacaatgcatacatatgcatatttcaataattttacctgctggatcaggtttggcaatgtgatgggcatgtcatatagtaaaaaatacagcaggtccaaatctaattgagatagttgttgcagacatatatgaatatataccttgattatactaattgtttaatatctagatatgtttatgacgaactacgcgattgtttaatagtatttgcttagacgccctttttgtccactaattaatttccttaacttccgtaccgttttcgtccgtacgtgctgtgagtacagtgcacttgattttgggtgattctagaatccaaggttgacacgttcatgcatttatataaatatttttttgcccttgtaatagtgtgctgttctagtagattggttgtctggttgatcttgattgtgtggggatctaatctcaaagccggtcgagatcatgcatgctgagatctactttctctatactaaaattaatcaatctcgtactagatatgacacatttcagtacgatgtatctatccaaatttatcgtcctaggctgtgtcacaggataatttattatacaaggatacgtgacattcggtacgatgttggtttattttggaacgaaagaagtaatagctagatcactacaggtatggcttaaaggatgatcatctagcgttgtttggtttaatactccctccatttcaaaatatacgacatctttaattttgtacataacctttgaccattcatcttatttaaaaattatataaaatttattttttagttgttttatcatcaaataaaatataatattaacttatactttacataattatattatatttttttaataagatgaatggtcaaatattatgtgaaaaatcaacaccgtcatatatttacatatatttaaaaaagaggtagcatttgaaaaattattgtttgactaacttaactgcaaactaattaactggatattatggtggaataccgtgcacatgaccactacgtgtctacggccggtatatataggaaaaagtatgaataacctctctcgaactatcgtggtcgaccgaattaccccccgaaccacaaaaccgaacatccttcacccccaactatacaaaccggacaaataaccccctggctcaaataacggcggtgttgatcctacgtggcagtccagtcagcaattcattaataaaaaaataggtggccccacctgttagtttcttactatctctctactctctctctttcccaatctctcagtctctctctttcccaatctcttgcggcgacggaggaggcgagcccggtagcggaggaggctgcaacagcgggggatggtatctctctctttctctcgagcgcaaggccacagagcagtgcggggaccgagggcggcgacgcgaggacggtgggtggcgggcggcagcgcgtggaggtgcagcggcggtcggcatgcacggtggcgcgcgggaaggtggaggagagagggggaatggaggtggatggggaaaatgaggaga

SEQ ID NO: 106849 - DNA, 1072 bp, Oryza sativa
aacaaaaattcctaaattgcatatagggaatggaataaagaagctgttggtggtgctctaacatttttttttaaccaattatgaccctccactatttaatttcccatctactttcacttatcatctaatcataacatgctctctcatttaattatacctacttttcataataacatgttcatcctaaaattttttatattttaaaacaagggtagtagtatattacaactgaattgattaggttccatgatctaaccgtttgcgtttggtatttgatttggtatttgtacggttaaaaaaatactccccgttctattttaagtgcagcaataagtttccgtgttcaactttaatagttcgtcttaattattttttttttaaaaaaaaaaatataagctattcatatttcatcatctaataacaataaaaatactaatcataaaaaaatttaaatttaaataaaatagacgatcaaagttgaacacaaaactttatggctccacttataatgggacggatggagtatactgcttcggacaaacaactcgatcggtctagctacgtacgtataaaaggccctgtattttctagacgggcaataaaagtatttaacgaactcaccacgcatctcgccgaccagtctctcgtgatcgatgctgacttgatattgtccacttgtggttaattagataattaaaccagttgattgtacatggttgtggccgtacaaagaagtacggcaactgatctaatccagataagttctttctcaaggaaaatgtataataaaattgtcgtttctggcgctgaattttctgatagtgcaaaccatgtgctagctagctgttacgctgccgttgaacatgttagttatatcttgtatcgaggagaaaaatattactctctaaattaattaatcacagagctaatcacaacaaaaattgagtaggcgacttattaacatgctcacatctgcacgcccattccggccccaaccggccgttaaatgctaaatgttcgtcatgacagttcgagcgtctaagaggtatatagaatcgaagccaggtcttca

SEQ ID NO: 106850 - DNA, 1989 bp, Oryza sativa
cacagtgcttggtccctccttagccttcgccggtacgagcgcgagaagactcgtagccgccggcgcaaccagggactaagagagatagagggagggaagaggggaaagagagagtaaagagaatatgccaaacgggtcccatgattcttttttgaaaaaaaatactgactagactgcctcgtaggatgaaaaccacgtcggattgatgcaggtgagttatttgtctcgtttgaataattgaggatatgtaatgtctggtatttaagtttagggggtaatcgatcggccgtaatagtttatggggtaagtcacactttttttcttattatttttataaatttgaacgtaaatgtctagatccttaattagaagtatttatatttgaaaatgaaagatattccaaatatagacccctaaagggatttattgaacaaattgggggaaaagctcaatgccaaagtccttggcgtcggggtcaaatgtttcaacactaaccttgttggtgttgagcctcagcgctagttataatcggaaaagctagctcatgcgtgcgttggcggcgcacatttttttcgaaagagttagcgtaactaatggtattagtttagataatgacagtaattaaggtaagattttcccttttcttgaaggtttttttactagcagattgaaaagaaatttgtacgtgaaagaaatttctaaactcaatttttttagatattcaacacgaaatttgaactttcaagttaaatttgaaatctttcgactcaagatttaaactttgaagtcaaattttgaaaacttttcaactcaaactttgaaaactatcaactcaaaatttaaatttgtaatttttttttgaaaaatttgaactcagatttaaaagttttcgacttagatttgaaaacattcggctcgagatttgaaaactttcaactcaaaattttaaaacttacaactctagatttaaaacattcttcagatttgaaaactttttgactcaaatattttgaaaacacgtgcactaactattaaaaaaaggggaaaaaaggggaaaacacgtgagtggaggggttgcgcaaaaagcaaaacagaaggcgaaaaaaagaaaacatgaaaaagatggcaaaaaaaaagagagaaaacgagtgggggcgccagctagcgcacgccaaatagcaacacccagttttaattgcgttgacatccttcattcgacttcccggctgtcttaataagaaaacaaattataggaatataaaccggaagatgttagtttatcaaatgtctcacctttgttgacagcaaatcactagaatttaggggtgggggaggagggacccacgtcctccttccaaattatgttttctttctaaataaaaaccaattggtgaaaacgaattaaaaattgataacaaatcgataagattaagagaaaccagactgactagcaccgaagtttgagttttgatgctagtttatttggctctgagatattcaacctcgacattgatctgggtatacatatgtaataaggttttgattgttttttataaaatatgtttcctgaatgacttaaatgtgaaaaatccagtaggcaccgttaaaaaaaaaaagaagcagcagcagcagcaaggcaccctataaataaataatcggttcccgcacatttcaaaactacaaaagattactatggttacttactagttttatggcattgggcattatataggttaactcctcttttaatttgtctcaaacagtgatatgtacatacgctgatcgtttgcttgttggcttccaattagccaaagttgaaattcttaaacttaattttgagttattctagatgttgttggcttttaagccgtagtcaaaatttaaattcctaaacataagtttaagttattcttgatattaatttcactggtagagaaaccatctttggtcgggtcgccaaaatacacaatagtcccggttgcaataaaa

SEQ ID NO: 106851 - DNA, 3505 bp, Oryza sativa
caaccccgaggtgctgaacgcgctgaacgggcgacggacgaggccgcggcggaggtgccggcggaggacgcgcggcagagcggcgtcgagggaaagatcacggaggccatggcggcggggaggcggcggttctggcgggacgccgccaacgtcgaggcgctcggggaggcggaactgccggtgttcgaaagggcgctccataagctcaggggcgccgtcgtgcgccgccgccgccgcctcgccgcagcaagaagaagctcctgaattagacattacaccgtgaatgcttgttaattaggtgccactgattaatcaattgcaaacgggtttagggctgccatttaatttgctccgtttttgtttagagatcgagcagctgcaataatgttaaacttaagcatgatggtatgttaagagcttttaattatgcgacggaagaaatgcctttcttgcttgatgctgtcaataatgttttgatcacaagaaattattaatgcatttgtgcgtctacttgttacataaaaatctacttggtacgtaaaaactagatgataccttgcacgttgccacagtataatttgtaatatacatttgtatgtcattgcaaataataccttggggaacattatatataacgattgaattattcaaaatgaaacctcagcaagtttttactgaaaagagaattcaagcaattgtaaaatacaacctgcaaattgtcatagcttatgaatctagttatttagtagtagcagatagtagctttagttatctatactaatataaaaagcatgagttcatcgaatacctatctttcctgacccttagatctattcatccaacggcttatatcaaaagttgaatcaacctatgcaattagccatccccacgttcgattagcagcagttatagcgatacagcgatcgatcacgagaaagaagcggaaaagaaaaaaaaaaacttctcttccgtgccttagcccgtcgccgcctcctggagccgctcgccgcctcctcgcacgcgcccgccggaccgccgggcaccgccgccagctccgagcgcacacccgccggagccgcccccctaccccgccaccacctcgcgcgcgcccgacgctcgccctaccccgccgctgccgcctcctcgcggccgccggtgagccgggttcaccgtcggctggcgccttctccaccaccgccgctgcctcctcgcacgcggcctctggagttctggggtcaccgtcggccggctcctcctcgcgtgcgcccgccggggagctgtggtgggttacggcactacgcagtacagactccaggttaaggtgatgtcctctcttcctaaatcctcaaacaacaaagattttgtgcttttattattttggggtcataaaattgtttacataaggtttgggcagggttgcttatgatacggggccccaaatgtttagtcaattggttctctcgtctcgctatgttatttgctcttgtttaggagataattttacttgctatgaattctgcttgctaagcatctcacaagtatcatatcagtcatgcttcctcaggaaatgtctaaaaacatggtggactgccgatcacacaaatttattctacaaagcaattatcagttaatacctaaggacttggctgactgccgattaccgattatagtgtaaacggtaagcatcagttgtggcagtgcacataattgaataaacaaaatgcccaatgcccctaattaatctgaaagcaatccatcagtttaataaattaagttgtgggatgcaggttgcaattagtgtttggccgtcaggcatctggcattaattagcattcggccatcaggcgtcttgcattctgtctgcttgctttgcctatttgattgggttggatcaggggtccaatgtgatttggtctgggggtcccacactaaaattatacatagcctataggttccacaatatcgttaaccaaagcactcgcccttcccatattcaagtggatccccattgatctaggttggcaaatcttactacactatttcgttacctcgtaagtactaagttcttttatggaacatattttcagatttaattccaatgataggcttgaagatattatgcagttttttacttattggagttgatgtgatggagctaacatcagctggaagtcaccttgaaaatggcacattttgtgtcttgcccattaactgtcaagtatggcacaattattagtgtgttttcccctttctgcggtgcagggagacgcatattacatatgtatccctctattctctggatcaaagagtgcagaggtccttcaattgcattctacggggatagggttcataattgaattgtttagtgatgtttgcaatctcacaaactcaaatgtcgttagcctctcttgaagacaagaaccattagtctcataaattatcaggtttggattttagcagttttaggttagattataattccagattaaagtgaaaatgatgaaagttatacattaaagattttgagtgaaaatattaccagattttttttctccaatggaatgttaattgttaagtgcaatatatattcttaattaaagttgtgtgcatagatgacctgccaacaatactatcccgtattgttcagtccattgatgattgaactggatgtcaactccatgtcctcattgtcttgataggcacagggaggcaacaatccaatccaggagagatgggataggatcccagctcaagggagccctggtggcagctacggttgggaggacctaagccctacaggcaagctctataatcaacccccttttgcttaccggcttccagtgatgcaggtactgatcccctcctccagtgatgtaggtactgatcccctcctccctccctctccctccctctttatcacgacattagctgattgatcaccagctttttattccgattgctccagtgaactttgttcacaaaatagtgtttttttcattttctgatgcttgtgtctatcgtgtgactcctccgccgacatgtacattgatatctgcccaactgattgatgaaatgatcgtttacattttttttgttcagtcaatagtttctgatcagcttggagtggtctgtgccatgttgctgtgataatgctacaggttaatcctcctggctctctgtacttaaacaatttctctggatctctttcccttttgttttggacgttatacaatctgttggctaataatggcattcatgaataatagatcatgttaaagctgtttgcatggtctgctgttgtcaaatagttttatgcagtcacaactcttattaaatgatcaggttgacttcaagcattgggctaaaaactaagaatatgtaagttaaataacatatatgccatcatcttcaatttaagtgatattgtgtcaatcttctgatcaactgttcacatcttcggattatatagattcatgtcacctgtgtatgtcttcggaattatcta

SEQ ID NO: 106852 - DNA, 668 bp, Oryza sativa
gactccggcttcttaaactttggtgggtgtgttggcgatgagatgcaatgccctttgcctctccctaagggtcccttttatactagaaaatacctcaactctcaagcaatacttagaaatatataaaccaacaccatatattagatattttaccttttccaaataaaacttcaacaattccttaacttcataaaagaatattccttaacttaaaacaaattcctaacaacctataccaaaaccatccacatatataaaaatataccttatccatatattccataactcatcaaaataaaaaatataccttatccctaaccctaacacatcccaattccaacacacaacaaatcatctaaagttcccatcaaataacacttcaccttcaattaccattaagaattccaacagaaaatttcaattcccaaactaaaaaataaatactcaaattatatttttattatcaaaattcacaattaaactcttaaaatttaaaatattaaaaattaatttattttttcactaattataaataatttttttaaaaataaatccaaccatataattattttcacacttattttacttttaaattaatttaattatacacctaccaacttaaaaaaatccaactttttaaaaaaatttgtatttcaattaattacata

SEQ ID NO: 106853 - DNA, 690 bp, Oryza sativa
tttctttccttgcctatccaagtcttctcgctttcattgtccatcaagccttctcataccaactcttttaccaaatcaaagtaaatttaccattccaactgacctagcatatttaatatatacttatgcccttacaacatcgtacctcctataaaaacgaatctccacatttatcctcgatccattcaagaacttctttcactcgtgaccttaattagttatatagagttgggtgggtgggaaacgaaaacctcctataaaaacgaatctccacattatcgtcgatccattctagaacttctttcactcgtgaccttaattagttatatagagttgggtgggaaacgaaatggtcttcaatgacatatccttaaactcaacatgtgtaccaacgtaaggtttcatcactctaccaccatagtaaacatgaacaattctatccatctacaccaaagaataaaatgtggctttacaactaaaattacatcttccttcctaaacgtagttcaaactaacatattataaccaatgcataacttagattgtcccaaagctactacttcacgaaaaatatttaatccacatccaaaagtaccaacaactttactagtgcattaaacatcaaaatattacaaatactccatcatacaacccaacttagttctaattaactttaataaatttctataa

SEQ ID NO: 106854 - DNA, 567 bp, Oryza sativa
catgggcgactgcctccagatgtacgacaacatgaaatccaacctgaactcggcggcctcggcgctcaagaagggggacaagaacacggcgcacaccatgctagactccgcgcgcactaacgtcgacacctgcgaggacggcttcagcgagcgggaggggctcaatccgatcatgggcgacctcgacaagatcctcgccgagctctccagcaacaccatcgccattgcctccgccataattgagtgactcatctcattttctctctgtctttctccctctgaccgtcttgaacaaacaactgaagtgtatgtagtatgtaccgagtgtttcaaaagctgaaactgcattatgtatctgtaccattatgattgattattatgacttgtgaaattgtgaattgtgattatgacatccatccccttttttaatcttgggattcttggttaatcagattagttaacttgtcaatggggaggaatttcctataggcgccaacattaatcagcaaacaaagtttcacacacacacacaaattttgttcagaatttgtttctttcaacagggga

SEQ ID NO: 106855 - DNA, 913 bp, Oryza sativa
tggggtgaaatcaatatatttaaaaataatgaagaaaataaaataatgaagaggaaccggaaagagcaaccggattagcctctttagtcccggttggtaacaccaaccgggactaaaaatggatttttactcccggtttttttacccgggactaaagatagcgatctttagtcccggattcgaagtcccggttcgaaaaccgggactataggggggttacgaaccggtagtaataaccctttctccaccagtgtgaaaagaataaataattatttaaattttttaaataagacgaatggtcaaatacgtactaaaaagtcaacgatgtcaaacatttttaaacagagggagtacaagctagccgtcatgcccttaatttgggctatagctagaatatttgcttacatttatgcgcgttgttgcatttgtaagtgtagtgtgttcttcgtccccaccctctcgttgattggagcagttgtttttttttcttttaccgagttgtagcctttgttttttcgttttttcttctcaccctttggcataggcttatatggcggattgtgttgtgtaaaaaaaaacccttttccttctaatatattgacgtgcaattattctgtgcattcgcgaaaagcattgtaaccttatactatatccatgcaaccacaatataagatgtaaaacatttctattatctaaaaagttttgagtctttttatttatctttctccgactcactcattgattgtgtgtagggctgtcaacgagccgagctcgagcgagctcgtctgcctaggcttgagctcggctaccgagcttgaatcttaagtaaaacaatatatatttcaaagataatctttaaaaaaataattaatttctagttcatcatattaatagaagaggaaaaaagaataaa

SEQ ID NO: 106856 - DNA, 513 bp, Oryza sativa
tttggctttagcttattcattttaggactaccgatggaactctatcatgtaccatactaccatgcaacatgaatggagatttggtcgacggaagagaatcttgcaaagataatcagacataattcagcgatgcaggaagactgaaactggaataacaattgcaagtcgatggatatgaacagcccaacgggctacaggaacttaacaacagtggtaaaagacaaggtcaatccaacatggtaaactcatcagttctgctcatagccagcgacataaccaacatcatccttctttcactttttacattcagaaaaacctccagatccttaactaacaactgaaagatcccacttaagttctaacccaacaagcattggaaacagtacgcgatattagccaccatatgagtctgactaccacaactgatactgcagcgaggaatttctggtgctaattaagcggaactttgaggaattccacctcatagatcgcacctgatctacgcgctttgcc

SEQ ID NO: 106857 - DNA, 538 bp, Oryza sativa
tttgattcatagcataggaaaaaaagcggtaccaacaaatagcacaagaatttttcgctttcgatcaaaagcacaggccaccgttttttcttcgccccatagcacttccgtcaggtttggagctaacagagttaggttgaagtatataaaaattttgttggacccatttgtccttcgtcttcctcgctgtaatctcccatcctgtgtcatctcgtcctctcgggttagtgcccacgacgacggcgtcggcaccgtcgccaatcagtgacgcagcgacgatccccgtccccaggcgcgccaccgccgtccccatccccaaccgcactgccaagccgaaccacacatcttcaccattctctgtccctgccggctcccgtggcgatgactgcagcagctgtaggagccctagctggtttccatcgggccctaccaccgcggccgagacgagctccgtgccacaaagcaacacaagtggcgcttcctccgccgtttcctccagcgagcaccaaccgtcccgctctcttacttcgtggacgcg

SEQ ID NO: 106858 - DNA, 665 bp, Oryza sativa
tgttacacaacgcaatgcaaccgcccaggcgggcaagcccgaggcaaaggaacaagagaattgaaaaaaccaaagactgctagtgtaaagagagcgttgctcctgtatagaggagaagttttccggtatttgcattccagaaatagtaaaaatccaacgctccataataaaaggtatcatacaaaaagtatttaagtattaatataggtacttaggtagaaagggtaaaatgataatttgctagaagatgaaaaatggtagaattgtctatagtattagttgtaggtacataggtaccgcatcagtagttcatcaccaaatatgcggtaagtcatctccatcgcctctaattttccattatattatttgcattgtatttttttatatttgcatattgtcgtgcccttttcccgtggctgtctctaccagttttaattttttttcttagtagcgacaaaataatgaaaatgtagatgagcctatactatgtaaatcttcgcatgaaactggttatcaatttatcgcttgaattcgatatcttttcacgtgctgacatctggttcgatccatcttttctgactgaaccaaatgcatatagcagaactagatagaaccctcttatctgaatatcagttaattctgcaagagatcaagttacgatcgaa

SEQ ID NO: 106859 - DNA, 533 bp, Oryza sativa
gagctcggtacccgatcaaggagtgcttcaagaagagcagtatatatgggattactcagatgaagcatatttttccttcctagtagatctcatctcatcaatcagaaagcagacagaaatggacgcaactgatcctgttgaaaatccgtgccctgcagtcaagatgagcatttacggattaacttaaggaaataaaggaagtaaattcagctatatgtattgagcttacccacagccggtagaaatgcagtgtaagaatgcgacacagtggaacaaagcaacagtactgcaggaggctagggagtgatttaggaaaggtggtaaggccttacatatattgtatagctgaacattcagactagctagacaactgctgaaccactcttcttttcttttatctttcccatggtactatccctgacaaaattttaagttattggccacatgtctatgctccacaacccaacattttgtgtatattcatcagaagaattggaccggcttagtctctccctggcagtttgatcttgttt

SEQ ID NO: 106860 - DNA, 1179 bp, Oryza sativa
cctttttttttttacttctcaagacttgttgtaatgactatcatttctagtaagagaaatgggggcgctatcgccctaattctaaaaaaaaaatttgtgtatattcatgaaccgtctaggtagctatggctactccttttcttattcatatccccaatcatcactaaatggtaattgatttcctgcacactagcgctgaagcaattgttctagtaacaccatggaaacgcaatggtctttgtcaaaacgttaggtttgttagaatgcaaatggtgaggctcctgagagagtacttaattcctactaatagaccttacagattagtagggaactttgcgttttccttttcgtacttctattagctacactcacatattctagggcactgatcaacagctgcaatagtatattgcaacgattagctggcgcctgggctctggcgatgtgattagtttacagtttatttcgatgtgattaatttagagtttgcttccaagattccatgatgtgaaaccagctgcgtgctttattgccgttacaaaggggtgagcatacacatgcttgagttttgtttcctccgtcacgggctcaatggcatctcatactcattgtttgtcgtcttatccctcgatttgactagtaaacatataccaattcatggcataatgcaaagctctattgcctttacatgcagcataatagtagcattaattacaattaatttacatgtcactccctccatctgtgattgcagctggggttgcagcacacgaagataagtgtcatgccttcctttcccctcgctgtgcctgcatgcaacaacaaaatcattttcagcattcagatttcagtagtttctatgtaattctgaactctgaacaaactgcttggtttggctctgatcgacaatcctgacctggaagaaggcagcttccccgtggctgcatgaagcgcactggacgtacttggtgatgtgattataattagtttacgtgaatattatagtccatggtgttaaagcaggcgcgcactttgattagaaaagaaaaagaaagacgtgcacatgattaagttttgtttcctccatcatggaatcatactactgcacatgctttcagattgatgaccatgtcaaagaaggaacatacctgatctgaaagactgaaaccatagagttca

SEQ ID NO: 106861 - DNA, 554 bp, Oryza sativa
ccaggggaccaggacctagtcgacggcggaggaagtagatggtagaggagatccggcatccggcagcgtggtgagcttaagcgacagcggcgccacgagcccgccggctatggcagcgagacagattcccccgagcggcgatggagacagtggcggacctctccctggagcaacgtgagcgaaggtggatgccgaggccggcgtagaggggatagaccggcgggagtccgcggtggtcagcgtggaggagtcagggacgcggaggatggcgcggcggcaactcggcaggaccggcaagtgtggtggccaggcagtcatcgggcaccggctgacggtctagggacgttgaggtcgaccggcccggggacgtgcgccacacctggggcgaggccgccccgacgtcgcggctggagtccagccatcgccgagttcccgttgatcacatgatcacctttgccaccgcgccgtcaccttgggcagcctccgccgcgccgctccctgtcagcgctgacccgccttcgcggtcatcttcgccaccagcactggggatcgac

SEQ ID NO: 106862 - DNA, 661 bp, Oryza sativa
  unsure (1)..(661): unsure at all n locations
tggcactgaatttcctttacctacttgtctatctcaattcgcaacataactctcaactctgggggtctggtcaagcttaaatagttctgaatcagatgtttccaacagagcaataagactggatgagtctccaaaagtgtttccataactattccatcattgaaaatgaaattaatctgataaaagtgtggaaatatcccaacgatctactatgtggatggagagcatcatttcaaccaacatctatacaagatgttcccctcctttttccggccttgggaccggctatgtcatttactaaacctaggatgacatagccggagttacctacccccctacaataaaaaaaaatttaaaaaagaaacacacacctaataaaacacggcaatgtattttacaagagcttaagaaaatttaaccatttttttggcattttcccattttttgatatttttacttttttaaatttttcatttttttaatttttttaatattttaaagaccagtaactaggtaaagacaaaaatatagattacaggtgacttgcacccaaatccttcaaaattaaccttcaatacanataagcccacacaattaaatcatggatgtatatacatacccaatttggtaattaaataacttaatttaggaaaaagaaaat

SEQ ID NO: 106863 - DNA, 529 bp, Oryza sativa
cacaccaccacgcctggctaatttttgttgtatttttttagtagagacagggtttcaccatgctagccaggatggtcttaatctcctgacctcgtgatctgcccacctctgcatcccaaagtgctgggattacaggtgtgagccaccgcgccttgcctcctgcattccttttttaacttgttggtgttctacatttgattgcatttaaggaagggtttctgctgctcaaacattttgacagctggtggcctagatagtctctcctgctcagtgagtctgaaagctgaccacccgcagcctgcttcgccagctgagaattgggcccaagcacagccaactttgatgagtggagatagatcactcagactatgtgatcaaatcaaaaaaagaatttcgggcttaacaaaatttattgcaatttgtagaattgaaggcagcacatgaatggctaaagaaaaatggtctattccaaatccatattaactactgtgctaccaggtccatgaccggcacgggctgagggaggggg

SEQ ID NO: 106864 - DNA, 588 bp, Oryza sativa
gctatgaaaattaatcaatgcaggcctttgcctctaccagttgtagagcacgtcagcaaaaaagaataacgagaaggtgtacagtcagggtttccaaggctgcaataattcaccctccatgtaatgcgatgaaaagctgatgtatcattaatataaagcggtggtgtccttatgaccccaacaggcaattccacactgtgtcctcttctggttggggagagagaggccaccaaagagaagcacagctggaagagatccatcagggaagagatagggtgtggtaccaagcagggaggggccagggccccatcacagcagctgtgatagagaggtgaccagagtggaccatgaagccagacagcctggcttcatgtcccatctcctccacttactagtgacatgactcagttgtcccacctgtaaaatgggaccaaaaatggtaggataagggtaggaaatgaaaatagctgttgggagaattaaagaagttcagtaagacacatatcaagtgcccaggagatgttagtggccaaccacctgttagaactggaagcattaagacatggtgagtctgtctgagtctgaatt

SEQ ID NO: 106865 - DNA, 704 bp, Oryza sativa
aaataatatatttgatctcataatttattaaataacaacaaaaatcatatattactaagctcgttggaagctcgagctcggctcgacaaagctcacgagcttagagagaggctcgggctcggctcgtcaggagctcgagctgagctcgaatcgagcctaggacgagccgagctcgagcagctcgcgagccttgagctttttttgacagccctaatgtgaatatcagcagcgagcgagctagaagtctagaactgtacattaacgcatatagtttttcatttgctgtcccctttggagagattgaataatgtttaaaacttgctacgacgattaattagccagatatttttcaagtgacttaattacctatgatttttcttacattttagtccttttaaaaaatattttctaaatagatccctaaaaatgtactccaaatatacgctcttcttggcaccacttaccctggctctgaggtccagcatgtcggcacgaatgacgctggtgatgagatgttgaacctcggcacaaataaccttggcgtcgagaaaatgatccaatttcaaaataagtctttttttagaaatctatttataaaataaatttttaaaaagagctaaaatgtagaaactataacttagggcctgtttgttacagctccaactcctaaatttaactccaggagttgggtctggaatagagtt

SEQ ID NO: 106866 - DNA, 1404 bp, Oryza sativa
ttttgtacataaatagcttataaaattattataagcagagacttacagtcagaatttaaaaaatgctatattcaaaatccgacaacatgacatgcatatagtaaaattatataaattggtgtttcatgataaattattcaagtttagtatagtcacactaaatctgtacacacctattcaaatatataaaacaaatcaaatttgctaaaacatatgtatcacacatgttggataattggaatatgagaggagaacaaagaggtaggtggtggccaaaagtccacatattatattctcagcgcattttattgtaactcctattattattttttatcatatgctccactttttaattaaaatatttataaaactaaaagcattacattcagatcttatactttttaattactttacactattagctgaactaatagcattacacacacactatgcttcatagtaattttttttccaaaacgtcttaacgctttacaactttttacaataaattatattttcgctttttcaataaattatattttcatatacataacatataataggatgtttagagccgcgcgaatgtgcgactacgtaacctagttttcaagtgataggtccttgatcaggaaaaaaacgaaaatagtttcttgccgtgcaccgcgagggcccacctgggggcagagagcccactgcccacagcatggcttgcaacttgcaagcagcagcacctagatcgaggcccaagaggcccatgctcgcttgctgacttaaatacgcaccggcagacgtctaaaaaagggaataccgtatcagaagtggcttgacgggagaaaaattgtataaataaggtgagtatcgaatcacctttagtttttataataggtaaagatagtttttataatagaaaatttctacaactttatttcataggattcatagggctcttttgattcataggattgacaaagaattttcatattattcaaattcctatgaattttttttgctatatgtccctcttattcataggagagaaaggaaacttttgcttcacgtttcttaggaaaatagcaagaggtgtgatctcttggtgaacttttctttattttccccatggcagtatcaaagaactcctattgtctttcatgtatttgttgatttctgtaggatttgaggaacataatacttcaaattctgcgtttttcatatcctgcaagacatataaaaaggaatgaagtacatgtgacatagtaaacctttactttttccattccttttatttagaaatcatgcgaaccgaataagccctaaagaaaaatacatttttaagcatttagagagcaagctgtatgtacagtgatactcgataccctatcaaaataagaattttgtcattttaat

SEQ ID NO: 106867 - DNA, 3791 bp, Oryza sativa
tttaatagatgacatcattaccttttggacacacgtttcaccattcatcttactcaaaaattttgtatatataacatacaaatcatgcttaaagtacttttagtgataaaacaacttgcaacaaagtaaatgataataacttatatcttttgaataagataaatggtaaaactggtgtctaaaatgccatctattaaaaacggatgtagtatgccatattgcaacgaatccaggtttgaatttttttattactatttatcaattgaaatgcgctcttatgtttaggccaatgtttatgcctaatcctctgaagatgagacatgaaaaggttataaaaaacgatcctagctatttcgcaggtgagattggacgtgtcaaatagtcataataaagaacaaattggctgggagaacgacaataccatccatagattttttttctctaattaattaacatctgacaattaattacctttcggtgttggattattcataaaaataccatcatcgtgcatgtaaaaacaaaaacaatcaaacaaactctggtccaaaggtgtgtccacatggctcatgcagaagcaaagaaggcgaaatatctgatttgtcatttttataaccgtccaaacgcaaaggatccgaatccatgccgtcagtcctctttcaaacacgtattatattgggccaattgcttatttgaccctgttttaaaagctaactaccaatttgaccctatttttttcagtttgcttatttgaccctgcttttcaaaatcgaagaggaaagctgaccctattccattaagacaagttaacaccgttaactaaggggtaaaatgatgaaaatgcccctaatacatccatctatcctctaccactcattcttatgtactctctctctctctccagagcactgcggagaagcggcggctcagcggcgcgacgcgaaagagcggcggcagctcggcgaccaggcgctggtggcggaggagcggcgactgcggaggagcggcggctcggcgacgaggagggcggcgggaggagcggcggctcgacggcgcgacgcggagggccaccgctggcggcggatgcggagggctgcggaggaacggcggtggctcggcgacaaggcggccctccgctggcggtggctgcgaaggagcggtagctcggcgacgaggaatacgaccggcgacgaggcggccctccgctggcggcggaggagcggcggctcggcgacgaggaaaacgaccgacgacggcggcgccggcacggattcccccacggctgccaccgccgtttcctccgctcctccctccgtgagccagctctgccgccacagcacctcgcggtcgccgccacacctcgcggtcactggcgctctccctccacaagccatcgccgccgcacctcgcggtttccgccgctctccctccacgagtcgctgccgccgccagcactcagagagagagagagagagacggaatacggggagagacgtagatatggatagggtttggtcaagggtattttggtcattacaaaaaataattgcatttctttcttttttaaaaaatgaaaacttaacagtgttaaaaaacagggccaaacggagggttcgttttaaaaaagtagggtcaaataagcaaattagaaaaagtagggtcatattgatagttaagcttcgaaacagggtcaaataagcaaatgccctatcatgttatatactcggaattaatgtgcggcatccgacctccagtacgtcttcggaggagcaaggcgtaatagctgtatgaactggatcaagaggctcttctactttcgaagggtgcgatcgtttcagctttttaggattagattctcctcgttttctgtttgcacgttttttaaactatattaaacggtatatttcgtgcaaaaactttctataaagaagttgttaaaaaaatccaacaaatttattcataaaaaaattatatattaatacttaattaatcatatgctaatcgtatttctcgttttacgtgcggctaaacagtccactgccaccgctgaaacgatcgcaccctatgtcacgtaactttattacagatatgtgtggtaaatcctgaacccatatatcaatgataaaaatacattgactttgaatggagacgatctcaattcgtttgtgctaatgttttttccaatgatttttctatacgattgtttgacgtgtatatatacgacagcggaacatatcgacttatgtcgatttccttgttactgtaaaacaaattaagtaaaaggtccaaaatatatgacgtttaacgattttttgttagttacatatcaaaatgcgtatatggtccttaattaaaatactgcatgttaagccagtaactttttgttttttagaggagagaaaaaaatagagccaaccttatagtcaacctattatatatgcaagttctaatataagctaatatccctagttagttctactattaaacttactagatcacttggagttaagattatcttgttctccatgaaaaatcttgcgaattaaaagggaacggagagagagagtacacgaaaattcaaaatggaacccaaccacacatgaccaaacacaatgacaagaacagatcaatacaatcatggtgagatcgatttgattatgttgttagtgtgatcagaagagcaattaaagcaaggcaacagatggcttcatctctgcttcagctttttcccaacagatggcacacacaaataataacacgtacaattcacaatactgtagtctgtggacgcatcggtggctagctcgtatcaccaatcattgcataatactagtcatggaattatctcctaatgatcgaggttatcattgaacatcacttaattgtgttctcgtcgttaattttctttccctaaattactgagcatctctagctagctgatgttgattccaaaagtaaaccttcttctttagtttacctttcgagcgtcgcaatggcctcttgatcagagcacttgacaaaacaccagataaacatatatactccctataagaaggtatattaaacacagatccagataaagtgttaaacatcaagataaatggtccgtaaaatacagattgagcctatatcagttttcttacattttcagataaaatttcaagaaggttcttgacgctagagttttgcaatcttgattgcacacatgaccaaaacaacgtgtatttgactattagtgactgcgtaagacttgtcgtgttcgctattgatttttcaactatctggtcaacaaatgccttgttactatgccggtgtttagtttacttcaaacttcaaaaaattctatcacatcaaatgtttagatatatgtatagagtattaaatgtgaaaaaaaaaaaccagttgcacgatttgcatgtaaattgcgagacgaatcttttaagcccaattacgccatgatttgacaatgtgatgctacagtaaacaattgctaatgataaattaattaggcttaataaattcatcttgcagtttacaggcggaatctgtaatttgttttgttattattctatgtttaatactttaaatgtatgtccgtatacttaaaaaaaaattgatacgcgaactaaacacggtctatatgaaatttcaaaatggaaccctgtcgaaacatgaattcggcaataataaaaggggtagcgcacgagacctaaaagtggatggatgcggagacaaggatttagacaggttcaggccctctcaatgagaggtaataccctacttcctgtttg

SEQ ID NO: 106868 - DNA, 3571 bp, Oryza sativa
ccaatacccaaatcatccggtctacgagtatcactcgtcgacagctgtaatatgcttgactcgggaggagcgcccgtaatcagtgccccaagaatgtaggctaaacctcgtaaacaaatatcgtgtcttagtgtcgtcttcatgtttagatctcttatggcgtttcttccgcgtttggtttttggtgtgctatcaaggcctgttttataactttttttttgaaaaaaaaagtccaaactaccccccatttaagtaccaaacattttatacctcaaactgtttaaaccgaataaactacctcataagcattgttttaggggtagttttgggaacatggattttaatctctcgggtggacatccacccgttttttccatgtcaactaaatggttatgaaatttttttcaaaaaaatacaagatagattaatatgtaatatatcacttcaaaaacatgcaagttcaaatttgacttatacaatttgtaacaaaattaacaaattaaactctaaatagtacatgtatattcacagtctaatttgctatttttgttacaacttgtagagctcgaaattgaacttgcatttttgtgaagtgatatattacatattaacctatcttatcatttttttttaaaaaaattcatagttatttaggtgacatgcaagaaacggaacactaaggtggcaatccaattaaataaataataaggtcccacctgtcatctctcttctctttcctctctctctagctgccttctcccatttcctttctctctcaacccaagctctacagcctcttcacccgaagtttgtcgatgcatgcagcatagaggcatatagaacagtctttattagtggtctctctattgctatgcaagtaaaggaggcaagagaaatatggttgttatgcatgacaacgccttacagtcaactcttagcttttattagagtaaattttgttgcatggtggtgaaagaaaggaaagaaaagtaagaaaaaaaaatattttgatacattaatggtagagagcatattgtctccaactgttatatagaacgttagtatctatatagcgtagagttcatgtatatctaagtttgtacatgcccggcgcgcggagctagccggggcttgcgcggagatgcccaccgaggctggggagctggataatcttgtgcagagacggccacaacggtcggtggagctagagcattaatttgtatacaacatatcagggataactttctgtatacaaataggtacatgatatttccggtggaggcaagtacaagtataggtacaagtacaagtacaaaaatatataagtataagtacaagtatagggtttagggtgtacttgtacttatatttgtatatttttgtatacttatatttttatacttgtatttttatatataacactgacaaaaatattgtttggcaagttataccgaccatagtatttagggactaacgtacggctgataccatggtatacgcgagtatgaaataaagaaagcatgtacaagaaatctattgatttattaaagtaacaaaataacgaaggatccgcattcgctctcacggcctagaaattctcatattaattggagaaaaagaaaaggtgagtttatatagaaatacaatttagaagtaactgaaattcaaaattaaaaagatgagaacattaaaagtagaggttagagtacatgtagaaatacaatataaaactagcggaaattcggaattaaaaaataaggaatattggaagaggaaaatagagtccatatatgaattcggaactaaaaataaaaaaactaaaagtggatgttaaagttcatatagaaatacaatttagaaataactaaaatttaaattaaaagaataaggaatactagaagaagagtctgagtccatatagaagtccatatataatataatttagaaataattgaaatttggaattagaaaaataaggagtattgaaagaatataaatacaatttagaaataatggaaattcaaaatttttaaaaaaagaaatattgaaataagaaatattggaagaagagtctagagtctatataggaatacaacttagactgataattgaaatctctacctctactattaaaaaaataaaattgaagatggttccgccataattttagtacgtcatccgtgttttaatcagcttcaattttatctttctgtcgaatcctttcttttttttccttacaccagagggtccctcttatctaagaagtacacgaattaattgtgcccacactgtttcacgcgccccttacccttaccgcaagtagcaaatcgggcctgcgcaggagtccgctttccacaaacgcctttacgtgccgctgcgattgggctcacaacgccctcgcacgtgtgattttccgcatgcccgattggatccgcgacgccctcgtgcctgtgatttgcgcttgccgcatctccgattgggattgcgtggctctcgcccacgatttaaaaattgaagatgtttttgtgaaaactatggtacgtcgtccatattcgattcccgtcacacttaacattcattgtgaagttacaacttgcatgtggactgcgaaacagagtccatgtgatgtggattccaagcgaataaatctcgcagagtccgtgtcgatatcacgtacgtcgctgcgtagatcatgttagcatgatttcaaatcagtctccatacatgctcgtatgtactactagagataccgttacaataatccgtaagaatcagttttactttcagaaaaaaaaacatgccacccggaataaaggatgatcaaagttgttgattccgtccgtcatcaattcctaccagacttgataaagctagatgaccaatccagctcaagtttgaaggcctcattgtttggcttatgccttttcctataagccaaattttaaattttagaattaattttgaattcaactttttggttttttatcgtactttattttacagcatttgcttttgagtcgctaagaacatgtatataaaagatttgcaattaaatagtcttttatttggtaataagtggttcggataagcacatgaataaacaaaataatgggttgtgactatttacccaccgacacatatgtacaaattaaattggctctacccattgcaacgcacagactccttttctagttatatttaaaaataaagaatattaaaagataagtttggagtccatatagaaatacaattagataacataaattcataattaaaaaataaggaatattggaagaagtgtctagagtctatatatgaatttaaaactaattggaagtcaaaattttttaaaaaaacaagaaaactgaaagtagagtttagagtccatatagaaataaaatttagaaataaattaaagtcgaaattaataaaaataaggaagattaggagaagagtatagattctatatatgaatacaatttaaaataactaaaatacaaaattaaaaattaaggaatattggaagaagagtcgaataaaatttagaaataagcaattaaaaaaataaaaa

SEQ ID NO: 106869 - DNA, 853 bp, Oryza sativa
tcgcaagccagacaaagagtggcagccggtgaaggggatatggtggatggagatggctgctggggagtgtggcggtggtgagtgccaccactacgaggccacgaagtctcaggcgagttagtgataggaaaagccaagccagaggtgacgaccagccctcaagcgactgctggtattttctacactcacaaataaatcggtaagcgcaaggatatcgctatagcatttcccccatgagtattatcaagggtatcatatttatatttccgcagggaaggcgacagtctgctttaatcaatatataattaattcaccatagtctaaacaggggttaaaataacactccctccatcccaaataaacaagtctaagattgtatgggatgttttctagtacaacaaatttggacagaagcttgtccagattcgttttactaggaaatttctcatccagtactaggttggttttttgtgggacaaagggagtaattgatgaggtagtagacatacacgagattcacctctataagaatatccagtagaaaatagcctaaggaaactacgaatcatctatacttctattctaatcttgtctagaataaacttaacatatacatgcttacaacctaggcacctaggtattatcaagagaccactccctgctagcatggttatggtatttacgcactcttacgtcatacccgaacgtgaaggaatacaaaggacggatagggctgtcaccacctgctgcctacctcatttttcactagagcacacccacatccaatgacatttatctagcctaagcaccatgcttatgcaataaataatatcactgactccctcgggactct

SEQ ID NO: 106870 - DNA, 836 bp, Oryza sativa
actttagtctataattcctgcatctaagttaattctccaatcataatacaactacattattttattattgatatacgtgtaagaaatgctaattttccctttatttatgcaagttggtggtcaaaattggtacttagcgaccgtcaacaacacccccaagtaaagataaaatttagaatgttgatcaggagttgctaccaatattttatttcacaatagtactatgtctacaacatatccttctacttagaatttgaataagttggcaataatagttttacatttattaccttagtcctcatggggcttgtagcttctccttgccttgggtagttgcggaacagaatggatcattgagcaccaatcactctctaactttcattctgctggttttcaaaaatttttacaattaaaacaaagttcatcaaatgatactctcggtcactcagggcatagtgttgcatcttttattattctacctctaaaaggtttatatgtggagctcatggtaggggtaaaatatatatagtaaagtaaatttgtttggtgctccatggtgcccgggtaccatgattgaaattgagtatatacccaattcaaatgagtatgaaacttttttaaatgtttaggtattaacattaactactttactaacgagttcaaaccaagtttgaactgaatttggacttgtttttgttagattttggttctaggtatatagcatccaaacatataattagttagttatgtaatcatggatttgtgaaataaagttaaatttgagatgttttgttgataggtataggtatgaatcgaattcttataactaggtatat

SEQ ID NO: 106871 - DNA, 847 bp, Oryza sativa
aaagaagccgatcgatcgaggcattctgatagctattccaacatcgtcgtggcatgctgcatagagaaacacccaggagtcttccgtctaactttgggctagacgaactaggtttgaaacctcaccccttctaattatttgatattagtttctttcctaatattcgtgttttttttatgctacatgcatgtaggtagttccaggctttccaaagttgctgttagttagatcgatcaatataatgcaactttaattagtttgttgccttttattcttctcctccggtctcctcctttttccgtgcatttgcgtgtgtcttaatcaaatccttcgataggtcacgctaaatctagacgcatcctttttatgtctaaaatcaaaattaattagaagttggtttttataagatgaagggttatgtaatgtgcacggcctactcctacttgataagccgtgtggcaaatggtcaaattgataataattggtaggaattatcaatctgatgacgcgcagatgtttttgatgcttgattaggaaaagtttgattaaacttgtcaaattttggccatcaattttatattagagtatatgcataaatataatatatttgtgatactatgatgattcttttcaagccaaatatatatatatatattctttaaaaacaacttaaaatgtgagaaataagtgatggtcataatttcaaaagtttaattaaatcataaatatctataaccagaagagcatgcactaatatatatatttggcgatcgaaattaaatggagctgatgcatgatacattgagacgtgccggccaactcgatcgattattgcatcatatattat

SEQ ID NO: 106872 - DNA, 1519 bp, Oryza sativa
gcgcccggtccacgcgggggcgatcgcgccacgtggaagatcgaacggctcgggtggcgcgtcctccacgtggcagtattttactgggcggcgcggcgagcttgacgtggagcgagagcgagggggtggtctctgccgtccgatgcggggaacttggggttcggagggctgggatcccgtgcgtgcctgaagggccgaacacgtggcgggatatgattggtgcgtggccggaacatcgacgtcgatgaggctctggatgtgctacaaagttcggtgcgggcgtgcttagtggatgaagtaattagctcaaggtggggccagaaagtataacgtgcgggtccgggccccacctgtcagtcaacggctgttgacctatgactggtcagcccgtgctttggacgctattttctcgctgggcttttcacattgttgggcctcacaagcttcgaaactcaggactaaatggacagtgaagtgtactatgcatctgcagttctgcacagcaatcaaaagacgtaactacacagctaatggtaactggtttgtctaccacttcatctataagaggcatcatccacctatacttcaaatacaattttcttttaaactactcatccgatctacgatccgattacaccgttgtgttcgtaacaattaaatctttacaacaatatctcacataattatattttgatgaaaaatcgcaaattacttttatgatatgtctaaattacttttagatttcactaagttacttcctagatacataaaagtaaattcaataaaacctaaaagtaagttacatatattatagaagtaacttagaacaaaacgaaggtaactttagcatgtcatttaaagtaaatccgttgtagagataaaatcatgactatatctagaaattaaattaaccagcacaaattatggaattaactaaaataataataaaagtaatcacctcatagcattatgaatgcataggaagtattttaatcaaatataaaagtaactatatataattaaagggactttcttttttataagttatttatacaatatatatgtaaattagttttaggctttactgaatttacttttatatgtataagaagtaacttagtgaaatctaaaagtaatttagacatatcataaaagtaatttgtgatttttcatcaaaatataatcatgtgagatcttgttgtaaagatttaattattacgaacacaacggtgtaatcggattgtaaatcggatgagtaatttaagagaaaattttatttgaagcatagatgatagggatatttccactacttgctcaatggattaatagcaacaaaaacttctaaagtactagcacgtgggtgtctctggttaagaataattggagaggcctctccaattagatttaccgcaatcaaaagcctgaagattgtgatgaaaagttcataagaaatagttccagtaaatgcaacaagcttttgagtatagaactgctacccatttggacacatgaattttgt

SEQ ID NO: 106873 - DNA, 584 bp, Oryza sativa
agctcggtaccccacatcgcattaacaaatatatttcaagccatgggatccttcctctgtatcttgttctaactagacccctttgagaattgaatccgtgttcggttgttgaaactatagctgaacagttgatctgatgctgatcaggtttgtcgcgtttgcagtacataaatggccggtgcactagcaaccgaacatataaggccgattactatattcgcactgatggatttgacctaaaccatactccaacacgcgtgcattgcattgcatatattgcatatatctactggtgatttgatttggatactgtcgacgccaacggagagatgcatgagcttactttcattttgggttgatggcttgatgcatgaaccctgccatcaagaacattactgtacacagcaactcgtgtccaactgaagcagaaaccggaacaggacatcaccgaagcataagtattattcatcttcttctacccttttgtactacttgacattggcaaatctagtactagtttctaatctccataagtactccattggtctcataaaaaaagaacgaattggatataacacattcta

SEQ ID NO: 106874 - DNA, 1192 bp, Oryza sativa
  unsure (1)..(1192): unsure at all n locations
ccacaacttgtaaagatatgcacgatttgaatcaaataagttaagaagttatgcaacactttatttatttggagcacttttttatacatatttattttttaagtacttattttgacaatatactaacgtggatttgtatataagcatatttatatttttattataataactaataactaaaagtcaattaaactggatgtaaaaattattatatttcggttgagatttgggaaggtgaagaaaacaaaaaatctttanagttaattggatgtaaattggatatgtagtataattcttaaagattaaattcaatattataaggtaatatcggtaggattactatataatggcatacttatatatgcttagctaagttgatgcaccaaaatactaaattgtcaagttcttgtactagaacgcacccacttgtcaagttgtcgtacttgaatgttcaattctcaagttcttgcacgatatcgcatcgacccgccaaatttatgtattgtgggtgcaatttactcttaaaagtttatatacccgattcaaatttaaatttggatttaaatattttatatatagaatatttctatacataaagtttatgcgtgcattattttcctcttttagtaagtttatacacctaaagtttacacatctaatgtttatccacctaaattttgtagagcaaatgtttataagtcaaaagtttatatattcgattcaaattcaaattcaaattcaaatattatatatatatatagaatatttctatacataaagtttatgcgtgcaaagtttatgatataaagtctatgcacatgaatgaaagtattagatttttttctattttttactaactttgttttttttttgaaatttatgatgaaaggagagaagggagaagagtatggggggaggggcgctctcccccatacccaatgatacccaccacgtggcgcaagccgctttcgcgtgacgtaaattgtgaacagtgaggcggcgacgacaataacagagacgcccaggacgatctgcgcagtacgcggcttgggcgcgtagacgacacacacctaggcacagcgagcgaagaggaccaaacaagcgcaacggggaccgggcaaacgcgagcagcggcagggaggcgaaacgtagcaggagcggaggagtgcgcgcctgcaacctcaccgcccgc

SEQ ID NO: 106875 - DNA, 1079 bp, Oryza sativa
  unsure (1)..(1079): unsure at all n locations
cttcttcaccgccnngcctcgagtccggtgagcggcaagaagcactttgcaacacgccgctcctccctttccgcnngaagcagcggcgcacngctcctcnatgtcccgccggcaccgccgctcgcttcatgtcgtccccggatggcaactcctcgtcgtggccgacaagaccacgcccctcgattggtcgcacccggcactgcgctgctcatgcagactgacctggcgagcttcgggttccgcttcgtcgccttcctcctcgtgcatggccacgcccgcaaggccgctgcctacctcttcgcagtgctcgctatcgagccgcccaaccggggcaccgccaccgccacaacgcttgacaactcttctcccctccctctcctatccttctcgctcgcatggatctctaacacattgcgtcttctgctgctgctcaattcttcaggacaaagccattggcatgtgacccgacgagcttgcccaagctcccgccgagcaaggagtacaacgccaagctccgcggcaaggaggccatcaggcaaaacacgacagccatcggaggtaagggctccatgtccgtcaagccggggaggaacgagccgtcgaaggcggcgccggcgcaggacgccattggaggaggagatcaccagcgcgtgtctggtgcacctgaagagcgtgagccaccactacagctcgctgcgccgctgactctccgtcgtgcctggagagaggagagagagatgaatagaggggagatggggagaggaggaggaggaagaaaagggatgagaatgacatgtggggccaacattggccccaccatttttttaaatttgtgtgaaactgacatgtgggtcccacgaggtttatcaggatcgaatagccacgtcagatcgagactgagtcaaattagccacgtaagcgccgcgtcaaccaaaaccgccatcgaaacggttgagggatctaatctgtaccggttttgatagttgagggacccattatatctggtcttgtggttgaaggacganaatcggattcgttgaccagtgatgngctntgtcagtcagtcatcaatttccact

SEQ ID NO: 106876 - DNA, 711 bp, Oryza sativa
aaattctaaaattgattattaataaatgccgagttctactatatttaaaatcttagttaatttagtaattctgaaactaatgcatatcaaatcgtacttggtttggagtctcaattatagatttgagtgatttgataattgaaatttaataattaatcgaaagttagaggttatatgtttcgagtttatatactttgatgtcttgaattataataaagtaaaaaactattgactccatatgttttccttttggtgtgttttacttaacacaaatttgatttgagcacgtgcgaatcttttttaatttttggattagatcgtagaattcgtaggtgcatggaaattataaggaatacctatgtgaattgcaacagttgcaacacaatcctggatcttcttaattagatacaaatgaacctttcttgtcgatgaaggtgtcaacacccgaagtagttagctaatttactcctggtagtgtggtttcaatgtggaacaattaattaatcaaattataaaccaatcttgtttgagaaatagaataaaataataatcttgattgtgaagaaaatgtacctgaccagcaaatttaggatcttcaggttccatgcatcggccaatcgggattcatgaaggcatctcctgctgttttttaaagagtgtagcccctgtacgcatgcaaccatttgatggtggtgtgagaaatcaagattg

SEQ ID NO: 106877 - DNA, 2030 bp, Oryza sativa
acgcaaatctagagcgtctcccgtggctttgcctgcggcgatcgatccctatcggttttttttgttttgcagatagaaaaagtatacgactctcgttattttaattagataatgcaatctcccaaatattcgatgggcttttaaatggcccacaatattagttaagcgcagttttttcgacctacgattgctatagtatagtctattaaattaacggacggatgtttctagttaacatgagagctcgtaggaaccctatcgattttacattttgcagatagaaaaaggtatacgactctcgttattttaattagatagatgcatctcccaaatattagatgggcttttacatggcccacaatattagctaaccgtagttttttcgatctatggttgctatagtatgatctattaaattaacggacatatgtttctagttaatgtgaaagctcgtagaaagtgtcaaattagtataggtatagatagatatacttttctactattttcagtcaagatgatctatctgtctttgagaggtaccgggggtaccatattactaaattaattcatataaaaaataggtacatatcaagtataataattagttctttgtatcctgtgagattagaaagaatgagcgtcttctcaggctgaaatgggcccaaaacaggggtatctatttggcacgcgccagcaaggaaactagtgcgtgccagctgtccctcccccacacgttttcttttttttttttcaccatttttcatgttttcattttctacctatctttttcgctattttttctttttcttgcttcccctcccttcgctagtttttcctttttttatgttttttttttcgattttaatcgttagcatacatgttttcaaaatatttgagtcgaaagttttcaaatttaacttgaaagttttctaatctaatgaaagtttcaactcatatttgaaaactttaaactcagattttaaaactttaaactcagatttaaaaattttcaactcgagatttgaaaattttcaagccaagttttgaaaattttcaaatcggcttgaaaattttcaaatctcgagttgtaaatttttaaatctgagttgaaagtttcaaatttgagttgatagttttttaaatctgagtttaaagttttcaaatatgagttgaaatttataaaattttgtgttgaaagtttttaaaatttgacttaaaagtttaaatatcgagtcaaaagttttcaaatttaacttgaaaattcaaatttgaagtcaaaaatttttaaaaagtaagtttagagtttcaaattttgagttgaaaattttaaattttatgtatggcttttaaattttcagtagaaagtttaaaatcaatcggataaaaagcaaaagagtaaattgcattgatggtacacaaacttgttaggtgggtgcaatttagtacataaacttgtaaaatgcttgttttggtacacgaacttgtctagttcgtgtgaacgaggaccaaaatagcttgcaatgttaattttacaaagctgatgttgattatgtgacgtgcatatgtgtaatgagtacgcataaggcatacaatatttataattttggtctctactttttccttcatcatggaaatgacgaatgtcatatatctctaacccttatatcatttctcattttttcatatatttttctatgttcactatatcccaatatttttattgaagaggtgtatggctaatagcaaccttctcaaatatatgtttacatagtatcctaatcagcccccctaaatcaataagattatccatgtaatgttcttttcgcctttctttgcacgcaccaaacaagctcatgcaccaaaacgagcgttttacaagtttgtacactaaattgcacccacctgactagttcgtgtaccttggatgcattttactcaaaggaaaatcttatcttaactatcgtcattatctaaactaatatgggtagttacacacttaatctagcttctcccggaaaatcctcgtgacg

SEQ ID NO: 106878 - DNA, 939 bp, Oryza sativa
tcatcagtcttacctcgcaaggatgatgctggtgatgcagaggaggaggcatgaatggtggtctgacaagctcgattgggcgtgattggtggatctagagaagagattggattacctgatttgcatgaatcttgatgagatctcgacagctcaaaaatcgagagatagaaaaatatcaaacaaataattaataggtggcccattttcctaattaaatataactacagcagcaaatatattgttcttgtatcgtggagagtagaggagcaaacaacaggggctagttgtgtatagcccttttttttaccaatatgtgtggcacatattagatgcacaccaaaattatgtggtggacacacaaatagtgggggactaaagaggaattagggtaattaagtatgtgactaactatattaagtatgtgatggattcacataatgttagtgtgacggactcacagtttatatacacacgtcggcgtttcattcttggaattcttgatccggaaggcacttgatgaagacgaacaagggtaacgagtcaccaccgacatcagtcggcgcgatagaggtggccaccacaaggagaaaggaggagccactaaaggaggagggcaaaaggcaaagggagagcaagaagatcggcccaaatgaagccaagcctggagatgccatccgcaagcttttaaacgccgccgccagccttctcattgtcagccgtcggtcgccgctagcaagcttctacccgcaaggccgtccgcacgcctgtccccgcagtctcttacactgggttgagatgggaaaagaggggatataggtggaagaaactgggttactaatatgtgaggtttatgtgggttgcatgctgacttggccaccatgttagctaaaacttggagcagtactacttgtgaccacccagttttggaagattattgca

SEQ ID NO: 106879 - DNA, 3104 bp, Oryza sativa
aactattttcatggacagtgcaagctcctgaatcctacctaatatatagtattccagggttgtctgtcagcacagggaagttggattggattaactttctgcctctctttttgattttttcttcagcgtcgccatccttaccatcgtttttctacactaggatggtgcaggatccacggctgttgctgtaagtcttccttttccatttagtgtttgacatctccgagtcgataaagcttaagatacctgtttaatcatgcattcctatttcacagcaagttcttttgttggagtgttcgcaaaaaagttcttttgttgggatggccgaatttattaagaatgagagaaacatattgcactaggaaagacaaacaaaaaagagaactgctgcctcaaagttacttaagtcatactacacgatgggtcagttttgaagcagctggaaagtaccccgtttgatttatattattgagcggattattgcaaggattatctactcaattataggaataaattcaatattctgatattaagcttaataacagttctaaaaaagtggtttaagaaatgctctagaggaaagttttttgagaaaacatatttttttaaagtgtcgagcaattattccgttttaatgatctaatgaataatccaaaaagaacctggcagatcatccagcagaatgccctgagaatccttgcgttgccatccttacagatgattcaaaagttcagaactgtatgagtttgcttaagtcatcattgttgacattgggtgtgcaattttttttctccatatgatttgctcacttatgagttatgacttatgagcttacacacacacattgatatcacgatactggcatataccttaaaaagatatcagtgtaaaatagtatttggacacagaattaggctaatttcgttttaataaactcttacacggacccttctggattcactcaaggcatggtgtccatgttactgactagcataaacaaagaagtctctatgcctagcacagactaagtcttcatctgcatggtgtttatgtggttgaaggtattcacgagtcaatcccctgtatgtttcaatctaaatgttcaccataacaactattctcatgtgattttccaatatattccattcagattgcattcttttttcagctgagcagtttcattggtttatgaaatacagtatcttgctatgctgatgtagcctgactgcccatatttttgtcatatgcccatttgcactgtaatccgtttctttctgtttttttttcaggtgattccaagaggcaacttcgaaaatacccaagcaagttgagtacatgtgtcctgtaggaattacaataagccatttttatgcgtaacaatatgcctgttcattctcatttcataagcataacaagaatcagaagagggttcaaaggaaggaattataacagccattatatatgtttcatatatattttcttgtgtactcagcagtgccaggtcggagaacatgctgccttcaccaacttgctgaacctgatagacatcagatgcatgaactggatgggcgtgtttaatttcatgcttctattcggtggcggatctagaaaattgattcgttggtgctagaacgtctctatcggtgttacagtatattaattatacttaaatcatggtgttatagcatatggataagcagtttcgctatagttttttgctgaaagtcgtcggtgtcgcctgacaccggtccttctactgtacatctgcccctgcttctattggaattaggggtgtagtacaagcctaaacgggatgtctctttcatcaacacacagtttggtttgacctcataaaatagaaatggaaaaatggaatagaacaaagtgagtcatgtagctatattaagggcctaggcttaggcttttaagccaatttttttgcttgtatatttcataagccagtgactttgaagccttaggtgtattgatgcagtcataccttcactttaaataagctgaaaaatttactccgacttaccttttagcaatagtgtaagaatagcttatggctttcaaaaacaggaaaaaaacagttgcttgtttgtttatcataggctttttggcttataagttactacatccgttttgtagtatgacattgttgactttttacataacgtttgaccattcgttttattcataaatatataaagtataagcatgtgaaattacaagttaagattatagtttttttattacagtataaaataagttataatatatattttgaataagatgaatgatcaacgtcaaagtcagcgaagtcattacttttgaaaacggaggtagtactactagcttatacaaacatggattaaggctgtgtttggcaatgatagttaggaactaatcccccgcaatagagtgactcattagcggccgttcagttttggagcgtggtttcattgaggtggctcctcttcccctccctgaccacgtcatgtgccttgtggggaggccgacgcacgctgacatgttagtggatcccacaatatattttaggaacaaatgggtcccacatattttttttctaattctaatgccatgtaagcgccatgtcaccatcacgttggatgaagccaaggtcaacacctccacataggcgtcccatcatcgaaaccgtcctcaaccaccgagggagtcaaattgcaccgatagtattagttaggagatcgagatatctggtattgtgattcaaaaatacgaatcatattcgaccactagttaagggagtaagagtggacttactccgtacaatatcaaccccccacccaccttcatgggccggaattgagcccaaccaactaaaccaaccgaacgaggcctcaaccgtcacacctacttgctgttgttacccagagggtgttggttacttgcgtacctgtcgtgctggaggcgcacagctcatggaggaggcgcccagtacaaattacaaacaacaacgacaaatctccaaaactgaatctctctctccctctcccctccattccattcgattcgacccaccaccgccacataaaccaaaaaaaaaaaaaaaaaaaccg

SEQ ID NO: 106880 - DNA, 712 bp, Oryza sativa
aagccacttcaaattggtgaatctttttccactggtcaaggacagtcgcaaccattgaacatcggtggtgagatcaaatcaaagactaatgaaagcaatgaagttaacatcgagcaagctaatcagccggtgccagttcagcaggatcagtctcaagtgaataacagtagtggaagggagcagcaggtatgtttcaactgttacaagccaggccactttgcaagagagtgtccgaagccgaagcatcagcagccgcaaggtcaggtcaataacattgttgtcacaggagccaatgcagtgccagttgcgtcttcaagagttgtgtcttcaagtgttacaactcagccaccagtttcaaggcagcagtagttttctttaaagccttagaataattatcgcagttatggaataagatagactgcagtttacctatgcctttttctttctagccattccgaatctcgggacgagattctttgtaaggggggtagtttgtcacatcctgattttcgtttcaggatttataaattatttaataaattaataatagaatttatattaaatgttttttaatttacaagtgaagttaaatgtgggaaataaaatttcttaaatctaaagcatggatggatttaatttttattaaattctccatgattaagtcaactctctgaaattttctcggatttttcagagctcaattcttaaataa

SEQ ID NO: 106881 - DNA, 672 bp, Oryza sativa
  unsure (1)..(672): unsure at all n locations
agtataagtttacataatttgatgcgatttaaatttaaatagtatgtagaatgatgattcaaatgtaaaactaagatgatgtggctttatgaaagaagaaaagaatgaagataatttataccatacatctaagggctaaaaaaattgagatgatatggcttaatgagagaagaaaaaaaaagagataatttgaaccatagattaatcatctaaggactaaaaacaattgatgtgatatgacttaatgagagaaaagaaaaatagcatgaactaagtgagattgaactatattggtatataggatattataaaaaatgatggagagatatattgaaatattatgtgaattatatggaataatttaacatgcttacattttaaatctctaaaatttaatgaattattaaattataaataatatagcatgcctgcattatgcttaaatgtaataattgctagtgggtgatgatgtggcatctttgcatgttaagctttaggaattagtggctataactttgtaagagaggatttacaaccatggaaaacctgtttgactgactgacatgttagaataattgggctaggcccaacttataatattaaatctcaaaggcccataatanatgttgaggataataataccacctctggatttaagcgagaaatatctca

SEQ ID NO: 106882 - DNA, 1161 bp, Oryza sativa
taagcaggcggtcgctttgcttgtagcagacattaagaagagcaagatcaagaagaggagctagctaggtggtctgatcattgggtagaaagaattgtgaacaaattaaggacccaggtgtgtgatccaattattttccccatttatgccagcttgatattttttgagtatcagataatagtactacaattatcaacagaaactgtttttccaattgtacccaaagtctgcatatttcagtcttctgtgttcttcgtcaattttataatgtagtagtaagcttagaaaaatttcaaactgtgcctgttgtcttacatgttgctttcaccacaactaatagaacttcctgagaaattatgtgcctatttgagatagaattgtatttaatacaattatacttttagttgtacaggcagactgcatgttgcagccttttgtgttgttcaactttatactagacaagtaatgtttgaacaaaatttcaaaattgtgcttgttgtcttacatgtagctttaaccaaaactagtcaaatttccttctaaatcatatgcctatttgagatagaattgtatttaataaaaccatatctttagttcctataggctatactctcacaaaacaaagttcctgtccatttttagttatggatctataatatagacccgccctaatttctagactttatttaaaaaaaatagtagatacataggtgatagatttgccttgaaccactagatacagtaaatgtagctttggcatggtgcatctctcccgacatggaactcttttttattttataaaggaagcttttattaatctcagacgattacatcaagttgatagaaccatactaagaaaattcccggcctctgcataactaggatgcacacagccaaaacatacaaacccacaaaagagtttgtaacaagagaaggaaagcagtaaaaatcagggagcaccaatcttcaggctagaccgccacccatgtccctggtaaaacattccctgaccacctgctccaaaaatcttaacgtttagtttgattttgtttgcggttatgatcatacagcagtgctcaattggctatggaccaagtccgtggaatatttgagggagcagctggtcttgctgcttaagacaatgccgtccgggaattattt

SEQ ID NO: 106883 - DNA, 771 bp, Oryza sativa
gaacccgggactaaaggggggttacaaccgggacttacaaaaggtttcctccaccagtgtcagtagcaaatttgtagatgccccaaaactaaaagttgaatattaaatctacctttttgcttgtaaaacatacatcgtgcaaaacaacaaattaaatttataatcccaggtctcctttgaaacaaagaaaaaagggaagaatatctggtgggatttgtaaagtaagaaaaaaaatcctatgaaatcctttggcataaaggattgatccctatatattatttcgcaatttctctactgccttccgtgtcccctcctgtatagggataaattaaatccttccatttccactatagggattaattaatttggatggaaatcttccgtttctcttcctcccaccgcgtgcaacacgctcacaagcgtaagtatgcatatgcatcagatccaatgttttgtccctattacacttattataaaaaggtatctatatttatatttgtctaatccgtacatggcatgttactggtagtttataataagccaatccataaaaagttttattaaaaagaatgaggttatgccttagttcctgcctgttttttctaatgtatcattcaaacattagtttggaaacttttctatggtttggtttctgtaacactccgtaattcaacacgcataacattttattggtacatttcgattatgttccagtgttgaatcatgcattctaaagatgtttttagaatttgcggatgagagatgtgatag

SEQ ID NO: 106884 - DNA, 863 bp, Oryza sativa
tttgatacgactactataggcgaattcagctcggacccttaagtggagcatgcgcaggaacttcaacactataattcttcgtcatcaaggattgtcgggtatttccctcttgggtcatgacactcttatattgaaaaggtttgactcggcattgaagctgactagtgagttgtatatatggatttaaatagacaactctatgtggcatattatctcatctttctttttttgctatacctctattgattgctttggtcatcaacccttccttttgagcagttcattgtcgacctgcaacatggacttctaaacttagacgactccataaataaaacataataatgctaatttatccttttacgtcttggcttttgacactacaaggaaagacaaacagatctaatattatgaatgacaacaatactagtaatttacccgtgctaacgctatgacaatatttgttaatgcaaaccaaacaattacaaaataatttaactagaataatagataaatttgttaaacattgctagaaattgtttcagatattgctagataaatttgccagtattgctctaatttcggagtagtagaaattgttacatgcagtaactttggatgattcacgaaggttaatattttcctgtcacaaagttaaacccatgtacagaaagatactaggttgatttgtatttattcaaaaagggaagaatcagtaataaaaatcctcattatcaaccaaacaaagtcatagaaaactcctaatctagtgcagttcactatcaactccatggtgcattcaatagactgaactatatatcttttattttttgaatgcgacagaaccaaattgggataacacaatt

SEQ ID NO: 106885 - DNA, 681 bp, Oryza sativa
attggatgagtagtggagataggcggaaaacatgaatggtggaaagttataattggttgggaagagaatgttggtggagaagttgctatattttagcaaatcctgatggctaaaagttgttatattttaggatggagggagtaccaattatgagatttggtcgagtctacaagtactccctccgtttcaaaatgtttgacactgttgactttttaagtacgtgtttgaccattcgtcttattcaaaaaatttaagtaattatttattcttttcatatcatttgattcattgttaaatatactttcatgtacacatatagttttacatattttataaatttttttaataagacaaacagtcaaatatgtgctaaaaagtcaacggcgtcaaatattttgaaacggagggagtacaacacaatttatgataaggaaggagagcacttctagcacggcaatttgctgtgagcttaataataagtcgtacaaaaaaatatcaaaaagttaatgagattactctatgatagatggagataaccagttttaacaaaaaaaaaagagctatcaagtgtggttccctagcacgtaccaatcgtgatatcttttgaaagcctgtattatctccatcagcttggggcaatcatttatataaacctgactttatttcagagacagatttacc

SEQ ID NO: 106886 - DNA, 854 bp, Oryza sativa
atttagaaatagagtatcttttaaaaaaaaactcaggttttagggaatgcataatgtaaaaccacatgataacaacatttagaaatagagtattttaaaaataaaaaaaactcaggttttagggaaggcggaatgtaaaacctcattttttgaggcaaaatgtttcaacgtagatgtttcatattgtgaatatagacctatccatcagattcatactaataggtgatattctagtataggttgctatatttttgaataaaagcacattaaacttaacatctatgtttctccctcccattaattcatgttctacatatccaacatatatctgccttgcttaataggactttctcccaccacatagtatcttaagagcaagttttatattacatctaatcttgtccatgtcatttccgtaccaaacccaacacccatattaactttattttattgttttcttgacaaaaaccggttctaccgtttccgttttcacttttttttaaatcaaaatcaaaatagtcaacgccaaatacaaaaacagagttaaatattatcgaatacgaaaacgaaacaaatacggatcagaacaaatatttgtcggaataaaaaacaactagaactgagcttctcagatcaacagagaggaatatttatcggctcattattttttctaaaataataaatcggcatttatagcaacaaacatcaaaagagaggaaatcacatcaacgccacaccattatcaatattggtaccacactgtatgatgattacacgaaacacataatagcagcaaaccactgcaaagcactgattctctcacagaacgccaactcctggccaaagcattcgct

SEQ ID NO: 106887 - DNA, 675 bp, Oryza sativa
aaaatatttgacgccgttgactttttagcacatatttgactgtttgtcttattaaaaaaatttataaaatatgtaaaactatatgtgtacatgaaagtatatttaacaatgaatcaaatgatatgaaaagaataaataattacttaaattttttgaataagacgaatggtcaaacacgtacttaaaaagtcaacagtgtcaaacattttgaaacggagggagtacttgtagactcgaccaaatctcataattggtactccctccatcctaaaatataacaacttttagccatcaggatttgctaaaatatagcaacttctccaccaacattctcttcccaaccaattataactttccaccattcatgttttccgcctatctccactactcatccaatcacaatcctccaccagttacttctacctacttttttaataaccgtgtccaaccctaaaacttcttagaggcttctccggtccagcgttctgtacctcgaggtacatgtaacgtgaggtaccgattacaatccaaccgttgatctctagaggggtacgatgggtagtgaacgaagagaaactcaacgacgcgcataggctgggcaccgacaccaacagggcgaaagggacgggtggcaatcaaccagggccagcctggtctgggcttccgacgcctcgg

SEQ ID NO: 106888 - DNA, 1029 bp, Oryza sativa
tcctattgtcgagccaactttccctattttctaacggacacatcatgtgtcaataataatgatcggatagttaatgatcatgactctcaaagatacatgcattattctcaacatatttgcattacgatgagttatttacaattaaatacataattcatgatccatttacccatattcactatatgaaatcttgataacgcatctgttctgactacaaatgttcgagtctaaattccagattcaatcaccaccaaagagcttggaaccatgatacatactctgggcctaaactcaacggaggcggaggtgcaagatattattaggttgagtacattagatgggtttgggagctaatctctcccacacacgtaaaacgaagcagctcattacattagaatattattaattaaatattaattatttattttataaaatggatttatatgttttttaaagtaatttttctatagaaaacttttagaaaaaagcacggcttagttgtttggaaagcgtgcgcacgaaaaacaagggagctaagttgggaaaggagtgggaagaacacaaccttagtgaggtggacaccgatcgaagcactagcatcgactttccatgactttcttagcctaatagcacgctacatgattatgtgaagcacaaaggactgagatgagggccggagggagacgttccgcatctccgacaagtactagaaaacagtgtcatttctatcgctgaggagttcaaaattaaattcagaaaaatagcaatttgattaaaattctcattcaaaaatttagaaaacccaataaaactataaaaaatgtataacaagattccatgtagaatatgaaatatcaacagtccatataaaaatataagttataaatatctgaaatttggaataataaaataactattaaaaaatgagtccaaatacaacacgatacgaaattaagtataaattaaaatccttaaaaagaaaaatctagaataaaacaataatttgatttgaaacaaattcgaaattag

SEQ ID NO: 106889 - DNA, 730 bp, Oryza sativa
  unsure (1)..(730): unsure at all n locations
ctagaatggtccacaacggaaatagctgatgaacaattacagatgacagaggagcagattgaattgttacctcattggaatcttgagcatttgataataaagaattacctaggtcaatcttgccccagctggctccagccagactgcctgaaagtgctgacttcacttgaactttatgggtgcaggaacattcagagcctatcattctttgacccactcttttctgatttagaagagtcaaacagcatttatcaccttgaggtgttggatgtccaccagtgtcctaacattgattggcaaggtttggtggctttaccctcttctcttagaagggttacccttggcaactttggccattcgacagatcactttgtgagttgctttcgtggcctctccctcctgacacatctggaaatacattgctggttcttaacatctattcccctgcaagtttggatgagtaatctttcatccttggagaatttgcgtattgataattgtggctccctcacatncatctgggtctctgaggcaagcaacatacacactgttggagtattttcatccctttcaacagtcaccatttcgttttgcaatgcactgttgagtcttgatgagttctttatgcccgcttatatgcctttcgtgaagacattgatgtgttatttgcaaggaattagcattacttgccagtcatgagctccccttttttctcgcttggagagctatt

SEQ ID NO: 106890 - DNA, 730 bp, Oryza sativa
ctttctagctcctgcatcagaaacttctaagtttgttcatgggatattgtaatgatatggttatcctcatggaactaattaaaattagattactatgtgtgcatgtatattgccaggtcaacatgaaagtatgcttttcatgattggttgcgtacataagttaattaatgttgttcctttttacttgcagcaaaaaaaggtgctccatgtaagggactttgggggtactctcatggcatttggtttagagatttgaaaggatttgtgcttgcctaggtgtgagcaattggttggatttggctgttaactgggttataaattttgtgttgtattggatgtttgtcgggttgtgttggatgctaattgggctgtaacctttgtgctatatgggttgttattgtgtttgattgttgggcctatatgggcttaacccacttgttatttgatactaatgtaaatgaatataataagattggctgaaaatggtgtggtataatgtttgggcctatatgggcttttgcaatggacttggtacatttattatttgatattaaagcaaatgaatataatagaattaggctgaaaatatgccacatcatagatgggctaggctaaaatctaatcgggcttggcattgggctaagcccataaacagggtgttcaatacatggattttaatgggccatcagatattttatgacgttttttatgttagatatgaacgtcacaa

SEQ ID NO: 106891 - DNA, 616 bp, Oryza sativa
caaagatgcctttgtagattgtgtacaaagtttaaaattccacaacttgatcttgctgaattacctgtattgatccatctgtagctatgttgcgagctatatacgacaccacaagaacttcttaacactcttaggcgttgtttagttcgcgaaaagaaaatctttagggtgtcacatcggccgtttgaccgaatggtggaagggattttcgaacacgaatgaaaaaattaatttcataactcgcctggaaaccacgagacgaatttattaagcctaattaatccgtcattagcaaatatttaccgcagcaccacatgatcaaatcatgacgcaattagactcaaaagatcgtctcgcaatttacatgcaaattatacaattagttttttttcgtccatatttaatgtttcatatatatatctaaacatttgatgtgtctaaacatttaatgtaacagaatttttagaagtttgaagagaactgaacacagcctaaataaagccttattttgcaacagatgtgcgtccgtctagttactcgtctactacttttgtttggttttctttcctgaccagctgagctcagcaccccgtaatactgagaatactgtagtatt

SEQ ID NO: 106892 - DNA, 1093 bp, Oryza sativa
atagttttacacatttcaacaaaaatttctgaataagacgaacggtcgaacatgttttaaaaagtcaacggcgttaaatatttagagacagagggactatataacagtctaacaccaagctagcttaattccctgtggcttgacaccaccatctgatgatctgaacatgcatgaagtgcaaatatatgcggcaatatctgactttttttttgagaacgagcaatatatcttaacttgctgtgataataagtacgtacttacatgtctggatgagaatttttcttatttttcagacttttataaattcaaaattttaaaatcaactctcacaaatttattcttttttaaaaaaaggaaccttccagtcacgccataatagcaagaaaatgttgccacaccatgaacagtggtttatttctttctggcgtggaaaaaatcattttaaaatcaagttttgggagggtttatgtgtttgaaacaatctaataaagtggtttaaataataaaaataatatctccggatgaactggggaaaaaaatgaagtagcaatgtgtcctagtagttatatatttgacacactgcatggggcaactaatatatataaacactctatttttttattaaataagtcatttaatttggatattgatgtgggagccagctagcttgggcattttcacggctgcagtttgtaaacaatagactgtagccaaagatatagccagcaaataaataattttaagataaaacctttacagttgtatttttagtgtccaaaagccaattaatgagatgcgcatatatatgcatgtatgttattgtgtatttaagatgacagtgttgactgcccgtgtatatttttatggatccatatctattcacatatacagtaaatcattcgtactaaaatataaaatttatcatcagataggacatattttagaagtacgaatctaaacatgatcatgtttagattcatagtcctatgatatattctatccaatatgattctaggtttttatattttagtactgtcggagaatgaactcctccaccagagaattgtgaggcccattttgtaagttcggccaa

SEQ ID NO: 106893 - DNA, 1639 bp, Oryza sativa
gggccgtcggctcattactttttattaattatttttgtctgactaagatgttgatcccattgagatttttttaataaaaaactcttctagtgccatccaagcgccacgtagccattaaatgggatgaaaaccaagttaacatataatgtaggatgctttgtacctaatcctatcttactataaacttatcctcgactaacttcttaagcttaacatgcaaagatgccacatcatcatcccccgccaaaatgccatattatcatccactaattaacaagatgtcacatcatcatccactaacaatcatcacatttaaacatcatgcaaacatgcgactccctccgtcccaaaatataagggattttgagtttttgattgcaacgtttgaccactcgtcttattcaaatcttttttgcaaatataaaaaacgaaaagttgtgcttaaagtactgtagacaataaagtaagtcacaaataaaataaataataatttcaaaaaaatttgaataagacgagtggtcaaacgctgcaaacaaaaactcaaaatcccttatattatgggacgagggagtatatctttatatttttataatttaagagcttttcaaatacaaacatgttaaattatcatccaatataattcacataatatttcaatgtatatctttattatgttttatgatatcctatatatttatatagttcattcttacttagtgcttaaatgattaatctatggttcaaattatctttctctttttttcctctaattaagtcatatcacatcaattgtttttagcatttagatgattaatctacggtccaaactatctccctactttttttcttccataaagtcataccaccttactttttacgtttgaatcaccattctacatactatttaaatttaaattatcataaaccatattaatttacttaatctgatgttatataactattttaaacgttatttttttattgttatcatactaaattctcgcagcaatacgcggggttttacctagtaataaatagatgatgtggcttaaccataactcagaaaaatcctaataaccatatcaattaagtgggaatcactttagtattataggattacggttgagtgatgcatgcgaataaaactcccaacaatagttgagctgagcgaccaaagatggacttttctcgttgctaaaggtaggtcaaattttctcttttgggcttctcaccgtggatgggcctaatcagcttgggccgggttttaatcatgcactcgttcacaccggccctattgggataattttttttctttactcaaatcgcagacgaaattctgctctctgcatccgggtggagtgcgactggatctaaaaaaattgcacgaagtttttttacgaaaaactttcagatgtaattatagtataactgaactgtaattacattgtaactactctataactgcacttgtattcaactgtggttttgttgtttagcaataagatcttatgcgtgacatgtgcgaaaatttctttatagtaattttttctcttcatgcacaaatctcaaggcaatccgatggctacaaatctaaaagtttcgaggacaaaaacttgtgaaagttttctagcaattccgt

SEQ ID NO: 106894 - DNA, 861 bp, Oryza sativa
tcacgaaaaataaaatcgtgcgcatattatttagaaaatcacaaaaaaaaatattcatggtgattcgacttcccacggcgcaggaaaaaaaagcgaaaaagggaaaaagcaatggggaaaaaaacaccaaaaaccaaaaaaaaattgttggtgggcgacggcgcgcgtgtcgcgcgtgggccgggtgggccggagtgcgtgcctgcggcgcgtatgcgcgaattagcaaactccggtgagggatcttgtgtactttttccttggaataagttcactttaggtccctctatttgtcgcccagtctgattttcatccctgcagcacaaaaccggatacaacgcatcccccaacttacaaaaccgtgcaaagaaggtcccttggcggtatagtcgctggttttggttgacgtggcgcctatgtggcgcttctttgactaggtcttcgttcaatgtggcattgacgtgacaatttgatataaaaaatcaaacccgtgggacccacatgtcagttacataaataataaaaaatggtggggcccacagtcacaattggcctcatctattatctctatcctctctctaaacacatgccaactcgccagagcaaggcggacaggcgaggcgacggcgggcgaagctcgccggcaggagggcggagcggcggcggccggcggagccaagcgggcggcgacgcgcgaagccgataggaggaggttgagcagcggctggagcgggctacgagcggggcgcagcggccggccggcggagcaggttgggcagtggccggagcgggctacgagtaggacggcgcctcgtcgccgtcgttcgcggcccgcacaaagcgttaggtacatcgcggaat

SEQ ID NO: 106895 - DNA, 1494 bp, Oryza sativa
aacgagtggtgggccacggccggagctgagggcggagcagctacgggccgcgggaagctcctctcctccagccggtcagcgccccgcgcccctccgttcatggccgcgacttctcccccgccggccggccgctccgtccctctgctccggccacgatgcaccgccggtcctcttctccacgggcgccgaccagccgctccgcccacaagttgtgggccacaacacgccgccgctccggccaccgacccgccgctgcccgcctcgcttcgcctctcgcctccgccctctgctctgccgctgctccagccgccgcccaccccgctccgccggttggagagagagatgagggtagtgaggatgacgtgtgggccccaccactttttattatttttgtaaaactaacatgtgggtcccacaggttttattattttttttgggatcggattgccacgtaggtgccacgttggatgaagacctactcaaatgagcgcctcgtaggcgccaagtcagccaaaactagcgactatactgccgagcgaccttgtttgcatggtttcttaagttggaggatgcgttgtatccggttttgtactgtagggatgaaaatcgaactgagcgacaaatagagggacctgaagtgaacttattcctttttgttttgcaaggacaaataacgtagcctgggccatgttgagaaaagcccttccatgggatcagaccccacaccattatttaaactgggcccaatttacatttatgggccataggcccgtagcctctcaaaaaggtccaacgtgatatgggctggttgaccatctcggctggaccatatcgcgtttgatgcctaaacttttaaatgtttatctgtgaccgcactggggagcgacatcttgaacattaattagttccaagcttaattgtatccatttcaataactatgtcctctcggccattatttataaattcaaaaaaaacacttttaccataatggaataaagaaggaatttataaaaactaggcagacatgtcatactcacccccctttgctcaatacatattacgtggcaatgcataattagctgccatggacgttgacagatatattaatgattctttttaaaggaaatatcgatcattctttctacaatatgcacaatcagccagctagagtatttgtgtactcgattaataataattaatctcttgtttgcttgtactcgcatgctattttctcactcggccattattttacccacgttcgccaattattatcaccgaatactgtttatatttaatatttaagctttgactcttcttttttaaaaaaaaagatatcgtgcataaacatttgaaaatatgttaaattattgaagcgtgttgtatcctgaaatataaaaattaagatttcgttaataagctttctttaatattaaatattagtataatcatttaaaaattattagccgtggaagttaaaaccatactttaccagac

SEQ ID NO: 106896 - DNA, 689 bp, Oryza sativa
gacggcgtggtgtcaaataggctgggcagcgacaaggcggtggcgaggatgttcaaccggctggcgaaaaacgcagtgctggaccggcggagcccgctacgcggcgtgcaggggcaggtgaacgaccaccgggagaacgcgtggaacgagtggtgggccacggccggagctgagggcggagcagctacgggccgcgggaagctcctctcctccagccggtcagcgccccgcgcccctccgttcatggccgcgacttctcccccgccggccggccgctccgtccctctgctccggccacgatgcaccgccggtcctcttctccacgggcgccgaccagccgctccgcccacaagttgtgggccacaacacgccgccgctccggccaccgacccgccgctgcccgcctcgcttcgcctctcgcctccgccctctgctctgccgctgctccagccgccgcccaccccgctccgccggttggagagagagatgagggtagtgaggatgacgtgtgggccccaccactttttattatttttgtaaaactaacatgtgggtcccacaggttttattattttttttgggatcggattggcacgtaggtgccacgttggatgaagacctactcaaatgagcgcctcgtaggcgccaagtcagccaaaactagcgactttcctgcgagcgaccttgtt

SEQ ID NO: 106897 - DNA, 646 bp, Oryza sativa
taatggctaaaagttgttatattttagggcggagagaatatacccctagataataaaggtggatctagtattatccgcaggtgaatccattgtctatccataaacacattcattatatattcatcatctttacaatagcgaaaaagattgagaatgacgatttatgtatacaataattttatcatctttaagaaaaaggtataccatgagattccatattttctaatgttaaacttggtatctccatgtaataataagtatctcgaggtaccgagttatttttggtgctacaagtactttaaaaaggaactctctgaattttctcatatgtatatatattgcaaatagaagcttatatacgacctatttatgcaagaactatatatgcatgcacaataatttgccactgacaagcgctagattctacgatttgtcatcgataaaaatatacaacttctaggtacaataatatgtactatcatacaagtgttattttaccatttttaccattagtatagttaacctccgttatcaatctttcattttttttacgatgccgaaaaaccacgccttgggaggtttgcaatatctactactatttcaatgccattttcaaataattcaattaattaagagcaaattttat

SEQ ID NO: 106898 - DNA, 1058 bp, Oryza sativa
atatttattgctaattaccataattagccctaatttactataattagtattgattaggtaattagcctagaaggaagcggccgcgtgcgcgctgcttctgtggctcggcgcgcacgcgccgagtaggaacaccctccctcatcttatcatccagttacgaaattgtcccctaaccacaaaaccagatatattatatccttcaacttacaaaaccgttcactttaggtctttcggtgattttgatcctagttttgtctaacgtgacagctgagtcagcgtgaggcccacgtatcatgatgccacgtcatcaccctctcccttcttcttctctctttctcacacacttttctcctctaggcaagctggccggcggatggggaggaggtcaccaggggtgaggcgggagaggaggaggtccggcggtcggcgacgaggtggcggtggctgcaacgcgggagcagggcgctgtgcctgggtcggatgtccggggcgaagacgactgcggcggcggcgaccggaggatcgaggaccctctcctctagtcatctcgaggagcacagccggtaggagaggagtgctggcacggtgggggaggagggctgacgaacccatccatggcgatttgacggtgagacggcggatggcttgagttgttcgttcagacttcagagtgccttgagcataatatctctccgatgctggtggtggtgaaggcgaggccctcttttaggttgagcaccttgaccacaccgtcctctgccaggaacgccaagggcatggtccttcccaagccagaaattcagaaatgccgctccttgtcctgattttcttcctagtcctcggtgtactttgccccgcggcagcggccaaagagcagttaatcttaaacgagttcaccagcacaaaccttcatcttcgacggcatggtgatgggctgctcgatcatgctgaccaacaacgtacacaaaacaagcaagggccatgtcttgtactggtgcctgccacaagatgcccaatagcacgggggatgcttgcagtcctttctccaattaattatg

SEQ ID NO: 106899 - DNA, 736 bp, Oryza sativa
ctataggccgaattcgagctcggtacccgttgtggacttagacgtgtggatgcgatacatttcttaggtgatgttcccatcaatattgaatgtaatgttgtctgaacgtgctcttcaaagtgataaaatgaaagctctcctatcatgttactctatttcttagatctacatgcttctgttgcacatattgtagctaagtttccttctaaataatatattaactagccagcctagtgccaattatccagggaatcatctatgaaaagttattcaagggtagtaccatcttggaatttattttttgtaatattgtgtgtgagttatgtactgacaggtcttttgaggagatgaaacattctgggctcagcatctggttctcatgttcttttgttcttttatttgcctgtgtgacctgtactgatataattgttcttgttcctttgttcatatgatctgtactaataaaactgttgagctggaagaattaggtacaaatacacctatacctaaccaactaaaccattaggggaataataatggaatatagttaatagtttagtcctttggggtttggacaacctgttgctttctttgaattcatacttgatgatttgttaagaatttattttcatttcatagccagatagatgcaatcagacatgcttgacttttaaagcttgaaaggtgcaacttgcagcttcttatcttctatttaggattctttcattgtcattga

SEQ ID NO: 106900 - DNA, 575 bp, Oryza sativa
tatagggcgaattcgagctcggtaccccgtcccaaaatataagcatttttagcttccaatctagacaactgtttgtctagattcatagccaaaaattactatattttgtgacggagttagtagccaaaaattaaagttcaatatttaatttggattttgaaattgtttttttttcatcgtagtaattgcttgataagcataaacataaacagcgaaacgttgcacatcacatgaagagaaaacaattcatgataagcatatactctcttcgtctaagaaaaaacttaacgtagaagtaggaggacgaatttgaactcctacgagagtcacatcctcttctaggttgaattttttctcaatggaaaaacgaaaaaacctcactgacttcctcgaatgaaccacggctggcggaccatgtatcgttccaggaattgcgatacgcgatatagtcccagttggattcatcgtcgtcctgcgaccgcatcatctcttcgtatgctttgtcctgctactcgatgttctttcttaccctcgacttccattcctgccgggtctctatcctcatgggtctcgac

SEQ ID NO: 106901 - DNA, 560 bp, Oryza sativa
tcaacgatgaattcctgagcatttctaagccgcatgtgcccatcattgccagataggatgccatgctttgcagaaaggtacatgacatatttagatagttctctgcttggacctctggatggagagctgcagcctagctcatcttcatggaagaaggatatgtccgtcgcaatatgccaagcaaggacagcagacatgaaaccggcacgctgaatgctatcgctgatcagcacctgcagccgagctcttgatgaactttcaatgtgcagtttgctcctcatgagctccaactttgcccattggccggtgaatttgctgatgtccccacacatcatctggatgcaatctgcttccaacctgtagtagcttatcaaggacgagcttcttcagctcatgagagatgtcgacatgagtcatagtgctgggctggatgccgatcacacgcttcatgcatttcagtaaacaactgccagctgctgctctcttctgctttatacatccgatgatgaggttgtactgtgccaacttttgggaccattgtggtttgctctctggatgga

SEQ ID NO: 106902 - DNA, 1098 bp, Oryza sativa
tctttagctagtgttacttgttttggggatttcttgggagtgtagcgtggctctgcccccctcccgctgtttggagttgcgtttttaaccgtcgtagtagttcctagcttcaagtcccccctttaggcataagccagtctagctgattactttgtgtaacaaaaactcttttcctgctaatatattgacgtgcaattcttttacgtgttcacaagaatatatgatttgattcgtcatgtggatgtgttgttctgaaatgatattcatgtggatgcagagtgtttgaaaaaacagaaaacgagaaaatcgaggagatacgtaaaacgagacaagctattaacgtgcgattaattgagtattaactattttaaacttgaaaaatggatgatatgatttttaaacaacttttctatagaatttttttaaaaaaggcattaccatttaatagtttgaaaaacacacgaaaaataaaaataagagactttttccctctgtctagaacgtatatataattcggctcggaattttaggaagaagcaatcactatcactcgaaccaaatcctaataatttcatttcagaatagaattctattgatcgaaacaaccccatgagactttgatttggctggagaaattcctgcgtctgtcactgtattactctttctgaagatggcaccaataatactaccaaaccagtcttacacttccattaattagctaaatcagtagtatatggttaatcagtacaaagatgcctttgtagattgtgtacaaagtttaaaattccacaacttgatcttgctgaattacctgtattgatccatctgtagctatgttgcgagctatatacgacaccacaagaacttcttaacactcttaggcgttgtttagttcgcgaaaagaaaatctttagggtgtcacatcggccgtttgaccgaatggtggaagggattttcgaacacgaatgaaaaaattaatttcataactcgcctggaaaccacgagacgaatttattaagcctaattaatccgtcattagcaaatatttaccgcagcaccacatgatcaaatcatgacgcaattagactcaaaagatcg

SEQ ID NO: 106903 - DNA, 633 bp, Oryza sativa
ttgtaggtcctcgaaacagcacggacgtactacgtaatactactatagttcgttgtagtaattagattccctgataccggcatgtatgtcgtgatctcgtggccctacgcattacttcatcggtcacataaaaaatcattctaatataaatttaaaaatatattttttttagattcgtcgtatattagaatgtgtcacatttagtcctatttttttataggacggagggaataggactaagctgctaaacagtatatgtcactacttatctcaagttttatggagtactatatgactaggctcctctccgttcatgaagactctgtttttggatttctgtattcaacgtttaaccatttgtcttatctgaatctttttaaaaaaattagtcatgcataaagtattatttatgttttatcatctaataacaataaaaatattgaatcacagaaaagttttaaataagaggagttaaatgttatatccaaaagctgaaaaataaagtctttgtgagacagaggaagtacactttctttgtttcaacatatataagtgtacttttaaaagtgaaagagaaaaataaaaggaagaaaagatcacctaagtgacccatattaattattaaacgagagg

SEQ ID NO: 106904 - DNA, 849 bp, Oryza sativa
aagcacaaaattaaagatgatggatatgtatggattgacttggacacgcgcttttgccttttactaatgactttttcaaggcagttgactctgttgacttaaaaaggatatctcaattaaaagtaaaatattctcaaatattttaagttagtgccttaggcaaagtactgtcacttttagtggatattggttgaaatggttaagcagagtgctagtgtgctttactaatctttggacatccatcaagctcattatccattaattaaccacctcttaaattaaatgtcacgtactaattacaataataatatatttaattataatggtaagaacattcacggctactgctaaaatattcacggagtagtaaggtacagagtttcgtaggatggaagaaagaaaacccataagttcgaaccagaacaaaatttaccataagttcaatacataatctaattgttgactgactaccaactaacatggtataaatcaagttaggattagataatctaaccaggtgaacaccactgagctccgaggaacatcactctccctatcagcttgttgcttatcaaccgtagctaacatttatatttaataacttattttaaaatttaggtttttgtttgtcttagtttgtttttcattgagttttaaaccgctaatgataatataagaatacatatttttactaccaattttgttttggttacttcatcattattatagagcttatcaaccgtggaccaaccaatcaaacactggaattttctacaaagaagaaaaatcttaaaaatcttaaaagattctaaggaggaaatatgtagggcctggcagtagaatccataa

SEQ ID NO: 106905 - DNA, 716 bp, Oryza sativa
gatagcttaaaactatcataatttttttatggaagttcttccttggttgcagcatgtgaaacgtgtgctttatatataattaattgattttcattaaatttccattttgatcaatctatatacttgatctcggattagaaaaaacaactagtaggactgtaaacaactggctcgttggtcgatcgctactcaagcacagccactagaataagcaaagcatcttggatcaaatataatttttcccttgtgtttaatttgctcaaggaaaatgaactggtcacatcaaagtataagtggcactctacagataaattcatggattaatttcttcttccagaataggaggacttttcccacacttttgttattatgaaatcagcatgagaagaggccaggaaacggtcaggaattgtttttcctttgggttaatcactagggagttattgtatgaaaattgagaggcaaaaattcattcacgtgcgatcgttaactgtcaggaaatagtttatgacaataatgtcctatttaatttcattgtaatatatggtttactcctaagttaattaatatgttaatttgtattctatccgaagagctgaactttttgtgaaacttaaattaccagcgtttatgtatattagctagttcatgcatataggattcgtataaacagtataaacatataatgcacagtttctatgtcttgccctactata

SEQ ID NO: 106906 - DNA, 659 bp, Oryza sativa
gtgaaactctgaagaaatctgcagcagggcggagagcaagggtagaatggagtgaactgaaacaggagtttggtggggttcagacttcagaggggcacaacaagatctgtttgactgttttttgcaaagagaacacttcaaaaccatcaaagatcagtactagccagcagtatcctacactacatatactacctctgctccataggaccataataataagttcatttttggctcaaaaaaaatcatttttaaagtaacctttgtattgtagtttgtgaaagtagagaataattgtattggaagtagataaagtaagaaataattacatggggatttgataaagtagagatattttaatcttttaggttttgtatcagtatgtgtgggatgggtgaaagatgaacttattttggaatggaggtagtaatatacatgagctcatatttgaagatttgacattcgttaatttcaaccaacatgtaagctaagtagtaagtacgtctagattgctgtgatcagtgtagattctcggttcatctcacgtcttgtttgtgaggagtaacatattcctttttccccgaaaaataaaatgtagattctcggttgggtttgtccatcgttgcccatgagcacgattgtcgaaaccattaaacggtgtt

SEQ ID NO: 106907 - DNA, 973 bp, Oryza sativa
ccatcaaataatgatggtgagaggttctcatcctcttatcccagccggagtgggttctcccgctctggtcaaagctaggctcccgtttcccgatgtaatagaagcccagaagtcttcacccattaatggtgaggaacatgggcgccccccgtgtcaagcggcatggtgtggtaggccccacgaccaaggcgacgtgtatacggcttccaagttaaggaacaagacatgcatttaaggcaaagatggtaatacttcttgaggaagttaggttgttgggcctatttagtatccccttgaactataaaagaaggaccttgcccaccgagaaaaaagaggacgactctaagaaaacctgaactctaggagaagtagggcgaaaaagctctctggagggaaggaatccttgtaacactcatccataatcccaaacacaggagtagggtattacgcttctcagctgcccgaacctgtataaaccccttttgtctcatcgtctttgggggatctaaccccctcaagaccacacagttttgctcaccaaatcctcgaatctcacccgctacctttggccgaacttacaaaatgggcctcacaattctctggtggaggagttcattctccgacagtactaaaatataaaaacctagaatcatattggatagaatatatcataggactatgaatctaaacatgatcatgtttagattcgtacttctaaaatatgtcctatctgatgataaattttatattttagtacgaatgatttactgtatatgtgaatagatatggatccataaaaatatacacgggcaggcaacactgtcatcttaaatacacaataacatacatgcatatatatgcgcatctcattaattggcttttggacactaaaaatacaactgtaaaggttttatcttaaaattatttatttgctggctatatctttggctacagtctattgttacaaactgca

SEQ ID NO: 106908 - DNA, 679 bp, Oryza sativa
agttattaccgtagaccatttcacttctcatagcaagaaaaaaatgacagaaagtacagttcattcctctaagatgtggtagtactaattgtacacttctccatcaaatctaagcctttgaccagctactcacgcaagatcagattcttattaggaattgtggtaacagtacaccaagagataaataatatgagaacgatttggccttatgcatctatatacttatgtcccatgtcaaaagagtcaaacgccgcaactgtgccaacgttgtcctatttttttgaaaacttcctctcttttttttttaaaaaaaagggcaacgttgtcccagatgcatacccctttcatccaaaaaaaaaacgtaatcctacctatgaacttggacatatgtgtgtccagattcgtagctaggatttgtctcttttttttctttttaacagagtagtatgcatgaacttgtgtgtgtgatacctcaataagggttatattcttgtgtgacaagtatatgccctagcttgggatcagcaaataaataaatgagattaactaggtcaatattggactagatagttcacattcacctaaagttacagtggtttcctttatatgcattcatctgtaaatatatgtagtacagtacgtagaaccgatcgttgcttgatcaattcaatggtaaaaa

SEQ ID NO: 106909 - DNA, 677 bp, Oryza sativa
atcgcaatgttgtcttccaccgcacaagggacacctgccaaaccctcactgaacaggtttctgacctttttctttacttaacattccattgatctgtttaattacctccaacatgcagctgtccgcctttcctaatttaatttcataaccgtgcaagcatgcatataacatgcagtctttgtacctacagtttctccttgtcgttttcaattctgtcaatggcctcatttattgacactctggaaaatagcctgttacgcatggtgatcagatataattgcttcctgaaaattaccatgtcctttatgctacgtgtgatttctgtttattatgctgctcatattagtgtcttcttttactccagttccatgattattcatttgtggcattaattccatacaatgcaggaacgaaatttagtgctggtagggcccacccgtgctgttgtgttgtcaatgccggatcctctgatcatcgatgttgaaatgaaagtgaagggcaccactgaatctgaggacaagcgcttgagcttactagctgtgccactcttatgtgctggtaagtattactcacacgtgcttaaatctggttcttacacaagcaagctaagcacactggagttcagacttggctacatcgtgtcatctgtggaggccacaatatctgtgcgtgtcatt

SEQ ID NO: 106910 - DNA, 531 bp, Oryza sativa
tattcacggagtagtaaggtacagagtttcgtaggatggaagaaagaaaacccataagttcggaccagaacaaaatttaccataaggtcaatacataatctaattgttgactgactaccaactaacatggtataaatcaagttaggattagataatctaaccaggtgaacaccactgagctccgaggaacatcactctccctatcagcttgttgcttatcaaccgtagctaacatttatatttaataacttattttaaaatttaggtttttgtttgtcttagtttgtttttcattgagttttaaaccgctaatgataatataagaatacatatttttactaccaattttgttttggttacttcatcattattatagagcttatcaaccgtggaccaaccaatcaaacactggaattttctacaaagaagaaaaatcttaaaaatcttaaaagattctaaggaggaaatatgtagggcctggcagtagaatccaataatcaagatggaacaaaacgctgcagaagaaggggc

SEQ ID NO: 106911 - DNA, 646 bp, Oryza sativa
tcatctgtcggtaaaaggtgatccatgcatgtaaatgccgtcactttatatgtcggctaatgatttgcaaagtcttcaatggcctctagcgcactcagtgaagaaattacatatcatgagcaaattaagatgcactaactgagtccttgtatggggctttggacgacggataggattgtttggggaaatccactacgtgcaataatgtgctagcctgcaacattcatcgatggttgcaaaatcctccatttacaatttgcattgcatagtaattttttgacatgatggactgacggactgtgcaatagctaacaactcatagagtctaaacatatttttcccgtgagctaagtgcctgtcaggaatataatctatattcgtcggtgaaaccgagaccgttggattaaaaagagtttgcacgcgacagcaacaccaggacttgtcacaacatttcaggtacatatacatacgtatatatctgcaaattaaataagaggaagaaaaataagaaggcaaaaagatgatacaaggttattaatttcattttctggacccagtcaagtcgccgtgcagacaggaggagagtatacttttcgattcagaggaggtcttcaaaaactcgtcatgcaatatgaaaaaaaatgcc

SEQ ID NO: 106912 - DNA, 571 bp, Oryza sativa
actagtttcatcttcatcttcagcatcctcctcctgaaacgaatcttgatgagttggacccaatctctggtgaacaggcaactttttctgcacttgccgatcctctctccttgcatgtgatcgacttgaactcccaacatatctccttctagagccaccacatcctgggcaatccttctattgacggcaatctcatcccctcattctagcagaacctgaaaaactcgcaactccaatgaggatcaaaattgcaatcatcttcataatatttttcttcttgcatctcatgcttcctctggtattttgtcgcgtcccaaatcgactctaaaatacatccctcaaattgtgcatagaataagtaaaatccatgtgaaagcctccaacaattaaaatgtgcaaagctaaaagtcaaataaggcttggaggatttttggatatttcctaaaagcctaaaatgcgtaaaaaaaatttagtggaattttcagagcccaaattataatttagaagaaataaaccaagttaaaatggttttataaaaaaaaaaatccctaaaaagtctttttcccccctt

SEQ ID NO: 106913 - DNA, 963 bp, Oryza sativa
caatagaaaaattagtcacacataaagtactattcatattttatcatccagtaacaataaaaatactaatcataaaaaaatttcaaataaaacgaatggtcaacgttggatatgaacagtgtaaaaccacaccttttttgggacaaagggagtattatacaagaattagggttttttttactagattcaccaaagaaagcatatatagtttgatctgagattcataagatcgttctcatccaatggactatataacccgatggatttttggtctattgtgagtttataattctcaaattcctcttatatacaattaatctctaaatttataggtagcagcaagttttgctagccaaattgcatttcttccttaatttcttatattcaaattgcttgtcaaacctccaatataattgtcgacagactcaaactgtggtttaatttccttttagtgacgtggattccacggacacattaaatagtatagtgtcttactatataaagttgatgcccactaactaccaaaactcaacatataagtgagttacatcatcacccactggcaattattatgattattttaaatcacatacaagtctgccacatgatcatccactaccaatgattatcttgagtattttaaataccatacaaatatgacatatcatttataattttattgtatttttaagaactcaatatgcaagcaatgtcgaatcattatcttattattttcacattatttaagcatatacatctatcatttctataactaggaaggtagcccgcgcattcgcacggacatgtattgcacgggcattcatgtggatttgtattttttaaaaaaaacttatagtgatagaatgtatatcaactggatgacacctaccacactttaaaaatactaattttttattaaattgggataaatgttgaacctagtgttagcctttaaccattaaa

SEQ ID NO: 106914 - DNA, 1911 bp, Oryza sativa
caaaacgtattcaacatagtgcatatactttaatggttgtagaacaaatataacttttaagccatcaacttgctttcgctgcgcagattatatatgctataatatatgaaagccctcctaatgtcgcggtatattgtacataatagattgaactatcatattagtatgtaaacgctttaagctggttctgtcaatacaataggcatttttttcccatttaagtgaaaaatcaaagcattttaattcattagtatatatttttatccaattattggttcaatctagttaattttcttgacgagacatacaaattctctcattggtagtatgggctttaaactatttatctacttataaataaattaaacaacagtccaaacaacagaaaagtagatataacgtaagaattatgatcagttgttattgtttctatattaatataatagttaaaataagaggggaggaaggaattgaatgagagaagagagaagaggaggggagagtatgtgtgcatataactacgaaaagagagaatataaggcactggaagaaggacgaccagatgggatatgaggggcggggatttttttttatagattcaagggtttgttggaaccatgccaccctaattttgcaaaatttgagatatgtcacccgtatctcaatgacatgtaggacccacatgagtcaatgacatgtgggtcagggtggcatatcacaaattttgtggcatgtttcaaattttccctagatttggtttggtggaacttggattattaagatctaatgatacaaaataataggtccactgcattaaatggattttggtagaaaaactattataaatatatatttttgccagttacaaatttgatttgtttcagttactattaccttattagctgaaaatagaatgatagttttattaattaataagatctatatttactcattgtttcctatagtatattagtagtagatactaaaaccctgaattatagtagtttatgactaacctaataatgttattttgacttacaataatttcataatgagggaagtattttttttggaacaatcacttacagttaggtccattttactttcattattatcatagacctaatttaattgttgtgaacttgcataggacgataaaaatctatatcattgttttttcatttttttttcacaattggttgagtggcaccgcaactcaacaaacataaccaaaagtaacatatttctttctttcgaatgttaacatatatggaaaataagctttaagtataaatttagtaataaataatatgacaaataagtggataaaaatagttgtatatttttgttttagagttttcttaattttttatcacaaaatttgctttcgaaagtatagcaaaaaaaaatgggataggtacatgatttagagagagcgagtgaataactggggaataacaggggaggggcggatgatgggagtaagcatgtccgcatccacatataggccagggtggtgtttgggatattggttgaaactaatgggtttatcatattaaataaaaattaatagctagatgttttatttttttcatagaattcgtagaaatctctcataatttcttaaagcgtcacatggcggtgcaggaattctccacggatatgaaatcatgtgactaaaaaaccatatttttttacaaggttattaatgtttatgcggcggcttagtctactaatttaaaattatgtagcaaattcttacagtataataatatctattttaagttaaagtacaagtcaatatgggttttaaattatcagtttagttgtaaatataatgttgagtatataaaaaaatgtgatgtacttcctccatctcagaatataccaacttttagctacggacctttt

SEQ ID NO: 106915 - DNA, 1888 bp, Oryza sativa
  unsure (1)..(1888): unsure at all n locations
agcgcgacctgaactgantgcgagatcttacagngacacattataatacttaagcgagggaggaagacgacctctctgagctccatgaagagagacggcagcgatggagcatggaattctcgccaccccaatcatgtcgagcttgccgctaaccccatctttcccgagcttggcaaagggggcgggctccatgtcctcatcagtggagggaggaaggaggagaggggtagcacaatgttatggtggacagtgggcggcacaacgagttttgtggctagccgccactcagagaaggggctgctcggtgaagagagcagctcaaggaggaggagcaaggcggatggtggtggtgtcaccattaaaatccgcgtcctttagcatcccctagtttcttcactcctgagccttgatcagcttgggcagtagtgaaggcgctttggcgagctccatctctctagctaggtagtcgacaatgagctcctcgccccttcactacttctagctgttgttgctgccaaagaggactagcaccagatttgtgccaccacgacatcgtcaccaacctttccattctgttctccagcattattggaccttctctccgtcgtggctacaggaccccctccacgactgtgcgtcaccacctttacctcatccactgaccgccgcatatcttcacccaccattgccatatgccgtggagcaatgccaatctacggcgcgaaagcagagggagaaagctcataggggtggagagagtgagagctatggaggccgggatggagagagctcgccagtaccttcaactactccgccgagcttattagagatgaaggaaagagagagagagacagagggggagaagaagagagggtaaggctgataggtgggacccccctcctctctgtgctaacatgcatggattatttgtagagatggcatctagctttgggtaaagtgtccggttttagtagtttgggattgttaaatacccagttttcatgtttaaagacgaattttagaccaagcgaagagttgaagtgcgtaaaatggagtttttccaaggtaaaaatggcttgtaagagtgggaaatagttaattattctgtaaaggaataagttcaccggaggtccctcaacttaacagcaagattttttgacgtcccttaaccacaaaaccagaaatctccacccctaatctatacaaaaccgttcactcaaggtccctaggcagtatatatgcgtggttatcgctgacgtggcatcctagtcagcaaaaataaataaaattaatatgtggggcccacatgtaagtgagacaatggtgtgggtcccacatttctccttttttttctttttctcttctcctctccgggttctctcgagtaggcgcggcgacagagggtgagagaggtggccggcggcggagcgtggacggcggcggcaggagagggagagagaggtagtcagcgtgacgacagcggcgggaaaggaggagatgtggtggccggcgcgatggcgagctcgggcgcggagatgttcgaacgcgccaggtgctcaacctcgggccctgccgccggcgagcggcgcgctttccccgtcgaccctttctccctccctcgccttctcgtcctacaccgccatcctctccgcgcactcccgccacggccgcctccgggaggccctctccctcttctccacctccgcggtcgtctgccctgacatcgcctcttttctctcctctcttctcttcttcttcaatgagggaggccaacggccagcgggcggagccgcgacgggcccgcggtggtcgagcgcgctagggcggcgaggagcaacgaaaaaggcaagtgagtcgggcggcgaccttgctcccgttcacgtgcggg

SEQ ID NO: 106916 - DNA, 788 bp, Oryza sativa
  unsure (1)..(788): unsure at all n locations
cgcctacgagtagatcgaccntgcgcngagcncanantccgcagccctggagctatacctcggtcagatcaaagaaggcactcaatacatgaaggattgaaagtttgggaaatttggtcgaagaacggccatttggggaatttggggaatattaacaaatactttatttctcttatactacttccaactgatgagataatcgtttggcggcttgcatgtttctaatttatatttaagaccatctgtttccgggtttttcgaatttattttatatcgaacgctaggctgaaaccgccttttcaaaattggtattaagccatcaggaattctgttgagtgagcttgatcatgtgtgtgccatctccttatatgcacatcaccggtcttattcacactctgttacgatttactaggtcatgagaaccatttaaacttgttccgctcgcctgttcttgcttatacccaagccaaacaagagcagactatgcgttgttgggggcgctgtcttccaactcaggggaacactaagacaaaaatatctcttcatgcccttcaggaccttaaacaaaagctggcacgccaactggttctatgttcaaaattctcaatagaccttcctcgaaactcttgtcgtctcttcaatctaccaagaaacaagggttttcattgcttacgtgagatgattcggaccatgcctggaaccgatggtaccgctgataaagctgaaataccaagtttgcttgacaccagttgactcgtcacttcattaaaagcctggtagctaattaa

SEQ ID NO: 106917 - DNA, 792 bp, Oryza sativa
  unsure (1)..(792): unsure at all n locations
ccgcggcattgaaactgaatgactcgcgccttactgcagnacnncatcattgcatttgcatggatagaaattaagctgaccatttcaatcaacactatagtattaagaccatactacaaaggcatgatcgatgtaattgtgtacctgagccagctgccttgaacatgaataaaaactactccctccttcccataacccataatataaggaattttcagtttttgcttgcaacgtttgaccactcatcttatttaatttttttttacaaatataaaaaacgaaaagttatgcttaaagtactatagataataaagtaagtcacaaataaaataattaataatttcaaaaaaatttaaataagacaagtgatcaaacgttgcaagaaaaaaaacttaaaatccccttatattataggacggagggagtatcactggttggctgtggttggctgcagtactcgcaccaacatgggtatcctgccctttcccatgatgatcgtcagatatatcctgcggacgagtgaaagccagcttgcccatcttctttgtgtccattcttttggtgctcatcaaacttgcagtaaactaaaggagtccttgctctgcatgctacaaaatcagtgccaccaaatggcttaagtaagcggcacaanacggttatgtgctcagtgctattttaaccccagaaatgctaccactagaattgttcagtggcggcaacaaattacaacaatgtcaacaataattgcaatntggccaaagaacgaaaattattatccaacccttgttctag

SEQ ID NO: 106918 - DNA, 556 bp, Oryza sativa
ttgttagagtctgttttatttccgttttttgtggcttggttgttacagttcgagtcacgtcctgtaaagccggattcgtgcaagttcacgattaggcgtagtgtagcgagtcgtacgctcacgttctccgccgtgtgggatggcacatgcgcaaatggaggaagtgggagtgcacagagccggagacacgatctacacgattgcatgatctcgttttcgctttccataaaaggagatgaaatatacagaaaagctgcgtaagtttagcggcacaaaaaacttctcgcgtgtgttcttctcttccactgttcatcgtcaagcattgtcgatttccagggattcgtgtgtagtttgatcctgagtttttgccaacaagatcaagatgatgatccaaagtgaatccacaaattgctacctttggtgtaggtagtaatcattcgtgaatcgtgatgaaccccatgaaggggtgttttcaggagggagaggcgccgggaagctttcacgtttttagacaaatccacgaggtaagtaacttattattagaaatttagaatgg

SEQ ID NO: 106919 - DNA, 720 bp, Oryza sativa
tgttttctgttgcctcgctagcttgcagtctctcgttggccgttagctttataaacgctaagttgtcgatgagaattatactttagttaaatctgcactattatcagcatatcctcactacaataattggtaatgaacatgctaacattctaaggatttcttcattcaaaagcaggtcggtaaaatggctctctcggtaataaggtgtgccagtatccagggttagaatagttgctacttctacacacagattattagtgcacagttggactgtaatgaaggtgtaatttcccatacataagaaacataaatcatcacgggtgattgaatccttgtcatctagtgtaaggcatctttcttttatttttgttagcaaaagtatacagtaatataacttttaagacatgatagagtagagtagctagttaggataatggacttaaaatgcacagcttgttgattcaggagttctcacatttgagaaaaatattatgctatatgccgatgcccatgcttcatttctcaagttctttaatatgattcctaattcacaatatgttttatttgaataatgaattaggaaaagcaggtgccaatcattggactggtgatgaatgatagaggttttatctctcgagtgctctgccccaaatttggaggataccttacttttggctctcttgaaaaagaaaaagaatctgcgcctgctcagcccacata

SEQ ID NO: 106920 - DNA, 652 bp, Oryza sativa
  unsure (1)..(652): unsure at all n locations
aatgttgttgggtgatcctcgcttctgcagttttttttcttcaggtgttaagatccttttggttaattttggttttgaaatgcagctcaaaagatcaagtcattgtggattgcagaatgagagggtcacgtttgaagtaactgcagtcagcatgaagctattgtgtagtactagatactggtgttggattgagagggctgcattttgaagttacattggttggcatgaagctattgtgcagatactgtatactgtttttttttaaacaaagttggatactggagttcctgtgactaattgaaaatcatagctctcttggattgagccttccaagctttgacaagttagatttgagcgtgtttgcatatttcgtacgagtacaggaaaatatgcattacatttccatgatactagaatatgaagtaatctggaattagatgggttacgaagaatgtggtgatattttagtgctaaataattttatcttttctctctttttctttatattaatctttaatctatctcgnggattagcaacagaaaacaaaaaaaaaactttttatatgtgtgtctttagcgattaaaaagggcattcctgtaaataaactacgacaaaatacaaacaaattcaacttcaaaataaagttttgaa

SEQ ID NO: 106921 - DNA, 4289 bp, Oryza sativa
tgcatcgaacagtgtacggtgtgagaaggaagaagcagagctcctgaaacagagctccatagtaccagcttatatcatcaagtctaacagatctctgtgtttggaaccagcctgattggaggggagcaaggcgtgcagaacgatctccctaagcccgcccagaatgcaatgcgaccaacttgtttcttgttttgcatagagtgctgcatccgaaaggtcagacctcatattgatattgtgattgttcatcagtagaccaagacaccaaacttttttctcctattctggatcggcatcgtggtatcattgcaaagagaaaaggatgtgttgcaagctttttcactggaaaatgaaaaatccgaccttgcaagaaattgagaatccgaaactagattcatacacgtgtgcctcaaatgtgctggccattaattgttacgccaaaagtatgtagaactgcattcctacactcctgtctgttcagaacgaaagttgactggcacattcaggatcgctcgtccaaatccaaaaccacagcaatacacatcattcttcctaatgagcttctgattaactgaagtacgtactactgctcctgatccattgtagtacagctaaaaacagcagataaaccgaaaatatgaagagaaaaaaaaaacagcaagaacgagaagggagactcccccccccccccccccccactcattgggttaattaggccgatcgatccatctccctcaaaagaggcattgctgaaagtgcagtaactaattcatcctccctcgaaaaactgttctgatccatcaagctactttgacacttagattgctcgcttggcttgcaaaagtgagatctctttgtactacttacttacagtcactgctgttgctgcgcaggctgttgcaggttagcgaacacgtcttgtctgtaaaggatgagcagcaactcaccatctggttcgcccgcaacatgatttgcagcatagatgccgatccggcgaagtttgtcaagctcggtctgaagatatcctccgatgccatcctgctcccggctccagcaatgtaatgcaaatccagaaatcaggtcccagctcgtgattctcttccttgtaatgaggcttgtgatcgttccattcatatataggtccatttggtgagaaacgagcgctctgactgatctcaggcgtgcagcttcacaaaacatcactgctaagcgtgcaattgctctcctttggacatgaagaagtgggtggtcacgcggaagaccattgttgaagttcagtagtctgtagtatgaatcaagtacagacggtggccccactgtaacctcatccctgcaaaattgcaatgtttcaagtcattactaacttcttgtagatcagaaacaaagatattaataattttcttgtagaaagtacaagtttttcttggggcggtactcccaagtcattcgaggccatctgttctagaagaaccaatggttgagtatagtaggtagtaatatatgccatcacttactactcaagggtaattaagccttttgacaccatatccatatgaaataaatgttaaattatcattccatttattataattgcccttactacagaatattctgactgaccatatctttaggaagatgagctttgatcttttactgatattcccttaaaacaaatgaagcattaagaaccaaataatattttggaaaattaaatatagtagaacataaattttgtgaattttaaaatccaaataatttagattagaaaaataagaaataccccaatgaacttaatgtcgaacctagaggaaaaattgataagcaaacttgaattttcaacgctcccagtataaattaaaaatcctgaacaaaaaaactcagatcgtaccaatcaaattcaatatttgaaagcaagagtttgtattttctatttctattatataaatgtacatatatattcttaaacttcagtttgataatttgatattgatcttgaatgtgccctattatcattacctgcgtcaatgcaatcctgattcaaattaatagaatcatttgtagaacagcttattcatttacaaatgataaataaaagtgtacaaatgaataagccgttctacaaatgattctataaatgattctacaaatgattcaattatcctgatacagattcacacttttatttatcatgatacatgtacagtgactaactaagcgagctacacacaaggagggaacatgccataagaattaataggacgtatatgcgtacacgttcacaggtttgccaacatcatttatcatgttgctttttttttaagctcaaaccacagccactatgaataacacactaaacacaattacaattttgtttaccagccgactgcccctatagagtgctaggattagcctcttgaagggtaaaaggagcacattgaaaaaaacataaaatacaactaggaaagctacacttaccagtcctgaagaaggtgaccatagtctgctttcaggtacaagataggttgggcattgaaaatgtcaggggctggtgtgtcagagaagttgaaccactgaccggcaccatttcggatggcaatcaaatatgcatttctttggtcaatgagtatctgaacagatggtgactcaggcatgtcaagagatattatgtgccacccctcctcattgcttgttataggaacattcctgaagttgtggtgtgccctccgctgaaaacggcctccaatatcgtccatcagcttgttgtagctcagagcagacaaatcaaccacgctgatgtggagaattggtattccctgcaagaagaaggatccatccagtgcatgagcagctgcaaggatattcagtttctgcacttgcacttgtccaaaaatcaaaacgatgtcatttcatttgaattcttcaatctttatgtgcacttgggaaaatgcgatacagtttatctacagtgaatagaacaagaaattgtttcacaataaaatattgcagaattggctggctcccccaagaggttggcctgtgcagcaattctttcagtctataattaaataggcaacaaggcacttgcctttcttaagaaaaaaaaagtgcatagctgaatataagacatagagtaccattcacatgtgctacttgtcatatgttttattctcagtggtgtatctaaaattattttttgtttcggagattctcggaacaatgaatcatgcaacttcatttagttttggcaaaggatttcatgttcagctgcacatttggatatgttaagggcttgtttggttagttcctataaggaagagattggaggggattgagggggtattaattccaaactcaatagggttgtggaattaatcatctcaaatcctcttcaattcccatggggagggattgaccgaacaagccctaagggagttcggccacattagcaagtcaagaaaactagggattaattttctttttcaaacaacaaattttacttacattttttagtaacataatggtctctaattattattctcgtcacgacaaatatgttttgttactactgaaattgctaaagtacatgtactaaacaccatttaacacatttgctaccgtaaaaaaagttaacaaggttacatacttccattggtgagcaacttgaattgtgtgctctcttcacctgcaaaatagaacttttctaagcaaacaaatgatacattttgaaaaaaggagtaatagttatgttatttctttctttatctttatatatcatgtatcttaaaccggttggtctttcctgataaattgggatgggagagtggcctatgctgaaaaatggtgactcatgtactactattattaagatttgccaaaggagtcctatatatgtagtaatgatcctattaggcttaccgttccaacttgcgtcgggagactaactagtaggcagttaggcacattacgcaaggccctgtgaatgtgaacagccatactgagtagtgcttaaaatgcaagagaatctcatctgaggcaggtagaaggaattacggcatgaaaaagaatcacaatgcactactttctcttggttcttgatgccttggatgcattgatgaaaacatattatcaacacatacatacatacatacatacatatatatatatatatatatatatatatatatatatatatatatatatatatatatatatatatatatatatatgagattccccttaaagaaaggagatgtgacaattaaggattttttattgggcccacatgctat

SEQ ID NO: 106922 - DNA, 2054 bp, Oryza sativa
acaattaaggattttttattgggcccacatgctatagatcataagttacaaataattaaacgccacattttaagagtggcaaatagttaaatgtcccgagaaaaagtatgtatgtgagatggcttgattacagatcaggtgcaaaatattacctatacaagatgttaatatggtttaattacagagatgcgaaatattaactatacaacatgttaaatatggcttaattactttctaaaaatggcttaattacggagtattcttgatgcgcgcggggttagtagttgcggcaagcttataattagccgcggtggggtgcaccgtgcagacgagcgcgcgctagcggaaactacggaggagacggcggcgctccccctgcgtgcagagcgtgcgcgcgcgtgagggaaagcttagctagcggaaatgagggagggaggggaggcgaagtgagtaggagagagcggaaggtcgtggaggcaggcctcacctctgcgcccgtggcggatcgccggcggcgagcggcgagggtttcttccccgcggcggcggcggtggagtcgaatcgcgcggcgtctctccttcgcccaggtgcgcggattcggaatcggggtgtctcgggagtcgggatgacgaagcttatgtccgaagcttccctccgagccgtcggatcagatccaacggctccagatgcgttcaggcgcgaaacgggattcccccgttgcccacggcctactgtccttatggaattttccgtttttttttcgattttgctatatctcacttgaaagattttttcttatctatcactcgattttctctctcaattttacattgcattttcttgtaagttacagtgtaatttatgaaacttacactgtaatgcaaattttaaattttgtattggatttggtctttttcttgaggatatggtaatttagtgtccattatggtgtttcttaattatcttttgctttttattatatctatcggattttaatccaaagattaaaaatctgtgtgatacgattataaaaatctttcgaaagatgtataggtactcccttttttttttaaaccgggaatttccgttgtgctcgatagagggaggcctggcagggccgtcttaggccgtgcgggccgtgtgaccgctcgtggcccatacttcttatggcccagtccactttgactcctttaatagttggccgaatctaatttatatgcctcaaccagaaatccggataggacgactccccaaactccaatgatattggactccctcatcagttttgaaggacggttttgctaatatggtgatgttgacatgatctttatcccatgtagcgcttatgtgatattagaattaaaaaaatatatgtgaggctcatttgtcattcacatacaaaaatatatattgtgggactcactgacatatggagcccacatatcatcatctctctctcaaacccttcttccacctccctctctcccttatctctctattttctttcccccttcggtcttggcgatgacaggcaggacgacgctggcgagcggacgagggccgaagcggcagcggcggggagctgattcccatccctttccttggctccccagaaaccctaatccatgtgccgcatttcgcctctccctgcgcaagaccgcatcacatgccgccgacgtctactcacattgctcatagattactggccgtgctagccatgggacatgtcgggaactcaaggttggccgcactcgagggcgaggaacgggtaatccgtgcgctagagccggcgccacacctaggtcatcctgcaaaaggaggggagcacaagcaccaagagaggagaagcaccaccgtccaaagaaatgggatgatcggtcgcaatccggagaggaagtggtcagaggcaccggtggtggtggcagaagaagagggggatccacctgtggcggaggaagaagacgaggaagaaggcgtcgacttcatcagcgacctcccagacgcccatcctcggcgagatcattgtccgtctccccaccaaagaagccaacatc

SEQ ID NO: 106923 - DNA, 717 bp, Oryza sativa
aaataatattttggaaaattaaatatagtagaacataaattttgtgaattttaaaatccaaataatttagattagaaaaataagaaataccccaatgaacttaatgtcgaacctagaggaaaaattgataagcaaacttgaattttcaacgctcccagtataaattaaaaatcctgaacaaaaaaactcagatcgtaccaatcaaattcaatatttgaaagcaagagtttgtattttctatttctattatataaatgtacatatatattcttaaacttcagtttgataatttgatattgatcttgaatgtgccctattatcattacctgcgtcaatgcaatcctgattcaaattaatagaatcatttgtagaacagcttattcatttacaaatgataaataaaagtgtacaaatgaataagccgttctacaaatgattctataaatgattctacaaatgattcaattatcctgatacagattcacacttttatttatcatgatacatgtacagtgactaactaagcgagctacacacaaggagggaacatgccataagaattaataggacgtatatgcgtacacgttcacaggtttgccaacatcatttatcatgtggcttttttttaagctcaaaccacagccactttgataacacactaaacacaattacaattttgttaccagccgactgcccctatagagtgctaggattagc

SEQ ID NO: 106924 - DNA, 700 bp, Oryza sativa
tgtggaagcttatgaatatccaaatgaaggatctggttattgacgatttcatggtcagtaaatttgagctcaataatacttggatcaaagatccatttgttactgccactagaactgacagtctcacttgcagctgaactattcaaattaccaacatcctacccttgattgtaatttagaaactcagatccatttatatactatggaggaatcaattaagtgtgaccacctaggaccgcactctacttggtgttattacctgagtttctgaactatgtctccatgtcattagacaaactgattcagttattcatatccagatattcacttatgtccttatgtcgttaaataatgtaatacctttctaaatttgtagcaaagtctagagaaaaacagaacagaagtgcataacttaactttcttttggcttaacctgatgcagaatctgaacgtctgggttttccttagtgttcttcccctcctgtatgcccacaacccttcaagtaattgccaccagcagacctctatgcaggctgcagcacgccagcaggtatttttttattttggatatttgaatttttgtgcagatgtgaaggaatcagtggatagatctagcttgaatgtttgactatctgtcattagatttacacagaaatgagaaacacatgtagcctttgatgtatatgatgttcataggtca

SEQ ID NO: 106925 - DNA, 750 bp, Oryza sativa
ctgcaatgcccttttgtgagattcagatataatacaatccgactcaacacacctgtaatagcagtgccaaggctccttacatgctgctgaacctcacatagataaaaaatggcaaaagtgaacctagaaacaatggattgtcacatgtgacagcagtaattgtaaatcattaatgctctctaaaagtctaggcctgtagattgtaccgatcagatgagactttttcatgaaggcacctaaattgtagtgctaaaaatgctttttctttgggaatgtatttcaaaccacccacggacctaggcgctacctagctggctatcccaaaagctaaatgtaaaggttattcttcaattttagaaggcacactgaattatatgaactcaagcagtttgagttatttttggcatgccaaccctatagatgcctcagaggagatgatgatgcaagcataaacaacagatgtacacactacagctgacagaaaaaaaatgaggaggtactatgagatcataagaaagcctggatagtagatgatttacccatatttttcatagtgttggttttacagtgttaattaatgatcacaagtcgtgccccaaatttctccaggagggatggtttgattcctgggattcctgtacacgaagaaaccatgtagatcaaatatgtaatgctgtcatgctgtgctgatacgttaaaccaaacaatgcaacatttggtcttacctgctaacctcgacgaaagaaaata

SEQ ID NO: 106926 - DNA, 1179 bp, Oryza sativa
cgacattttctacactctaaacgtagttggtctcaaatataggccactgcattttttttatatcatccaaaatgcccttatgtacattaggtgggccctacacgtcatcccctccatctctcttggagcaaggagtcgttgttcaccttgttggtgacgccgtcgttttgctccctcgcatgtcgctgactcgctcgtcttgcgccattggcggctagctttcttgattcaaaagcgagtaagcaatcaaacttcgccgcaacaaagagctactccctccgtcccaaaatattgtcctctaggcaaaggatagcgacaaccttagttggatgagggaggacgcgcgtaggggcgcagcgtccacagcaactggcgatatggggcgtgctccgggcggcaatggacgtcgctggtgaggggcggagtcaaattcaaatttgaatcgggtatgtaaactttgacttataaactttgggtctataaactttaggtgtataaactttagatgtatagaaatactatatataaaaaatatttgaattcaaattcaaatttgaatcggatatataaacttttgatttataaactttaggtctataaaatttagatgtgtaaacttaagatgtacaaactttaggtgcataaatttactaaaataggaaagtaatgcggtgccaaaaaaggaaaccaggtggaggaggggggagggggcgcccaggggcgatcgatcgctccttagcatttccggagaccggtatggtatgtatgttaattagaggctatcacgttacaacagttaagacaatacggtctctaaccattaatataccaaaatactttattactagtcatctttcctttattagactcaatacaatgaaaaatttcctaataaatgctaagagttgactctatgccgttgttatgcgtaacaaccatatttctctttccttcttcctctctcttccacgtcaccaaatatgcttgcatgataataaagagagatcgctaataaagaccattgcacatgtcctaagaaatgtttgaatcaggttattttctaccattccattttttatttgcatgcattcatttctaaatgaagtacagtgaattacgttccatggatcatacaaaaaaaatcatgccccttaattatgttgaatcaattgctttgga

SEQ ID NO: 106927 - DNA, 1009 bp, Oryza sativa
aggtcccacacacggacgtcacgcgatgccgcgatctcatcggatgattttctctgatcacgcgatcacagagccgcgccgccgcgggcccacgccacgcgcgagcgcctgcgcgacccggcgcccccatgccgcacgcccagtcccacgccgccacgcgcgacccggcgtcaccggtcatccacaagcttcatcgcaacaacatcatcatcggtcgcccatgagattcgttgttgctgctaccgcttgtctgcgaggttcttcgccgccaccggtggtcgtcggcgtggttcatgggtaatttagtgcaatctattcttatatatgactcgtactaattaagttttaccattttgcaggttaaaaaaagactaggcacatgagttctctgcttttagagacctttggtctataagcctcctgatgtcttgattcatctaatggtggttttcactgtcacatatgagcatgatgatccaatcatatactttcttttaccaggtctatccaatggtcctaattattgcagctaacatcgctcatcctcctttcaaaagctgctttggctgtgtttttttttttggaggggttgcccctcccctctgcacgtaaaatgatggagtgatagattaacgtatgattaattaagttttacattgtgaaacggagggagtagctataaaaaaattaaaaatgtattaatatgattttctaaaacaactttcctatataaacttcttgcgaaacttaaaaaacaagaaagataagttgggaactcatgagaaagacagccgtacacttgtctgtctgtaaaatgtgcctcaaggacaaatgtgccaacagtatgaagagttgcattcctacacttgtctgtctgttcagaacgaaagtacgttgattggcacattcaggatcgctcttccaaattcagaagcgccgcattacacatcattcttcttaaggagctcctgatcattgtagtacagctaaaaacgtactgcagagaaac

SEQ ID NO: 106928 - DNA, 577 bp, Oryza sativa
atacccacacccgtgcgggtaatgggtactcatacctatataattgacctgtaacatttataattttgtactctaattagccatattagatctgtaaaccatcaatatttttcctaacaacaatgctattaacattagcgttcaaaggcgagtaaaaaaactttacaatcacattacataatcaagaaatcaaataataatttcatataactagactagaacaatgcttaagatgcgaaataagttttatgctatgatttaatagtcgttgagacttatattactcatagttttatgcttaatttacgggtttttcaaccaagggttgatgggtacgggtgggtaaagaatggacctatacccacatactcaatgggtaagagttctcgtccgttagtagacccataaataaagagttagaacatgattagcttctaataaaataaaagctcatagggtgtcgggtcataggtcccattaccatctctagtcatgcctccccgtcatcgtcgttggcagctcaattggccattcggcggcttgatgccccgatgaggaatctgctggaatgagaatg

SEQ ID NO: 106929 - DNA, 561 bp, Oryza sativa
ttacgaggatgttgatacttagttatgtttgctgattttggttttgctgtggctctgtggatccagtcctggcctattctggtgctgtttgacttcgtcaagcatcaaaactgtctgttttcgtttcctcttaaagacttaatgtgatgtgcaagacttttgcatgttcttgcaaaagctttggacggcatatcttggtattaatgcttggaaacatcctgaagctatggtttgatcagaactcaagatgtggctcagctgtgttcctggtctttgttttcacaggacagggaaacactctagctaactaccattgagcattgtctgctttactcatcagatgacaatattactagactctcatcaaacaatacactagccaatgcattggatattggcattgtttgtacatcacagagtaatgctttgtgttggcatttagagaggtttatgttttctagtatcccaatgcaatgtcaactaggatcaaagaaggtcctgatcatttgacatatgccttacaaacagagttagcatatagaacagttacttcaatggatt

SEQ ID NO: 106930 - DNA, 696 bp, Oryza sativa
attttgtactctaattagccatattagatctgtaaaccatcaatatttttcctaacaacaatgctattaacattagcgttcaaaggcgagtaaaaaaactttacaatcacattacataatcaagaaatcaaataataatttcatataactagactagaacaatgcttaagatgcgaaataagttttatgctatgatttaatagtcgttgagacttatattactcatagttttatgcttaatttacgggtttttcaaccaagggttgatgggtacgggtgggtaaagaatggacctatacccacatactcaatgggtaagagttctcgtccgttagtagacccataaataaagagttagaacatgattagcttctaataaaataaaagctcatagggtgtcgggtcataggtcccattaccatctctagtcatgcctccccgtcatcgtcgttgcagctccattggccattcgccggcttgatgccccgatgaggaatctgctggaatgagaatggaaagaggagaagaccgtacttgttgcggggaagacgagatgcccgtttagaactcctccaatacccataaaacggagcaaatccattttcacatgattaattaaatattaactaaattaaagttaaaaataaattaatatattatttaaaatagtagaaaaggttttataaaaaaatacat

SEQ ID NO: 106931 - DNA, 724 bp, Oryza sativa
  unsure (1)..(724): unsure at all n locations
atttttaatctttggattaaaatccgatagatataataaaaagcaaaagataattaagaaacaccataatggacactaaattaccatatcctcaagaaaaagaccaaatccaatacaaaatttaaaatttgcattacagtgtaagtttcataaattacactgtaacttacaagaaaatgcaatgtaaaattgagagagaaaatcgagtgatagataagaaaaaatctttcaagtgagatatagcaaaatcgaaaaaaaaacggaaaattccataaggacagtaggccgtgggcaacgggggaatcccgtttcgcgcctgaacgcatctggagccgttggatctgatccgacggctcggagggaagcttcggacataagcttcgtcatcccgactcccgagacaccccgattccgaatccgcgcacctgggcgaaggagagacgccgcgcgattcgacttcaaccgccgccgcgcggngaagaaaccctcgccgctcgccgccggcgatcccgcacgggcgcagaggtgaggccttgcttcacgaaccttcgctctttcctactcacttcgcgctncccttcttcncttaatttnncgctagctaagctttccttcacgcgcgcgcacgctcttgacgcagggggagcgccngcgtctncttcgtagtttccgctagcgcgcgctcgtctgacggtgcaccccaacgcgcttaatataagcttgc

SEQ ID NO: 106932 - DNA, 1208 bp, Oryza sativa
ccgtattcgagctatccatattcgttttcctatccggtaaaaaatatgaaaacgaatatggtatgagcattatccgttcgtatccgctccgttttcatccctagcgctagagactcgaagcatcccagagatagagaagcagagcaacaacttgtgaagcagaagttctccctgaagacctctagcatggcatccatcaacactgcaaaactaaaaaatagattcaacctaatttttttttacggggagattcaacctaatttgatttaaggttcaacccatcccatctatcaaaccaaacacacgattacatctcactaatttcttttacttttttccctcttttttcccctcttatcattttcccattcttttcttgtgccccaccccgagttttcatcatgaagggtgtctggctaggagcaagaagggggacatacaagggcagaataaaaaggacaggaccagacacgtggatgaaagggagagaagaggactgcttgacaaggataaaaggaaaaagaaggagaaaaaggaggaaaaaggagacaaagaggtgatgccatattgcatttagaatggtgcataggggtgtgttcgatagcacaggttaccaacccgggcacacagtacgcgcggaaaacggagcggtctattaacgtgtgattaattaagtattagctattttttcaaaaatggatattttgatttttttaagcactttcgtatataaacttttttttaaaaaaacgcaccgtttagtagtttgaaaaacgtgcgcgtgaaaaacgaggtagatgggttgaaaaaagaggtgccgaacacacccgggcgtgttctatacttctcctttttcaaattttactttctcatttttcacatgcacgctttctgactaaacgatgcgttttttttccaaatatgttctataagaaagttgttttaaaaattcatattaatcactttaaagttttttaagttaatacttaattaattaggcgcaaatgaatcgctccattttccgtgtgcaggggagaaatttccaaacggtacattcaaacacagctttagggttaacacagtctaaaaatgcattttttgagtttatcgatcaaatgtcacccgtaaaataagtttaagaaccattagcgtattttactcaaaatcgcatgtgactgttgcaagtacttacaagttacaattacatg

SEQ ID NO: 106933 - DNA, 585 bp, Oryza sativa
gttgatttttgagccacttgatattctcctatattcgtgcaggtgcggtacgggtacattgtaaatacatgctgactattttttggtaaaaaatatggcgccataaatatagctgctcccttgattaaagtagaacaaacatgcatggccgtgggtccgtacgtggcacaagctaactgtgagcgatcgctgcatgaatattagtagtacgagacaaaagaatgttactcctttctcagtactgccaatgcagtgaatctagttgattcatttcttttaacaggaagctagtgagtagggaacaaatactcccaaattatagtgtatatacttgagttacatctcaattataatataattatatcctacttacatattaattacatagtgttaactaagatataattacaccgtaagtaggatgtaattacaaaaataggataagaataagtaaacaactgatgtgcacgttaatgatccaccaagattgattaaattaccgctggggaagagctttacttctagttagcaaccttttttagttttggttgtgcaaccggatgccaatccgaaactaaagatgta

SEQ ID NO: 106934 - DNA, 642 bp, Oryza sativa
ttagtcttgattatttcaaccgagactaaagatagatatttttagtcattttaaccaggactaaagatatacatctttagtttcggattggcatccggttgcacaaccaaaactaaaaaaggttgctaactagaagtaaagctcttccccagcggtaatttaatcaatcttggtggatcattaacgtgcacatcagttgtttacttattcttatcctatttttgtaattacatcctacttacggtgtaattatatcttagttaacactatgtaattaatatgtaagtaggatataattatattataattgagatgtaactcaagtatatacactataatttgggagtatttgttccctactcactagcttcctgttaaaagaaatgaatcaactagattcactgcattggcagtactgagaaaggagtaacattcttttgtctcgtactactaatattcatgcagcgatcgctcacagttagcttgtgccacgtacggacccacagccatgcatgtttgttctactttaatcaagggagcagctatatttatggcgccctattttttaccaaaaaatagtcagcatgtatttacaatgtacccgtaccgcacctgcacgaatataggagaatatcaagtggc

SEQ ID NO: 106935 - DNA, 683 bp, Oryza sativa
atgttggcatgatgcttttttggttcagtataaaaaatcaacacttcctcaatcctcatgcatatgaacattgtgcatggatcacatctctataacttaatacaattgatattaatacttgtatggctttagataatagaaacgtttgcatctccagctttggtcattaagcacagaaccagtaagttttaatcaatttgataaaacaaaagacatactgacgtgtaattcttctgcgcgttcgtggaaataaaaaaaagacataagaagctgagacaaatccagccacaacatcttataaatgataacttgctgaattaacgataattttttttatagatgccatgtaaagtggaataaaagattataataattgtttgattgattgtataagacaatgaagttgatgcgggctaccattagagaatatatcctatgcacacaagcttcccgtgcacactccgtgcacaccaactatcaaatggcatagaaaattctaaaaaaaaattgaacacacacttccaatagtattgcacctacgtgtgaaatgctatcttaaaattcattatattttagctgtaacaaaaaaagataaaattttgacagatttttacccttaaaactattagatttttcactttttttgatagggataaaatacaataaatttgaatatgacttta

SEQ ID NO: 106936 - DNA, 719 bp, Oryza sativa
tcatttttagccatggttcaatagctgtcgggccatgtcagccccccacttaccaattcgaactaaaaattgatctttagtcttagttggtgttaccaacccagataaaagatgcttccatggttagtttcaaaagtatccaagtcatcatatgtgtgtagtagatgggatgataacgcgagtgagggctgaagtgagagatcttgagtttgagtctcacatcccacatatttttttttaacttggtatgatggacaactaatctcacatcccacatatatgtttttttttcttggtatatatctttagtcttgattatttcaaccgagactaaagatagatatttttagtcattttaaccaggactaaagatatacatctttagtttcggattggcatccggttgcacaaccaaaactaaaaaaggttgctaactagaagtaaagctcttccccagcggtaatttaatcaatcttggtggatcattaacgtgcacatcagttgtttacttattcttatcctatttttgtaattacatcctacttacggtgtaattatatcttagttaacactatgtaattaatatgtaagtaggatataattatattataattgagatgtaactcaagtatatacactataatttgggagtatttgttccctactcactagcttcctgttaaaagaaatgaatcaactagattcactgcattagcagt

SEQ ID NO: 106937 - DNA, 988 bp, Oryza sativa
gttttcatggcagtttacatcagaaaaaaaaaactctggacggatctgattctggtgggtacagaagaacaaggttttctacttttcccttcattaactaataatttgatagattttagagggatgcaattaacaatcagcattggtcattttctattccttctatgatgcctaaatatttcccctagggaacacttaatgttcagactgaaaatatcagggtagagtacataatccctcctaagtttgcaaagctacaacagtttatctagaaatacagtattgtagcaaagtaatatttcatcgatcacaccctcataaccagaaaccatatattgataaaaatgtaaactacaaccggcattaattgctcagcaatgattattcagtttatttaacatttgaccacccaatttctcaacttatactgtagatgataagttatccagcgccaagtttccagaagcgatgcatatttagtttagtatgtaacgctattagcatctagtaattctaatggtcttagcaactaataactctacacgttaacaaggatagagaatatcctacggttataaatatgatcagagcaggattacttactatttaatttatttctgcttttggcttatggagaaaaaatcagttagtggtgagatgatctcctcatacctgatagtatggagttcttttgaaaaggtaaatattgatatcatctttatggtgccttttcacccgtttctttgcaagtcatctcttatcttgaccgttcctccaaaccagctcaaattatttcagtagccacaagcccagtaaaaagggacaaaggctaagccagtgctggtgtcaaatgtgatgccgacggccacaacatcctgaatggatccatctgccaggtgaaatcagtgcaagtcacactgaacggtgagtgttctctgctctgctccattcacacgccataaaaaaatttacagtgtcacacaaggta

SEQ ID NO: 106938 - DNA, 584 bp, Oryza sativa
atgggtcaattattaatttcagcactaaaaacaaaagtgatcactaaaaacaaaagtgatcaataattatatagcgacagggcaatcgaaaagaaagagagaaaaagaacgaacaggcgtccatgcatcctgggctcgtggccggtctctttggtcatggacactgcaaattctctttgcaattaattgatcatcaagaggcttcaggaagaaactaagaagcctgagatgatgtgattacgcgaacatatccacctactaactgccggccggccgggccggccggcaacatcacgtaccatcgatggatatgatcagcagtgggtatatgtgagacaattagtggttcataattagttggtcattttctaatcgtgtgttgctactagtagcaaccatggccagtggtaggcgtcgatcggtattcacgctagtggtaggattcgatcatctcttcccattaattctctctctgcaaaaatcaaaagggcacgcatgcaatgcatgttatcatgatcagtcgtcactcgaccggtcctgcaaagtgtaattaaagtagagtggaagggcatatagctaatggg

SEQ ID NO: 106939 - DNA, 815 bp, Oryza sativa
atacattacaacgggtgaaggctattttaattttattattgttatatgggttagttaagataaaaattactctgagaattcgcttggatatatatttttctagaaaattatgagttgcaattaggagcccaatcatctcagattagcatgcgagtttttttaaaaaaaaaattttatatgacttcttctatattttcaaaagcgaacgaacttataacttgactcagatacgaatctgtatttctaaaagcaaacgaacttaaaacccgactcatatacagataacttattaaagtaccgataaaaactatagatatgattcgtatcttagttgcggagatagacaggcgcgcggctcatgggtcaatggcgcggcacgaccacgtgtcgaagtactagaaatttccttgagcctaataattaaccacaagatcgaccaaagtcgcacactctaactagctagctagccagaaacaattaatgtgataaaattgttgccatatgccggtgaactgcgttaagaataagagaaaatttcctgcgtaaccctaaattttgtccaatcccttttatatcctgagatttacttattttcattcatacccctaaatttcagtttatatcctttcttttatatctctttcgttagttgacagttaaatttatgaagtatatcgatggagtatataaatttattgtgtgtgactaataaggcatgacaaccaatcacacttctccatataataataagtctatttttcgtccctgaactctttgggtgtgtcttatatggctggagcaagtctattttgtat

SEQ ID NO: 106940 - DNA, 705 bp, Oryza sativa
tccaaagtaattatttagttgactaaataatagatgaaaatgattagcaagtcttaatatagttttatgcattttaatgcacataaatataaaaaacaatttagagatatatcaatgctgacatcagaacctgatacctatcagtatcatattgaaaaatggattaatctgatattttagagcaactttcatatagaaagttttcgcacaaaatataccgtttagcagtttgaaaagcgtgccacgagtatccaaaatttcatctccgtcttgtcggagaaacgaacaatatggtcatcattctattggctgaatgctacaccattctgttgtaggcatccactgtaattgaggcatttagcctattccccacacatagataaagcaaaactttaacaagcctcaaaagaattacataaagaaggaagaaacaaaaatctaccaaatacaagcagatcagcccgcagcctttttagataaagcaaactttgttgtcaagttgatatgcaaaaccacttccagcttatatacgtaactagaatataatataattaatatcaacatccagccactttcagcaggaatatagagttagaaaagttatgatgaaacgtacacgatggagaatatagcgatgtccataactagtactatatatgaaaaaaaaaaagaatggagaaaggtcaatgcaaaatatgagactgt

SEQ ID NO: 106941 - DNA, 617 bp, Oryza sativa
actttgtaaaagctccacctccagttcttcatcatcaagttatgtcatgtctgagcattgtgtgaggcgccaattttccgaaaggttcctagcatgtgatgtcaaagaattatctttatcaggcaatattcaagtctttatatctaactggaaagtcttccattaggtagcgattatcagctttgggaagtgacaatggcaaggtctcttcgtccacagaatctcggtatttcaatggaacgacttcaatcgaaaacctattttggctggccgactttgaacgacttgtgggtaaagatggtccagtacctatttggaaaaatctcattagacatgatgacatagtagtatctatgaaaatgtgtaaaatgacagattgtggcatactgtcagtcatgtcctttgtcttgtggaggagaaatgtcccaaaaggatggtcacaaaaccacacagctccgtgacaatttgtgttggattttgtcgatcccaatcctgcacgtaataaactatgctatcacaaattgaggaaataaactttccataaggcattaattgttctttgaagacagccacattgtgaaagaaaattaaggtgcgttatgcaccgtaacaacatt

SEQ ID NO: 106942 - DNA, 767 bp, Oryza sativa
tttgaccgttcgtcttattaaaaacttttgcgaaatacgtaaaactatatatatacatataagtatatttaacaatgaatcaaatgataggaaaagaattaataattacttaatttttttgaataaaatgaacggtcaaacatatttaaaaaaatcaacggcgttaaatatttagtaattaacggaggtagtatatagcgagaagatatttgcatacgtacgatcatatctgtagttaaccggtatatcattggagcttcacaattgcttttttttttcctcgctacacctttcatcacttctatgacgtacccaacttgtcataaacattcggcttaatttcacacaaattcctcaattgcttaacttttctgaaaccaaaccggcagaagaactagcaattatatatatttcaataagcatgagtaaaaaccctagacagaaaggaaattagaaaaaaaaaacttcatcctatgaaaattttgagttggattaataattcttttgtgtatgaaatttcttaagtgagaaaaatccttcaatatacaacccacactttatctggattgttcaacttcattccaatttgaaaattttcttaattcaactcaacggaaaaaagaattccaactcaaaatttggtaacatcttaagcaagaatgcacactctatgaaaactgcccagtagatagtacacagttgaacaaattggaattttgcgagcacatctacactgtacttggctagcttggaaagttcatatgccg

SEQ ID NO: 106943 - DNA, 692 bp, Oryza sativa
gataacataatgatgatacaatatatcgtgaatttgtgctgaacaacaaagatacaatctcctaaacatttaacatgagtctatagttatctctttatgtttatatgattagtatgtaccaatcattttagaaattagaacaattgtagcatacgacattgtgtttgatcactgaatgacagctactaccattttacaatttctacgtgtgcgcgtgcttttgtcaatcgtgacagcatagcgtcttgatgatgtagttatccatctccctgtcgaattttaattcttttgggttgcaaatctcattcctctttcctgcaaaccagctccatttgctcgaacgatttcagtgtttttgccaactgtgacaccgacttgtggccacatcctgatgcccagtaaaaaccattgcaagtcaagacgctgcacgatgaatggtctctggggttggttgacaaatgagaaccggtgacaacgaatgctggccgtgctcagtcagtctgctggaccccttcctacatgtgtcaccgttcttcaacacaacgtctgaagtttgaacattttttgtgttgaacattgtgcttctctgtcttcatatgttgcaggaggaaagatggagaaagtgctgagagtagccatggaggtgatgagtcggcaccatgctcccgatagaagcctgtgcttactgttac

SEQ ID NO: 106944 - DNA, 579 bp, Oryza sativa
acccgactaatatacagataacttattaaagtaccgataaaaactatagatatgattcgtatcttagttgcggagatagacaggcgcgcggctcatgggtcaatggcgcggcacgaccacgtgtcgaagtactagaaatttccttgagcctaataattaaccacaagatcgaccaaagtcgcacactctaactagctagctagccagaaacaattaatgtgataaaattgttgccatatgccggtgaactgcgttaagaataagagaaaatttcctgcgtaaccctaaattttgtccaatcccttttatatcctgagatttacttattttcattcatacccctaaatttcagtttatatcctttcttttatatctctttcgttagttgacagttaaatttatgaagtatatcgatggagtatataaatttattgtgtgtgactaataaggcatgacaaccaatcacacttcttcatataataataagtctatttttcgtcccctgaactctttgggtgggttctatatggctggagcaagactattttgatttccttttttttggggcttacccttgct

SEQ ID NO: 106945 - DNA, 650 bp, Oryza sativa
ttcatgaaaaggcaacctgacaagcaaatttcgtttgcatgtaagaaagaagacttgaggtacgacatgattactggtgccgaattttttttcattaaaccaaaccagaaaccaaattaaatgaataagacacgcatccccatatctaaaaacaatttgagctctaactgtgatggcgggtaatcattttctatctagcctcctctagcagcaaccaatagaggccattgcttcatttatcagaagggtgatctcatgcaccatattcgatcagttttcatggcagtttacatcagaaaaaaaaaactctggacggatctgattctggtgggtacagaagaacaaggttttctacttttcccttcattaactaataatttgatagattttagagggatgcaattaacaatcagcattggtcattttctattccttctatgatgcctaaatatttcccctagggaacacttaatgttcagactgaaaatatcagggtagagtacataatccctcctaagtttgcaaagctacaacagtttatctagaaatacagtattgtagcaaagtaatatttcatcgatcacaccctcataaccagaaaccatatattgataaaaatgtaaactacaaccggcattaattgctcagca

SEQ ID NO: 106946 - DNA, 706 bp, Oryza sativa
atccattagcacccatggtttcatcgacttgcttgtttatttactccctcctttttatatcataaagtcaaacttctataaatttagtcaaatttgtatgaaaatatagcaactctataacatcaagttaatttcattaaatctaaccttcgatatattttgatattatgtttgtttagtgttaaaagtattactatgtttttcctataaatttgataaaacttaaagaagttgattaagggtgtgtttagattcaggggtgtaaagttttggcgtgtcacatcggatatatggatacacatttgaagcattaaacgtagtctaataataaaataaattacagaatccgcctgcaaaccacgagacgaatttattaagcctaattaatccgtcattagcaaatgtttactgtagcactacattgtcaaattaaggcgcaattaggcttaaaagatttgtctcgtaatttacacgtaatatgtgtaattagttattttttcgtctatatttaataatccatgtatgtgtccaaacattcgatgtgatgggtaggtgaaatgttttttttaactaaacaaggccaaaataatccatatatatagtccataatgcatccctatcattgatcgcatcacatgtctaggtttttctttttcttgagaacacacatgccggcctaggtcaaatattattttgtacgttgcat

SEQ ID NO: 106947 - DNA, 827 bp, Oryza sativa
ggttaccttcttgtcaccattcctaggctatcatgcgttagtgtaaacctatttgtgatcattattggtgtagaaggttcaggtgggtgctttctgtcattcttcctaggttgccttttcctacaaaatatgcatatgcgattgattaatcaagaaaaaaataataagctgtaaagatagaaaaagtaatatatttttttctttgtcccattcattgggcacttgttgcaggcaggtttttcaatccaatcacataaaaaaaacatacacaggctgtgtttagtttccttcgaacttttaacttttccgtcacatcaaatgtttgggcatagagcattaaatatagataaaaaaaccaattatacagtttgcatgtaaattgcgagacgaatcttttgagcctaattacgccatgatttgacaatgtgatgctatagtaaatatttgctaatgacagattaattagacttaatagattcatctcgcagtttacaggcggcatctataatttgttttgttattagtctacgtttaatacttcaaatgtgtgtccgtatacgtcaattttttttttgccaaaacaactaaacacggccacaatccctctgtgtttaacgattaggaaatgaactgctgcaattgccgattgaccgagcgccgttttcgtatatagggtaccgttttttattatttttaaattttgttttatcacaattttttctgcatcgtactgatatcgatactgagtagtttaataataaatatagtcgattaccgaccgatcgagcattgtttcgaaagagatgctaccgatttcgatcgttttc

SEQ ID NO: 106948 - DNA, 670 bp, Oryza sativa
tctagtgttgaaaatatttctatgttttctataaatttgatcaaatttataaatatttgactaagaaaacaaaatcaaaatatcttcactactaaagattggaaggctcccgtgtgcctacgaatattactgggtgtttctctaaacacacggtaacttaccgtgcgtagaacaataaattcgggaaccatcaagcacataccgtgtgttaggattcacgggagcaccggaatccaccgctttccatctgtgcgcgtcgagctctattggcgtgtcgaacaaaatgttaccgtgtgaccccagtgcacggtaaaccaccgttctctgttacgaccgccgttagcccgttacatcgggagtgctaccgtgaagtccgaatttttagtacactcggtaagattttcaaccatcctgtgcgttttcatgcaaactcacgggccacacggtaaaccgattaaaccaccgtgtgagcgttaccgtgagctagaactcgataacggcgttgatgtgtgtttttggctggttccgggggttttgagcacacggaagccttcccatctctagtagttagcttataatataaagcgcaagaaacataattttcttaagtggatatatttggatatctgaaatatatgaacatataacatggattatatttgtagggcat

SEQ ID NO: 106949 - DNA, 719 bp, Oryza sativa
agcttcttttgtacttggattcatcttgtccttctattgggctggaccaggggaaaaattgatgccaaggttggagactcttcactgtgacgattgatgatcattaaatccatacctgtgtaggtgacaaagttgatccatgtattagtaatagttgcagataccttcaagtcactacgagatgtactaggtgacatgaaaaaggattaaaggccattattgtatcatccttaatgtacaaatgctgaggtaagcctaaggttgatttgcatagtcctattgataaacggaggtggctgtttttataggtggttattttcaagttgctttggttactgaattttttcttgaatttatttatgcaaatattgaagtctttagttctttacattattcattctggctgaatcatcacaatccagtcactatattaaacccaattttttattgaagcattgttggtgtacctagccaagaagaattaatttggtagagtttatgagtgagcaagtagaaatattagaaccaaagcaataccaagtttaggaaggaaagatcaagaaaaggaagtagtttagattgcgaagagcagcctcaaatttaagaaaacgtacagttcactggaaaacatgttctttgtcttctgtagatgacaaaagtagtagcaggattttttagaagaggctttgtcctatacgcaccagccatttccattcatt

SEQ ID NO: 106950 - DNA, 609 bp, Oryza sativa
  unsure (1)..(609): unsure at all n locations
cttataccgagggaaggaagaaaaagcaaaacaaaaattgtagctaagaagaaaaaaatacggtggctatacacaactccgattggaggaaaggggcaaaaccacagtacactcccaagaaatctccaaaagcagcaatacccattaaaggccacagatgaccttacgagcggatggactgcagagccagtgagaccgaagagagcgcataatcgaaaaccctggagtcatgttcaaaactgaattttaaaattttgataagatttatctgaattttatcagttgttttcgccttttcggttaatcagtacacttaccatgagtganttttatccagcatcggaattatgaatagcatgctgcataccctgcctgcgttgcatgcttgccaagagtggtcagaaagcatccctgcttcagctccactcctacatacagatgaggttagcttgggaagtttatctgacttctttttgtggcagtcacctctcttgcttgtgctatggggaactagttgcttggtggcagtgtgctactgaagtgaaagcaaagaactacctggagncaaccgatgatccactgatctcggccctttatataattctccaa

SEQ ID NO: 106951 - DNA, 665 bp, Oryza sativa
tattgtgctagggaatttgaaaagttatgagccactggccttatgcatgggctcaaatctcaaaaactcaaagtatatgcatattcggatgacgcataatcataaatgctaggtaattttctatttgctgctgccagtatcggatctagttgacaattggaatttaacacaacaatcaacaattaatgtcaccggggtctaatatttgttttcaccggggtcatagctggtaaaataaagaggatatgagaggttaaaataaaatcatcggggtctactgacccccgtaattgactgtaccttcgcccctgtgtgttagattaagattaatggtcacatttttttggatggatttagagatgatgtggaaagatatactctccttgtttgttaaataaatgatgccggtaacttttaacatagcgttaaactattccgcgcattcaatatatatatatatatatatatatatatatacgtattggatgggccatcttttataatcaaaagaactgtcagtacttatactttaacatattattaatattttgcattaaatgacatgtgaaacattgacagtcaagaagcaaaaacgtattgatcgtatgacttatgaagttcatgcttaatatggtgccatctgctgaaacacactataatgaagc

SEQ ID NO: 106952 - DNA, 546 bp, Oryza sativa
ctttctggaacatttctcctccacaaaccaaaggacatgactgacagtatgccacaatctgtcattttacacattttcatagatactactatgtcatcatgtctaatgagatttttccaaataggtactggaccatctttacccacaagtcgttcaaagtcggccagccaaaataggttttcgattgaagtcgttccattgaaataccgagattctgtggacgaagagaccttgccattgtcacttcccaaagctgataatcgctacctaatggaagactttccagttagatataaagacttgaatattgcctgataaagataattcttcgacatcacatgctaggaacctttcggaaaattggcgcctcacacaatgctcagacatgacataacttgatgatgaagaactggaggtggagcttttacaaagtctatgcatatgacgaaattatctgttgataactcttttctggatgatgattgctctaatatggaggaaaacagggattgttccaaccttaaagccagttgaaacttgagagag

SEQ ID NO: 106953 - DNA, 3421 bp, Oryza sativa
atatcaaccaaactttaatttaacaatgtaggtaagtggtaaggattaatacaaaattttcatgtacataaccactttgaagtctggacaatagatggggcaatccatactgaccaagaaaatctggaagggggattcaagtagctcaacgttttaccaattcgcattcgtactatcaaggagactatgggtgaggcaatatcaggctggtggctactgcttcgccttatgtttatgtttctagctactaaagaaggtcagtgcataaatggatcgttgaaatgacaactcctgatgcctcctaggccaatatccatgcataacagcacaactcgatgcatagccatcgaaattgtgtgatctgcctttatcaagtgttcatctatccctttctcagccagtagaatttcttgttccttatctgatcttcaatttgtaaaacatttcattaatttgatgcaattattcaaccttctcattgcagttcaatgtgacacatacaatatatatgtataggccaatcatatgatgggagacaagagatatatcattgcttttttatacatcggataatgttccactcagttccccggagagcgactcctagaatgcatgaagttaaacctctaactctaaaattattcgtagattaaaaaatactagccgccaactcgtgcgttgcatgggctctatcaatataatataaataaatatataggttttaatcagatgtcgaaactttgattatttgtttttcaaaatatctctctaaaaggcaattagcaggattgccccctacaactttaccttatttatattcttgattttcccacacaactctttaataaatagatagagaataataaaaatatcaagtaatttaattatcatagaataattaaaaattttgataatagcaataaaatcttagcccacgttgaacttcgcgtgtggcaggcaatgcttgcactgcaagatttttgtaattattgaattgctaaagaagacagccttttgattatctatttaaattagtaatagaaaggtttactggtgtcgtaattttagattttttttgatcaagtaaattcaaactgtacaattaatcaatgaaaagtactggagcataaactgttctttgggtatatgatctatacttccaaattttaaaaaataataagtatcatgatgtacttgtctaaatatctattttgtacgctcaaaatttagaaaaaaaaactatattagtgagtcataactaatgtgacccatagttaacatgattatgttggtcgccaacctgtgcatcacacgtgctattatataattattataaatattaaaaagttaatatgctaaatgttacttttctaattatacctatttaaaccaaaaagggtccacatcaaggactgcatacaaattattaatttcaaacttcggaattaaactaataaaatactataaaacaggagtcaacttcatatttattcatttaaattttggaattagcatttttttaggaaaaaactgaaactaaagagtgtatgatatttattaattcaaattttggaatttttcgaaaaaaactgaaataaggagtggatgatatttatgtaatattctattgctctagaatatttcaattgaaacatattctgttgtgttttacttaaaattatacttatagtgtacagattaacaaaaactaattaatataatcgagagttaaaatactaagttatttataattcatgcaaaatcttaaattgagagttgatatttcttaatatatgcatgtttgtaaataatgacatctaattgaaactgcaatgaagttttatttatatttgcattataggtgcaacaaagttgttttattttgtggatcaatacctaaattttatattattagatgtggtgatggtgtggttgagtcctgatctcatttcagatgagaaatatgtaaataaaacaaccaagatgaaaaaaaaaagattacctcaaaatctggatggagaaaatagtctgaacctatagagtctgaggttgcgtgtatccaattgacgtcgtcagttgagcagtatatgcacacaccggcacgctgctgatcgtcatgtgcaagacaaaggaggtcgatgtggcctccatcatgccatactccagcgttgtgaagagtaagttgttggctttgtctatgagtaatggagcagctcctgctgcgggcagagattgatgaaaagtaaaatcgtaattacctgtggatgacacgatgaatataagatcctcatagttaaaaattgccccttgacatagattagttaatttaataatatcttgaaaattgaacgtgaaccatatatatatatatatatatgtcggtcctaggattaaattgcatcttgcctgacaaataaaattagtaatgaaataaccaagcaaaatggttgaagcatagccaatctttttggaatgatacaaaaggagcagtacatcataaaaagtgtggaaaaaaaagaactaaccttaaatgaatctgcatgatatgcatgacaaagatagctataacaattatagtcatcaaacttttgctctaagaaacatagcaaagtaattagcttggctaaaaacgataatatgtaactcaaagataaacatttgcatgtaccattgtttactggaaagtaatttgtaagtaccaaagtaattagctttcagttgaatctgatgcagatgccattgtcttgctgattggttaccgctgcagatctatttaatatatacgtacgaaaaataatgatatatttgtaattaccggcacatgatgttcaaagagcagcttttctatttgcatcactgttattttggctgcaagaagcaagatcatgtcatcgggcgaatttgtgtacgcaaatataccgtgcggccacttgaaccaagcaatccgtattatgaattagtaacgacagaaaataaaatcaaacagtgcaagcagttatataatcgcctctcctgatgtgctttctcttcataattgttctctctccttattgaggatctgcttgctcctgcagcagcgctgcatatatacacgcatgcgcttcttgttaaacacagataaagacggttagggaaataaaattagcattactttttacctaattttgaagcagaaagattgaagggcgatgtccatctcctcgcgtggaacgaagttgtcagtattctgggtttgatcggattaacgttgatggccagccggcgaatgcatctgcctggtttacgctctcgtcgttcccatctacgttccgctcgtataatcgactggctatttcagatgggatcgatgggggtaggcgctaccgagagatatgatatagtgcgggcaaaattggttatatggcatcgaaagttcacgttt

SEQ ID NO: 106954 - DNA, 4134 bp, Oryza sativa
caccactctctcctcttcctcaactctctccctcacttcctcccgacctcccgcctccacctctcttttcttcctcccgacctcccacatctcgccgcctcccgaccgccggccgcctccatctcccacgcctcgccggcccccggccatcggacgccggatccggccgacagcgcccccccatcgactgccggactcctcccccgcctcccccaccagatccggcctccacgaggtcgggggacgtggatacgcatcccggccacctcccggccgctagcgcctcctacaccgactgccgaactcgtcccccacctcccccaccggatccggcctccacgagatcaggagacgtggatccgcgtcccggccaccagacgcggccgcctctcgaccgtcggacgccggatctggcctccgggaagccggatccggccgccagcgcttcccacaccgactgccggacgcctcccctgcctcccccaccagatcccgcctccacaaggttaggggatgtggatccgcgtcccagccgccggacgaggccgcctcccgactatcgaacgccggctctgcttcccctttgctccgcgggcggatgtgcctcccaccagagggcgctgcggcctccacctcccgaccgtccctcgccatggccgccatcctcttgttttgctttgatattatattgttgtatgtggattgagaaattcttgccatcccctttctgtgaatgtgtgctatatgacttctatgaatgtgtgctatatgagatctatcggtttgaatttcttgtgtgagcaaagcaactgtgacaacgagcaccaccatggcagcgtgcgccattttttcttttgctaggtttttcacaccagtgacgggttgcacgctatgtctttcaattttttttgttgggttaaagatatcactgacgggtcacaatataaggtccgtcacaggttaatagtcacctgtgacgggttttatatatggtccgtcacaggtgttggtcaccactgacggaccttcacccgtcaaaggtgaggacagtcatcagtgaccacttatctctgaccagggccaaatccgtcagaggtgacagtttgagcccgtcacaggtagccttgtccggtgtagtgtataactaatgtaccctttcgttatgatcttactttacacgaaccagagaaagatgtggagacttgtcttgtacatgagaaagcctgactagcattcacacagttggctccttggaacatatgaattttgcaagaatttcatagagattagttcaattttacaaaaatcctcccaattccttcgattcaatggagtcctttttgcatcaagtgagattcttcttggttcttagttcgaaccagccagacccccaatgatttgttcctaactaatgtttaggaatcgttagtagtccttgtgatgttaattaagcactgaagcaaatcattcttcagcatatataatgcaagagctgttttatcttactttgagtataactatgaattccaaatatcttctaaagccggaatttgcgagtgggatagctcaaattcttcatataagttgtatgcttcagagtctacatccctatatatatagggatgtagtatagctaaaacacacccacacccttggccttcccgcaccacccacccaccccaccacctatatatatatagggatgcgctaaaccgcaccgagggtgtggtataactaaactactcccctcacggcacccccccattaacccataagtaattgagttactaacgtctttttctttcctcccgcactcttatcagtttggttctccattggcccatgagttactgaattactggatctgttaacccattagtaagtgagttactaacgtttttttctttcctcccgcacgcactcctatctattttcctatctattttgttctctactagcccacatgagtaactggattactgagacggttaacccataagtaattgagttactaactttatttttctttccacccacactcctatcacaattggcacattagtaaaatgattactgagtatgtagtaactggattactgaggctgttcacccataagtaattaagttactaacgtttttttatttttcctccctcactcttatcgcaattggcccatcagtaaatacaacgcaacctgacgacataatgttctattttgtgtacaataggacaatattgaacaagaagaatagtatccaacattgcttctctcggtgtatggaattaatttctaattccaaatgactaacacagccacattactgctaatacaaacatcatgtagccacattattgctaacacaaacttcttgtagtaatagaggtagtagtctaatgatgcactgtctaaagaacaggaatacatatttctcttaatgttgtttcttctctgaattcatggcagggaaccttcagctggggaatgcaatatgctgagagagacccatagacgccggacagtgcaagtgccacacatcattgtcgagcccacgcagtgttgcagattccttaatcctccccgccaacatttatccatcacccatgcaagaaacattgaactgtcacttgcacttgttctacacgtgtgaaaaaaatttaaaaatacatcaaaagcatgcactcaagtactatatgtagataaaaagaaaatggtaagatcattcaaatcttcaattgtggattattcaaggctccaatcatctgaactatagtatgtcagaactcaaaccaatttgaagatatctcagacaaggtcacacaaaggctaattgcacttgcccaggttaactgaatctaaaaccagtaacaaccaatatccttttctgttaaaagatcagagagtaaataagtactcaaaacaattaatagttcagtcctttctctgcagtgggcaatgatgtattaaaacctcagcctatgtgcccagattcacatagtccacccaaatttacatggtgtattcatgagaaacataattttattaaataaacaaatttacatgtgccctttctcttggtcttaattaaagtctcttctccaaacaaacttacaactagtatgtcagaagaaaccaaaaagggcataacgatttagttcacctaaattttcttgacagcatgtacattccaagcagcgtttacttctttaaatctcatcagtgaacctgttcgcttacaaaatcatttgaagagatttttctaagcggaaatcacacacaacgaaagagagaaatcatcagagtgatgcggatttttttcagaagcaggtcgcagtaaattcaaccatagactggaaccaacacaagatacagtaaaggagaaggaacgtgagtggtgcaaagtgcaaagcatgtaggatgtggaggagatggtggtgaatctggacatagatgtcatcgtggaggcggtagactgtgccgtcaaggcatcaaccttgccggagcggtagtggctgcgcacgggccttaatctcctcctcatccggcgaacgatcaggtcagaccggcgagggatgcatgagtgcgttacctcctgctgatggcactgccctggtggtctcacgcccctttggctccttgccgcatgcgttgtcctgcacgggcgacggcgactgtcgctccttggtcaccgtcgccttcgacgattgggatccgttacctcctgcttgtcgatcctaacagccagatccggtggtggaacgaccatggaggacggccgatctgctcaacgtcgagtaagctggcggtcctccccggttatggccgtcagccgttcgccgccaggagcacctccgcctgttcagatccaaaaaaaggaaaacagatgggtggttagtcacagcatgggaacctaccgtcggagtggttgtcacagccgtggtcatgcgggatgtcgatgcccccgatgatgagggtcgaagccgtggccgacgcgaggtgctggcgggttcggcaccgcatcgaccacggccaatgtggatggccggccgaggagcagggagggccatgcatgggaagaaaggcgcgggctctcggacgtctgcgtcggtggagggcggacggtagagcctggggg

SEQ ID NO: 106955 - DNA, 2425 bp, Oryza sativa
ttttttttggttgggtatataaagagactaaataagatctaacggctcacatctattcaatcctcgggacttcgttcggactccgattactataaatttatagtctatttttcactactcggcgagctctacgcatccacggttcccgatcgcctatacgaacaatggtttaaaagttgaacttttgcgcgtttgctctaatattccgcgagatatattaatttaaaactcggggtattacagtaaccgtcgaaactttcatccaaattgccataaatgcccttagtaaatgttgatagcgaaatctaaacaatagttctgagcaaaattggggctgacagggcccaattatcaacaccagtttattttgcctccataagcggtattaacgctggtttcatccgacgtgatgcttatgtgatattacaattagaaaaatagatcatgagtcgcacatattgacgacgcactcctttatctccctatttcattcctccccattctccctcttctctccaaatgggcacgccatggagctcctcgtgtggatggacacacaaaaaaaaacttgtataattagctggttttgatgccatctaacctatatcccaagcatgcctcgtaaggctttctatttgtaaatggctttttttcaccttttaaagttccaaagctattgagttgattgaatgaacattatgcgaagcatatcatttgcaatgttctattggcatacctattcataattagaaatcctttagtttttttttcatttttaaaggtaccttattttccattgacaaaatgctagtctgttttctattcacaaacgggaagtccgtttggtttggctctgtggcattgattaagtgcaaatgtgtgcaactggaaatggaacagtggagtacaagctttcatccaaaaataccttaaatgccctcaattattaataaattgatagcccaataatttaaatagtgcctaatgaagttgtggaggaaggcgaaccaggcaagctgattatgatgttataaacatataggggtgctaactttttagcttacaaaatttgagggttcagtatagtgggctgaatttttattcattttaaaccaaaaatataggtaaggttgtaaaaagaacccatatttttgaaccaatacatgtgcaaccccttagaattggatagggagcatttcgtacaatttagtttgggtgagttttgatcggtattagagttagaataaattaactactcaatatctcacaaggtaaattggccctctttataagaaaatattgtctctatgtatgctgatgaaacataacactgaactgatgagaaacagtacatgtagtagggaggtaattttacctgtattgattatttctgaatatcggctaactgtaataagattgtgctgccttttacttctgccaaaaaaaatagctttgttgcctatagaagcgtgaataaggcattatatatcttaaaataaatatgtcaacacagcttaatgtatcacaccacatggctgactagcatttctgatccaagattatcattatcggggtttcctctctcccctgggtcgggaggcgacgacccagccgccccctctcttccacccctttcactatactggagaaccccacatctctcccggttcgcaacccctttactcccgggtagcgaaccaggagaaggaatccgggactaaagatcgcagtctttagtcccggttcagatacccgggagtaaatatttatctttaaagatagctgagccacgtccggttgatccccttttctttttttttaattgttaatttactactggcagttaatccctgtattttctcgcatcgggtgagaagcatatccccaaatcaaaccccaaatcaagtaacatcccaaatcactcacctcacaaatctaagttacacacaaatcaaatacatcacaaatccttaaataaattacacacaaaataaaaacatcacagatccatgcaatgaatcacaaattctagaaattatacatccagggaatcacaaatcacaaatcacacaaaaaatggaggacgccggccgccgcctgcgtgcgcggccccaccaagcgccctccgccgctggccgcccgccgcgcgcccgtcaccgctggccgcaggccgcctacccgctgtcgccgccgccagccgcctacccgcgccgaccgtcgcttggcccggcgctcgctcgcatcggccgtagctcggcccgccgttcgccgctcgcttgcgccggcctccgcctggcccggcgctcgcccgcgccggccgcggctcagcgcgccgctcggccgtgcagagggatgagggggagtaaaggggaggaggaagggaagaaggggaagtagaaaaggggaggggaggaggaagagatcg

SEQ ID NO: 106956 - DNA, 895 bp, Oryza sativa
ggtcgtaatcctctaaggttcgaccaggatgtcttcgcctccaattcgccattttgacaaccacatagctacataaaaggcgaacgcttgatcgacgaaaacgccaggggggcgaaacgaatcggccgaagcatcgctcgccgaacgttgaaaccgcgacagcttgtttcggaataaagataccgaacgccgttacattcaacttacgcaaaacacaagcgtttttcccaacgcaaaatgctacgagtcgaaaacggaagtcgaaagctgaaaagtcaacaaatcttttcgccaatccccaaaagggggccgaacgcatgagtttcggcgaaatccccgctaaaacaatagggaaaaggggaaagaaaaaaatacaagtcaagaatcgcgcaaagcagacaaacttggcaaaatataatcacccagtgtcataatacagcttcgccattctcgaaaggcgaacgccagtgttcatattttttctgcaggagtctaaaaagaggtttcggcaggaacatcggccgaaaggggacgcctcatgccataccgtatagtttgcacggtctcggccaaagctccttactcactcttgcccgtgaggggcttgttggaggcatgccatgaagcccttcggccggacctgccgaaactatagtaccatcaaggattcaagccaaagacgtcaaggccattcaggcgaagccctatggcgaaagccataagcgaagatggcgaaggctgaaagccgcgtcggtattccgaaaagtaaggcatctcgggcaaactacaaagacttcgccatgacgagttcggcatcaaggaggcccacaggctgcccccgccttttaggcccggttgccatagaccaagcccagcctatcagcccattaaaggc

SEQ ID NO: 106957 - DNA, 714 bp, Oryza sativa
acaggttttgtccacgccataccttccgccatagtaccaatgaggtacggcgtcaaggggtgcggccgaccaggtttcgcccacccacgccttcgccatagtaccaataacgtactgcgtcaagggctgcgggcgaacaggtttcgccacacccacgccttgcgccatagtaccaataaggtacggcgtcaagggcttgcgggcgaagaggtttcggccacccacgcccttcgccatagtgccaataaggaacggcgtcaagggctgcgggcgaacaggtttcgccaacccacgcctttcgccaaagtgccaatatggcatggcgtcaaggcctgcgggcgaagaggtttcgccacacgccatacccttcgccatagtaccaatgaggtacagcgtcaagggttgcgggcgaagaggtttcgtccacccacgcccttcgccttagtgccaataaggcacgacgtcaagggttgcgggcgaacaggtttcgcccacccgcgccctttgccacagtaccaataaggcacggcgtcaagggctgcgggcgaagaggtttcgccacacgccatacccttcgccatagtaccaatgaggtacggcgtcaagggttgcgggcgaacaaatttcgcccacccacgcccttcaccatagtgccaatatggcacggcgtcaagggctgcgggcgaagaagtttcgccacacgccatacccttc

SEQ ID NO: 106958 - DNA, 1251 bp, Oryza sativa
accaagcatctccaccttgactcattagcagcaaacaatagtattacatacgtatagtatccgtctagaagtcataatcatgaaataaactctagaagtcataatcataaatacacccccccgtaggatatccaaataaacaacccgaaaccgaaaccgacacagtgtcggccagtcagaccgcgggttgcgccggtctgaccgcgcattacacgccggtctgaccggctaccagagcccggtctgaccggtcacacaaaatgataaaatcctgcgatcacctgtaaatccaatcatcttcaaaaccactttgtgaataaattccaaataacaaaaccaataatctccaatgcccaattgttcatcacagaataataatcaaaaacacctttgattttacaatctcccccttgatgaacacattggcaaatccataaaaatgttttggtgtttgaaaaataaaaacaaaagtggtaaaaagcacacttcgtacaaacgtacacatcgtgctcgaaaaatccaaaagaaaacttctccccctttttaaaagaaagaaattcccaattgaaccaaaaacatgctcttctcaacaactctccaaaaattcatcttgcttctcccaaaaatccaaaaattttcacattacttctcccccttttgacaataatttcattaagcataggaattatgttcattaatgttcaagagcttagcatacatatagcatatcatgtcatgtggtgcaataaaaagaagatgaacccatctataacataacaagcatgcattaaagtataaccatgaaccaaagattttacaattaagcttgaatcaacaatcagaattcatgatttcatatgatttataatgcaacatcttaacaagcacataggttgaagaataaacactaaacacatatacctattgcatttatcactctttctcaaataacctttagcacaaaataaccaagagaattttttaactttttctttttcttgagcctttttgctcatatttttctcttttattccgagtacgtccctgtcgtcaagactgtttccagggattcggcacccattattttgctcacatcgaatacgtccttgtcgtcaagactgtttctaaggattcggtattcatttttttcatatttttattctctttttcacaatgagcaattaaagctatttgaggaataacaagttaataaaacatatatatatatatatatatatatatatatatata

SEQ ID NO: 106959 - DNA, 4042 bp, Oryza sativa
cccccccccccccgcgtcgggcgcttggtaccgagcattctcggataaaaaaaagagagaagagcaatgggctatagatctgtagccagctgcagcacggactcccagacgcaatgtgtgtatgacaggtgggatcatattgtatgaattggctattagattggctatagatgaattgaaactagtagtgtgctatatatatctttgtagacagacgggttaaggctctggagcttaagtcttccgtctaagaagatgtattttcacaagcggatggccatcatatccctcacccacaaccatgcaggtggctatttaggaacgaaaattcggctggccgcatagtgaaataggccttttgacagcggaaatcgtttttctaatagcgtgcctgcaatgattcattttcttcttattcgaagcaaaccatgtgtattttacctagctaaaaatataatcacctaattctttgcgattgatcagcattcagcaacgaacccactatactcatcttatataattataatgggaaaattgtaatggccaaatggctggatagaatgacataacgtcgctggctcgcagcatccaaatacaatattgcaaatgtattgacgattggtgtcagtcaacgagcggtgacggtggcagtggcagggcagccggccggcgtgacacgttcgtaacgcgagaggcggcgaccggccggccgcggtcgccgtggaggactccatttgaccgaccgacctccctctcgccggctagcttaattagctatcgatatcaaagacatgccccgtcaaaagaaagaaagatactgctgctactagtgaagcttgtagtagtatttccccttttttttttttgacaaattgatccttatagaaaacttatttcaaaactagtccctaccaaaaactatatcagaaataggccgtcggctcagcgctaatgtctttggcgctgagattgttcctatcagcaacggaactggcgctgatatcatgccagcgtggcgggcgagccgcgacgtggcgcggtctcagcgccaatatatctggcgctgaccaaatgtacacactaattaaactgacgcgctatagtttattagcaatgtacttgtggtgtagtggtaatttctttgatggtgtacccttcagccaaagttcgaatccccattaggtcatatattttcattcttttaatctgcatgcgtacatataaatgatgatctctgtttttgaaaaaaaaatagaagaatggatttaaaaaaacttgagtttttaaaaagaaaatttaaacaacattttgagaactaaggtaagttttattttaaaatgtcacgtgtttttttaaattaaaacaacacttgaacttttaaaagaaatatcacttttttaaaaaaaatatttaaaaggaataacacatttagtacatatttaaaaatataagaatggacttaaaaatacctgagctttgaaaaaattaaaaccgcaagttgagaactaagtgaaaaaaagtttagtaaaaacatataggagggggtttgaaccctggtcactgcaataccaactcacaagtacctaccacgtcgcggctcgcccgccacgctggcatgatgtcagcgccagtccctttggcgctgacaagaacaacctcagcgtcaacggttttggcgctgacccaacagcctaattcctaattcctagatatagtttttggtagagactagttttgaaataagttttctataaggatcaatttgtcaaaaaaaaaaaaaaacagtagtatttctccctgtgggtcaatatgccgtctacatacgtcgtcgcctagttgccatgcatggccacatctatcctgacgtggatcgcctctgccctgcctggcacgctgcctggcacgccacctagctcgtccctcgatctgtccctaccagcttcataaataactttccataggtggtgtttggatccaggactaactttattccctatcacatcggatgtttagatattaattttgagtattaaacatagactatttataaaactaattacataaattagagctaattcacttgacaaatttttttaagtctaattaatccataattagcacatgtttattatagcatcacataagttgttcatggattaattaggctcactacatttgtctcgcgaattaggctaatcatggattaattaggctcaatagattcgtctcgcgaattagtctagagttatggaatgggttttatcaatagtctacgtttaatacttctaattagtgtccaaacatccgatgtgacagggaccatccaaactgacggatctcccagaggcggtacaggttggagcctctgctaagagcatgtacaatagtagactataagccaactataaacacatatcgagaagataaataaggagagagatgagcagcgggctacaaatttatagtcagctgcaacacagactacaagatacaatatgtgtatgacaagtgggaccaggtataactagtgcagtatatgattatagataactattgtatgaattggctattgaattgactatagatgatttagagctagtagttggctatactattaaacttgctctaaggctgtgttcggcagtgcaggatgagaatccatccctcctgcacgtaaaatggagcagtcttttaacacatgattaattaagtattagcttttttttaaagaaaatagatcgatatgattttttaaagcaactttcatatagaaatttttttttttacaaaaaacgcaccgtttagtagtttgaaaagtatgcgtgcggaaatcaaaagaggtgggttgggaagatgaagtgctgaactcagcctaataatagtcccccactgcatctttactaaaattttctacatacatatatgagaaggtggtctagtttgttcagccccttctatttttttctgggttcgcctcggccacgatttgtgcaatggatgcagtggtcctgacctttctaacagtacatatgttttgacaatgctagctcttgctctacactttaaaacaacagcaagaatgaaaaactatattttgaaattaaccttttcaaggggatgtgaacaagtaatgattcttgtaagacgggttattttgaagctgcaacttttgtgttttatggccaaagttccataaaacaacatgtattataacatgtgacacataattaatcctgagtatttggttccaagattacataaaattacattccttgacaaattcaagaaaatgataagattttatataggcccacatttactcaaattttgatggtataaagtgtttataggattctgaattattgattaagatgacttaactctttattacttcgaaaaatattgctttagacctgttaaaattagctgaaatttagatatggctaaagtgttatggaacttttaaaccactaagccaaaggttgtgcaccacaaaatcataagaaccgttgttttctataattttgacaataaaaaaaaagattttacaaaaattactcaatcgtttttatctccttatagttatactactagtatatatgtgaatggagagaatcaaatcattttacctttagcgaagaagagaaaatgggtaccaacacaacacgagtgataatttgctctatggccacatgccatgtactatgatcgtgttctaacttttaaactgcttgtgtgggttggatcaatttaagggaattcaagagttggaggtggaaattgactgcctgaatccagggcaatcaataactgtggcataatcacctccaatgttctccaaaccaaggaaacagatttcatccacgacaatttatatagacaaattttgctaacttcgtagttttggccataggacaccgcacgaagttacttttggggaacacactctaaaaatgtggttatttgccaggagacacttcatccattaaattaatgttttcatgctgactacgcgagagcgagggtccactttttttacatg

SEQ ID NO: 106960 - DNA, 3799 bp, Oryza sativa
cctctctcccccttctttctctcttctcccgatggacggcgtggtgggaggcgtcaacattgacgttggcacccggagcgtgcggactgctccgcggtggtggcggagcctggagcacgtgcaggctgcccagtggcggcggcatacgcagcctgctcggcagcggcggtggcttggcgcgcggatcttcgccaccatggctagttcgaccagctgcagtgtgtgggtggcctggcgccggacgagcacttactactctaacgcatactttcttccctcgactcggcgacctctgaccgcagccgtcgcagctcgtcacgtccgcggtcaacgcgccagcaaagctcctccacagccgcctgcttcttccccgcctccttcttcctcgcgatgatggtgtctttcgtcgactcgacagcagacttgaacgacggttcttggccacagccagctagacctagagcagctcagcctccttgccgagcaggcatggaggagagccacgccttcaccgccagccatagggtcaccctgttgattgcaggcagccagctatatgccgacaacctcaccaaagaagagagaatggagggagagagaggaaaagagagaaacgaggggtaatttggtcaacatatgcaaaaaagtgggcctgctctcgcctagtcagcatgaaaactttaatttaatggatggagcgtctcctggcaagtaaccatgttttcagagtgtgtttccccaaaagtgacttcgtgtggtgtactacggctaaaaccacgaacccgtgatgtcctgtagcaaaatttgcctatataacttgttgtggatgaaatatgtttccttggtttggagaacattggaggtgattatgccacaattattgattgccctggattcaggcagttaatttccacctccaactcttgaattcccttaaattgatccaaaccacacaagcagtgtaatactagcacatacacatgtgacgtactcttcaaattcaaggagctcgcaattcctgaagtttgtaacactactacagaaaacacaaatttgtgccggttgagaacacctcttaggtgcaaaagttaccaagttaaaggccgtcgaattgatatttacatcgttgaaaattcagtatggctattagatgaatttattgatttgaaagatttgtttgttaattgaacggttccagctagaacattctgttctctgatttggaaccttttcaattcaatttaaaacttccgtatcctgatttgaattatatgcagaggaatgatttggaagcaggggatgaggcacagtcgcacagagggtgttaggatagcaggacatgtggaaaagggaggacgtggcagccttgcaccttgcagggtgtcaaacatcgccgttttgtctagggtacgtgacaacaaatactcaacttactttgtgttaagtacaccaaaattaaccactagaaatcatttataaactttttgccgcaacgacttccattgaaatcctatattaacaaattaagaacagaccacttgaaaaattgtgcaccaaaacacggtacacagatcgttggcattatctatgccttatgttcattagtatattttcatcttgaagttcaaggggccgcgctgttaaaaactcgataaatatcagtagaaagcagtgaggacacaacagctaacagaaagaaacatataaacatgcgaggaaatctcatgtattctccacacgattttatgcctcgcatgtttatcgaaggaggggagtggagataaaagtgccccccaccccccaaacccaaaaaaattgtgaaattgcaatagtatttacagtaacacgtgctaacgaaagttagtgatccatgcaaccaaatacattttctctcaattgcccttccaaagttatgttttgtagtcaacaattgttcccaggaattgaaacttttaggcagatttagctgaatatctccaatttgctgtccaaatatgatataagattttccatctcaaatattctacttatttgcacaaaaaagataaacctttgtatatatatttttttcattgaagtatgtcttgttggttggactttttatttcaactgtgaattcaagtttctttaggtttcataaataaattgaactatctaaatcttttttttcataaagaaaaatgatcattcatgacttcatataagcaactatagttcgtatgatttctatttgtatacgttgttggaataaatgttggcccacaattagtgctatgagattaatatcatcttggaaattcaagtggagagatgtcaagttaaataggaaactattagagagcacctattgaccggttgagatggtgggactgccacatgcgcgagcgctccaatccgatcgagaccgtgggcggggcggggctggctggctggttgctgctctctctctctctctctctcattattttgcaacggttgagaatcaccaccattacctctgcaacaaatgagagaatcaatcttgatttaatcatcgggttaattctatcgactctctctcatttttttttgcaacggttgagaatcaacaccattacctctacaacaaatgagagaaccaatcgcgatttgattattggagtaactctgttgattgctctggtaacgggcatgttgattgctccggcaacgggcagattcccctctcgcgcactatataaacccatcacctggacagccagagacacatctctcggctctgtcttctctagcgcattgtcttcttccttgatggttctttgtttcctctattcctgcgctactttctgtttccccggttctgatcacctgagcgcacgggtactcgggacgagcagccctctggaacaacatccgcttgtgtacctgcacgggtaggtgggtgatcaagtttttgaggagcgtcatccgacatgactgctctacatcaactacgtcttatgttgttctgtatcggctacgtcctttgcatcaactgtctgcgacgtctacttcctctctaatgtgatgtcttcaaccgacactttagcaggagagaacggcggtgccccaagaggaggagggaatggcggcacatgagagaacgtcaatacaaatgcctcatcatccagtggagcattctctgggtatatctccattctaatctttgtaactattagcatgatcatgtttagcactagcactagatcacttcctcccgcgatcatcatgattattatcttgttttttgggattaaaatatgctaatttatgaccaaatttccaacattccaaaaatttgataggtcttttttggtagttggttttgtggcattactaaaaccacatgctttcgatggtccaaattataaaagatggaaagcatgtgcactattgtggttgatggctgttgacggtagttatagaccaatttcgacagtcaatataactggaataaaggagaactagctatgcttgcagtgcatattttgtttagaataatctatctccacttgtacttggatttttatttgtttgcagatattgctatacaaatggaggaaaatcgacagaaaacaaccgaacgatcaatcgaaacccgttgagaggtagacttatgggtagatgagcctctaaacccattaaaataggcatattttgctacaggacatcgtgacttcgttgttttagctataggacaccgcacgaagtgacttttgggggaagacactcccaaaagatggatattggcaggtggacaccgcgaccattaaaataataa

SEQ ID NO: 106961 - DNA, 709 bp, Oryza sativa
acttcaacaaatggtgcaaaaggaagtgccaaaagatcaagcaactatactcgtaaggaggacattcaattgtgcatttcatggcagagcattagctcagatcctattattggcaatgagcaaccagggaaggcatattggcagaggatcgcagagcactaccatgctaaccgtgattttgagtctgataggaatgcaaactctcttgagcaccattggggtaacattcagaaggaagtaagcaagtttcaaggttgctacaatcaaattgagcgtcatcatccaagtggcataccacatcaagagcttgtaagttaaattgtttatttattattattaataacaatcttgtatgtatgtgaactaaaacttaaattatgttgcaggttcttgaagctgaggcattatactcgtccactgcaccaaagaatagggcatttcagtttaatcattgttggctcaagttgaggaattctccaaagtttcaaacactagaatcccacaagaggccacggtctaggaagtctttgaccccaattgagagagctggtgaagaagatgaaggagatgatgctagcaagagtacagctcctgatttatctcagccgagtgctaaaaagagaccaataggtaggaagcaagcaaaggagaagttgaagaatggaggagaagatggaccatacaaagaggcgatgaaagatttgcttga

SEQ ID NO: 106962 - DNA, 511 bp, Oryza sativa
gcaagcaagcgagctaaaactccaaactaattacaatataagctagaagagaactgtaataatatcttagttaactatttatatagatgtagactattaaaggtcataaccacaaatgcaacatccaagagaattctacatacatataattctatgggaatacctcaaaaaaggtgtcaccgtaacgtgagaagttgagatccgaggactcgatacttttggcaacaagttcctgtcagtgaaaggtctttataagaattgattgcacaggataaaatacaagtaaaacatatgtatgtgaaggtcggcaagatagttttacatataaatataatgttagcttgtatgtcgatattctagcacttcaaataatgttcaacatgattacaagaataaaaaaattaaaatttactatgaagtcataattggtgtatagcatgtaatgctttggattgaatacactaagagatgaaaatgattacattattcactaaatatgttgagtacgggg

SEQ ID NO: 106963 - DNA, 546 bp, Oryza sativa
aaaggagagagaagccgagcgtggcagcggctctagggctagggaaaaattcaggaaaaaaagtaggaaacggaagaggaggcccgaggcatgctatttatagccaaaggaggaggagatcggctcggatacgaggggaatcggcggcggaagggctagggttcgccagcaaaatagaagataaactccacttcgaatccacgcgatataccacgggatatactccgattcttgaggggaaagaaagaggaggataagggcaacaaatcccctcaatcaatttcggaaacgggacacaagatgcgacggatttggcggtggtagcggctgcacacacggctcggcagggagtctggaggttgggggcgacactgtagcagagggacacaatacagacttcttgccgggctttctttctcggcccgattggaagagggagacaaagcagacttcgccgcgagagacagccgctgctcgggctgaagaagagagagagagaaaggagaggagtgggccggattaggccggatttggcccggagctagg

SEQ ID NO: 106964 - DNA, 1085 bp, Oryza sativa
agaaaagaccaacaaaaaaaaatagtagattagtttttcgatgatcctatagaccattgtgccttttccctagttcttgttagttaaggcttgttgagttttcgattgcatcggttgtgttaatttgctggtcttagtgttaggcgattagagtttcgagttcttgccaccaccgcacatcgccaccttcatcaattttgccgtcatcaccaccgtcaccaccatcgcagtcacccaccaaatcactttctatttgtgtttgatctgttgccgatagcttttgttagttgccttgtatcctgccgccactagaaaggaaatagaaccctgattcgagtgaccttccttaaaacagtcatatctttttcatacggactcgaaattaggcttataatatatccacggacatctacaaaaaaagttacatccgattctccccgctttgtcgggttcggcaaatttaaaatcgccaaattcctcttgcaaaattctgtttttgtggcgagaagcttcgggacctattcgcatagaactttaaaaaaattctacaagcttcatactttgtccgtttaagataagattttctgtggttggttctagtgtgctcctggttgtgaaaaaaatatcaaaaaaaaagttgtgcctctctcctcagcactagagagagcaagcaaaaaaaaaaagaggatccagcgagcacaccacaccattccccctttgtcaccaccttctaccaccggttcttgttttcgttgttgtttgggtttgtgttttgtggcgtcctttgtggttaggctcgcgtctctacttcgactagcctaggaccagcactgtacactatacccttgagcgattattcaatttgctttggctaacgtggtttctagttttctcttgagcattgctttcagcccaccaacagctccaccacaaacccgactcagcttacaggtcttgttgctacagcaccgatacacctcgttccacggttgctaacttgtggtgttgctgtccccacctaagaacaaggtaagaactggtaagagcttgtgagacaagctgcgagtgaagtgagagtgagcgtc

SEQ ID NO: 106965 - DNA, 603 bp, Oryza sativa
ctaagatattttataatatgtctttttcatttgcgtaatgaaaacacgccaaccagaagttgcttgctgtacttttaaaaatgtctatacaatattatagagatagaaaaacgctggtttattgtaatgaagaaaacatagatatataaaattgagagaaggtagtactctagaattgcatttttgatatataaaatttgaatgttacaattgcatctttttcaaatgtgtgtggtggtgttggggagggatagagggagtaatacacgaataattaataattatgaataaatgaatagaacaacaacaaatagtttggggataattatatatgtgtgtgttctcaactatttaaaagctaatcttaaaaaataaaagcaatgaaaaattaaactttaaaattaactataaaattaggattaagcttgaaagtttaaattttaattgtaaccgacaaggcgacaagcaaagaatggcagacccacatatgtatgtctaaactacaggaatatgccacacgaacctaactacgggatttgcttactacgctttacaaaccacaaccaacccttccctttctaaccctatcccaccaaaaaaaaa

SEQ ID NO: 106966 - DNA, 759 bp, Oryza sativa
gagcagccgagcccctgctccatcatgtgatcagtcacacagtacagagatcgatcgaattttttgcagtaatatcgtatcttcatcgatcagcaatcaagtacagcagtacacaccgatcgagtgaattgatgaaccatatatatccatgaattaatatccatatatgagtgcatggatggctgtacaaaataaagtattagtactacttttgaaaatgatcgaactacgacactggtgtgtgtacatctcaatgctggtttgcgtcctcatgaagttcggaaacggatgtgattttctttccggcggaaaattaaacgcatgtgatcgatcgatctcatctactcctagctatagctttcagatgtgctaatctgccatccatggctagccaagccaatcaatattagctgctcacgtatgacgagggccagaagtcacaattatcaacgtgcgtgtaaacaaatcaaacgtggaaatatgtactctgaattgtatcgatcgacacgtcctgccggctgcatcatatcgttgttcgaacaaaaatagtcccagaacgtgtcccagaacggcatatgtacaaaaatttagcatcctgagaactatagtcccagggtggcatatgtacaaaaatttagcatcctgagaactatagtcccagaacgtgtaataatctaaatctcgcagggagaaattcaaagtgtagacaaattttaattgaattccaagcggttggggaacaaaaattgaccaaatttg

SEQ ID NO: 106967 - DNA, 631 bp, Oryza sativa
ctttgtacagaaagtatgtactcttgtcctaaagaaaaagagaagcccgtgattttctccggctcatgaggaccagaaaaaccacgcctctgttaaaacccagaccagcagaagaccagctcctacaaaatcactgcataataactattgagcttcattattcaccgtatcttttttttttcaggtcataatcacaaaagttcttacgtcaatgtacagagaaacacgatatgttactgacgagtggttttttaccagatgggaggaaaatgtcctggcattttcaagacggggaccatgttgccgggtcatataggaacatggtctttgacctcgtttcttatggccatggtttagatgttttagtatcatttaagatagatggtttaaaatctcactatctcggatactccggaaatttcttttgaactatacatttgtattttgttctcaaacttggttaaattctgtttgaactgcttgaaattcaactaaaatttgtttacaactcgaatttctctctgcaggatatgattgatcaactgcctaatatgcttcattcgctccattgctgtacttaatcgctgatgatgatgaagaaactactccaaaacaaaaattacatgatgga

SEQ ID NO: 106968 - DNA, 2227 bp, Oryza sativa
aaagttagattactcactccatcccagaataagttcacctagcacacgatgtgacatatgatattactatgaatatgaacatgcagatatgtcacatccatatacttattttgaaacggagggagtaaggatttgccattgtcttcatctcctttggagaactcgagggtttgtatgcaatgtacttaagtatgtgcacatctagcttatgcaccttatgcactacacctactatttggttgatgcctaaccttattatactaaacttaggcaaattactaaattagggtatgatgacgtaagtgtggctacgaaatagttgatcacaaatgtggtatggttagctataatccatctgccatccaccgattggtcgagctcggaacgtaaaccacacacgcacggcgctggcgcggggcacatggaaccatagcacgattagcccggacagccgcccatactcatcgacgaaaacttcattaaattttaatatttttgattgataataaaatttttatacaaataatagttatagtgaagtttgcctaggcaaaaatatctttctagctctaccactgtaatgaagagagaggttcactttatatctatgtgcattgtctatttatgcagtgttttttaccgtaaaaggaaatgacacagttattctcactgttctactgctgtgaaagggcaacatgatccgaaaatttgttaatagacgagttgattttacacagcccttgctttcatctgtgctaacaaatcagagcttagcaggcctctagtcaataaacctggcccatgtcatactacctttacagtttcggcccgatctaacagtctggactttaattgtctaggcccagcccatggaaaatgcgaactttttcgagtagatttctggccatgttactaacatatacaaatcgatgtttcgttccgcagaaatagattagttgcaaatcatctctaagcttcggatattttggtcaataatcttcacatcgcacgacaagtaatacatctaggatgggtttggaattgacttttttttttcgcaaggttaggaattaactttctcgacaagaatacaaatacatgccccggacatgaacggtttgacctgacggcattttaaaaggagtttgcgttttttgttttcttttcctttttttcttgagttgtacgagagatttgaattagtacaattttagtttaagttagtagccaaatggatttcaagttaccaattcaactagctaattaattaaatcgcgcattcgcgcgaccatgacatgtccttttatgtattaaaattagaactaaatattgggatgtggatttttattcctcgaggggatgtcctctcgttgcttacatatcatctagatagttattaaaaaaatttgagaaaaaaaagaaatatatcacttccaaacatagtataaggtcaaattcaattaaaatatgttgtatttacgaagggttaatttaaattgttttagctttaatatacgtgtgtagatgccacatcaaactggttaattagctggtgaaagcagcggtttttttatcgttagttggaagaaaaaaaatcagcagtagtagtgcagcagcaggaggctgccactttcttccttggagatggtgagcaggtgagtaccaccgccacattgttgccacgtgtctgtgtttgttgctctttgtttcccatctcttttcctcagtttctctcatattccgcgtgcacgcttttcaaactgctaaacgatgggttttttttaataaaatttataaacgaaagttgtttaaaaaattatattaatctatttttttttaaaaaatcgctaatacttaattaataacgtgctaattgacagctccatttttcgtgtgctgaaaatgtgttgggaaccagagaaacgatcacactcttctatatccttctcgtgcttcttagctttcgatcaatccaagccattctttcttaattcaatggctaatataatgttgtatatgtggcacaacgactgagagaataaacattctacgttcatacgatgatgatgatgttgtgttctccccgtaagaatgccgccggacttttgcccggagtagaattaacatttccaaccacactcccgttaatccttttcttttaaatttgaaataagacctaaaatctgataaactttggttagtccaaaccctctgaaccaaatgagca

SEQ ID NO: 106969 - DNA, 1592 bp, Oryza sativa
taagtagtctatatttaatactctaaattagtgtctaaatataaagactaaagttaagtccttggattaaaacaccaccatgcttgagatgttcagagaataagaggaggttgcagtagcttgctggtgagcggatggatcgacagcttatctaaccccagtagtggtaaccactgtcaaaaagaaaaaaaaaagggaaaatggaaaattctaagccaactgaccgcgacgtgtttggacgcgacaccatcttccttgccgggttttccgtcttgagtagtgagctttaggctcgcgtcggcgcgtgacgtaggcgtgccgcactagcttccgtcatcagactctgtgttaagttgtcaacttatattatcagtagaaaaattgccagctcaaggtccatggggaggtggcttaattacaggcctaacgataacgatatacagctagcctcgacgcaattaaattggacgaagtgtttgaggtggatcggtgaatttgaaaggctctccgttggagaaatgaaaaaaaaaagaaacaaatcagttttgctctgtgctgttttgtctgagtcagaaaaatgggtttagctgatgcggtgtcctagaggaggcaagcatatgctggtgaggtctggcatcttaaaaatacaagaacaaatttaaaaactccggtctgtggatgaccggatatagattattttgagtcacgatacagccgtgctaccatcatcgcaagattcctttgaatctttgaccagcaccatccaatcaaatcatagcacacattcagttattggcaaagccggatcgatctatttgatttgttatctaaaaaaacatacagtagtttgccataaaaaaaaaacatagcagtacaatacatttgtcgtcgtacagttttcttcattttgttgtcttgctagatagaagtagcttctaaaatcccaacacaacgttttttccggattttttagtcgcgctttggttaatgaaacaggtggggggaaaatcatagccccggaacggtattgggctactggcgccaacgtgcgaataagtccattttgtcaccctcatctattgcgcttgtgtgaataacatctctcaacaggaaaactgggtataatgcctccttcttctttgaaaaccagagcaaatcaccttcctaggtggttttgctggcagtttcgtccgacgtggtgttgttgacccggttgacaagctgactcagcgtggtgggacccacatgtcagtgtgtagctctctctcccccttatttctctctcagccctcctccgccaacgccgacaccctcgtctccgcgtgcccacaactcgtcggccacctcgtccgtctcgaccgcctccactttgcccgcccggtgccccgcgccgtcgggatccgccccgtcccatcctcccacagtgtctccttcgtcggcgacccggagccgctcatcgcccgccccaccgcgaaatgcgtggtgcccagccttgttgcggccaaggaggagaatcgccgcacggcgaaggagccggcgattatcgtgccatcgaggtacaggcaggtcggaagcggctgcggtggcggcag

SEQ ID NO: 106970 - DNA, 1774 bp, Oryza sativa
aaagaatggaaagaatattaccattaataatatttttgagttaatgattagagtctttatcgtctcaactattgtacagacacggcctctaaataatcttgtattgtttaagagaccatactcatctttaccattgaacatgcccttatgcttacaattattttaaaagaagttttttcaaggaggttaccaaattaaaccttaggttagaagaatatgacatcttgcttaatttggcagtgatatccgtgtcaccttttctcccacatgattgaaacaaagcaagacaaagatggacactaaatcaaagagctgacgacagaagaatgtgaccggagcacaacaattttcttccttaatttctcagttctcttctagaacagaaactaagtcgattcgttccaaaaaaaaaaaggaacagaaactaagcatgcacagcagttttactgtatttctcaaggaaagacatgtgattattggaaaggacgaacatatatagcaaaaattcaaggtaaatacctgagcacaaacacagcctctttcgaacctagatcttgaaagaaccgcggcgccggccgagaaggggcaagagcagcgggagaggccgacttcgtcgcgaccgcgtggggcactggggtggtccaggaagttgatttgggcccatgggacaagacagcccactagccaggccagggattaataagggagtactatgtcagaaaagatatttattagccagttgactaaagctttaattagtcaaactttaagtgttaggataatgatatcaaagattcatgcatgttttaccgtaaatagagacatctacccacttttgatgtccgttctcagtagccacataactccgatcgatatgcaaattaaataaagtccatcggtcttgttccattgtactgtgaggggctatttggttgacggctaagtttatcatatcacgtttgccgtaagtctaaggggttattttggtattcctattctagtagcgtaaactataaaaaaaaactcactagcaggctagaaaattagctaacatttggagtatagaacaagtgaatgatgaacaacaaaacgtcatttatttttttccccaaatgagtaagacgccatttaattagaaacatctctgtaaaacatgttaacatcttgttgggttataagttcaatgtcgtctctatgtttacgtgatgagcggttaatagaactaagcggagtattctgtaaatattaaaaattcaataatttactggtaatgttatttgtaacaaaatactatcaatataggtaaaaggtatttcgtggcaacccaattgcaaccgcaagtatgttaacgtctctctgcttacacaacatgatgcactagcaaagaaacctcgttagtgccgattctaaaatcctcatgtgtacaggttttggtctagcaccatgaaattaagcagcattagtttttacaaccgatgcatgtaaggtatatatattcgccggttttagttgagtgactaatctacgtgatggaacagaggtgcacttgatagtacagtggtaatataggggtcgtgtggtttcaatctcaatatcttgtgttcaatatccttaacacgttcacaatttcttcttaaaaaagtgcttgaaggggcagcggcagcgtcaagcaccccctgggcggcgtcgagcttctttcttagctccgcctcccagctcccgtattgaaggcggagggtgtcctgcgcctcgttcatcacggtggtggcaatga

SEQ ID NO: 106971 - DNA, 604 bp, Oryza sativa
atctcgacaaatgcagagtcgtcgcgcccaacctaccaacgaagaccgacgacctatctcatcgcaccggccgtggctggactatttgagaaaaggttgttgacggataattcgtcatgaacgttgtcggcttgatcactcgatatgattgcgaacggacatccggatatgctataagtttggtatgtgagtcatgctggtcacatgagatgcacatgtaataaaccaactctagcgttctcgaaccagtacgtagcaatctcccgcaccgcaaacttccattggtgttcgagagatgattctactcgctcgctggttctcgaaccagtacatagcaatctcccgcaccgcaaacttccattggtgttcgagagatgattctactcgctcgctggttctcgaaccagtacgtagcaatctcccgcaccgcaacctccattggtgttcgagagatggttctactcgctcgctggttctcgaaccagtacgtagcaatctcccgcaccgcaacctccatgggtgttcgagagatggttctacttgctcgctggttctcgaaccagtacgtagcaatctcccgcaccgcaacctcagatggtcgagg

SEQ ID NO: 106972 - DNA, 678 bp, Oryza sativa
ataaataatttaagagaaaaatcattttgaagcttgctaaaatacatgtatgcatgtgtgtatagatgaggtggagagagagtagtagcaggtagttttaggaattttatgaaacacactaaagacgcacattgaaacatatcactatcacgtatgaaacattttattttaacagtttgaaacacatgtttttcttttgacataatataatcatatgatatcttgttgtaaagatttaattgcaacgaatacaacggtgtgatcggttcgtagatcggataagtaatttagaagaaaaaatatttaaagagaggaggaaaacatgaaaagaaacagatatgtatgtatgatgcagcgatagggtaggcgtccgatatttctgttttcataaacttctaacttttttttccaaactaccaactttcctcaaacttcttcacaatttcagaaagtaaacacagccttaatttatatttttcgacttaatatgagtgttcgtatttatggttcttttattagtatcacgatttgaatctgataaatagaattatacacccacgattttaaagcaccacacacacggatagtgcttctccgtatatagttggggggcacaatattatacttggagatggtaagatttagggaatatattcccagcaacaaaaaagatttagg

SEQ ID NO: 106973 - DNA, 752 bp, Oryza sativa
tacacccctggatctaaacaccctctaaatatgccatcttcagtcttattggcttggacaggaaacaggagagaacatcggctccacacgttggcaaaaaaactatagtagcttcagagaaggaaaagaacataagccaatccgtgtaagcacaaaaatgtgtgaatagacacagttataaagcttgagtgatcttaggattaaactttgagcaattttatagtccttgaggagataccaagtagtaccaccttttttttattgtaaatttggtatctcataggtacctcatggtacctcctaaaggatggtaaaattgctcttaaattttagtgtaaaatcatgctctcggtaccttcagtaaattttggtgtctttcaaggactgtaaaaattcttataatcttgtctcatgtcatctcaagataacattatcaaccaatcgtgtcaacacaacatcagtaagtcatcttgacttggactagaatcattcaaaagtgataaagaagcgcgagatgcatgattgccatgtcatgctcagagagttacaatattgcctaacttgataaggacgagatatggatctgctgcatattgcacaagtatgtcataaatgaaaattctttgtgccatgtcaaagtgcgaactttcgctcgaaataataaggctaatgtgacaaacctccaaaatataaatgtggggtggacatggtaatgcttcatgtgaaacatttcccttactacaagtagtaaa

SEQ ID NO: 106974 - DNA, 636 bp, Oryza sativa
  unsure (1)..(636): unsure at all n locations
ttcccaaactcccaattttccagcatatcacatcacattcaaaactttcctgctcacataaactctaatttttttttctaaactaccaacttttcccaaacttctccataattttaggaactaaacacaaccatatgtattacttctattagaaaacgttccatcggattatattgttccatcggattatattttaagactagcacaacccatttctaaatcatgagagcaagtttaatagtatagcccactgctaagtgtctaggtccaattcatttatagccaatctaataaccaatttataaaatagttgtttcctatactattagtatatggttctacctgtcatacatacattacgtctcgaagtccgtgctgcagcttgctacaaatatgtagcccactaatcttctctctcatattctatcttaataaaatatgtttatatagctagctaatagtctgctattgtatttgctctgagccactccgatgaccaaatcttgacacgtgtgacgatcccgtcggccgncgacgcttgtgctgcgcccgccttcccccacggatggacgcgtgcacctctgcctatctttccgcgctcgatgcagctcggtcaacttcgcggcttccccctga

SEQ ID NO: 106975 - DNA, 603 bp, Oryza sativa
atccacgtgacatataccagacattttcgtttttgataccacggttttcttatagaaaaaatgaaattaagcagtagagtatcaactaagatcctattcgagattctaaagaaacagattgtgagtagccaactagtcgtaatctaaaaatatagatttgttactccctccatttcataatgtaagtcattttaccatttcccacattcatatcgatgcctatctagattcattaacatcaatatgaatgtgggaaatgctaaagtaatttacattataaaacggagaaagtacattctaaccttttaatttattttctggattatatacaattacataggtttggaatctagctagatgatttaggaaaaaggctatagagctgctaaaagttcctgtttaacaggacataggagtgttggactaaacggcactttagcagtcctggcagtcgtactccatacgttttaaaataaattaaacatctttgacgagatatgtcacgtttcggtttatttttttaaaaaaatagtatgctcgtagcagtagcacaactggacttttgtggcagctcaagcgtgtgctaactagcaagcttcgagc

SEQ ID NO: 106976 - DNA, 636 bp, Oryza sativa
aatggaagctctctggtgggattggcatatggcgctatggtggcattgtgaaaattgcatcctcaagtaagaggttgccttcatattcatccaggggaggaggttcagctgatctgaaccaacaaatgctggaatttgtgcaccttctgtctgaagtctcccttgaggaatctagagttggagaatctcagcattcacttttccagcaatttgtgcttcgagttgtgcgggcattccttcaggaatggggtgaagctgagggcttgcccttagatgatatggtaggtaagttctacttattattgtataatattcgctgaccacctgatttctttagtggtgctctcaccaaacaagctgagccttgacacaaaagaaaaaaaaatgtgttaaattcctcacgctggtgattttttttttcaggtccttgaaacaatacttgaacaagcctgtaaagaattcaccattctgcttgcttcccatcgaaaccaggtacttcattgtttgtgaattacctaatagggtattttgttcaattttcaatggtagccccgccgcaagcaattgcaaaaactaataactatgtcatgattattgatcaatttttgtctatgattcagttttgggctggctgtg

SEQ ID NO: 106977 - DNA, 599 bp, Oryza sativa
tgacgtcgtggatgatgatgatgcctgatcgagatggatggtccaggatggatcagtgatcagtagtgactagtgacatgcattttaattttttggggggcttaaacttggggacaggttgagctcactcgatcgatcgagacctgcgtgcttatatatattcagatacagatgcagcttttgacaaatatatacttcagtaaaattgatatgcagcgtttgtaaacgttgtgcgaaacacggcggtagaaatttggacacctttttgcaccaacttcttcaactgctcctcatttttttgcctgctatgatcgctttatatgcatgaaggattttaatttttttttagttctaaacgtcaactagagaaaatagagtatgctgctggacccctggacgcatgcatctcgtcgactatatttatagaagagaaaaaatatatatatgggactataataagaatcatcagactttatagtcagaaacaaaacgaatatgtatgtaatgtacttacgtatgtacaacacattggcacgcctagttcaacagctgcgtaggttaattgtatacgagttctagctgatcccgtcttaagtgat

SEQ ID NO: 106978 - DNA, 679 bp, Oryza sativa
aaatccgtgagtacaattcttactcgtgttgacgtggacgaatcttcaatgtcttttttttatccaacggaagtttccaagtttgcactatatatgtgatttctatcacatattttgcccatatatggctcggcttattggttttagatagaaagcgcaaaggtttgcaacaagcaccatgcaaccataggtgtttgagatagggtgtgtttagttcatgtcaaaattagaagtttgattgaaattggaacgatgtgacggaaaagttgaaagtttgtgtgtgtaggaaagttttgatgtgatgaaaaagttaaaagtatgaaaataaaaatttgaaactaaacttggcaagcagcccatgtaaaacgaaaaattaattagaaaataatcaaaggttttaattatttcaacttaaaatagtggatccaattcatattttagaacaacttttatataaaaaattttcacacgaaacgtatcataccttttagcagtttataaaacgtgctaatgaaatccaagacggaatatatgtgcatcgcccgttgttccttctttttcttctttccttatattttatctccacatgttccatgtttttgtttctacgtcggtttatgctccgtgatatatatctgttcatatgttgaggtctggccacaaacgttgtttctgcaat

SEQ ID NO: 106979 - DNA, 1130 bp, Oryza sativa
gcagaagaggtcaacggccggattccccgaccatgaatgatcaagtgggttaatttatggttgcaacggaagaatattcaagcaagcctgtacttctgaaattggaaagtaaacgccacgggtcatcgcctgaaccagtcaagcagtgttgctgcagcctgcagatcagtttacccatgaatatatacagcgcaacgacagccgtactatagtttgtccacagtacgctggattttttttttctaatctttagttttaaagataaatatatccaaaacttatttataagatctgcaccttttgaccgaactagcgtgctaaaacaatattatatcatactagtttgattggcatggcagtattatttgaccacgccaatataaccggcgtgactaaaagagtttagatttttaaaattagttttatgagggtttatttttaaaataaaaaagtttcagacaataaaaaaaacattccagtatgctgaaggttgacgtttttcaaattttcgggtgtacccatggtttctggtagtaggatgtatgttcaaattaaatttaaattcaaattctgtgaaaatatgtccagaattgaactgttcaaactatccaaaatttgggtcccccgatattagaatttatatatagcatgtattcgcaatgtgctaagtttatgcatctctgctccttgattaattagtcaacgtacgagccagggagcataattaacctagctatagctagctagatggcgagccagggagtatggtgcagaagccagaagtcaatcgcgagcatgcagcggacgagctaatcaagtcatgcccagttccctcgacgtcgtatttctccataaaaaaaaacttaaggatgtgatacgttaatgaatttgaataggggttatccagattcattatagtaaaatatgtcctacttccttcgtttcacaatgcaagtcattctaacatttcccacatttatattgatgctaatgaatccatacatatatatctatttagattcattagcatcaatatgaatgtgaaaaatgctagaatgacttacattgtgaaacggagggagtatctttaactaggttgagtttttttggatggatagagtagacgccta

SEQ ID NO: 106980 - DNA, 1575 bp, Oryza sativa
aaaattgttgtgctccggtcacattcttctgtcgtcagctctttgatttagtgtccatctttgtcttgctttgtttcaatcatgtggaagaaaaggtgacacggatatcactgccaaattaagcaagatgtcatattcttctaacataaggtttaatttggtaacctccttgaaaaaacttcttttaaaataattgtaagcataagggcatgttcaatggtaaagatgagtatggtctcttaaacaatacaagattatttagaggccgtgtctgtacaatagttgagacgataaagactctaatcattaactcaaaaatattatttttgttaatattctttccattcttttaccctcatgcaaccatatttccatattatagtgattaaaagtcgttgttaagccgttgtcatgcataagaacgatgttttatctctcctttttctctttcttccatgtcaacaagtattcctaattagcaacgcaaagagaccactgttgacaaccattgtacatgccataacaagtgaaatcctacaaataaaaaacaaaaagagaaacgactgaaagttatttttattcgaaccagatgtccggttgtttgaaccatattttaagtcctcatattacaaaactgagaataaattgaggtggctgccaaacttgtagcttagcatgtaatttctggcatgaagaatcaagtaggaagggcagaattgattttttttctgtgatagattaattaattgaggaaaaaaaactaccagaagttgttaggaaaatgtatcaataataatcgaataggagcattgaaaaagatctcatttctctaataccttaaatcaatatcggtaaatccaatctctctaattttctctttatagaagaaagaccattgtatttataatgacctcactttttgacagaaaaccaagcaagtaaaatcctctgctaatttccaagtaccataagacatctttacgatgtcacatgtgcatatgcaagttgcacaacacagtaaattaaacaaacccaaaggtggacctacattattaggctatatgatgtgcaggctgatactggccgtttgggtttccgttttcaatattagacgacattattcgataattaaagtttcaggtatttcaaatctgatacccgcatccacgtgacatataccagacattttcgtttttgataccacggttttcttatagaaaaaatgaaattaagcagtagagtatcaactaagatcctattcgagattctaaagaaacagattgtgagtagccaactagtcgtaatctaaaaatatagatttgttactccctccatttcataatgtaagtcattttaccatttcccacattcatatcgatgcctatctagattcattaacatcaatatgaatgtgggaaatgctaaagtaatttacattataaaacggagaaagtacattctaaccttttaatttattttctggattatatacaattacatagttttggaatctagctagatgatttaggaaaaaggctatagagctgctagaagttcctgtttaaacaggacata

SEQ ID NO: 106981 - DNA, 646 bp, Oryza sativa
tactgaaaacacgcatgtataatgtatcgatgtatatctctacggcctttgagagagcgacatgaattgtagactaggaagacctggatggcctcctagtagtttagctaaaatcagcttaattagtttgcttggagcaggtggtgacttactgactcggccaccctaattccacaaaaaccaaacgcccacttgcattgctcccgtagcaacgcgtgatttgcctcagttttccactgaaaaaattactccatcagtcccaaaatataagtatttttagactctgacacagtcttcgagatgatactttgaccaacaatatttattaaaaaaagatattttaaataaaaagaattgcatattatgatagtttgattaatgataaatctagtaacatcaattttacatgattaatttttttatttcttttgctattaatagttaaagttaaaaatgattgatttggcactatgttaaaaatatttatattttgagacggagggagtaagcagtaggagacaaggaaaacgttgtctaagctgtaatgccggtacgtacagtgggcgactaataatccttctcgggttgtttttctcgcccggaaattggaggattcgcgtaaaaaaaaaatagtgccacggagctg

SEQ ID NO: 106982 - DNA, 586 bp, Oryza sativa
tgatctcctgttgtacctccagaaaacgctctctgttcctcatcctttgaacccttttcttctgatttttggtgaaaataccagaaggacaccattgcgtttttctaccctcatcttcatcttgatcacgatcatgatgcactaggcccaacctctgatgaacaggactcttttctgacccagccgattgcctttattgtaggatcggcttgaactccccgcattgtctctgcatccagggcaatcttcaattgatggcaaccgcatcccctcgttctagcaaaatctgaaaaactcacaatctcaatgtggatcaaaaccgtcatctttctcttcaaaatacctctcctgctgcttgtcatgcctcctttgatatttgttgataattctaactgaattcagctgtgaactccgatgtttgccctcatcggctgttcttccagatatatgcaccatgttgataggaaaaggattaccattgacctttatcggctttttggagtcaacaaacttaattttggcttcctcgatagccagctggatctggtgtctgaaaactttgcaatcattggtagcatgagaacta

SEQ ID NO: 106983 - DNA, 657 bp, Oryza sativa
aagaaagatatgatttcgatatcaccaaggctgataagattttcgatttgctacttcgggagaggcagattcaacttcctgctagtcatgtgattccatcggctgaggagttggggaaaaggaaatattgcaagtggcataactctagttctcatgctaccaatgattgcaaagttttcagacaacagatccagctggctatcgagggaggcaaaattaagtttgttgactccaaaaagccgatgaaggtcaatggtaatccttttcctatcaacatggtgcatatatctgggagaacagccgatgagggcaaacatcggagttcacagctgaattcagttagaattatcaacaaatatcaaaggaggcatgacaagcagcaggagaggtattttgaagagaaagatgacggttttgatccacattgagattgtgagtttttcagattttgctagaacgaggggatgcggttgccatcaattgaagattgccctggatgcagagacaatgcggggagttcaagccgatcctacaatagaggcaatcggctgggtcagaaaagagtcctgttcatcagaggttgggcctagtgcatcatgatcgtgatcaagatgaagatgagggtagaaaaacgcaatggtgtccttctggtatttt

SEQ ID NO: 106984 - DNA, 644 bp, Oryza sativa
tctggctcatattatcagattgcaaatgtggtctcccttttgtgaaccctttgaagattttttgttatcctgtctatttaatgggtacatgagctttcttcctactgttaccacaattttctgcaattgctgtgcaccacatgatccattactgtgaactgctgtctgtatgccatcttctggagtgatggatgtagtatagtgctgtatgtgaagttgtgaaccaggcacaccctgtttcttttattacgagcaaaacactttatgtttgttctagtatgatggtaacataagttgtatgatgcaagctgttactgaaattttaatggaatatgcagtcagttggagcatcgcgaaagaacttaatgtttcatacattagccgtaaattcttcttgcatgaatgttgctggcagttgcacagtgtagtctaaatattttgacatgccatattaccaaatagttatattatttaatcttattactttttaataaggcttttatgcttgtctcgttgaatggatttcgcttcttgatggtgggagtagtattgttcatcttcaatgtcaaagattggaatgtggagtcgaatttcacgacctggttcaaaataatgcgccacctttctatcctgctttggctaac

SEQ ID NO: 106985 - DNA, 588 bp, Oryza sativa
tcatttgcggtgcatgtaaaacggagcgactaattaatgcataattaattaatagtttttttaaaaaaagattaatatgagtttttcaaacaactttcctatagatttttttttgaaaaaacgcatcgttaatagtttggggagtgtacacacgtaaaacgagaaggaatgagttaggaacttcaagcaacgaacacaaactaagagcaagtttaatagtatagtcaactggtagcttcaaattatctatagccaatttaataatctattcatgcaatagttatctataaatatatactgcatcattaatacatagtgccacatctcgtacacacataacattttgaagttcgtgccgaagttggttataaatctgtagcccaatttccttttgtctcttctctgatctcatccacgtgtttatagctaacttgtaacctgctacctaaccagcttagcattgcgctttggtactactttggatcttttttttttctcattgaaacaatgtacattacatttgtatagagattattagtgtttttacacgtaatagccaaataagaacaactaccaaaaccaaataaa

SEQ ID NO: 106986 - DNA, 701 bp, Oryza sativa
tttttcactagaatatatttgagtacatgtaaattatgactgggacaacactacaactggttcttctagccggaatttttttttagcaacgtgtgagatgtagattaacagaggtaatggcctctgaaattttctgtatgtttacccataaaggatgcatccaaaaacaatggataaccttctgctagctgaaaaggaattcaggtgatgcttgaattcagggactaaattctaatctcacatcggatgtttggacattattttaactaattacataaataagagctaattcacgtgacaatttttttaagcctcattaatccataattagcacatgtttactgtagcatcacataggttaattgtgaattaattatgctcaatagattcgtctcgcgaattagtccagggttatggattaggttttatcaataatctacatttaatacttctaataattagtgtccaaacatccaatgtgataagaattaaaaattagtccatccaaacagcccctaaagccgtttaggggcatatgcgtgtgctacgtctgaactgaactccccagattttttttttgttttgaaaaatgtgatctctccagatacattgttcgaatcaatgccacggtgataagcaaaatcaaatcaagtgtgggcgtgtggcttggcgtgtccatagcgcttcataatcatatccat

SEQ ID NO: 106987 - DNA, 800 bp, Oryza sativa
cccacccgtcagcgagggtgccgggcgggcccgcccgtcagcggcgcgcgcgcgggaagagcccgagtggtccgcgggaaaaagaaaagaggggaaggtaaatgggccgagccggcccaagatggggaaggggggattttatggtttttctttttataaaatcattttaactttgtttatttcttaataattattatttgtgctctgaaaattccactaaaatttatttacacattttaggcttttaggaaataaacaaaaatcctctaagccttatttgacttttaactttgcacattttaatttttggaggctttcacacagattttaattattctaggcataatttagaggatgtattttagggtcgttttgggacgtgacagacactaattttgaggccctcagcccattggcatcatggttgggcccatttcgactccaactcctttctaaaagatttaaattaagcaagggtgagtacaaacgtactcagcaagccaccactacagaatgcatttagtgcacacaggggttcaaggatggcttggtttatttgcttaaagcttgttttcacaattcatttcacaaacctacgacttagcagttttaactgaaaacaacgttaagttggagttgtcattaatcatcgagggttcatccaccttccccaagcctcgctaggtcaggtttaccctcgcattcctgtttatatcctctttcatcatatcgaccttcccgcacagtgggcaaggtcagatagtttggtccatctctaatcttaagcaggtcacatagtc

SEQ ID NO: 106988 - DNA, 1131 bp, Oryza sativa
tgaagcttttgcagatggcttgaagttggaccctgcaaatgaagatatagcgaaagctttaaggtaactattctgtatttttcatcccgtgagcatcttgtgatctccctggtgcccttgtgcatgcgtagttatcgttattagaaaatttcttgcgtgccatttgaatgcttctcttgctataaagttgaaagaaggatctgtgtagagatttctccgtttctgtagtacaattcttttttttttcaccctgcagggatgcccaggaggccatgaaggaccaaatggagcacagaggttgattcagccttaccttgcgcctctattttgttgctagctactccctccgttctataaaaagtataaatctaagacatgcgacatattctaatactatgaatttaatataaattaggatatgtcacatctgttacggtttgtattttatggtaaagagggagtaagtcccaaagacattttggctgccaacggacaagcttttgcgttttgttaacctgagacctgagagtttagtgttaaatgtgaactatgtgggaactatttcatggtttgtggaagtcgtcgtgccttctggacaccatcagttttttttccttacattgactactcgttggcttataagctgcggccagaatctaaatttgaaaacttcttaaagaaaatccaagaattacttttggagttgctattctgtactaggtatcctctcttactataaatttataacccaccaactcctaaaacttaacatacaaagatgccatcatcctctactaacaagatgccactgccacatcattatctagtaacaatcattaaatttaaacatcaaacaaagatgctatattgtctataattttataatttattaaattttagagcttttaaaatgcaagtatgttaaatcatcatcccacattatcacataatatttcaatatacatctttattattttttaaatatactatgtaactatatagttcatgttatttttctcttctctcattaagccatatcaaatcagttgtttttagtgcttaaatgaaatctatggtccaaattttctctctttttcttctctcattaatctatatcacctcaatgatttt

SEQ ID NO: 106989 - DNA, 3051 bp, Oryza sativa
ccttacggaaatgaaaagaaaatcctagtcaagaacaagggggagaagaaagcaagggtgagcttagaattttgtggggaacgaactgcctgctagaacaccaccaaaccccgagaagcagaaaagggaatcgagggggaagatgaagacttggatttaactggtcacagcaaagaaacaaggaagactcttatctatatccagacccagtggagtcgagagaaggaagaaaagtcggagcagctaccgccggcggccgggattcggcggcggcgaatgaatcagatcgaagggtaggatagggtagcaaagggaagggaagaattgaggaggaggagcatagtgctagtagttggaggaggggaagaagagagagaaatatcaagccattttagtcgagtcagcttggattggagagagggactgtggatggatggtcaagttggagactccctggcagccggcgtcactgcgtctgcgtgcacactgactgcaacgtggggccggctgcggctgtctagttgcgtgcgctgctgattttcctactgtagaaaaagacctcacaagtactcccttcgttgttttgactttttttttccttagtcaaattcctttagattcaactaaatttgtagaaaaatacactaatattttcaatatgaaacaaatatattatcaaatatattcaatgctaaatttaatgaaactaattggtattataaatgttgctatttttttctataaatttaatcaaatttaaagaactttgagtataaaaaaagtcaagtgtcttataatatgaaacggagggattacttactactcattgaaaattaaacttactactcattgaaaattaaaaacattttaaatttcttaataagaaataaaatatccacgttccgagatataaattatttttgtttatgtttttctattgtcaaaatctcttatattttggtacggagatagtagtttttaaatttagagtatttaaatatttaccactctgaaatttattcagatttgtattattaggatgtctcaaatcccacattagatttattttttataagacggagagagtagacacatagggtggctagacccatatgtcatagtcatataggggtggtaacttgttaaatatcacatttgacaaatacttaactatctcttttagttacataagataatcctaaaacaatcatatagtatactttttttacaaacacagatgatcacaatgcgtgcgcactcaccttagacttatgagcatctccggaagactaagctactatatctggagattgagcacctttagtgactgatatattttgagattgatgaagttatcacggatgcctcattgtgacgttgttgattggtacatcgcctaccacttaaataataattagcagtaaatacttgcacccgtatcaaatcacataataattagcagtaaatacttgcacccgtatcaaaccacagagggtgtgctagtacactataagaaacataaccaattaagttaccttcacttgcaatcatatagtattgtgtattgtgtaaactcagaggtttaggaccaacaacagaattgcaagtctaccacacacttgtactcggggtttatttacccatgtcgggtatgaactaaacaccaaattgtaaatatgccatgtatgacccatgggttgttacaacaatgaaaaaaaaaggcaaaaaaaaaagtatatgttgcctctctctactgtagcacgagtcccatttttctccctcaacccgataaccatacagatgttccctcatatgtcaaaaccgagtcaaacaacctcccttagtggtgcacaacgattttgtcttatatagctggcaattcaacaaaattataagttcaaaataaaaaacatgctaggcctacatgccatcctccctattcgttttcttcctccacctctcctcatgtttggggaccaatcatcaattgattccatatggcacggtgaggcatacatgcgctcccgaactgggtgcgcgctgtggcgaggaagacaacaaccaactcaactttcttgcctccatctgagacaattagagcaggatgttctacagcacctgaattgagatcatataacttacctccctctaacttgtgtcactgacgtgtgggccctttacccagtggaccccacatgttagtgactcaaagtcagagggaagtaagctagaggatcccccttcctacggcacccatgggtgcacatgcgccacggatcagaaccataccatcatttcctacgaggcatcccacgcccatcgctcacccctacgctccacgtttcatgctgaccaccgagggagtcctcaagtgatcaagtccactgtctccacctcaccgctgcccgcaataacctttggtccatctcctcgccccatcacatctccattggccctatcattagtatcatatataggagactagcaagtgggatttaaaacatgggttgaccagataaagaaaatacaatgtaagatgaaccgatgggtaagccagaacctatatgataaaatcaaaaggtaccacaccaaaatagagaagataatccacaccacaccaacatgagattcttgatggctttgtttgtgccttgttcttcctacagaaattcatggagtgtacagtattagagttgtcacaagaacgaaaggaaacatattctatgcacacaagttcctgtgcataccaattagcaaatgtcatgaaaattctacagaaaaatagacatttactcctaatagtattatacatttctgtaaggtctcatattcaaattcattatattttagccgcaacaaaaaaagtgaaaaaaaactaacagttttaagggtaaaaatctattagaattttgtttttttaggctaaaatataataaatttgaagataagatttcacacgtaggtgtaatactattggaagtctgtgtccaattttttctagaattttctatgacatttgctagttggtgcgcacggagtgtacacgggaag

SEQ ID NO: 106990 - DNA, 2142 bp, Oryza sativa
accacaccaaaatagagaagataatccacaccacaccaacatgagattcttgatggctttgtttgtgccttgttcttcctacagaaattcatggagtgtacagtattagagttgtcacaagaacgaaaggaaacatattctatgcacacaagttcctgtgcataccaattagcaaatgtcatgaaaattctacagaaaaatagacatttactcctaatagtattatacatttctgtaaggtctcatattcaaattcattatattttagccgcaacaaaaaaagtgaaaaaaaactaacagttttaagggtaaaaatctattagaattttgtttttttaggctaaaatataataaatttgaagataagatttcacacgtaggtgtaatactattggaagtctgtgtccaattttttctagaattttctatgacatttgctagttggtgcgcacggagtgtacacgggaagttttgtgcatagaatatgttcccaaaacaaaagaaaatgttttttttattgcataagggaatgtcattgcttgccacaagctatcttggctacgcttcaatgccacaaaccaaggaaaattcactttttttctctttttgcttcgtttaacattttacccctgcaaatgaccaatattcccccacatgtttattcttcatattttcgaattctctcttgaatttctatcgtgttttcacaaatctttaggttctctctcttagaccttgtttgtttgatcccaagagaggggattaaggggaaataactctataccacagtagaatgtagaatagatctctttcaaatctctttcaatcatcttgtgggagagattaaccgaacaagaccttaagagaatattactaaaaatgttcttgatctttttggaaggttgtaggattactattaactaggtgattctccacgttttactgcgggaatcactaagcaattctgaatatatttttttgacaatcaagctagaagtaaaaaaggaaaaaaattgaaacattagggtttatcagtacttatcatgaaacaaacaaatgatacttgtattttaatgtgaaacatattgataagtatatgttaaatattataaaaataatagatatatttgttaaaatattgtgtaaatgatacgaggggtgatgattggatatgtttgcatgttgatttatagaattaaataaattatagatgatgttttatacttgcatgaagttaaatatgtaattattaccagtgggtgatgatgtgggatggttgtatgttaagctttgtaattttatacaaagtatagatttagcaccaatctaagctagatacgtgttccgcatgaaccaaccaaacatacgtggccttttcttcaagattaatattatcactggtgtaatcacccatctaaaatgatttacttgcataatgatcactccaaaattgcctctctgtccacagatgagagaaccacgtgccactcaaaacaagtggttgtacttttgtatggaggaaggcttcgaaatgcatcagctttccatcttctattattgggacatcattattgatcaagcaaactgtttaacccggggcccttgttggtctctttcatggtagatagtttaatcgccagtgttgctttccgtacatcatgcctggcaattttgggcataaaatctggtgttacacgacacaacagaacgcataaaattttcattcttttgaaagtttgactaatgaagtttgcaatgcataatcacaccaatgttagttaattaatggcttgtcgcgtcggacacgtttgagaagaaatttcaagatgtgttatttcaactcttcttatgcattcctacctggtaggtgtaacttcctgctgctctaggtggtcttgatttaaaaaaggtacagcttagctacacgggcccagatatgtatcattgtggcttttataaatcctgtacttttctcctgcattgttccaaaaaaaaagtgttctccctctttttgtttatatccgtgaatttttgtttatatctcaattcgtatcttaaaacgttgcacatacgtcttcagtttagtctatcaaaaatcttggaactgcgacgtcacatcattgtccaatgtaacgggcttaa

SEQ ID NO: 106991 - DNA, 1128 bp, Oryza sativa
gttgagctgcatcgattcgatcttcaactagaggtaaacttgtcatggcggtttgcgttctcgggaatagtgcttccatctttatgacactctaatcttgtctatgtaattcgttgagttatcatatatactttataatctctgttagttacgctatataacttgtcatcggctgtttcttttgttaggaagttgccgatagagttagatctcgttattaatctagattatatcgtgtatctaccatctcttagaggttttcatcatcttgtatagatctcacagttatctttatgcttaatgctgtatcggttgagtttgatctattaagttttatctataattgtgatatccagcctgttttatgatcataaatagagatagtatcggagtttcagccgatcttacctgatttagctattttatgtcttgtatgcttgatcattatactaaatctgccctttatatttagatcttattgcaacaaagtatattaggctttctgtttagtatatcttgcttgttttgatatcttagtataaagtggtatcggagtattagccgatacgtgctagatctatttgatcagctatgctataaacatctacatattcattgctttaatatatatttcgacttaagtgatttatactgtctcggcatggcgaccgtctatcccaatcacttagtttaagtatatatcggagtaaagactatatgctgttaatgtctacagccgatcgagtagatttagttttatcttatttattcattattgccaatcgattcaaagatgacatcggctcgaagataaatgatatgtcataggtaagtagccgatcggctatcgtttatggatttaaccgcggtttctcttgtctttattcttgttgattgtaggatcaaatcaactggcacgctcatgaacctaaaggcgagattttggacctgtacaggatttaagcagatcttccaggctagtgtgtgttttttcacatcaacacgcttttggcacgtccggtgggatcgagttgtgacaactttttctcatggcagaaaaacaatcaccgtcatcaggagtcaagcctccaaaccccccgagggccaagcttccaaaccctccgggga

SEQ ID NO: 106992 - DNA, 540 bp, Oryza sativa
atactctgatcagaggtgtacaacaggacccacacgaaatgaacaaagatcaaatgctacataccccgtcgagtgtggtacacaagtgattcaagcttattacatgcccgttcttagccccaccccaaccacctataccacgctggggttcccgacgactcagtcgtgcgtgcgcgatgtgaccaaggcgggtgcgccacgcgggaggcacccccgtccaaacctaggcactcgaggccctccaaaggctacctgcctcacgactctccaacgtggtataaatgatcacagtagaactagtaagaacaagccggtcccaaataaggcatgtggtaagtacgtagggtgcttgattagatgtcaaaatgttcggtccttaacgacctagacggggctacttgcatcaggggaaaccaacctcccattatcgccctatcacccgtccgaatccaacataattcatcaaccattatttagtgtaagtgctcaagttttatgcccaataatgcaagttgtctatataccacaattaatagcact

SEQ ID NO: 106993 - DNA, 555 bp, Oryza sativa
tgccagatacttatattctagaacttcaccctttacatgttgtatgacgcatattggttatttttcatgtcgtgacatagtttcaacctgagacaaagagtgatagtctctttttcatgtacaaacttctttcacagttcatgaaaaataatcattgagattctctcttccaagctcacaacaaactaatatatctctgccaaacatctgatgatgcaaatgttctccttttttctaatttccttctccttctttgctctccctcctcaccttgtcttgctgctccttgtctgtcccagatatttctaagttcacatgtttgtgatgctgcactaccaatagttaattatacaaaactcggaaacaccccatcaccattccaaactttaagcctctaaaacactagcagacctcaatcatatgctctcctaacttaatttacattgtgggcatcgagcccaggagaccttccaagattatgaacaatatcagcagagagagctctgtttcgatgattttattctctatttctccaactggaaaatctaattgaat

SEQ ID NO: 106994 - DNA, 671 bp, Oryza sativa
  unsure (1)..(671): unsure at all n locations
ttatgcttcatttggttaccatataagttttcttgaatgttatctgagtgactatagttcacatattgttgtaaaaatttaatttcatagatcagtaaagttcattcattgatgttgtttgtcttctaattttcagttgacttagttttgctaagatatagccccccttttttcacttgatctcgctttattccctgtgtagtatatatgtatatgtatgtttctatctccgttatctcctctcaagaagataatcaatttcttctactctaattctcttgtacaatgggtactagaaaaattacaatgtaaccattgaaatttatagtgtcatattggtgtagatgtagtttacagtataaaaaatttgactggtttttagaacaatatgacaaaaaaatatggctagtccctagtttaatttggcccaatagtttagacgcggttatgaaacaacatatatagaataaaacgtgaattgtacatgcagtattgctagtctcactaaaagaacagtagctccatggagaaataaacccgcacaccagtcatgtaattccaaaagtngaaagatacatacaagtgcggctggtgttacccctctctgaaaatgntcaataaggagcacatttggaagccactcagcagaaacatcatattcaccacatgcg

SEQ ID NO: 106995 - DNA, 703 bp, Oryza sativa
tttttttattttgatctttggtttctcgtttacttgagttgtgtgcgtggatgagattggatcggatggtctcgattcgatgcgcctattggtcagaagtagtagaactcagaagtcgttgagctcgtccaatttaagctcaaattaaaaaatatattattctcttaaaaaaaagtccaaataccctctaaactacatatagaagtttgtaaggcatcttaaactttaaaactagatatctaactccctaaactttacaaaacagttcatattatctcttaaggtgattttgtataatggtttttatctaatttgtactctctccgtttcaggttataagacgttttgatttttgtcaaagtctaattgttttaagtttgaccaagtttgtagaaaaaagtagtaacattttcaacccaagataaatttattatgaaaatatattcaattattgatttaatgaaactaatttagtattataaatattactatatttgtctatgatcttagtcaaacttgaaacagtttgactttgaccgaagtcaaaacgtcttataacttgaaacggagagagtatataacttggatgagtttgatcacgtgacatatacattggacatatatattaaaatctccatttaaatctttctttttaatcacttgttagctctcacttgtttgcaaacaagtcccaccataataa

SEQ ID NO: 106996 - DNA, 631 bp, Oryza sativa
tagaaatggcgcattttttcttacagtttttttcttgcatgttttttttaaaaaaattaccgacgatggaaataatatttctcgcatgttttttttatggaaaatggaaaaccattttagcatttttttgcgcttttttctcacgcatttttttgaaccgtttttatttttctcgtgcattttctctttttaaatagttagattagattagagatagagaagagatatacactgattagaaatcggaatttgtttcgccctttccatttttttctcgcgtgcattttttattttgtacgaaccagctttttattttttcacgaaccatttttttagccactttcttagggaatcggacaaacttttttagatgttttttcagatttttttcgtctttataggaatcagactttatttttccctttttaaaggaatcggatctagcctttatttttcaccacttttttttgccttttataggaattggatctactgcttttttcgccacttagtggaaacaaaattttattgttgttgttttctttttttccctttttttccttttttgcagtttttctttttttttatgcacctttatgccctcgttctctcccttttattattttttcaa

SEQ ID NO: 106997 - DNA, 785 bp, Oryza sativa
ggcgtacgccggagggaggtggcttagcgtgacggccgggtcacggggagaggggaagccggccggtgcctctgccgaccgtggcatccgcctccgcctgcctccgccgaccgccgcatccgcctccgcctgcgcccgccggccgcccacgcctgctcgcccacttccgcccacgcctgcgcctgcccgcccccctccgcctgcgcctgcgcccacccgccccccgccttcgcacgtcggccgccccctgtctggtagaagagagaagaggagtagaagagagaagaagtgttgagaaaggagaggtagaagagagaaattaatttaaaatagatagcagttgaaagataattgtaaaatataagatgaaggatgtaatatggatgatctgctggagtaaaaagaaatatagagtgataatctttttggaggatcatccaaatagcaatatggaggataaaatttagatgagctgatggggatgctcttagggccgcttgtgaagaagcatttttgcaggcgaacagtactacttagccacctgcaaaaattgatatacgcaggcggccgcccgcccacctgtgatagtgcctgattttcacaatccttaaatcacaggtggagcagtaggacgcctacgtagatcggtgtttgttgatcgtactggtgatggaccaaatgacactatcggttttcccagtcacaaacaagctgttctaatctagtataatgtaccagcttgggacactggtatcatgtgttgctcttttatatatggctatata

SEQ ID NO: 106998 - DNA, 633 bp, Oryza sativa
caatatggctattgcagaatctttcttggatggttgtcctgacccaaagaaattgcttgaaattctaggcaatgttaaggttagtgaatttgcattagtttgtttgacttttgatgttcatatttccattgaggctatgtactagaaatatccattcttttgtcagtagagaactctacagctaagttactgtttgtacaggagtttctgattttttttgggtgaaatttctgttttccaaatgtacctaaaattttcttggcaacaataattcaaacctaaaactatgtttactttttttttcttatataaattcattccaattgtaaatttggttatacaagaaatgatataattttgatgtttgtcactttagtccaatcatttagttagtgtcaattatatgttactaactatacttagttctcaaaaggacagtcttcttgttctgccctgttttccttcatccattcgccgggggtcttatcattttgcacaactcatctatgtttcagttccaatttcaaatttgttcttttccttcttctgggttgatgaagatatttgtcacatgctacatgcacgaaaatttattttggtttgggtataggaaaccttaacatctacatttta

SEQ ID NO: 106999 - DNA, 1145 bp, Oryza sativa
tactcttgtctatggctaggatgggttggaaactatgtcacgtcttccgtctgtataccgtggtggtatgtggcacgtggttacacgtgaggaagatgtgtcttgtaggtaaagatgtacacctctgatcagagtataacctattcgaatagccgcgccctcggttatgggcaagccgagcaatgtacccaagttagtgtttttaattcttcaaacctgcttaacaactaaaatgtggaatggttggcctgggttggcttgggacgagctgggacccaaggtcgggttgccagttcggtctgaatcatcgtaggccttgggttaaggcaggttcgtgtgggttcacggccttgattaataatattgtatagctctaggaccgtatttacaaaatagctttgagcaactaagtgtcttttaatgctgtttactgcaaaccctaaccccctatattataactcccttgtactcccttacatttattctgcacttgtgggtgtgtcttgttgagaacggtggttgtactcagtcttgctcaatttttcccaaagccagaagaggagttcctggaagatgaaggctttggtgtctagctcgtgcctgccgtcaagcgcctgtggtcgtcgccctagtcttccgctgtttttcgtttgtcttcctgtgtgctgggccttcgccgcccatgtaataaattaattgtttaagcttccgcttgttaaactctgtattgtatcaacttttggtgtaccttgcctcctgggacaaggaataatacacgcatgtaaggaacgcccattgggttatttccagtcgtgacagtgtccacgaggaagaatgggtccaacggagccttcccgggttcggccgaaccaccaatttggccgaaccacttctgaggccgttgatcacgagattcgacgtggacggccttgattacttcctgatggcggttccagggtagtttcgtcatttcgcataggctgtaaccgtcatacctgcctataataggaggagctcactctcatttccaagaggctctattgtatcttttgtatattaaaataaggaagagagtgaggggaagctctggaggagtgcccggaagtttggcgctcatccgacttctactttgacgagtgtagctt

SEQ ID NO: 107000 - DNA, 643 bp, Oryza sativa
caccttcatcctagttgaagtgcagttgtgagttttcgtgtccaacgtttgaccggtcgtcttatttgaaaaatttatgaaaaaatttaaaaaaagtcacagatgaagcattattcatatattatcatctaataataataaaaattaatcataattttttttaaataagatggatagtcaaacgttgaataaacgatacaaaactatattctttcttggacggaggtaagtactactccaatttttatgaagatatgtatacacctccaagaccttgttcgggtggaaaaggattcccttcctcatggggattgagcaatcatgacctaagttagcttatttagaccgcaagcagcacaagaatatatcttatgcatataaatttttcgtacacatcaactagcaaatgtaaaaaagtttgtagaaaaaatttgacacataatacatcctgggctgggtagtgttgagataaaactagcgtcatttttttcacgctcgtgtgtgtgcttggtcgggtattcatttaacactatatattatagtgatccaaatagaggccggccggatcaccgctttatcaacacaccggccgttttttttgagtactactagctctcttcactagtgtacggccatctattta

SEQ ID NO: 107001 - DNA, 613 bp, Oryza sativa
ttattatcccttaatcccctctcttgggatcacacaaacaaggtctttgagtgtgtaccttaagatctgtgaaaacaccttagacattcatgagagaatttttttatatgaacaataaacatgtgcgggaatattggtcatttgttggggttaaatgcttaaccgagcgaatagagaaaaaaagtgggtgatccttggcttgtggcagtcgggcgtatctcaagatagcttgaggcaagcaatgacatttccttatgccataaaaaaaacatttttttttgttttgggaacatattctatgcacaaaactttccgtgtacacttcgagcgcaccaactagcagatgtgatacaaaattctagaataaaatggacacaggcttgctatagtattacacctaccagtgacaacttatcttccaattcatgatattttagactaaaaaaacacgagtctaatagattgttacccttcaaactgatagttgtttttcactcctcatagttgggctagaatataatgacttcggatgtgagacctttcagaaacgtataatactattaggagtgaatgtctatttttttgtacaactatcatgacaattggtaattgg

SEQ ID NO: 107002 - DNA, 549 bp, Oryza sativa
aacgcccattgggttatttccagtcgtgacagtgtccacgaggaagaatgggtccaacggagccttcccgggttcggccgaaccaccaatttggccgaaccacttctgaggccgttgatcacgagattcgacgtggacggccttgattacttcctgatggcggttccagggtagtttcgtcatttcgcataggctgtaaccgtcatacctgcctataataggaggagctcactctcatttccaagaggctctattgtatcttttgtatattaaaataaggaagagagtgaggggaagctctggaggagtgcccggaagtttggcgctcatccgacttctactttgacgagtgtagcttcctaggaggaattctgaaggagtaccggagctgtcgatacactctgctctaggttcggagagcttattctataaagtaagcattcgtgttcctttcttatgttatttaatttcttagtctaagtaagatagatttccatctttgcgggttcattgtttagtatttatactaagtgctctagtactaggact

SEQ ID NO: 107003 - DNA, 581 bp, Oryza sativa
tgaaaactcaacaaggtgtgcatcggttgacttgataggagtttgagcaaggaattcataagctgctttctctgattctactgaactaactgttgagctaactgtggagatggacccagacccaatttcactttcatgtgaggtcacagtatcatggtttactctctcatcagaaacctgcaatgcaaaggaactggtaataagctctatagtctatcccaactggcttcagattttcaaatggagcaatggactaagctttaaacttaacctgagaaataaaccatcccttaactctttgttgggcttattttgacgctaactagaaattttaaactcgaacattacattaaaattcgacccatagtcccatacaatcaagtacatgatccagtaacagtaacttcaaatttgatgtccaatacgcaattactccccacatttcatattataagtcgctttgactgttttcctagtcaaacttcggtaagtttaaccaagtttatagaaaaatatggtagtattttcaacacaaaaacaaacatattatcaaaatatattcaatgttagatttaatgaaa

SEQ ID NO: 107004 - DNA, 688 bp, Oryza sativa
ttaaagaacatttgatgataaatcaagtcacaataaaataaatgataataacataaattttttaaataagacgaaaggtcgtttgtcaaaaaatcaatggcgtcatacgttaaaataaaatacggagggagtattttccatgagctccaagatgaaccggaaatacttggggaaaagaacaggtgaggagaggcgaagccaaccgccatctaacctgacgatggtacctcgtccaacgtccagtcgacgaccagtcctcttccggtcttgagcgcttcactgctgaattggtagatttgggacagatgtataacgaccgtcgacgaggctagtgttgatcatataacaactgacaagtctgcaccgaatctgattctccaccacgtagcgtgcgtgcatgtaccttattagtatgattcttactctaaatatttttgtcagttacttaaaaaaatgagatttagagaaagagacgttactccaaatattttttaagaaaaattgtaagtgtgatgggatttgaacatggtaacttagggtcaaaatcacatactccttgctaatgcactgtaaagtacatctcttgtcaatcacttctatgttgcgtaagtaatactccctccgtattttaatgtatgacgtcgttgactttttgataaacgtttgacccttcgtcttatttaaaaaa

SEQ ID NO: 107005 - DNA, 671 bp, Oryza sativa
caacaaattaagtgagcgtgcataattattattcttagtcggggttgctgaccatgtatttgtgttgtttaagtttttcgactttgttgtgtttgttgcgtgtgtaacgtcgaatgcaccaaggtctagtttgcgttgggccatcgacatactggcatgtttttgcgccctttgaactcatccaccaagatggctagggaatcgaaggtcatctacactgccttcccttgcattgaaagcttgaaccaccactccgtgtgaaggtgccgtcgatgaaataggatttggttcaaggtggtgaaggtgccgtcgatgaaataggattcggttcaggtgcagtcagtcacactaggaccatccaagttgtatctaaggactgagattctcggagcaccgttcacataaaaaaaaatattgtacaactattgtagcaatggtactgtagcacttgatctacatccttgatctgaaaaataaatggagcatgggcgccacttaggggtgtttagatccaggatagtaaagttttggtgtcatatcagctattatataggatgtcgcataaggtatttgggagctaatctatctatctatccgccagctgattagtggagatgacggcttgtatttttctgacacgtggcacgaaccaacatcgtatagatgattct

SEQ ID NO: 107006 - DNA, 641 bp, Oryza sativa
attgtaaatgaaatatgatagacatgccaatgtgatatccgacactttgattatatggatgatgaatatatgttaagtattataaagatgatggatacatatgcatacatacatacatgtatatgttaaaaatactatgaaaataatgtgaaggaagatgattggatgttgatttggagaattcaataaattatagatgatgttgcatgcttgcataagttttatatgtaattattgttagtggatgatgaagtggtatgtttgtatgttgaactttaagattagcgggttataactttatactaagatagaatatggagttataaaatttagaaaatgaattagaaatcaaacactagctatctaccagcagctacttaaaatcttattaagcttttcaaacagaccaagtatttttcttttttggcttcgtttctgaaccggagtctgggaatttttactagtaagatcatggtttaccacaatttatcttttttttttctgggaaggtcaaaaggaaatttaatgattgtattctgagctttcattttttttagcttacgtttttgagccgttaaccatacaaatataaaggtcatgtcccaaaaaaaatatttattggtttccctaaaaagagtatt

SEQ ID NO: 107007 - DNA, 822 bp, Oryza sativa
caatagtcattcacaaattataatagcattttcttttatcgtttaattcggaaatcccgagcccactaaactaccgtccaaaccaggggcagacggctgcttcgtttcaaaaaagcaggggcaaaatcacaaaccctaaaaaataggagtaaaatcacaattgagatgtaaattaagggcagaaacacaattgcctctttctctaaaggcagtgttggagggtttgtgctttttcagagtagtctgggtttttatctattaagaacaaccttccccgtgctttgctgtgaaaatttctaactagtaacttttaatatttttaataattgagctaaaagtaaaaaatatattagttataaaccataaataaaactgatttgtgttcagatatatacatttattagacttcgtacgagattgtaaatgaaatatgatagacatgccaatgtgatatccgacactttgattatatggatgatgaatatatgttaagtattataaagatgatggatacatatgcatacatacatacatgtatatgttaaaaatactatgaaaataatgtgaaggaagatgattggatgttgatttggagaattcaataaattatagatgatgttgcatgcttgcataagttttatatgtaattattgttagtggatgatgaagtggtatgtttgtatgttgaactttaggattagcgggttataactttatactaagatagaatatggagttataaaatttagaaaatgaattagaaatcaaacactagctatctaccagcagctacttaaaatcttattaagcttttcaaacaga

SEQ ID NO: 107008 - DNA, 506 bp, Oryza sativa
cgagctcggtacccatatctgtaaatgaaaactgcacctgcagggctttaacagcggatttgtacagatacttgtcacatttcaacatctctagtagcaacttggatagagaaccgaaattctgacatatatcaactgggtagcggcagaaggcaggaagcaaattccacagctgattggaacatgatttcaagtcttcacatttccgtgctgacttggctgaagttaaagcagaaggttaggaaatcatgttgcgtatgtatttaagacctaatgaattggctttacctacccatgttagaagcttgttgtacagattctgctagaggtacaatgcgctctaggaattgttgtggtgaggccccatagatatacttatctaaaatgggcaaagccaagtatttgagcatgttagccggtcctcatcaaaacctattggaattagtgaaaggattttatctggccccaaagcaatgacagctgccccaatgcactcttcaacctga

SEQ ID NO: 107009 - DNA, 609 bp, Oryza sativa
actaaattttttacttaggtagatgagttataattattctagatgcactcacagcattactaagggtgtgtttgagaggagaaaaaaagagaagtttaagaagatacgtaaaacaaggtgagctattagaacaggtacaataacagactattagccagctataaacatattttaatgagataaaatatgatagagaagagaatcgggctacagatatgtagccagctgcagcacggattccaagacgtagtgtgtgtataaattggctatatatggtgagaccatatataaagagtatagtaatcaactattgtatgaattggctattagattaactatatatgaattggagctagtagtgggctatattattaaacttgctcttagcgcatgaataattgagtgttaactatttcaaatataaaaatagattaatatgatttttaaagcaatttttaaatttttttttaaaaaaacacatcgtttagtagttcaggaagcatgcgcgtgaagaacgagagaaatctcctcttagtctcttgctactgaacgaaagcttaagaatttgcaaatttgccaccgtttttttcaattttgcaagtatgccac

SEQ ID NO: 107010 - DNA, 573 bp, Oryza sativa
catatatgatagtttctttaatgataaatctagtaacattaattttacgtgattgatcttttttatttttttctattaatggtcaaagttaaaaatatttgactcgttattatgctataatgcttatattttggaacagagggagtacttacaaacaacacggggctgacaatttctttagggagggtgatcccaagcccaccgtccctatgaaatcgcagcaggacgtaaggatgtcctacacttatgggcatgcccatgcatattgggggttcctactggttctgatggtgtcatcaccaacgctgcgcgcgcttgatgatttcatgtccttggattataggatccccgatttgatggagcttttgatgcacccgctttgttgcacgcagggatcgggcaccgagcaccctcgcaaggcgcgatccggggaacagatcgatcaggttgaatccattcatgagatccatggtcttgtctaaagcctcgagatactcatccccctgcgggcacgtgtcgccgatgattgccgtcatgatgatgttgttcgccatgatcttaaccagctcgctg

SEQ ID NO: 107011 - DNA, 524 bp, Oryza sativa
actataggcgaattcgagctcggtacccgaaaaacatgtcattcgcttaatccgtactatttaattatttttttagcttcgctgtgccttggtcaaattaatgttacaaaaaagaagttctggtatggtgtattggtgttaccatgactttgcacttcaattgcttatgtagaatgtaaatctcgtgatctagcgaagctccatgagcatgcaagatgtactacatccgtccctagatataagggatttttgttgaatgtgacatatcctagtacaacgaatttagacaagctttctgtccaaatttgttgtactaggatgtatcatatccaaccaaaatcccttatatttagggacggagtgggagtagcttaattgggtgaagtaagcagcagtcaggccgaagcgcggttaagcctgccaatggggcaagatccaccccatatccaatccactagccatcccataaaatccaaaccagaccaatccattttcctggtcagtccaaaccgacccaacccatt

SEQ ID NO: 107012 - DNA, 656 bp, Oryza sativa
  unsure (1)..(656): unsure at all n locations
gggcgaattcgagctcggtacccaaggtaaattgttggacaatggaattgaataaattgtcacctttttcttataaaaacctcaagtaaatgttttgattaaaaagaggtgtgtgggactatgttctggcgcttaatttacaagttacccaaacataacattcaggacaatgataataaataatcgtgactggccggtgtagatgtaatcgggacaaagtgattttagtttaatatgagtgaaattcagtatatcaaagactacaaactattccacagtatagaatattctttttcaaatttcttaattataatgtagtttatcgtacatataacgaatacgatgaggtaggatttctttaagcattctcccgcttccttcctagttattaagaatttgtgttagataaaacatgcagcaatatataggtggcatatgcttgccaatcaacgtgtacatgtagagtgcacaattgtagatatgtcaggaacaaattatttgataatagaattcaaccgtatcctatattttttaaactctaacttattggtagttgtttacacccaaattttgtacctagggataaaataggaaaaattgccaaagtttggaagtctgccggntttctctaattgggccagtctgactgccatctg

SEQ ID NO: 107013 - DNA, 603 bp, Oryza sativa
aatggcatggctggggttggtaaatgcaaatgttgagctggtccctgtcgacatccccatgcccgacatttttcccatgcacaacccaacaccgtcggggcccaaggatggatgtttgtccccggtgattattcacctggacaccttggaggacctccagccttatccaatggtgtacaaacaatacaagtggtcctacggaaactatgatgattgtatctcgttcccaaataggctataaggctatgccatgcagactacatccgaatgctgtgcggggaccaaatgaagacccagatgtggatggtggtggaggttatacgtgctaccaaaaacgatccaagtcactgtggggccgcatcacggggagatcccacagcattgatcgtgggggagatggggaaagattctacaatgaacacactaggggatgccatcgcaacagagacacatacattatctttaacacattctccgatctatggacgacactgaagttagggccaccattctacttttaaccctgcataaccacatagccaagaagggggggggatccctcgcttttgatctgtcttcttccccaactgaggtgttttcctt

SEQ ID NO: 107014 - DNA, 520 bp, Oryza sativa
tcataaatctgttttagttatgcatgctggtgaagtgatatatgatgaaatagtatataatgtcactttcttttaataattgttcatatatgtttgaataacatgtaaaggttctcaacaaaacttaaatgaatataattttacaatttaaaatatagtcaacatgtgtcataaattctaattgtgattttaatcataaataacacaatggtacaaatagataaaaaaattgaacttataatttaaaagttaaaaagttagtataatttaaaatttactgttgcaaatattatgtatttagaagtatgcttatttaaaatttattgttgcaaaagctctcataaagagagaatgtgagggaaaaaaatagaggatttcctaaaagaaaacacagaggaggatgtacgttttttttttaaggatgagaaaacataaatctgatttaatggcttgaagttgtatgtccactaattttaataaaaattaaaaggtagatgtttatttttcacgatatatgatt

SEQ ID NO: 107015 - DNA, 516 bp, Oryza sativa
taattcattgccgtattcaaccatataccaaaaatagtaatgcaaatggaagtaaacatatgtttcgtttgttgcaatttgcaaaagaattggcattgccaaaaacgtcggcaagaaaaccaaagcacatacacttgattgcttcaaaaaaaaaatcacatactcttgccttttgactagattaatttgccaaaattttgacagtagccaaatctcgtctttaaccaaaagtttacattggtgtcgatccgaacaagctctcgatgttctgactaaatagctcttcttaaacaaatggacctggatgtacgaaggagtagcatgctgactttgaagtttgaagtctgaaccggcaaatcgcacaaagagatgatcgattggccaaggaaagaagctccttttaaagtacttgtgtcatttatatatgagcccacgatatgggtccccataccaaccccttaaaatcagaggacaataagttgtagaatctgttttcactgcccaagacatgatcat

SEQ ID NO: 107016 - DNA, 934 bp, Oryza sativa
ttttaaattatgacaacttcaaacaatattttcaaatactaaatgatttgaaatgaaaaagtcatcaacaacaaagttgtataacttatcaatatctataatttttactttggtcatttttctatatgactttgtttcaataatttgaatttgaatttcaaattatgacaacttcaaacaacattttcaaatactaaatgatttgaactgaaaaaatcaacaaaaacaaagttgtataactcatcaatatctataacttttattttggtcgtttattcatctgacaaagtgatagtaacattgttcacaaaatttacatatctctcttatagtttataaaccatatggagatatgtaaaatttatgaacaatgttaaaatcactttgtcgaatgaacaaatgaccaaaatgaaaattgtagatctagatgaattgtacaactttcttgttgatgactttttcagttgaagtcgttcactaataaaaaattctatttgaagttctcaaactttgaatttcaaatttcaaattatttaaatagagtcagatagagaaatgaccaaaataaaatttttgcatctcgatgagttctacaactttgattttggtgacttttccatttgaaatcatttattaatcccaaattttgttcgaagttgttaaattttgaaaattcaaattttgaaatgttcaaatgaacttattcgtaaaatggaccaatacaatagttgtagatctcgatgagctctacaattttgttgtttatgatttttacatttgatacacaaaacatagcctaaaattaaatttaaagttatcataaattgaaattaaaaagtacaacatattattgtattttttttttgccaaaaacaaagaaagggctgcagaggcgccccgaatttttggtgcgaaccaaagttttagcgccaaa

SEQ ID NO: 107017 - DNA, 943 bp, Oryza sativa
accaaagatggtttcttcaccagtgtagcaacaccatcttttatgtaaaattaactgtaccgtacagatcaaccaaccaagaagcataatatatacaaacttgatcctacaagatcaaattcctatcaattcaaggacctacaggatcaaagcatatcggtataatctaatcttgctacacaggcctcaaattaatttgttcagtttcagaggtgcttggtttgaagcctaatcttggtctagtgtttaaaacttatgaagataaagattaaattggcgtacgacgtacgtaaaacgcgaaagatattaacacatgattagttaagttttaagtattacaaacttgacgaatggatatattagatattttaaaacaacttctatataacaagttttcgcacgaaaatgtaagtttgaaaaacgtgctaacgaaaaccgaggtaaaatctatatcttcatccgaaaagaacatgattcagccgcacttatggccttatcggttctgacaaattagtgtacaagagtacttatacttcactatataaaaaaaaactacatagaaatatgtcttttttactgtacagatggtgtacataagaaaatccacttatgcctgcagtgcgggctgtgcggcccacagttagtattgcacgcctcatttctattctagagacggttatgcgaacatctagaaattgatttttagatatagttgtcttaagcgattgtctttaaaagtagattttcatatgtggtcgtctaagttgtccgtatgatttagaaatgtcactactcgtatgtgcccccaccccccctccctttttttccatattacgaaggtggtattttttaacctggagttcttttgtgccagtacttattaattaattaatacttcgtaaaatgacaattggatagtccttacatgtataaagggtttttt

SEQ ID NO: 107018 - DNA, 528 bp, Oryza sativa
atcttgtcgggcttgaaattttttgttggtatcctccatacatggagctttctcttatttgtaatacccaaaaattcaccagagctacttgcaacaatcatttccggtttacgggtctgtgttaaatcgaagcacacaacacattgatgtaagtgttaatagaaaaccttaccacagatactacagcacaatattattgatatatttctaattgcaatagcaacattagcagcaaactacatttccaaatggaagctcactattcatagcatgatcaataataaaatatgtaaaaacatattgtcgcaggaaaatggttagaaaacgaactgggacaggtaaaatttgtacctcagccagaagactacccacttgacgccctttggctaagtcataaattcgcaactgcccgcgcaatttctcattagatggcttactggtgtctttaacagagacgaatgcaaacggcgtgtaaatttcagctcctctcgatattctggctatgttaggaatgacctgcgcccaaaa

SEQ ID NO: 107019 - DNA, 595 bp, Oryza sativa
ggaggtaaatggacttgtcagcgagggatgagtaaaagggtgggccggcggcccgaagagagaggaggagggagagagaggccgcgggctgagggagggagagagtaatacttgggccgaaaaaggcccaaggacagagagaggaattttaatttatttttcatttattttaataggttaaatgaattttgtggtattaaaattagttattgagctccgaaaattcacggaaaatttcaaagaataatttagaccaacttatagccattttagtttgtttttttaagttttttcattcaatcataaaataaaacgccacaattttgatttttttattcataaaatgagactagagatgacttcaatcctaaaatcctaaaatcctaaaatgagagactataattgatgtagacaacaagagtccacctaggacaaatgatttatggtctagtggcaatgtagtataacaagattttttttgttttttttaaaaaatataatagttatgtgttttatgacgatccattattgtcatccggctatcgtcacagagcccatgcagagtatactatgacgatggttatgacagatacac

SEQ ID NO: 107020 - DNA, 653 bp, Oryza sativa
tagtgagtctatggatatattatccaaatcaatgtactaggcctaggaaggaacatggtctgtagccagtgacgacagggtctgctgccgtgtagaatttagttcattacttgaatatcgaatgattcctgcaaaattttgccattgtctccaaaattggaagtgccttttataaaatccaccataacccaatggatccttaagcataaaggtaaaggctttatatacatgtaatcgtgtatggtatataatctggacttttccagaattaaaatagcagatttacctaggctttcctcgagcatctataagttgatgtgtcttggcatcaatgttctcttttacctgagaaaaaaaatcatgaactagttataccaaacatgcgactgagtttaataaatggtgaagaaatgtatgggcaagattttcagcctgaagacctctaacctggtcaagattccaaataagatgaggctgcaactttgcttcaaatgtggagggaccaacctacaaagataataaaaagttatgtgtgactgaaggtcaagctaagcaccattcacagcagctactagcatgagtatcacgattcaggggttgacaagtacataacaggagtaaggtccaaatgttagaaaacaaaatagaggtta

SEQ ID NO: 107021 - DNA, 616 bp, Oryza sativa
taatctgtaattctgatagcaaaactagctctttttggtgaaaatgtaacgcgttaagatatccagtaacacggtgagtgaatgatgctgttttactgactctgaataaagtgtgtgttgatctggtaaactgaaaactcgatgcttctttcagagtttcagttgtctgttgcttgcatacatgatggaatacttttttcttctagaactctataacaaccaggcaaataatttgtcttcctggaaaaaaggcaatcttgtcgattatgtactgatatctggcaggctaaacttagcaattgcattagatgccaaatattgccatataagtcttccagattcagaaattgatggctaagctgcactgacaagtacgaaatgcatgcaggcttgtgaacagtttcagtctgtatcgatggcaatagatgttgacccgtgccatatctccaaatatgatactccagtaatttgtatgatattcacatgaatcaagctcagttctcgtacaaatcctatgaaattcgtttgttccaaacaagccctaaacaaaaaaaaattatgatgtcataatacgacttacaagttacaatcaatttgaaacgcgtgaattttactg

SEQ ID NO: 107022 - DNA, 544 bp, Oryza sativa
gggactatgttctggcgcttaatttacaagttacccaaacataacattcaggacaatgataataaataatcgtgactggccggtgtagatgtaatcgggacaaagtgattttagtttaatatgagtgaaattcagtatatcaaagactacaaactattccacagtatagaatattctttttcaaatttcttaattataatgtagtttatcgtacatataacgaatacgatgaggtaggatttctttaagcattctcccgcttccttcctagttattaagaatttgtgttagataaaacatgcagcaatatataggtggcatatgcttcccaatcaacgtgtacatgtagagtgcacaattgtagatatgtcaggaacaaattatttgataatagaattcaaccgtatcctatattttttaaactctaacttattggtagttggttacacccaaattttgtacctagggataaaataggaaaaattgccaaagtttggaagtctgccggttttctctaattggccagtctgactgccatctgttg

SEQ ID NO: 107023 - DNA, 826 bp, Oryza sativa
tgaaaacaaactgctgatatctccttggataagtccgcagaaaaatgcatctgatataattctcattttatatatgtacttttgacagctgcgtgttgctcgtcaagtagaagtgagttgcagttcttgctcttctaagctgtcctgatggagaaacactggcagagcaagatggggtgatactacttttcgatgcagaaaatccaaagcctgtttcttcctggtcagtaaagaaggtatgtttggctgagttgttatactctgaacagtccatagagcacattatatattttctgggactaaattttctggttagtgattgtaggcagtgcgcattgttagctacttattgctttggttctcaagtgaaatgtttatattttgtttctttcctctgcttgtgtcaatctgttgaatgcatcagtggcccattaatgtattacaagaattaatttcacttttcttttgtaggcaaggggaggcagcgttgcttttttgaagggtgattcctctttggatgcaaacagaaaagacaggatagatggagaggcatcatcgctggtttatgtcaacggttctcatgagtatgttatatttgatccccgaagcaatgaagaattgcatattggcaagagtgcacacaaaaatattcaaactgaggagcctggtgagttatggtttgctgcatttattctaatcagcttctgtatacttgtatttttcattgtgttaacctgctcttctctacggctatatttgctggtggcaagattatatagtactccctccgttttaaaatgtttgacaccgttgactttttagttgt

SEQ ID NO: 107024 - DNA, 1865 bp, Oryza sativa
ccacttacgtccgatctaagatcaatggacatctacacttgtggatttgagttctgcaactagtttaggtggtcatcatgtttggtcaaatgttgtgtatataggaacagctcaaaggtgagaaaaggtttaaaaagaagtggaaaaagggaaagtgagacaacaaagaaagttggaatttggataggagggagtgtccatatcacacacgcatacacatggtataggaatgagtcaagttagaccagtagtagtagtattaatttccttagcagccacagctagcttggcattggcaaaatgtatttatcaataatacttaaaaaggcttcagtgatagggatagtgaaatctatcattgtaagtatttccgtcgtaaattttatggagtaaatcacttcttgaacatcttgatattgaaggcaatcaagtttagacaaatatagaatcaaaataagtgaatattccccgtagcaaataatggatagcacacttcattaaaaaaatatatttatccgtagcaaagcacgggtaccatctaatgtatatgtgtggtattattttggtgtttaccctattggtcactggagacaagaccagtgtggtagtagcagttaaattctattgtagtaattagatggtaaaataaaatatataggcagaattcttcaaaaagaaaaaaaaatgacattgtatctatgttgacgaaatggttccgtttctctaaaattctcatgaaattcctccaacctaaataggccgtataagaatttagcaaaacaaaatattgtatgattgactagataccccaattacatctatatgttcacgaaagctaagtttgtatttttcaaaatgaagtcaactcaaaatccgataatgatccgaaattattattggtacaactttgtcatccaagtgggattagtcctaatttcttcaccataaatgcgctgtgccatgggtacgttgtatactcgactttgtcgacatagcttacataaaaaaaaaattgaaattaattaaacattggaacagagctagctatccatgcatgacgttcgcatgtgcttaggacagaaggatattactccctccaatatgtcttgataaatatcgttttggacatcattatggtatttacaacacaattcaataatttgtattgtaatatattatatagtctagtgaaattcaaacattatgaaacatttctccagattaatttatatgtgattctcgcgtatccattctaaatacttttaagatgccgttcatacttcagagttttaaaatgtttgaccagaaacatgtccaggtacacgcagggtgaaatgagttttttaatatatttaatatgaaaaaggtattccattcgtcatctctttttgttaaacccagccatattggttaagtgaaaatgatggtttgcaaccttgcatcaatcaatcttaaagtaacactgttttgagaaaacaaagcgttgatgttacgttggattttcttggcttcacattcttataagcatagtttttttttaaaaaaaatgttaacccctctctagcgttgacaatgatgcgaagattttttttagaaaaaaaaacgaatgatgcaaagattgccatatgcataatttaattgtatttgtgatacactgactgacatatgttgatatatctccatgtggtgcaaatcaatctctgtacttttttcaagacaaaatccatgccaattatgtatatacaggaacctgaacaaagaacaaccacgtgtcttccagagataccgcacaaatgtgcagcaaatcaatcataatttacacacagagtacgtttgaactgtaaccaattacaatcaaagacgtc

SEQ ID NO: 107025 - DNA, 1506 bp, Oryza sativa
aaaacaaagcgttgatgttacgttggattttcttggcttcacattcttataagcatagtttttttttaaaaaaaatgttaacccctctctagcgttgacaatgatgcgaagattttttttagaaaaaaaaacgaatgatgcaaagattgccatatgcataatttaattgtatttgtgatacactgactgacatatgttgatatatctccatgtggtgcaaatcaatctctgtacttttttcaagacaaaatccatgccaattatgtatatacaggaacctgaacaaagaacaaccacgtgtcttccagagataccgcacaaatgtgcagcaaatcaatcataatttacacacagagtacgtttgaactgtaaccaattacaatcaaagacgtcattatgtctgacaggatccggctttgttgccattaggtctgacaattaacctaaaaatatcttgattacgtacgatcgagatgattaattttgggacaaagatcgagaagatggctcaaagtgcttcaattttattttattttctccttgcaatttcacatgcggtcgatgaagttggtgtctacaagagtgagccagttggccaattgcgactatagctaacattgcgaaggacatcacaccgaaaagataaattttgtgatttttttttaaatcaagagtaagcagaaatcgtgatcaatgttcaagttgggcacgtttcaaaattcaaatccctgtcccgcgatgaattgacgaaggaacgtgcaggtctcaaattacgtgagtggtggtcgaaactataaagtgcttctttctgattttattggcaataagtccacgcttttgcagaattgcagcttatgctaaataaatagtactccctccgtttcaaaatgtttgacaccgttgactttttagcacatgtttaaccgttcgtcttattcaaaaactttggtgagatatgtaaaattatatgcctatataaaaatatatttaacaataaatcaaatgataggaaaagaattaataattacttaaattttttgaataagacgaacggtcaaacatgtgataaaaagtcaacggcgtcaaatatttcgaaacggagggagtagtagtttcgttaaaaataggacgccactttttttcttaatttcaatcactgttttttattaaaaataataataaacatagttagtcccacgaaatacgggaatagattgtttagatatagagttaacaaaagtgagagcatattttctcaattttggtcgtattgcacaatccaaatatctaaatgtgtactcgtagaagaaaatatctttctaaatctacttaaggacgtgcgtgcattacactcataccactgcacacgcatatatgagcgcgtccttaactccttatacacatgtgacatgtccactataaattcatatattatctctccgttttataaaacaaattagatgctatcaggatttattgtactcagttatgtttcatcctattaga

SEQ ID NO: 107026 - DNA, 1438 bp, Oryza sativa
gggcaataagaaaacagcagcagcagtgtctcgtttattccactcactctctctcgatctctccccccacacgatatgtccttcctatcctttcccactactttacttcccactactttactttctctctcctctctccctcgtatgcattgttaatgtttgtagtgtcataattacaaatcccccggctctggcgaggcgttggatttaggcggtcctctctctcgttttgctctcctctctctctctcggtcttctctctcgctctcctctctctcggagctgaggcgacaggcggtggcgcaagaggggaggctgcggcgggtagagacggtgcggcccagcggcgggaggcggcatcgatcggcggtgatggccacgccctcccatctgcggcagcggcatgcagcgagaggagcggcggccgctcggaggcgcccttcctcgggcagatccgacgggaggaagggtagtggcggcccgacatcgccaccacggcctcggggcagcagtgtcctcggcctgccatgattttgttgttggatttgtgatttgattttctgggatgatttttttgttggatttgtgatttcctgatttagtggatttgtgattcattttctatcgtttctttgtattgtcgctcagatggatcggatcgggagggaggtaatacatggatattaggtttgttctggggatcaaatttatgaggtcgagattaaatttggtattttcgtgttgtgtttttggttgtctgattgattgattgatttggggatctagctcgggttttttttttttttgaagatagactcggactcaaacgaacgaagcagggacggatcgcacggacgagtgaaaaattgcgcataccgacgaaagtttgggtgacaaaaggaaaattacaaatctgttaattagttaagataagataaggcgtaagagtgcgagaccaaatttatttgtagggtagtgcgctaggcaagagtatatataggacatatgccgtatatcggtttttatattgtaagtcagttgtaagggtagatttacttgctcacgagtttatgcaaattttaacattttaaaaggaaaaaaaatatgttttctatttaaaagatccaaaagtttgcaaccgcaacaaaagattgcacaagttaaagaataggacaatcgctaccgtagcctgttggagtcacctaccgtctagaaggatgcttttttatgaagagaaaaacatgccgctcctcctcaaaccgaatcggatccagaattgcagattcatgtgacaagcatcaatcatcatgcctgacgtctgatcttcacaatggtaaaaaaaatgttgaacaattatttggtcagtgggaggaccgactggacagtaaccttgggtaatctgaccatccgaaggataggcagtaaaagaaactccatt

SEQ ID NO: 107027 - DNA, 620 bp, Oryza sativa
tcattcaaggtccaggatacaattcagaggtctatatatgcgtgtccagtactccagtcagcactgaatatttggtgaaaaattgagtattttccagtgcatgatgagatcatgcatgatgaagagtattggaagacagtttaacttgtaaagttgcagttttctccgacaatagtgatttagaaaattatgcgtgccataatttgttggccttagatttcggatcatgtcaaaagtaatgcatatgatatatgtgttcctaacttcctatcactcgttcactattatatattgagagttcctacgttaataagttaaacccatataattagggacatgctatgatcctgtacgtgaacaagttaaatttatggggggcatgcatatctctcttcaaggcacataaacattaatcctttcactgtccatgcgtcttgtgcatgaataactttttgcaagattcaaaccacactagccacatactgccttcgtcccagaaaaaagacaacctatgcccaaaaaaataaatctggacaaccatttgtctacatatgataccatgtagatcctaagactatgaattgtggtgcttgaacgtaacccgctctgataccatattg

SEQ ID NO: 107028 - DNA, 2315 bp, Oryza sativa
tgttgttttaaccattttcttaaaagaaaaatctctttccattccactctcaatataatcattaccaacaaacgcttcgtctgcatgcaaatatcaacctgttcgttgtctacatggaaatatcaactttaattttattattttgaatcttcgactcctaaagaagacaataatcacgcaacatttgcaacatgcatcgccctctgcatgactgtaagggtaacaagtagtttctttccaccttttgtttttgcagttattgagtttgtctctcttctaaacatttctccttaatacaaaggtgtatatcttgtgagcattaatgaaaaaagtatgggatttaccccaaccagatcgacataatgctaaaagcatgaaccttattaccagctctagacacatacaatgcatgtctcaactttcatcatcttttttttatatatataatggaatatacccggactctacatgtctcaattttcttagcctatatatatatgagggattcatgcatataactaaataagtggtggttgcacaaatcacttggatttgtctttgctgccaactacatcgttctagttaggattggagctcctatttggtcagcatgtcggatgagcaacatgaggcatacctcgccgcgtcggtgaagttcgatgacggcatgattttgtgttgggagtgttttaagtcgaacaataaagattcgactaaagcacgacattacgaagatctaattaaacacaacaaatcgaagcatgctaggaacaaatttatatgtggcaagtgcggttgttccttctatagcgagggagaggagggcacacatgatcgtatagtccacagtacctagccaggtatatggtgttatatgagattgaaaatttttacattgcattttgtagtttaattctaacctcaattgtttgtttgatttttttccccttgaaggtcattgggctgctaggtggaagaaattaataatttgatggatttagtggttctcactttaggaggattccaactagagctccatcagctagattattagtcttagataatttctttaatcattagtagttgtgcttgctgcctatagctttagttgttctcgcttcatgaggattctatttgtagcctaatcattttattattgatgttgttaactttgccgcctttcattatgatctaagttaatctgtctaattatttaattgtcagtaatttggcactatattttgattactctcgagtgatggttcaaagcatctgcttaatttatgcattctaatttgagttgaataatttcagtgttgctacctttaaaacactctaatgcaatgaaccatatgaactctaatgacattaaaatttcttaacagaatcccgtacaatagtttagtaaaaaggagaaccatggatgaatctgttttcattgaatattaagtacgaccatgcatacatcgttagctgcggtgcagtctaccggtagctcctggcatatagccgcaatgtccacctatgagcgtcacccgctctttctctagcagcgcacaaacaccgtagtttacgtggctgtcccgagcagcaacaagggtgaaagacgcacactcatgagagtgtgtgctccgctccggcatcccgattgcacatcacccatcgacaccgcgcccattaccaccacccatgtccaccgctgccgctccgtctaggcaacaacacaagattgagacagagaccgaataatgttctagatgactgaaagtttggcaatgcatccgatcttctgttctagatgactgaaattttgaaaataccaaagatcaagactgaattgttcggtctgatcaagtaccggccactcttaacctgtgaagctatttcttttcgaaccggatactgtggagaacacggtgttggagttacattcaactgagttcacttgaagagggtttagatttagtgaataggttccatctaggtagaaacaagcaagttgattatatcctattgcctctctttcaaatgaaaaataaactttcgacgatacaaatcttaactagtgaacttttgatatcatgaaactatctatctatctattatatactaaaagtccattagattttctagaaacgctctcataccgccatgtggcaccctacaaacactcctatgccgccacgtggcgctctaataaatttagaattctaaaataaatctaaccgttagttttcatttaatctggtggacccattattttttaccattggatctataataaaaataaccaatccgatttatcttaaaaggcc

SEQ ID NO: 107029 - DNA, 1419 bp, Oryza sativa
tacggttgtttatttataaaatatctacaattctacatatgtaattttttaagacttttttagaacttctataaaaaaagtttccaagttttcacctaagatgtggtttccactatatatttccggcatatagaagtgaggctcatcatgaataaatcaagtggttatatctgttataggaatgaaaacggagtggatacaaacaaatatgctcttatcatatttgttttcatttttatctagatatgaaaacggatgtgaataaatcaaatacaaaatcaaatatgaattgcctcgaatactattgacacgaatatgaaaataaatatttgtcaaaactcaacaattgcccaaattttaatagaaacaaatatcaccacacatgattagcacattttatatataaaaaaatgttttatatgtactaaggccgagttcccaaccttgtctccgaacacggaaagccaagtaacggattaacacataattaattatgtaggagtattagctaaaaaacctttcaaaatgaattgatatatattttttaaaagtaacttctctatagaaaatttttgaaaaaaacgcaccgtttaatagtttggaaaacgtgcgcgtggaaagcaagagaggagaggttgggaaaattgggagaagaacacggcctaaacaatgtccattacgtttgacatgtataacattactagcataaatacatgtataaatgtctaattaatgttacaacgtattccataaaatttagtacaatgaataaaaatatttacaagtttaaacaatacttgagagaacgtgcctgaccggaggccctccctgatgatgggctgagtggtgtttggttggtgccctgaatatttccagtgacgcctggcctgagttacttccgtgcatcattagcccaagcgccaccgcataatcaagtggattgattagtgcagcatgcaccatgcaggtcagcaggtgctggttgagtggttgtgatactgatgatatgactagatgattaaactatttttgcccctggcttctcatctttttttttttttgcccctggtataagtcataacctttttttttcatctgttctcaggcacaacaccaaccaaaggcttgcctgaccaggcattcctattccatcaaaacctcagggaggtctcaggcactgctcaggccgtccacaaaacatgcccttaacaacatggactagtattactgggatgagacgtggattgaagctcaagttatgaagaaatgaggtatactctgcctttagcaaatatctgtattgcaatattttcaagatatccatattattactaagtgtgttggtcatgtttgttactttcggtagcaacacgtgaatgccatgcacaactgattctcagccatgcataactgattctc

SEQ ID NO: 107030 - DNA, 815 bp, Oryza sativa
ataattagttttgtacttagccttagcatataagattgtgtagggttctaatatatgccagttagccttagcatatatatgactatttgagttttagtataagattatttgagttttaatataagattattagatttgtaattagacttagcatataagattgtgtagggttctaatatacgacagttagacttagcatatatgactatttgagttttagtataagatcattatagttttaatataagattactagatttgtaattagacttagcatataagattgtgtagggttctaatatacgatagttagacttagcatatatgactatttgagttttaatataagatcattattgttttaatataagattattagatttgtaattagccttagcatataagattgtgtagggttctaatatacgacagttagacttagcatatatgactatttgagttttaatataagattattatagttttaatataagattattagatttgtaattagacttagcatataagattgtgtagggttctaatatacgacagttagacttagcatatatgactatttgagttttaatataagattattatagttttaatataagattattagatttgtaattagacttagcatataagattgtgtagggttctaatatacgacagttagacttagcatatatgactatttgagttttagtataagattatttgagttttaatataagattattatatttgtaattagacttagtatataattattgactagctagggtcctaatgtacgtacttagacttgg

SEQ ID NO: 107031 - DNA, 678 bp, Oryza sativa
gctcgagatatggccggtgaactagatcagtgcttaagtttcatttagatctctgcttgtggttgcttttgcttgtgtgaactagatctgaggttaagtttacttcatttagatcagtacttttattttcttttccttgtgtgaactagatctctggttttgttcgtttatgtgcacattattgtctttttaggaacaatatgttagtcttttttatgtttttttcaatttattgtttggattcatttgttcaattatttgttatttcagtagttagaattgcagctagttatgaaactattagcatattaagttatttgtcttttgttatttgttatttgtcttttgtctttgtatccagaagttgagtactagcagtcacatattttgtatattagttggcactgtaattctgtgaagaataaaatccaaataggtgaagatggcactagcagttatttttttagactagtccattttcattgaatagtctgcaatatagagcgcgaacggcttgctcggcagcggtgacagtgcctggagcgcgcgcggcctgcttggagggagttgttgaggaggcggcgatgtcatacgcgtaggcggagtggattgcgttcttggtctcgtcgtggctgtcggcgacgtagacgacgccgtcactgctgatgcagccgaaga

SEQ ID NO: 107032 - DNA, 962 bp, Oryza sativa
cgtgccacatacaccacggtatacggacggaagtacgtaacatagtttccaacccatcctagccatagacaagagtaccgacccaaccccacttacggccgaaacccccgggacaggtaggcaggattgagcccctagcagcaggacaccggccttgtgccatgacatctcgactaccgggccgcagctcgtgtagccttcatttgtcctagagatgtccatcgaccccggacttcgtccttatatggccgaggtgctactatcaaaaccatacaccccgagcccagcctaaaaccattttgaggattttgaatagagggggaggtgtgaacccaattccacaataatccaacaattccatagtgtccaggtgataagagtattcccaaagtctagagttgtaaaaccacataatgttgcctaattaaccagcgaagcatctacctaaaatcatactagtggtaccatgagtagagtgtccactagttggggttttgtttattctagggtgaacaggggaataatatcaataccaataataaggtcataacaaaggtaaataggcatggctagacaaaacagtgataacgtgagaatttaaataaagcgataatgcaataatttaaatcaaaataattttataaactgggattcaatgtgttcgaggatgatgtgacttgccttgctcgctttcccaaacgtcggcttcaacctccacgaagagcggatcttccgaagctgcagcgtctacacgaccaacggaaaataaaaggcttttactctaataaactccatataacccacaagaacaaagaacaaaaatgggttcttgacttcttaaggaaaaattaaagacttgaacggtccaattccgagttcaaatggccaagttatggccatttgaagtttatatgctctttaaatgaatatttacgaatttcttcatttaaattttaatttaa

SEQ ID NO: 107033 - DNA, 761 bp, Oryza sativa
  unsure (1)..(761): unsure at all n locations
ctggttcatctactnnnnnnnnnnnnnnnnnnnnnnnnnttctacaaagcatcagtccatggaaagacgcatttgagatgacaaagccatacaagtcaataaaatccacatgaataattgctgatgagtcaatgactcacaacagcttctcaaggccacatcatcacaattacagtgttccatttgacataaagaaatctgaagaatgcatccatattttcagaattatgcggacaaagactgtgaggtactgaggtaggcatctattaccttgtattcttcctagtctcagattccttcacatgttcatacaaaatgcattcacttgcaagttaatttcttcaaaaagagaaatatttagggcaacaaaagaactcaagtcacttcatcagcttgagagaatggttatttgcacaaacaacttgagcaagccatacgaccttaacatccagtttaatggtttgtaaccaattatttccttttttttaagaaagggaggtttcaacccagtcagaaatacatatttaaaaaaatgaaaagacatcagctagtgatcaacctagaaaattaaatatcaaacagcacaggaggtcaaacaaaaggaataagcctaatttctgatattgcaatgctctgctttctgaaatttctcgtacgaaccaaaaaacaaatgcatgctctaagaccacccgcatggtaaagttaggtgatatctataaaacatgtacatctcagcaatagactagattaatagtaaccat

SEQ ID NO: 107034 - DNA, 730 bp, Oryza sativa
ttatcccgtcatggcctcgggtcatgatacttagtcaatccatggaccttgtactaaacctttgtatttcatataaaagataattgaaccaagaaacataaacacaaaattcataaacctaatccttatgtctcaacagtcaaaagcccaaagtaactactttgcattgtacatctggaaattattttataatcagaataagaacacaaagaagcatacttcggtgccaacatactgaacagagcacaacctgcgtatgtgtattgatcaaaagacatccagaacgctcagcagctaagtactgtagcaaagaacatcccaaataactgcagagtagaactctacaagaggtgaacaacagaacaaaattaatcagcggtgataccttttcaatggaccattgctttgaaatacagatctgacgcaaaacttgccttggagcggctctgttcggaagggcttgttaccaactccctccgcctcgttttccggacgcacgcttctcaaactgctaatcggtgccgtttttacaaaaagtttctatacgaaagttgcttaaaaaatcatattgatccatttttgaaaaaaaaagctaatacttaattaatcacgcgtagggatgaaaacggtcggaaacggtcggaaaaaccctctaccatttccattttcattttattttctcgaaaatgatgagctacttgcagtagaagacgaatcaaccggggcgcgc

SEQ ID NO: 107035 - DNA, 3377 bp, Oryza sativa
atctccttctttcaggataatacacgcgctccgggggaacgcggctggtaaccttgacttgtcctggacaccttccccttcccttcggaggggcattcatcgcggcgcaagccaaacggcgggggcgcgacgcccgaggacgcaaccatgtggtttttcgggccggtgtatacttgctccgcggtggagatggtttttgtttgttttacgatatgcacgagaagcaggagcgcgcataggtgggaaaggcattttcgacataccagaacgggaaaagggaggggggggggggtcgggatcgtgggccccacccgtcatgcacacgtcgggtgaaccccgccggtgaagaaagtacgcgggcgctcaccggtgcaaggcaagtaacggaaggtggggcccacgagtcagcgcccgatggttcaggttcagggtcgggtcaggtcaggtcaggtctcccccgggtcgtcgtcgatcgggggatggatgtcagtgagggcgaacgcacgaaacagccgtgacaaaaaaatgtgtgaggcgtttgttggaaaagaccaaagctcttttattactcgtgctgcactattgcactgtttagttcgaggggttgaaaagtatcatattgatatacgtacatacatttaaagtattaaacgtaaagtaataacaaaacatattctatctataaactatgagacaaatttattaaacctaattaatttatcattagcaaatatttactgtagcaccatattgttaaatcaagaagcaattaagcttaaaagatttgtttcgtaatttacacgcaatgaaaagtttttacgtagaaactacaaagggcctacatatgcatgtgctgtttgccccaaaccgtcattcgtaggtaaccaacgtagggggggttgggtggtgctcagcacttcagcagtcagagcaagtttaatagcgtagccaactattagctctaattcatctatagccaatctaatagcttattcatataatagttacatattacactattaatatctggtcccacctgtcatacacacacttcttcttaaagtccgtgctacagctggctacaaatctgtagcccgctgattttctctttcctcatttatcttcttaaaatatgtttgcagttggcttataggctgctattgtacctgctctcagcagccagttcaaccttccccgatgaagatcctctgaaagtactagctggcccaatgaatgatactcctacatctcctactcctatctggtcatggacgacacacaggccaaagagccagccatcatcattggcttcaagaacaaagagggtggtagcggtaacagttaatcctagtgttaaggatcaagctaagtgccagcatttttatgcgttttcatatacaactggaactttactgagtacaggtatgatggctgatctttattttgtcatgtattctaggattctaattatgtacaactttgttaggtgattcatttaatatttagactgtacacagccacagagatttggaaagtttgacttttaggaatttcggattgttctaaaccaaacttgtgaaggctgatttcacccagcaaaccaaagagctataatccaggaatgattgtttccacaacatggagatgaactgaccaaatcagggtttacaaaaccgtttaaagcaaggaatgcaaaactccgcaaaataataaaatctgtgaaataccgagtggcatgcgcgaaaaataacaacaaaatagtataaatcaatatttgaatccttgtgaccaattttgagtgaacgaagaatggatttcgaccaagaaaacattttgacctttgctatgatttggacacccccaattgaaacattttgacctttgctatgatttggacacctccaattgaaacaacacaattgatagttatgcaattatgtaacatatgtatagaattaaaattattatgacaatggttgaaaaagtttaaagtccatgccatcatcaacacaatattataatgtctaacaaacatgaagcaatataatataatataatataatatgacaacagaatactcactccatccaaaataagttcatttttcacctctcccatttatcccaaaataatttcacttctttttctttacctactcttggtccacaaattgatgagtcttattccttcaataccacttacctatctttatatacatacccactaatactacttttcatattgatgagggacactttgatctttttcactttatttgagtacgtatggttaaaaatgaagatatttttgagacggatgtagtattataatggctatgacatcaggaatataatagtaaaaaaatatttgatataacaacatatatcatgggggaatatccagtaaaaacctcgtacaagtgaaaacccgtgaacaaccgaacctaaaattttataaattcatggaaaaaaatactggagatagccagataggtataggcatgagatacatttccaccaaatcttaatttcaaactcaacttcttttggggggtgaatagtgccttggttttcaccagatatttctctatataacatactattgtctttttgcctttttctttttagaaaatatttgattatgttgaagtgccaaaattcacataaatctacttttaaaacatattttgatgcctcataggattaccatgatcaatgtttataggatttttctcaattttttttatattcttcaagtcaaattcaaaacttgcaaattatactaaagtattgtagcgcccgttccgtcgtggcgcctagcgggaaaaattatctcttaaaaaccctaattgcgaaatttgtttctctgattgctgtctagtgtccgtgccatctcaagatctcaatccccgatctatcgtcgagttcaattccgaatccaatccctccaaatcaaatttctccgcaaaagtctagtttgcctcctccgggttcgatgggccgatttccgctcggcccatctctcccccggccccctctccccgggcgctctctctctctctctcgcgctctccccccccgctcagcctcgcccgcacgccgcgcgcgcgtgcgcgtgagccgccgcgccgagcgctccctccctccctctctctctctctctcgctttccccggcgcgtttcccccccccccccgctcgctgctcgcgcgtgcgagagccgcgccgagcgccccctcctttcgcgcgagctccccgatcgcaaagccggagccgcgcgccgtcactagcgcgcgcgcccgggtggtttcccgcccgagccgcgtcgtctgcgttgtccgcgtcgcccggtcccggtacccagccgcgccggccgttg

SEQ ID NO: 107036 - DNA, 636 bp, Oryza sativa
ctcataggggtatatgcatgtgtgtggtgaaacttgaccactcggggacaagtcttagacttgacaaattctttcaatgataggcgacgtaacagtcgacaacgaggtgcgtggcaacttcgtaaatgtcaaaatatgtctacctaatctctcagaagtactcataggggtatatgcatgtatgcattaatagggggtgagtgtgtgcgtgctgtgagtttttgcgtttgtacttaggttctaaaaaatatcaaacattatttattgtttctcttttaatttaagagataaaacaatagggagtggacgacaatattgtgtacatggaagggtgaggaggtggtgaagattttatttttctatttttctaaatgatttaagtgaaagccggtgacagggtgtttcattttttctaagaatttctatggtttttcctgtttttttatagaaggtgacacatggcaacttaagattttttttaaaaaaaaatagatctaatagttaaaaataataaatacgtcaatttaattactatttattacaattttatgacatattatacggtgatttatgagcgctctagagcgtgtttaatttatttttgttacgtacaataaatgatttagtataacataa

SEQ ID NO: 107037 - DNA, 896 bp, Oryza sativa
caacgagagcatgaggggaggaggatcggatcgccaggctcacctggcaacggcaaggccgaggccacgctccgatttggcggtggcggaggtggccaaatctggaggcgcacgcgcggagggaggagaggagaggaaagaggtggtgtgcgtgtgtgcagaacgagtactagtagaagctagaggggaagggaagcgaggcagttgggagtattttatacgatgagctggatttttttggtttctttttgtggcttttattcaacttttttttcttcaaaattgctatgcaaacaacctaacttttcgccgttttttccttttgggtttatggaaagattactttgtctttctttcaggtttttagaccagcatgcttctgtaacaccctgaaaattcgaccgacaaaaatctaaactctaaaaatatgggccttcaaaaactttttaaaaatattgcatcatgccaattttattcaatgatttgattggattttgatttcggaattcatcgatcacaaataagggaaagttaataaggaattaaccctgaaattagatttggttaaagaaataaataaattataatttaaaataaatattatgtaaggatagaaataaataaaatatcatcgcggccgtatttgtatcaattagatttaaatgcaatggaacaagaattaatcctaattaaaaattcaaataaataaaaaaataataaaatatgggtaatattaatctagggtgaattcattggttggataacacaaatattgagtaaaattcatatatgcaaaaattaggaattatagaatcaaatttataggaaatagactaaaatgggaaaaataagaaaaagtcactattcattagcccctaagtgcttgatgtgggcct

SEQ ID NO: 107038 - DNA, 848 bp, Oryza sativa
cacaaatctaggcctgtgaggaaagtacgaacatcagtttggggcatgtgcaccataactaatgagtcatgctgtgcagccaaggcagtgaggtgtacactaaaccacaggtgcacacaagccagtcaccacattgctggctgtcatagcgcatacaatgctcaataaggtgataaacactactaggtggtcagcaaggttagcagctacaggcacctaacaccgcctaggatcaacttgacaaggggtttcctagcaattaccaaacatatcacataaaataaagacaattaaaatatcagcactagagctaccaaggcaggtgcaccgccaaatgcaatatcacagccgagacatagcacatagctcctaaaacatgcgccgtgcctagggccaacttttagaacattaagcacatcaaataaggatggcatggcattaggtgtttaatgtgatgcattttacaaagtagcttattgtgtggtatgttgtgtcctactggtatctgctggcatagctacatcctaataaacaaaactagcactgtgactcacaaagaaccacaattgggacaaaatttgctcataatagagatgagaaggttcaacaagaagatagccgtaacgcgatatgtgaacatttccctcctcacccccatcatattcattagtcactctactgctttccagaaagaaaaagaaccttcccttcccttctctcattcaagagaacagaaatttagattacacatacggttgtctaaaagcagacaccacaaattctagcaccaaggaatgctgacccttggggttgcccaaaactcccatgatccaatcactacaagtcgg

SEQ ID NO: 107039 - DNA, 675 bp, Oryza sativa
tggtgaaagtcggcataccgcaaggtggtcggcaatttggccctcaaaacaggcagatgatagtaataacatcacgtttgcaccaagtttggtatggtatggacgggcattgccagatgattgtgttgcaaaggttgaagtttaatgaagcatggagtctctttgaatcaaatgcgggtattagaataacctataacgtgcaagtcaagtgtcatgccgagagcatagtgaacaagtgtggaggccttccgcttgctcttaagattgttggtcaggctatggcatcaaaaggaactgaacatgaatgggaactagctgtgaatttgcttgaacaatcacaattccacaaggtcccggatgtagaaaatgatctatattctgtactgtacattagttatgacaacctgccagatgagaggacaaagcaatgctttcttttctttgccttcgccagctatggaactgtatgcacagagtcctacacgaagtttttggatgggccatggattactagatgaagatgatgatattggaaacagcaatttgagaggttactcagtcgttccttgtttaaaaagagcttgtctattagaaggacatcctctaggggagaagtatttgaggatgcatgactgcatccaagatctggccctttggattacagcaacaaaaagg

SEQ ID NO: 107040 - DNA, 2873 bp, Oryza sativa
gctagaatgacttacattataaaacggagggagtacttgataatgttaatatggcatgggaatcaatggtctcttcctatacaaggcagatcctcaatggattaacttatctgcatctataccaatataaaatatatctgtttcatcacataattcttttctagccctgcatttctacagcctacatatggtataattttagtatcatggttgattcaatctgtagagtctagcgtgcactgcagaatccagtgtgcacaatctgcatacagtataattcaattgcaagatcggtgttctttgtaggcatgcaaatcgataagaacttattcatgtgagttgatggtcttaacataatgacatttgtttatcagcgtatgaattatggggaagaagtatggcatgttgcccactgtttttcttcttattatatactagatgagggaaccaaagtggatcaatacgccttcagaattttgtgcatctttcaatttgggtaagatgatattgaaggaccagaagccaccaataaaatagaagtgcttatcttatccatttcatttactggaattatacttttgctttttcattctatgcagagagcagagtcaaactataggattgcagttccggtttcatttatacaagttaaccgtgtgcaatttaaagcaactaaattttgcacatcgttgcaattatcagagacacctgattggggtttcgaaagaattatattagaatagttttgcctcacagatgatttaagaaacttgtcaattagaccttaaatgttttcgtttgagattggtttacattcggcaccttaccttccatggtaatctgagtccatgtccttttaaggaatagcataaaagctaacactccctattcccaaacgatgtttgacaaatgcttgttaagtgatatattgtgtgaatcttatgatcacctgtttatatctgcaggttatatagattcatgtcacatgtgtatgtcttcagaatatctatatttatgtcagtgtctgtttttagatttatatatatttaggttacctgtgtatatattgagatttttcctaattgcatatcattacaaattacaaatatatttaatgaattttatatggatagtgtactctgttcttgttccatttttttccaagaataattgtcattagaatatgcagatttagtttgggaagcaaaattctatattctcaacttaggctttgttttcctttaggtggtgatatgggccctgtttagatcccaccccaaaaattttcaccatgtcacatcgaacgtttacgtttgaacacctgcatgaagtactaaatataagtttaataaaacaactaattgtacagattgcgactaatttgcgagacaaatttttaagcctaattgctccatgatttgacaatgtggtgctacattaaatatttgctaatgacagattaattaggcttaataaattcgtctcgcggtttactgacggattctgtaattagttttttattagtgcccgaacaccccatacgacatcctatataatatccgatgtgatataccaaaacgttacatccctagatctaaacaggtagctgagaggtagctgagaagatccaggccacttaatttagatgagaaaaaaaaatatctcccgcgagttcctcatggcttatcatagcaagaccaatggtgccacttgtaaaatccagatttctgttttaaccggcttggcatgcactacctgaattaagtgagtaaacatgtccatgcaacgtttctcaattcaatgagcaggaagacgtgccatgcacatgcataattactagtaacaataaaattctcacttagtctgaagttcttaacctaggtcatgaacaccgtgttgactgttcatccgaaacttgtttggattgatgaaaaattttgccaaccccaaatttttggtaactttgatagtgttgtatagttatttgatttgctaccaatttatgctctcactagtataaattgtattatatcagatttggtgtcaaaacttactaatgtttaggcactactaaaatattggtaagataaggattggcactaaaacaaacaagccctataataatcacttggctttccttttgtgaggttaatttcttggttgcagcccaacctctccttgtggcccgtgacctattgatgcctcctcctaataataatgtcccagtcatgtcacatcttgttcgtgtaaggacacgtgatcagtgtagataacttctttgtgctacctcccacaacatttgtttcagtcgtgggaaatactcatttcgtcatgaaagaaaaataaccttatgtctagattcattattataggtggtacgtgtccagtagcagtaaatacgtcttcatcagtaacagtaaagcagagcattcccgtgtgccggaagaggtcgccgcggctggagacaattcagccggtgttctactggcgactggcctcctcgagttcttgatcttggcggattgccgtccatggagaccacacgaagcgatggcagcatcatggtggtaggggcggtcgatatcgattgcccccagcaccggctgtgcgggtaccgcgacttgatacggggcgtctccggcggcggcgccgccatgtcgcgctggccggaggcggcgcccttcgtcccgcagatcgccagtactggtggcgatggtggtgcagcggtggccggcggcggctggtcgagcgggagctcaagcccggctccatcgtcttgcagctcctcctcctcttggcgcgagggagactgctgcaacgacgtctgctggtgttcttcttccacggtccacgagcttcgcagcatcgcggag

SEQ ID NO: 107041 - DNA, 714 bp, Oryza sativa
attgagggcctattattccgcaaggttcattccaaattgaaaaaatcgaggtttttccccgcccaagtgatcacgtggtagttttggcaaaaccttacaaatgaaggagggggccaaattaacgctcagtaacgacacgtaaatttaacgtatttgttctttatctgacaaaatgcgttattttaagaatgggcataagccaaattagggctttcagtgcggggtttatcatgggattttaaggatgtcacgcatattgcagatttagcgaattaatcacagattcagcaagtccattaagctgaggcgttgggtatcaagcaatggatcggttattgcaacgtttacaggcagatatataactttatccagttaaaggtagcaaattaaggttaatgcggagcagaaagtagttaattgtgtaaagttttcttagttaaataatcgttttgctttgttttattgaaataagtccccataaaggtgttggtcttttatgtttaaacacaagtaataaataatggcattaaattttagttcagttgcattagaaagtacgcaagcaaaaggtggttatggtatcgggtgactaattggtcatctattcaacagcagatagtccggtacgtgtacattatacgggataatagaaaaatggcacggtatttgatagttcggtacaacgtggcattccagcaaaatttccggtagggg

SEQ ID NO: 107042 - DNA, 560 bp, Oryza sativa
ctttgtgaatgaaaatgctcaataaattgcaaggcatcaggataatccgcacaccaaccagcacgactcatttggaagtctccgagattacggcgatgtaataggtcgtcccacgtaacgcctactggtaacacttgaatcagatctgactgacttaatgcacgaataacttgatctgcaataacactatgtttgctttgttcatcataaagtaaatttatcttaaatggattatgttcactaatatctgcctgttgcaataattgctcaattaaaattggctgccacggtgtggctcttgtggttcgcatacttttaggtaagacagaaaaactcgcaatgccatatttttgtggcactcgtgcagataacaccattgatttaataacttgccgtatttcttttttcttcaattgcaaatcagcaaaattaaattcatagaaataagtacacaaacgtggaaattgccaaatattatgttcttgactgactaacggattttcaatgatatcaaattgtctaatcgcctgtagctcattaattttatggtattctacttc

SEQ ID NO: 107043 - DNA, 622 bp, Oryza sativa
tattgttgatgaaccattaggtggtgcgcatcgtgacgtacttaaaattgcacacagtttaaaacagcagattttagctgatttagcagagttagatagcctcaccacagaagcattgttagaacgccgttatgagcgtctcatgagttacggctacgtttaaagtatatcattaaataaagcggtccttttgctaaaatttttggtaaaagtgaccgcttttttcatctttgcgattgatggaatacggtacaatcctgtatctatccaatatacaaagcggtcataatgttaaaagaacgaattagtaagaaagtgcaagaattgataagagcaatcgcctttttatttaattatgtattgtacacataaatgcttgatcttcattgattttttgcatggctaataaactatacattaagccaaactgcttttcataatccaaccatttggttcgaatagacggctgatcagaggttaagaagaacagatgatttatattttctgttggataattaatgtagctagtgctagcaaagccccccattttattgggcgtaaaacctagcattgcaaagatctcaaatggaatattagcaggcaggaatattgcatcaggaaa

SEQ ID NO: 107044 - DNA, 523 bp, Oryza sativa
tggttggcctttgttttgaatagtgatagtgaagtgttcggtgccgatccaactaaagatttggaacattttttaggttataccgccattatcattttctgtattatgtttttattgggaattgtgttgcaattactgaataaaaaccaatatcaagtattacgtcgcccattagggctatgggcatttgcttgggcattattgcatgtggcgagctatttagtgcttgagcttagcttagatgtttcactgtttttcagtgagttagtacaacggccttatttaattttaggcgggatagcgtttaccattttaatggtgatggcgatcacttctattccgaaagtgaaaacagcactgggtaaaaaatggttcagcgtacatcaatttgcttatccggctattgtgttggcagccattcattattattggtcagtaaaagatgacacgcttggcccgatcgtgattggtataatggtaactgtcatcgtcttatggaagtttgggtaccgagctcgaattc

SEQ ID NO: 107045 - DNA, 627 bp, Oryza sativa
catgctttctcgatgaaccgggttgttcattgccttttttgcttgtatcaaagctggtattcacataagtaaataactgattaactcagggtttaaacatcaatgaccagtaaccttgactattgtgtaagcacaataggttctgttctgatttatcaatcgtccagcccaatggttgggcaaacccgcttaatttatttaagagatcattaatatcttttgcgttacccgtttgatatgccatgcttaatactccgttgttgtctcaatcacaaaataatctttggttgccacacgatagcccccattaaataccagtcctgtacgcccttcagcgatagtgacttggtcactggcggcacgctgaatacccggaatccaatacacgccatcgaaagctccccagcggttgcgaccttggctagaatccttaaggctaataaattccacagggattaaaggataagcaccgccttgactttcacccatcgaatcaatactgcgtggctgttgatatgagctgaacatatcgtaattgcataacggatataatgcttggtaacgagagtccgtacgtagattcttaccactgctaccgtaaaaatcgcgccaactttggtcgggcat

SEQ ID NO: 107046 - DNA, 1007 bp, Oryza sativa
tttatcttattcagaagtttgaacaaactcatttttgctatacttatttatcatcaagcttctatcttaaaggggaatacggttcaagcggattggtcaatgccgccagatttattttaatgttgctagcgctagaccggcttagtagcaaagtaattattaaaggctataccattgaagataagtttgcaaaagctctatttgaaaaaggagaaaaacatcctcttttattcagatcttattcaaaggaatcgacctggaatgaagacattattgataaaaattatcctatgagctattgggaaggatacaaacccttgcaccaaaaggtgcatgaatacatcgataatgatgagttactcccgaaatataaaaaagaattcttgtgctcatatgattaaaaaatactttcgacaccaatattttctcttgttaattttaaatgaacaggcgcatttctcatcttcagcttagtcatttgagcttctataaagggagcccaatttctcgtttgaactaaataatcataagaaatagttgttataatgaccttgtttttcatactgaccaaatagcgaagcacgttttctaattcataactatccaccagatcaatacacaacgtatccgttgtctctcctttaaccatttcacaaaaatcttttccccgctcaattaaattataatgttcgtgcttcgtcagttccgctatcaaggttgatttgcccgtcgcaatactgccggaaataacaataaaattgggagagtggaagtagtcaagtctagatttgacatatttttttatgttatcgctatagtgttttttaacatcgaaacttgagttaaacatggatatatctaacataattgatatttttccttatgggttttgcggaagttctaaagcagtgtcaaaggttataaaccaaatcatagaggtttgacgcaaaatcacattgatgaattgttttctaatttaagacagtttttagaaattaggggaacag

SEQ ID NO: 107047 - DNA, 783 bp, Oryza sativa
  unsure (1)..(783): unsure at all n locations
ttcaagaaacccaagcagtccaacgccacctgattttagggggttgttttcaccgttcatcttatatgaattagaaaccactaaggttgatggtcaggaatcacactacttaaatagtttattcccaactaatatcacgattaataataatggtgatgcagtcttgagtttaactcaaagactaaatagttcggctacttatatgaactttgattataaccaagctaatagtttggccactctaatcagagaaagtagtcctaataataccttttatgttgttgataacagttcaacaattaatcaaccattagttaataaaacatttattaatctaagccaataccaatcagggttcttagcggttgggatcatccttttattcttatcattaatcatgattgttggctttaaggttcaagggttctttgggatctttggtttgatcttatcagctgtgatcaccttcttgatctattcaagatttaacgcgtttgttgatctatttagtttcattggtttaattggggtgatcatctttaacttcttggtgcagttatttatcaatctcaatttcaagcgcaacgttagtaataagatctccttgcntgagtcgtgaagattaacccacaacaagacctttttaaaagcagtcgatctttatctgatattattagatatcgggttattcatgtcgtttatctctaaatatgagtcgcaatcaattgggatgggtaccgagctagaattcgcccagagtgatcgatagcattcatgccgcgc

SEQ ID NO: 107048 - DNA, 527 bp, Oryza sativa
tgtgggaagatggtaaagaatatccattttacccattagatacttcatctgcgtcacaccctgtttatacaggtaaacgccgtgaagcaaatacggaaggtcgcgcacgtataatttaatgaacgctttaaaggtatggcaagtttaacggctaaaaaataacaggaatgtgcatcaaaattttaaattcattaaaaacagctaaatcccgtcatccagattgccaaattcgttcgttgtaaaggtaagttgtacgttatttgtaaaacgaatccgcgttttaaggcacgccagcgttaggtgtaaagataaaagcgtatttaaataatacgctttttttatgtggtaaaagacggtttagactaataatgcaccgctagcacagggttaaacgtgtggctgataatttatcttgtgtgcttgttactgcctctctaagtaagagaggcaagtgttaccaatattcgtttatggattacgcttgaatttactaaagtctggttctcgtttttcgttgaaagcatttc

SEQ ID NO: 107049 - DNA, 1767 bp, Oryza sativa
tgcctttataagcgatattaaattgcgacttggtcaatttccattcactatcataggtgtcacgattaaattcattactcgcgttaaaagccgatcgcaatttatattccacaaaatcaccagcataatagcggttaattccagcactaaaatgtgtttatcttgcccaaaataattcatagtctagataagtgcgtggggccatgttccatttatgcgtaaattgcgcataataaaaacgcatacccggcacaaatgttacatcacgccatttaattttgtcttttaaataaaatgctaaacgttgatgattcactttgccatttagcggtaaataatccacttttaacgtgaaatattgctctttaggtatgcaatcgggacaattttcaatatcaaacggttggctttctgcataatatttccttgcaccggtatattgtcgtgctaatttaggctgttttaatgccgattgataatattgccattcccaacctacacttgcctcatgtgtagtatgcgctaattcaagcttcttaaattgtaaatgctgtttaagctgaacacttttttgttctgtataacgcttaccaataccgcctttagtcgcttcttctgtatttggatcagagatccaattaatgctatctgttttagtataacgataaagcgtatctgcatcatattttgtttgcgttctattatgacgataggataattcgctagtaagcaaacccatctgttataattttcccatttaatgttagttaataacccaccgccactaatacgaaaacgaccatctaatgcattatctaaatattcatctgcataatgtggtgcataaatagcatttgctaataagcggttattatcattcacttcatttttatagcttaataataggctttcattacggcggtggcgtcctacccatttatgcaggaattgttgatgctgtggcaccgcactttgttgacggctatatgcaaataacaacgctgaatgtgcagaaagcggttgatttaactgaatagttgtttcatgcttatcaaatttaggttgtaataatggcgaggtggcacgttgaaattatctttataagcgccgtcaagatggaacctagtccaagcactgtgcgttgtacgatatgatatagcaccagacgctcgctctgcatttggttcttttaactgcgcatcaactgcaccgccagtaaagctaccataacggcttgatacattacttttcaaaacatccactttcccgattaaatctggacttaaccaaaatgcttgaggatgccctattggaatatgctcaggattgattgttttgaccgcattaacattaataacgccattcgcacctaaaccaatcggattgatattatcgttgatccccataccattaagcataaaattattattataataacgctcaccgtggaatgatatattttgcggcgtgatctcacctaatgtattgccattatgcgtattagatacttgtacagcaggcaaagaagctaacgcatcactaatatgcgaattagcggcaatttagtattgaataatttctctgtaaaagaatatttgcctgacgatgttgaatttacatttcccttcacataaatagtgccgagttctgtattagcatacatctgagtactgaataaactcaatgaaacgaaaagactaattttatttaacttcataaaccttaattatattatggaaatagtacgctaattctaaattcttcaag

SEQ ID NO: 107050 - DNA, 667 bp, Oryza sativa
tcaatgctcatcgcttgcgcttgcatttcttgattgaacgttaacctaccaattcacgcatttttgggaaaaagcctaaccaccataagtgtttgttttagttgatgagctattttcattgcaatcaagccccatgttgggctaattaaactttaaccttttgccaactctttttttaaatgccatatctaatacatttagtagttctgactttttaaaactcattatttagtctcctgtttataacgttggatatactcatcggctgaaatgccaagtgctttagcccccgcaatctctgcatccgataatgcgactttttgcgcatctgcgttagggttttgaccgcctgtttgcgtccccaaaagtgcagggttagggcttactgtggctaaaaagtctgacaatgccgttaaattctgtttacctaaactttctgcccacgctttttgagcaggtaacaagcgaccgtctgataatgcggtttgaattaacgcatcacgctccttgtcattaatgctttgtttaagtgtattaagctcagtttgtacggtttgtaaatcagctaacgccacatattttgcagggtctgggttgtttactttggcacttagtgcgaccgtttcagattttgcttgcggggtaccgagctcgaattcggcctata

SEQ ID NO: 107051 - DNA, 752 bp, Oryza sativa
ctatagggcgaattcgagctcggtacccctactcggattaccttaatcaatataatgctttatttttaataactatcttagataagcaacgctacaaatattcttttggtagaagttggactggacagagatttgatcaaactaaattatatttaccttgtaaagataatggtagtatagattgggaatttatggaggattatatacgctctcttcctaatggaaatattatttagcttaaaaagccatacaataaatcttatttatgataatcagaagcaacctacctttatagttggttgcttttggtgtacatcaaatttcgaaaaactcgtccttatattgtttaaaatacaatcaattaaacacattgaaaaattttccttgacaacattcagaccttattcaaactgacctttattggaaatgcaaaattttaaaaaaaacacttgacaaaagaaaacgcttgacaaacaccctttaatataatacctttttgcccacagagaatagtcccctcattaagatttttactttttaagccataaaaggtttaaaaatttaagagttttaatgaagggattttgttttctatggcacagcatttttcgctatcttgcaaggcacgccacttgtctatacaagtggacgagctttctgatgtcgaaattttgtcgttgctgaaaaccgcttcgtggggccatgctgataatataaatgatattgaatgtccgcattgtcacgttagacac

SEQ ID NO: 107052 - DNA, 554 bp, Oryza sativa
ccgttgatttaagcggtcggcgcctaattcaccgattcttaatgcggataaaaaacgaatacgttggaatgctataaaaattgcgtcaacactcacactagcgggatctttttctctttgtttaactaaggttaaataatgttgatagcattggactgcttttttaacgattagattaacacattcttgtgtccataaatgcgtttcagtgaattgatttttgtttgggtattcaattttttctaaatcagtaaattgtggatttagaaaagtttgccaagattcgtccgcttgttgctggttgacttttttagccagtgcgccgatgcctgaattagcatcaaagcgataacttttttgtagatgacataatgaatcgcaaatcgttggaacttgattcatcatatttaattggtatccggttaattcattcaaagcagtgcaatgtgctgtactataaccttgagtcataaaatggcccaattcgcccataattgcgcccgcttcaacagaggctagttgatctttatcaccaagcataatcaaacgggttg

SEQ ID NO: 107053 - DNA, 552 bp, Oryza sativa
  unsure (1)..(552): unsure at all n locations
cgaacncgagctcggtacccattattgtcaaaacaatcaccaattagcttacctttagacgtaattattccgcaatttgaaggtaaaaatattcttattcagcaaaaagttagagatcaagctggagaagtaaataatgttaaatcgttggtgcatattgattcactacaattacgcgcaaatgtggatcaacaagcgattagattagaagattttagcttagtaagtgatcaaggtcatttactctcgaagggatcgttaatattagctaacgactatccgttaaacttacatgtaatggctaatttggcggagcaaaaatcgattaacttgccggcgagtgaattaacaacaacattaagcggttcattattggctacgacacatttaaccatgcaaaccagtggcgtagcgaatatgaagctagtaagtgatgtgcaattggctgagccaaaaacgcctttaaaagtcagtttaaatagcgatgcaattcattatcctttactcattaatacgtttgaacagccacttaagattcaggcagcaggtata

SEQ ID NO: 107054 - DNA, 603 bp, Oryza sativa
gagctcggtacccagtggtattttacaagccgtcgatcaggttaatattggtgcacaggtttacggacaaattcattatattttagtctccgaacggctatttgtcaaaaaaaggagagctgttagcgattatagacccacaattggcacagtctgagttaaaattcgctaaagcggagttagaacgtaatcaagcaaatatgcttgctaagcaagctatcctgaagcagtatcagacgaattctgaacgacatagaagattaatcaagctcaatgctttttcccaacacgagcttgatgacgctagaactcgtttataggtagcaaaggcagatattcgtattgcacacagtaattttgaaagcgcacatcttctagtgacaatggctaaaactcatatggcctatactgagatccgctcaccaatggatggaactagagtgtctattatggctcagagtggccataccgctacagcacagctactaagtacctaccttaatgactttggctaatatcgatacgatgaagatcagtgtttaaatatgcgaagctgatatcatgcatgtacaaacgggagctcctgttgcttgtactttgctc

SEQ ID NO: 107055 - DNA, 776 bp, Oryza sativa
atggcattgatgacatgcgatcactcagggcgaatttagctcgtacccctataggctcattaagtttaaaccttatttttcctatatgggcttatttaaagatgattctatgttcgggctatataaggaaaagtgttgttttttacgtaagtcagatcaatatttgcaggaaataaaagacactatccccattcattttttatctgatcataaaattagccgccaatcaaaaatattttatctaggtcctcaacacattattgaaaacatttcttcctattcccactggattacgtcctcaatctcttgatatcaacgtttacgctcaagaattcgcactggaaatcaaactaaaatccgaatttacctgatatgattattaatattgaaaggttccttgctcgagttaatattaataccgccgatgaatttaaacaggtttgggaaacaaacgcgtttgtaggcttatccacaaggatttgagtcaattcaatacttttaattaaattatatggtgcattacagcataaatgatattatatgctttcattaaaaggagaaaaaatggtacatgaagcaagccgactcttggcttctattacccggggtttacaaaaagaattaccggctaaagtaaattgcatggtgcttaatgaccaagtcacaaaacacacaagaaaatggaaggcaatttttctataaggttgcctttctggattggcggtgctcccattatacctataaatgctatcttccataaggagaataggcttgga

SEQ ID NO: 107056 - DNA, 692 bp, Oryza sativa
aagtaatataaataatataatctaattgagataaatgggacttggtgggtagcaacgtgtagtagtgggacaagaaaagtgaaaggctattacaaaatatgaaaaaggaaattagaaagtaaatttagtaaaacagcttcattttagaatagtgaagctgtttttttattcacaaaacaaatctggttgctgatgtttcattatacgttttcgtacacgattaataactttacgaatgcctgattcagtcatgccatactttttaactaaaaagaaccaattattaccagtaaaatcattataaatatctaaatctcgttgagcaattttataataaaaatctttaggaaaagaaatgacttgaccagcataatgttcagctaagaagtcagcaacacttgttgaaatttgttcgcaaatttctgtatcaaggttgtaatttttgcatagtgcactcacgttatcttcaatgtcgcgcaaaagctcatgtcgtgctatttccatttgaggatcatcttgtttttcctaatttatataaaccaataatattagagatatgggtcccaaatctgccaataacttagagcctttaacttaaagaataccattgtgaaatttggcgatattcaatttatttacctacttgtttttgccattggttcaaattttctaaaataaaagaggcttgtgaa

SEQ ID NO: 107057 - DNA, 751 bp, Oryza sativa
tgctgaaaaacagccggtcgtgttaatttataaccaactaaaataagtaccgcagctaaggttgctaatggaatttgattaagcatagttggaatggtcagtacacaaactaacaataacagcccgtgcaatatacttgatattttatgggtttcgcccgcatttgcatttgcagaagagcgaacaatcacagcagtaatcggtaagccccccattaatgctgaaactagattacctataccttgcgcttttaattcttggttggtatctgtaatgcgacgcttgctatctatgcgatcggcggcttcaatcgacagtaatgtttcaattgaagcgactattgccatcgttatgcctgtgctccaaactatcgaataatgaaaacccgcccaatcaggaaaatagagcaagtcgcctatttccgcccaactgtgtgcgataggcagttgcaccagttgactttcgggtatggctaaaggtgtaccggcaaacaacttattcaaaccaatactcatgattacggcgatcaaggcggacggcaacatttttatgctttttaatgttgcagagcgctcccaaccaagcatcatgagtaacgacaataaagaaataattaatgaacctaaatggatattgataaaacttaacgataattcattaaataaatgtttattaccaaaagcataaggcaattgagaagtaataattaaaataccaataccggctaacattccttcaatcacagcaatcg

SEQ ID NO: 107058 - DNA, 797 bp, Oryza sativa
tttttagaaaaattcggtatgccgaccgcacttggacggtatcaaccaaatgcgtctattgaagaacaaaataaattattggaatccttgtacgcaatccaatctgatagcggcattattgtgccagcagatatgcccattgaattactcagtgctggacgtagcggaacgggtgattataaagccttatatgacaccatgaatgagactatccagcgtgtcgtattaggacaaacatcatcatctggaggtactccaggtagattaggcaatgatgatttacaggaaaaagtgctggaatccattattaaagccgactctgacgttatctgcaaatcctttaaccgtggtccggtaacctggcttacgcaaatgaatttttctaacgctaagccaccgcgtatattcaaaatgtttgaagaatcagaggatttaaacgaaaaagctgaacgagacaaaaaaatatttgagacaacaggttatcgtccgaccttaaaacaaattcaaatttcatacggtggtgaatgggaaaaggcggaacgtttaacctattctacaaagaacagcaaaagtgctgtcaaaaataaggttgattttgcacatattgtaagtgatgaacaagatatacccgcacaaatggtaaaccagctaaataatacccttgcaccagtaattgatgactgggtaagccaagaacaggcattagcaaataatgttgaatctcttgaacagttacgtgatgaattatttacccttaatgcctgaaatggatttagcccgttatatcgaagcaatgg

SEQ ID NO: 107059 - DNA, 641 bp, Oryza sativa
gatccatagtatccgatttacgcaacagcaagcacctgacggtacgccttggcaaccattagcgaattggtatagagatagtaagaaatacaatcaagataaaattctcaccctacacggtgatctacgcggtacattacgatatcaagcagataatcatggtgtgatatttggttctgaccgtccttatgcggcaattcatcaatttggtggcacgataaaacctaaaaataaaaaaatattaaagctggggacattatatgcacgaagtatcataattccagctcgtccatggcttggtatttctgcagacaatgaacaacgattaattgaaatcgcacgtaatcaccttgaaaacgcatttaatgcataaaacgcttgtaaagctattttaatgtttattctataaatgattacttagatactttttaaggcgtttataaacatttataaacgccttaaattcaaataaatcatctcatcacttactcattatatttttcctaccaaatacattctagacgcgtccaaaatacaaatgcgttcctgcctgtcatactgacttcattgaattaatcacaaatatattatcgaaatgaaactcacaaagatgccgattatgaaattaggcacgcatacag

SEQ ID NO: 107060 - DNA, 580 bp, Oryza sativa
ccaacaaaatgtttgtctttagtgtgaaggattagaacgaacctttatcttctgacacagattctttcgtttttgcatcggacgacggttgttcggattttctaacttgttctacgtatttaacttcgccgtcaatttttatcattttgacgcggattaaacgggcttttaaactgacggcagtatcaccttttttgtgatgtttgctatctttagatacgatataggtatccgtccataagtcagacagaacaaatgaaatcaacacttttctttcttcattaactgcattcatacaccgctcaattagcttttcagcctcaccgccgacaatattgcaatcaaagaaccgatattccggatttgacgcatcgccggtaagcgctgatacacggcaggctaaaaaagggtttccctttttcggcgtgactttacgaatatcatttaaataaccgatgccggtagtatgtaggttgaaataattttgttgagtttgagtagtcataatttgtttctcctatgtgaataaaaaagcggagaaacattcctacccaattcgggttaaatgtttcccgccagg

SEQ ID NO: 107061 - DNA, 513 bp, Oryza sativa
atggcacaccacgttgattagcaaaatcaaactcttgctgaaaatgttgagtagcaaacaatctttctgcaccggctaaatcaatcgcgaccacgccagcttcatatttagttaaatactgtttagccaagcaaattgtttctaaatttgctgatctattatctgccgcacgcatacaacataaaatcaaatttgctttaaacaaacttgtgctagccaagcccgcttgtaagccacgtaatgcggctttaccgcatcttcttgtgacattgatcgttgtgtatgtagttgtggagcaaaacgaatttctgcatagactaaaccatcttgatctaaacgttgaattaaatccgtaacggctgagctcaatgcttctggtgtttgcaataaagaaagtggcaagtcaaaacaacgtaaatactcatttaaatcactgcaatcttgtgggactgatacataagcagttaatgcttcagctgtactcgcgggtaaattaaccgcttgttttttagc

SEQ ID NO: 107062 - DNA, 548 bp, Oryza sativa
cttcttcaatggagttttaattgcgtacgtcatattgcgcacttggaataatcatccatttctccccattgatagtgagaatttgacggggcgaaagaccaaccattgtgcattcgtaacggtcggggagaataccaagacgacgaaaaatgccatcaatcccgtgtgcaattaagctgtgcggacacggtattaacgattgaccgaacttagactgactgtaatagacgagtaaggcatcagggtggtaagtattttcgtctgttgtcatcgccgctctgccaagcgtaagcagatattttcctttgtccgtattactcacatctttataatccgaaacatttgcgggggcaaaataccacggtgtacgtttatcgccactgataccgtcggcacgaacgatctcttgattgccgcgcgctccgttagaaaagccgtaagcatgatcgctattttgataatgcgcgtagttctttgtgatataggtacagtagggatattgaccgccggtataggtgccttttttgtttaacgtaccgataccaaag

SEQ ID NO: 107063 - DNA, 625 bp, Oryza sativa
ggcataatccaagccccttacgcacaaaaaacgcctccacgcctgcggcgcaaaactccatgcggcgcatgtcttgcattgtgatagtgatattgtccataacttatccttttttaatctcagttgtgcgataatttccgtatgccaacacctgccaatcctcagtccaacaatcgccgaaaaatacgcattgtggcgtcccctcgtcgatttgcggaaaattccaatcttttgccccgaccgcctcggggctgttgtttgactgcttgcgggcggtggcttggctgacaagatagctgatagccaccacgattaccgcgcgcacgattgcccatccgattgctgcccacataaatccctcctaaaatactcttgagccgtcatacggggattttgtcggcatatgcggaatccccccaaaattaagcatgttgttaaattttttaaggcacgtttgcgcccgcccgtcgcaccccggatagactttaatcacggtgccaatggatagtttttgcgtcccgcccatgagcgttaatttattatgctcatgcacggtcaccgcgcgggtctcaaccacaccgtcatccagccattcgataaatcccgcattaaaccagccttgcgg

SEQ ID NO: 107064 - DNA, 667 bp, Oryza sativa
tgtattctgccattttttgtttgaataatggttcattcaaatttattttcgataaataggtcgttaaaaaaaattgtttttggacggaattgagcgtatttgcttgaaaaaataatgcgatctctaatacaggatcagaaatagcgctgtattcccaatcaataataaataactgttgctgatgttggattagatttgctaaatgtaaatcatggtggcaaatggctaattgcaaaggctcgatttttttgaacggcgggcaaaaattaagttgatgttgttgggagggggtgagtctatcccataataattgacagcgttctgctagttgtaaaatggtgcgctgttttggtaatggataagcgtgcaatgttgctagctgtaaggctaattgctctagtaaatcgggatcaaatgcagtggcaggtttgccttctaaccacgttaataaactgctgtttgcggtttgataatagactttcggtgtaaagggcagggcgtcaaggtgctgtagaatataggcttcttgtgcataattaatagctaaaagtgtagcacgagcgctttgttggcgaaaaataaattttggttgcccatcattcaatggcgttgaaagttggatcatttggctacaagcggttaaacctgctaattttttgcgaaaaat

SEQ ID NO: 107065 - DNA, 611 bp, Oryza sativa
atttttagcaccaattatttttattgtggttggttttttgagttttgtgctagtgctacgcacttggatgcaattctgtcaagttagtgcttatttgccattatcacaatcattattacgtttaaccgcgcctatggttaatccggtgagtaagtttattccaaccgttaaaaatattaattttgccgcattgttaattgcattagcgttgttagcggtggagaaaggggtattaggtttgcctttgactatggcagtattggtcgggttgttaggcattattaagatgtttgggcagattctttttttcactacgcttattcgtgctttaatgagttgggttacgcgcggtgatcatcctttagatgaggttattgctcagattacggagccggtattaggcattattcgtaaaattttacctcgtacggggatgttagatttttcggtgatggtgtaaggctttggtttggtattgctgaataatctattttatagtgtattcggagctttttgggcggttgcctgatgaaagcgggcgagtttgttgaaaatccgtacggtattcgcctgcggatttttttacagcccaaagcgagtcgcgatcaaat

SEQ ID NO: 107066 - DNA, 613 bp, Oryza sativa
atattggtgtggagcttttaaccagcttaataaagcaacattttcaggtggcaaatctacacttgcttgatattcaatcacacttaaattgcgagtagttttaccgagttggttgttaatttgttgttttaattgatcaaaaataagcatagttaatgtttctagcaaataggcattaatttttagtggtcatgaacgtggtagctattttagcctatttcttctttaaattcataccaaatcagagtaaagtcgaattatttttttatgaattaatacaggaataatccaaccaatagttgggtttaggaaaaggcataaaattttaaagattaatattgatattctacacttttatttattggtttaaagcatcagatgaaatgttaatgggtatacttttacgttaagatgtttatattttaatgatttgcttactgttattgatgttcttttaagctgttgtagtgacttgttttcagcaaacgggtcatgaagcggacaaaatttgcttaaaaaaagattataatcacggaaaaataaatgaaattagtccgagtggcattagctgtgccgttgaattgttattttgattatctattgctacctaata

SEQ ID NO: 107067 - DNA, 619 bp, Oryza sativa
ggctgctttacaggtaaggctatttttacattcacttgtgtttgataatctgtgtatgctgtacctaatgctaaggaatattgccctttatggccaccaatcgcagcacccactgagacaccatagccattgccaaaatttaaagaagacatcgccgccgtattggctgtattcatatgcatttctttgcggaattgatggagaattctttgatcaatttgttgaatatttgcagtagttgctccgcgtccagaagcttttttaaaatcactatatgataatgaatcaccttcttttgctaatttttcatatgctgcaacatatttttcaaagtctggcaataagtatttaatcgcttctactgaaggatttatcgattccgttaaggcattaatattttcattaatcccctttaggttaagataagacatagaatctaaagattcaggatttattcctacttcgtttaatttgtcatatacatgaaaaagcttttcattctgttgttccaaaaacccacgattaaaccgaacccatttccacatatcatataagttagatataacggcatagttatcacgttctttgaggtgacggtaaaaagatttttcctcttgat

SEQ ID NO: 107068 - DNA, 1694 bp, Oryza sativa
aaagcgttcacgcaattaatttattaaatatcgccttagcagaaattatccaaaaaataacagatgcgaaatttgaccagcaaattgatattgaaattattagtttattgtttaatgaaaaattgaatagccaacaaaataacttaaatttcctggtcggtaaggtaaatttttgcactttattacctatgcgcgccattccatttaaagttgtttgcttattaggtatgaatgaaagcgattttccgcgtgcacagacggtgaatagttttgatttaatgcagtatgcctctaaaaaaggcgatcgggctcggcgtgatgatgatcgttatttatttttagaagcactattatcagcacaacaatttttctatattagttatattggacaatctaatattaataataagcaacatttaccatcggtgatggtttcgcagttactagattatttcgctgaatatcttgcgcctcaatctttagcattagtcagcccacaaggtaaattttctgaacagcacttttttgcagaaatggtgcaacaacatccattaacagtatttagcttaaacaactttagcgaaacaaattatgcctatgatcgagaatggctcaccatgacccaaacggaaaaaatgcaagagttttgcccgggtgaatttaattcaaacgctgaattgcctactgaaattcagctcgaacagttaattaagtttgtggtcaatccggtgcagtatttctttaatcagcatttaggtattatttagggataataataaacagattgaagaaagtgaaaaatttgtattgaatgcattagatcgttataaactacgtgataaattggtttgcttagatgatgatttaattcagcaaatgtttgaacaggaaaagctgaaaggtaatttacccgcggcgaatttgctcaactagcacaacaaaaaattgtagcatcggttaacattataaaagacgaattagtgggttatttaaccgaaagtgagattttagaagttgatcagacctttttaattaatggaatcgaattacgtgttgtaggtaatatttgccataggtttggtgatgaaattgttttttggaaagtcagtggtttaaaagataaagattatattcgttattggctttattatttgtttcttcgaatacaatcacaaccgttgaaattaaagattatctatttagatgaaaataaaaagaaagtattccaatttaatgaaattagccaagatgatgcaaaaaagcaattacgcatttatttaaccgattatttatccagtttttcttgtttaaaatgggctatgtttgaaggtttagatgattattttaaaaatcttaataaggctgaaaatattgagcactactgtcaggaaaacttagaaaagttaatcggaaaagaattttttaatagtcgctatttaaaacgtattttaaatcaaagcgtaatgttagattatggtagtattcacagtactacattacaatggtttgagttaatgcaaactagtaaaaaaagccctcatagtaaggaaaatgaatgaaaaagaattttattgcacaatcagtccgttatgcgctctgttcttatttcacattagcagtgatgaacccaacatttgctaatgatttaccaaatcagaccgctaattcagtacaaacaatgccaaatatggctg

SEQ ID NO: 107069 - DNA, 646 bp, Oryza sativa
gaccgcgaactcaaagatcttgaatttgagcgtaagcaagtattacatcatctcgctttacttaaggctaatattgacgtaattaagcgtgcaatcgccctttgtgaaccacgaagaagatattacgcactataacactgaaaattttatctaccgccgccgattcaaattgtttaaggggaaaattcgcaagtatattttgcagatcatgcgagaaaatcccaataaaggctttactatcagtgaactcacccagcagatttttgctattgaacaaaacgatagcaaaccttccgccaaacaccttgattcggttcgcaagcagttaaatgcattttaccaaaatggcttaatcactcgcacgcaagtaagccatagagaagtgtattggcaatggaaagcaaaatagcggtaacaccgctattccacacgctcaaccacagttatttaaagatggttgctacaacgttttcagccgccaatgaaacccaccacgacaaccagccctttcttttccagccgcaataacatactctttaccgccctgtaataactatcgccaacatcaacaaattgcggctgaccttgcaatttaaggacttgttcggcgatttctccgcattgaatccaatctccatattctcgc

SEQ ID NO: 107070 - DNA, 718 bp, Oryza sativa
atcagtaagccattcggcttaataaaagaaaaacttgcgtgataaatcatcatatcttgatgatctcttaacgtaatcgcccagaacccttctaatgggtcaagttgattcgccattagacaaatctttaaattatctgttaatttagctatttctatacttttgccctcacttaatgctcgacaaagcgctaaaggcaataatttttccattaacataaaattagttaagatcgcttctagccgttcggatttattaaatgatcggttacaatatttttctaagagcgtattgactcggtaaggctcgtgattaaataaaggttgccattgcgtattatgctgaagatagtgtacaaactgctgacgttctttattacataagatcgttctgaattgataacgaatatattcttttacctttttcacgattcttgcttcattagcgtacatttggctaaatgtcggaaacgaatacgtttttttcattattttgccttgaaaatctaaatatataaacgacaaagccgtacctaattcaacattaggtacgggctttccttatacacaataactaaaatcgtaggatagcgttattttttattcaattgtggaataacattattttgcacagataataaacctgcgtccgtataaacagctagtttatcacgtgtatcaacaatgtataaattacgcatagttaattgacctatacg

SEQ ID NO: 107071 - DNA, 738 bp, Oryza sativa
tgactaatacggccttctaaggtaaattcacaatctgttgcaagcggtaaatattgataacacgcttaattaaacggactaaatcttctgtcgctaatgccgttggcgtaccgccaccaaaatacaccgcttgaatcttgccatttccttggcgaattgaagcttcgtaagcaagttcttcaatcaatttatcggtataaactttactatagtcttctttccaagcatttcgataaaaaccacagaaaatacaatgactggcacaaaatgggatatgaaaataagctaaaccatcctcttttaatacattaattgccgcttgttgccaacattgttgccattctgcttgaggtatagcttctccctcccagacgggcattaaggcttgacgttcagggaaggcgttgggttgtgcttgagttgctttccaaggtattgttgtaatcattttcgctcacttacattcttcaaaaagaggaatttactttatacctaattcatttttaactgatattgatttttatcaacttatgattgagttaatacaggctaccgctatttagtcagtaatacacttctcattccgccacaattcagcaaaatctgaccgcttcttaatcaaatggctagttgcaccgtccaccataatttcaaccgcttgtggtcgtgaattataagtagatgacattgaagctccataggcgcctgctgaatataccgccagtaaatctccttcag

SEQ ID NO: 107072 - DNA, 676 bp, Oryza sativa
aaggtgggtgcagcttttaaacgcgtctcattcgctcagacgcctaataccaaaaaatattgatatttctagcttgagtttagcactgacacaaatttcaaatttttatattgttttttttggcagggtgttacgattcgacaatgactcacttgacacttaattacgtactccctccgtcaaaaaaaaaaacaaaccctggtttctgtgcccaacgtttaaccgtccgtcttattttaaaaaattatgaaaaaaaataaaaagacaaatcacgcataaaatattaatcatgttttatcatctaacaacaataaaaatacgaattataaaaaaatttcatataagacggacagtcaaagttggacacggatacccagggtttgcctttttttttgggacggagggagtacaccagtaagcatacacacatgaatattgggagcactagagttggtttttcttccatatcttaatttatgctaaataacatagaactatatttctttgggatggagaaagtattcactactcttctctttgtttaaaaaacacctctatatttgatagcttcaacctttttatcgcgcttatttgatcaccattgctatgtggcaccaaacgtgacaacccaatcaacattaaaagtttaaaaacatattggacccacctatcatct

SEQ ID NO: 107073 - DNA, 850 bp, Oryza sativa
aaacaagacaaaacgtttacgacaatacatgttttgatgatgaagaatacattagtcgtgaaaaatacacgtttacgacaaaaacgtatgtcttgatttaataagctgctaaaaatacacgtttacgacacatatactgctaacaaaacgttttctatgacacaatatacgtatgaaaaaaaattgttcataattatcttttagtttgttttaattttctacagattatcatagcgtagtatattactctctgcgtctcataaaaaatcaaactagcattggatgtggcatatcccagtaatacgaatttaaacataggtatatccatattcctagtacaagtatatgccacgtccgttactatgttggttttttatgagatggagagtgtatgtgtcatcatgtatggtggtgtgcaggtttggcgacgttgccgaggagccaaggatgttgatctcgtcggagaagctggtcggggaagggttcgagtacgagggcaagaacctggacgacatgttcgacgatgctgtcgagtacggcaaggcgttggggatgctgccataagccgtagtgatgatacagtagcagactgatgtgtgggcccggacccacatgtgagttactgctactgcatcagcagtgaatctgcatccgttcgtaacatgtgggtagaatgtagtatatgcccttgctatacatatccatccgaataatcatgaacattatcgaaataatttgatagcatggattgtgacgtcatactacaatatttcatatatgcatgtataaattcgatgccaaatgaagagaaaaatgaatccacatgtgcatggtcttgactattttactg

SEQ ID NO: 107074 - DNA, 518 bp, Oryza sativa
ctgctgtttgtgatgatgatatgatagctagctagcttctcaaatcaagaactcgatcgttttgattttagctggtcgtacttgagtagtactactcctgatcaaaattaattgctgttctttgctctgctgatctagccattacagtcttcaaaaaatctcatcttctctctctctgctgctgcaacaagatcgaacaagtagaggtaccctgcgaacagtgtctccaacagtgcgatctgttctcccgggcctgcttggtcgtcgtcctcgtcgtcttcttcctcttttcatgttcttgcaagcagagagagtcagtcagtcaggcagtacagtacacagtgtgatcgatcgatcgatttcgatttcgatcgagaggagagagagagagtcgagtcatgtcagcactgtggctgtctcgtccttcttggggaatcgacgtactgtttcttcttggggagagtcacggatggctacctatagcaattgcttctactgctactagtagtagtagtagt

SEQ ID NO: 107075 - DNA, 1068 bp, Oryza sativa
tcatagtactagaattatatgtcgtccatctactaaatctcttatattgggacggagtgagtaccagctaatagttatatataggtattgaatatattcttcatgtaaaattctgcaaatttcaatcaaatttccgattacaaaatctgacgatattttggcccacacagcgaccccggctggttagattagccagcactaggcaataatttaaccaaattactcaattaatattcatacaataatgttgggttgccttggtgtttggggctattcgtgcttgctacggcttagcccaagcaccagaaaagccctcgttccattatcgcttgagatatgtgcagtgtacactacgaccagaaattgttctaagtactcttgtcacaatgtcccaaaaattagagataaagttaatatatataattctaaaagtgaactaaccagccgagctacctttaattcccaccctcatagatacacacacaaaaataataaccacacacacacacacactcaaactttcttgattcttgataatcttaggcttacttataagatcaagagtctactaagatcaagagcttacttctgaggcttaactcttatatatatggtcctaattaagttactctttcgagtaccctttatttttttaataagtattctctctgtcttaaaatatactaatatatatagctaattttaggattcaaatttatttcaaaatataactacatccatttcctcatctaaactaatcacacttcttgctcgattcaacttttttacatactttctcatcttaaccaatcacagctagccatttctcacgcactaaacctaatttaagaaatgacatgcataagtagttgtattttgagatgaagagaggaccagtgataaaattttggtttaagtattaaattatataaacaatgattaaattaaacatgcatatttaaggttgtgcccatgtgttaaatgacacacacacatatatataaagaatatgtgtatatatatatatatatatatatatatatatatatatatatatatatatatata

SEQ ID NO: 107076 - DNA, 2699 bp, Oryza sativa
ttttaggccgtttgtgttcggttttcatgggctttcagattgtgcttttgttgtgatggaggtgaatagttaaacgattttgctatatctctatatatctcacttgaaagattttttttcttatctctcacttgattttctcactcaaattacttccgcaagtttttttttgcactcaaaactttcagatttgtgcataaagggaaaattttgctagaaagaaattttcacacatgtgacgtataagattcacgtgctagctaatgaaaccatagctgaatgtacgttttactagtaagttatatcgtggttacaatataattacaatatagttacaatgtattaattatatttcaattatattatagttatatatgaaagtttttgactaaaaaatttgcggtagtttttaagatactccctaaatgtatcttaaaaagttattgttgtcatatattaaaaatggtgagagtataatcttttgtttttttacctttgagaatgataaatgaagtagtatcaattctattatatgagttgaatctccatagtgccttaggatgtgttcgggaggcaaggttgggaaccttgcctcctgacacggaaaacgaaacacacgattatagtgagattaattaaatattagcaaaaaaacttaaaaaaatatattaatataattttttaaagcaactttcatatagaaaacttttgcaaaaaaaaatccaccgtttagtagtttgaatagcgtgtgcgtggaaaaacgagggaagtaatttgggaaagaggggaaaagaacacaaccttaaaatgattgtgattcttgaaagacagagagagaagattgtgtattgtttgccctatttaagttgtatggatacaaaggaaatgcttgcctttatcaatcctttgtaattccttcacaatgagtttgttgcagacgggacagcagtattgaattgatgtacatttacaacaagtgaacctcctaatttcttaatcttaatatctagtatttctttctctcagcataaaaaaatgtttccccatggtggattggtggtcatcccctctactattcatcaatcatatttctctccattcattttcctataatacaataactatgatatttttgggtattgaatgtctcaaattttgaacccctacagtcttgtcttggagacacttggccagtagttattacttcatccgattataaatatttgacatttagaataggatctgactaggctttgaaatgttgaccatcaattttacatcagcataagtttgtaaaatgaaataagcatacggtattatgatagtactttttcaagaaaaattcatgcataccagttgtcctttttttaaaaaagagcatttaaaaaattatcgatggacaagggtttaaatgttagccaaatcttatactaataaacattaaatatttatagagtgtatttcatcactatagtcaattcctgacctccttcacatacttggttagtattaataaaagtcaagttgaaacaaattgacatgataatgatttgttgtgtagccatatatataggacatcttcaactagtggttcccttatcatcgttgtacccctcctcggtaataggttagttaccgagcaaaacagataaaagctaaaatgctagaaaaggttaattaaaaacttttttaaattcgtaacaaacatttttcgttatttagccttggtggtaaactatggtgaccgatggtcaaaccttggtttcaacgaagccacccattgtagtgtaaaaatatttctgtagcttaatttaggggttgtttggttggtgaccgcaatttgctataccaaaatcttagacacagttgaattaagctacactttattagcacattggcccgtgcgttatattgtcattttctagccaaagtttgccataattgtggctaacaaattgttggccacattttggctacgttcgataggacatgttcccaacttctccttctcgtttttcgcgcgtacgctttttcaaactgttaaacggtgtgttttttgcaaaatatttttttacgaaagttgcttaaaaaattatattaatctattttttttaaaaaaagtagctaaaacttaattaatctcacgctagacgctgcttcgttttacgtgtcgggtacccaaccctcactcccgaacacagcctttgtgtggtttactacagttatagtaaagctagtctccatccaaacaatcctttagtccatataacttcgtatactccaaaattccactcgttctacggacatcactaatacgaagatcaagtggaagatagatatttttaatgacatgttattttcagtgaacacttgaggtcctcacgatccacaaacacacattttcgtagataagttctgaaatactccatacggcggttgtcacgatgtcatgatcgtcgttacccaaggaagaagaaaagagtggcattttctccacgccagtgttcccaacggagcatcttttcttcccccacacggcatcgacgtcacactttctggtgcaaactttaataattagtccaaaaacaaaaaaagaatttcgggcacatcttctcccgaaacgccaggtgggccccacctgcatcactgacagcctgtccccacaacgcgcagtcgtgttcccacctgtcaggatgtta

SEQ ID NO: 107077 - DNA, 698 bp, Oryza sativa
tcattaatgtgattcatcaaaagtctaacttattattcagaaatagcatcaatcagcatgtacaatctactattactaaaatatctctcttttttttggaaatggcaaaaggacaataaaaaaatgaattgttttacttcaactcattttcttttactcaagacaataaccacaaaaatggtactactttggtgcttcctgtgcacaaaatataatagcacacattttacaaggcattgagatcatatttcagctttctttaacgcaaatccttcagtgtcagaaggattcatggtacttctatatgagttaaccaaactacaggacagacttgaagtaaaactgttcactcctatataggattataaagataggatgaactcagcgacatggaaacaatagggtatatgataggagtccatatgaggctagacatgtatgtacctgtggcaaaacagttagcagctcaaggaagcttgggataaagtcttgttgagagttcatttcatcacttagccaattcacaatcccaccacctccccagtcctctacaggtacatgcaccgcaagagcagccattgcaatgcaaatctgaagatggcacaaaaggtagtttgccattataactgtgaaatacaaaattgattgcttaattacaagctatatactcaaataaatgtggtcttagaatgtgtgca

SEQ ID NO: 107078 - DNA, 735 bp, Oryza sativa
atatcgatcttatatactatctccattttttaaataaataccgccgttattttttcctcacaaccattcgttttattaaaaaaatttaggtaattataatttatttggttatgagttattttatcactcatagtaatttaagtgtgatttatatcttatacatttgcataaaatttttgaataagacgaatggtcaaacatatgagaaaaagccaatagtatcatctattaacaaacggagagagtatgcaatataaactcctacttctcctatattttttttcaagaatcaagagataccactcctgtaggtgctagctagacaatatatatatattgagctgttccacagcacgagaaaaaccctaacagatagcatagaaatttcaacatatcaagaagccaagaagaatatacagataacgatctggaagctaccgtgatggggacacactcagaagtgagagctaattaatcatgaaacttgtcctacatggttaatttaattaaaaacaataacaaacagcaattataaatagttggtaggggccagagttttcttcagctacacagagaagttgttatttttagagagagagagagagagagagaggaatatagaggcgatttcaagggcttacaagtatatagattaaggatgtgttcttcccactctcattttctgcgcgtacgcttttcaaactgttaaatgatgtgatttatgcaaaaactttc

SEQ ID NO: 107079 - DNA, 1153 bp, Oryza sativa
tacttattaaaaaaataaagggtactcgaaagagtaacttaattaggaccatatatataagagttaagcctcagaagtaagctcttgatcttagtagactcttgatcttataagtaagcctaagattatcaagaatcaagaaagtttgagtgtgtgtgtgtgtgtggttattatttttgtgtgtgtatctatgagggtgggaattaaaggtagctcggctggttagttcacttttagaattatatatattaactttatctctaatttttgggacattgtgacaagagtacttagaacaatttctggtcgtagtgtacactgcacatatctcaagcgataatggaacgagggcttttctgttgcttgggctaagccgtagcaagcacgaatagccccaaacaccaaggcaacccaacattattgtatgaatattaattgagtaatttgtttaaattattgcctagtgctggctaatctaaccagccggggtcgctgtgtggcccaaattatcgtcagattttgtaatcggaaatttgattggaaatttgcagaatttttacatgaagaatataattcaatacctatatataactattagctggtactcactccgtcccaaaatataagagattttagtagatgtacgacatataattcctagtactatgaatctaatcaaggagcctgttcagattcataagactatgatgtatcacattcaccatagatgtactatacattgattctagtactacgaatctggtcaaggagcatatccaaatttataggattataatgtatcatattcacctaaaatcccttagtattttattctagaatagagggagtacttttcctaggagtgcattccatacatggtcgtataaggctacgttttgttcgtgtgagatagggtgagaaaacacatcattttccgcgctcacacttcccaaactactaaacggtgcgtattttgcaaaaaatttctataggaaagttgctttaaaaaatcatattaatccatttttgaaatttaaaatagttaatactcaattaatcatatgctaatggctcacctcgttttgcgtatctttccaatatactcctcaaactcaccctaaatacattggttgcgtacgtttggcagcgattg

SEQ ID NO: 107080 - DNA, 669 bp, Oryza sativa
cacccataaagcccatggatactcccataagccccccttcaattttttcatcatagttgataagacagaagatgctaaaggtcttatcatagcattttagcatagtttaatactgagattatgtgtttatatcggtgtactcggtatgttgagtccccctaactttttgtttctgaatccgtccctgaacgtgctcaaggtgtggcagcgcgattctacgtcgtcaacactcacccgtacacatgaatgataatttttcatgattcttcaaaaaatatttataaacacatatatagttcgatcgtggagtggtttagtattagcatttcaccgaactgttacctttcaccctataatttcctcctcgcaaattaaagtttaattcgttctaatggtggcaaacagaacattcacgacgggatatcgatcttatatactatctccattttttaaatagatgacgccgttaattttttctcacaaccattcgttttattaaaaaaatttacgtaattataatttatttcgttatgagttattttatcactcatagtaatttaagtgtgatttatatcttatacatttgcataaaatttttgaataagacgaatggtcaaacatatgagaaaaagccaatagtatcatctattaacaaacggagagagtatg

SEQ ID NO: 107081 - DNA, 709 bp, Oryza sativa
ccatcgactatcagatgtgccagtagttcatcataaaagaggtgattttatatggagagaagaaaaataatgtaatgcataacggcagcaagatgcaacactaaggccatataaagagtattagggtgcatgacatatatagggcaacaacgctcggaggggcgctcgatatcttttcgttgcatcggtcacccgtcttgaatcaatttccatgcctatgcctctgatgaccattagatttttcctttccaaaataaatatacttcccagtgctacattaatattaaacacaattcccaatattaaaaatattcatttacaaaaaaccaaagggatagaattatttgaccacgaatttaggaaaagaagcaatatatatatatatatatatatatatatatatatatatatatatatatatatatatatatatatatatatatatatatatatatatatatctaccgctatagatatataccgagggggggataaataacatgaacgggatttctttatatacacctatagagagatagatccactgaccccgacaacctatatgagcttacgaataggcagatttctgctgcgggggagtcatatatctaaggaccccaattggattactgtaaaacaaatttttaccttctcttaaccgccgtaaagggtaagggaaaggaatttctaaacccaataatttaaattt

SEQ ID NO: 107082 - DNA, 748 bp, Oryza sativa
  unsure (1)..(748): unsure at all n locations
gtgtggngtgaanccttatatgatcgtgttcatcataaaaataattgagtggtatagccatcacataaccacgatccgaagccacaccgagcaatcacagaactacgatccgaaataactagctttatacctgtcaaggttggatgcggccaagtggtgagggtgagaataatccgaagcctcctggactctgacctgtcaaaccgaacaatcacagaaccacaatctgggactaatccacacaagagacccgagagccaaaagcacgaattagggggcaccagaggagccttctcacaaatccaaaagaactcacaagaacaaaggggtaagacacttatgtagtcttcagcaatctctcatatatgaggatttcaattgaacaaaagttatctaatggatggagtagagagtgcagccgtggatattcgtgctcaacgtttgaccatccgtcttatttaaaaattttgtaaaaaaattaaaaatatttaatcacacataaagtactattcatattttatcatctaatagccataaaaaatactaatcataaaaaaatttcaaataagacgaacgggtaaacggtgaatgagaataatgcaaatagcacttattttgggaccgagaatttaccaagcaagaagcttttttttacatgcgtactttggtatacttgcctgggtctggtnggcatagtacgagcgatgggaacggaacggtacaaacactgcgatccgtgtgctggtga

SEQ ID NO: 107083 - DNA, 572 bp, Oryza sativa
actattcttgcaagaatgccacttgtggtgagtctctagaagtctttactttcccgtatcattgatacaagagtgggatttcatggaccaaatgcacggagaagtctcttgaccacaaagtgatttgtcatgtcctcactcccaagtcctttaatcttgttgacaagaatcatcatactatcatacatctcttgcgctgtctccttgtcatgcattacaaatcttgcaagccttcctttcaataattgaatcttggactcacgaacggagggacatccctcatgagccaattgcaaagtatgccatatctacttggccttctgtagtccatcaaccttgttgaactgcttcggattcaaggcggagagaattgcattggaagcttgagcattgcggctgatgaggtgatcttgctccgaagggagctccatgtcatcatggggtatacaatacctgttcatacaatgttgcaaatacttggatgcaaagagattagatgcaacttcattttgtgctactcgagcggcataatatgtcccatcaaatcgaagagcacgcctagaaagcatgga

SEQ ID NO: 107084 - DNA, 709 bp, Oryza sativa
catcattatttactagctagggttgtataatatacgtcacctatacttagcttatatcacgatttgtaattagacttagcacgtaaggttgtgtagggttctaatgtacgacatttacacttagcatacatgacttagattgttaaaacataaatgtctcgtgacttagcatatacgcacgaaacacttagcatatacatgactattttagtcttagcatgtaatattatttgagttttaatataagattattttatttgtaattagatttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcatatacgcacgaaacacttagcatgtacatgactattttagtcttagcatgtaatattatttgagttttaatataagattattttatttgtaattagatttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtct

SEQ ID NO: 107085 - DNA, 966 bp, Oryza sativa
gggttaagataaaccaagcgtagaatgacacacaagcatttgctactcattcccataatatatgatgtaagccaagtggaaagaaaagagagagagataatctattcctatacttctagtatacatagtatacatatattctagttaactgatatactagctaataccctctatccgatgccctcctggtacttcgagaagccacccctgactgccgagttccttacgacagcccgtcatgaccatacaaccggggctaaaacggaggaataccctccccaggaaattaacttaggactatatacaggcgcggaggaatacccgtactgagctgtcaccatcagcggcccacctatcatccgcagcatataaccccaaataatgatatcccgtaatctagacaccctgtctaaactaccagatactactctaatatcatcgtcatgacatagagtaattgcatatgcaaacattatacccgcaccaaagcatctcccagataagctagcagcatattcagtataacatgaacataatgtaaagtaggcattcgtatactcgaaaaatatttcaataccataaatgtatatagaagagtattctaataaaagtacaaagcttacaaaagaggaaaggaaagctactagagccatacccgaactcttccgaagacttccggactcctgatttctactatattcctattccaccagctagatactactaaactaaacttgagagagtatgagaaagcttgcttgaggtgtgtgagtgaagtgagaaagtgaagtccttatatagaggtagttatgacggttgtggaaggggaattgtccgaagtgccctccaaccatcattgggatgcaatcctggacgtccacgccgaaccctgcatccaacggcgccatgatgggttcggccgaaccatgggctgggccatcccggcccatcttcggctggcggcct

SEQ ID NO: 107086 - DNA, 1159 bp, Oryza sativa
ctgaatatggagggcaagtacaagctagctgattctgttctccagtcaaaatggcaattgcggaatcgaaggaccttctcagattcgtttattgtcaattcatctgcttaattcacattctctgttgaaaatttatcatgagtagtgctccatgttcaacttatttattggaacaagagttgtatgtggtacgagcatttgaacaagaaacattatttattgcactatgcggaatgcccagatcagtaatcagaggaacactttatccaatttagagcagtgaactgttgtaacactggctgcatgaggaccttataaggtattccttctttctcttgctttgacatttattcttcattcaacagtgcaacctagctgtgatcgctaaagataccgcccctgttgatttcttaacccgcagcctgtcccttgccattcccctcctctacgtgagctaacctggtgcactcattcttctctaactaggatacctctcgatggcagcagtgctatctccactgatcgtggtccaggatgtagaggtgggtatgtattcgttgatactctactgattagaatttgacgaaccactgtcattcaatctgctgacacatattgcagttaatgtctgttcttcctgcctgtataaacactgtttgatgcatgtagaaatgtgtaccttgcaatgtcatgcatggatcaaaatcagacagctcaagataaggtattacaagcacacttaattgaacaaattcgacatgctgcactttgattgacaattttgagggcaacaccaatcttgatttgagtgaaaacttgctttatgtttctatttgttccatttctgtcttttcacatgcaagtgcaaccttatttttttatgagacgttgctgtacaagattaccagcattttcttcccaatgaacaatacagaatgttgtttcttattaatggttctatccagcaatccagtcttctataggttgtcctgtttttgagcagtattcaggagggcagatccctcccttgaatttggaagtgactagtatattcaatgcgtgcgcatatgcaatgctctttgcaggcacacaacattattttagcttcattgaattctgacatttgctgttttggcaaatagttatgaacctctcaaca

SEQ ID NO: 107087 - DNA, 507 bp, Oryza sativa
tttactttccgagggtcgatgaatccagtatcgaaaaccccccaccgtcgggccctttgaatctccattctacaacgataaaaggaagtatatattatatatagtctacttatatacaaggacctaattatttaaaggaaacgtaataagaaatctaactgaacgatacttacaaaatgcagcaactcataatagaaacgtcgagggcgtccagctggtatagttcgtagatacccttgaaattgatccagagaatgtcatctccttgcaagaagtccgtgtccctgatcctcgctctgatcatctctctaccggtggcgctcatctccatgtacagttgatggaacttgtacatttgagtgggtaggaactgcagctgctcaggcttgataagcggtttatcgagttcgtacatgtatttcactttcgccttttcgattggtgcacctcatatcaattgatccgtagttagcccggtgtcatcaataaattcttgtattccaaaat

SEQ ID NO: 107088 - DNA, 873 bp, Oryza sativa
cctttccaaccgatagacgttattcaccccaattaccaggcctcccccctcttctttgttgggaagtccaaaaatcatgctccaccccctctgtttgttttgggagcaactccccgacccccaatagatcagcaatattccaaatgtcctcatctcctttttttaaggttctgtttttcctccttcatttaatgtctaattacttttatgcccgcagtatttctgttatgtattggcccaaagagcacaatagtacatcagatcttgcatatttgttaaatagaaaaattgaataggtagccacagactacttgagaaactcaaagagacaactaaaaatgtattacaccttaatcaatctgtttagtgcagcatggcaatcatcaagttacccttgattcaagtattatgttaccacgctgttgcagttgctctctctgaatttcattagtagaaaataaaccttccatacattattttcttatttggcctcttaaaatcacaatttaacatggaaaggtccaaggtgaccaagttgtcgtatgtatatctagtatatgagttaaatttaattagtgtgtgtgaacaatgccaaatgtgtcttttagcgaacaaatatcagtttatttgttttaagcaatattagaaattttataattgttctttttctatcgaaaacatgtgcaattagctagtgctctacatactgccttattttattctcattcttgagcacaataccctatctctgttactatgtggttacatctctaactcaagttcctcaatctgttcagagtgctgtttcttccagggatttgtttggtactgtatctccatatcaggctccaagcagccttcatacatttggaa

SEQ ID NO: 107089 - DNA, 716 bp, Oryza sativa
agtattccaagaaaaagagtggaatgattttgtgacccacttatacaatttaatgtacccactcaaatccaaagacccaagtgacctgcaaaaatttagggaataagggggacctatgatatgctttcctcaacttcgaaaaaaaaataacaaactattctgctggtcaagggttttaactcaacaatatgccatatctctactattataaaaattgaagatgtttttgccggtattttggtatgtcatccgggtttgagtcggtttttaagttcgttcacttttagaaatacagatccgtgtttgagttggattttaagctcatttgcttttggaaatacagaaggagtcgtataagaaatatcattaaaaaaactcgcatgctaacttgagatgatatacggactcttgcagcttatgattttcaaaaaaaaatatccaagcgaattcccacagtgaattttaccctagctaaaccatataacaacaataaaattaaaatagcatttacccattgcaacgcacgggcattttttctagtatcttaaaaataagaaattatattgttgcttcaacactttaaattatgttctgtacagtacagtatgggtgattgtaaaagaaatcaatttcatcatatgaacaggaatatttagtgagcaacatgacttgcgtattaacagaagtgttgaatgttctaaaggagaaatcaacag

SEQ ID NO: 107090 - DNA, 676 bp, Oryza sativa
atttctttattgttattgagaaagtaaaatactttatagcaaaacttacaatatctttgggctttggctaagtgcgatgattagttttgtgttctcttttaattttgcaaacttcggtatggtgtactctcttcgtcccaaaaaaaactcaacctaggagaagatgtgacccctcttaggataatggatctggacagaccctctatccagattcattattttaggagaggtcaaatctcctcctaattaagtttctttgggacggagagagtaacagttttggtttttgctgaccagaaatattcatgcccaagctggcaaggcccatccatcgcttgccagtttcccacagccaattaagagcaagtttaatagtatagctaactactagctccaaatcatttatagccaatgtaatagccaattcatactatagttgtttactacactattaatatctggtcccacctgtcatatacacattacgtcttgaagtccgtgctgtagctggctacagatcagtaacaccactgctcttctctcttattttattctttaaaatatatttatagattatagtctgtattccagctctaattaatgctaaaagtttagtagtggcttctatggtctcgtgccctttgacctcgatggtttcgatcgtctcgttcccttt

SEQ ID NO: 107091 - DNA, 686 bp, Oryza sativa
ttttgagtacttgatgatgtgatccaggtttgctgttgagttcttgatgatgtgatccaggaggcggtgatgaatgggatgtgaggttggtgagttcgactcgaatgagccggctctctctttttattttttttttttttttttttttttttttttttttttgctcgagcaaagcttaaaatgccggctgtatatttctaataggggccggttgctattatatatgtcggttgggaaaccggcacctatagacggtttctaaccagcaccaatgagtatttgtgtactagggaacttgattttttttaaagatgtttaaaatcaaatgatttttgacaacctttgacaaaataaacaaatttgaccgaaatttcaattgaactatcacaaatttgattggtgaaattaaacataatttttccagtaaaaagaaaacataatttttacatttttttacacagctggcagaagtgtcacagcacttggacaggctgttccttcacttgtggatccagccgaccggtggaggatcacgttcacctaggttggctgcttcccgcgctctgcctacggagtcattgcccggacctttttcttcccggcgtggtcacattggtcatcgccgaagctgtcctggggagtccccttgttgccacctgttcccgcccgccatgtccagggtttcg

SEQ ID NO: 107092 - DNA, 522 bp, Oryza sativa
  unsure (1)..(522): unsure at all n locations
aatattaattatattataaaaaatataatattaaacaactaattataaaaaaaattaaaatttncaaacaaaatattaaaatatatattttcctatcaataatacatatattttataatatttaaattcataaaaaaatattatcttagctaaaaactaatcctgataaagccaactataatattttttaaattattgatgataaaaaaaaatataatatcagttacactatgtggaatttattttacttttcacaatcttcataattaatattattttacaattaaaaaaaatattacaaattaattttttaatttttcaactatatcatataaaaacgatacaatttttgcttaaatataattcaattttatatatataagataataaaacacacttttttacttttatttcattctataacctgttttttctaatttttatttattttagttactctaactatccataaaatttgttttttacaaaaattcttatctaccataatttatttcttactac

SEQ ID NO: 107093 - DNA, 788 bp, Oryza sativa
ttgaacccgttgaccaaaaatcgatatggagaatagagtagaggaggtacacagaatcaatgccaggtttgtaagaacagatgacattcaaatttaacaaattggcaatggttcatgagaggataatcatcaaaaattcagttcaaaaaacagtccattgggtacctccatagctcatgtgccaaaattcggatcagccaaaagaaaacactggcatctttgccagctcaggcaaacactcctggtataaaatgaagaaatgtgaatttctgtttgccgatcgcctcagccctgaaaaaccagagcaatttgcaatgcaggctgtaataagttctcatgatccttgtccttgacagaggacgaagtgacttatttctttcgcttaacttttagaattcttcttgcagacttttcactgttgccaccagtagtgcctattgagaagccacctggggatgattgactatgctggccaaattggaacatgcccggtgaagcggatgtagctgaagcaaactgagttgctggcgtactaaacagagttggagtggatggtgaactgcttggaagaccaaagggtgaagctgctgaaaaagcaaacgggttcttgtccccagccatctgacctccattcatctgatcagttcctgtacttaaaccaacagtcgggctcggtgtaccaaaaagtggtgttgtaggtgatgcatttggtatcgtaggcgtagctgaggtaaatgagaatacagggctcgaggttgagctaaaaggtgaagtggcaggggagccaa

SEQ ID NO: 107094 - DNA, 1715 bp, Oryza sativa
ctaattaattaagtgcagtgtgtgcggcagtcgtcgccgcagatgatcaagcatccttggctcatcgccagcacgcagttctggcaagcctcaggcgagcagccgccgtcgcactgcggggcgcacgccgtggcgacggtgtcggtgtactcgcacgaatgggcgcatgtctcgtcgcagctgccagcagaacatcttcgccgccgccggcgcgacggcggaggaggagaggacaaccagcacgacgcaggccatggcggcgacggcgacggcagccgtaggagatcgaggctacgccggtggccatcttgtgtggattattgtgcatgcgtgtgtttggtgtgcctgcagctgcaggatggttaattgactagccggagtggtgtccagtgtaatggggcatgcagccgacgatatttattggcagcaaagctgagatatacttatcttctcaatctcacctaattagtatatgtgcaagtagcttgcaagtagaatgctgtaagatggtggttttcaaaggaaatatcaaataacctaattgaagtaactaaattgggtgttcagtccgcatgtatagggctgtcaacgagccaagcttgagcgaacttccctatgtaggcttgagctcggaacagactcgagcctaatttgacatcgagcttggaattaagcttgggctcggttcgttcgagcctcgagccttttctcgagcttgctattggaaactcagccacgagcttgctccattcaagagaaaagtagaactgtgatgatttgatggagaaaagtagtactactagtactactttggaaagtaagataagaagtcaaacaaatgctatactctctgatggatttgacagtaccgtattgttttgttgatggaagaattcaatgaggagggagatagaggggatggataaaggagagaaacaaagagaaggtggagctcgtcgagctattcgagctcggctgagtaggctcgcgagttcaaaggtaagctcgagctcgatttgattatcagacgagccgagcttgaatcgaacttataacgagccgaactcgagctgcttgtgaaccttgagctttttgacagccctacccatgtacaaagtacatttgaacctaccaagatcttcatcacatctatttaagccaatactgcttaagtccctccgtctcgaaataaatcaactcgagagagtttagattgtaaggaaaaatatccacaatttataaataacaagaaaagaagcccgcgcagatgcacgggcattttatttattgtttatataaataatgctaagagaattaagttatatctcaccatatacatataacaaattatagattttgcctcgtagtaataaaaaattatgttgtgaaatagaccgtagactttaatataaatgataagaatgtctcttagatttaatcaaaattcacttttgtccaggtaagtgtaaactctcctattatcaccattacttattatcattgttcttaaaagatagatatgattttaataaatggaactccatctaaaccaccaaaataagtctaatacatcattaatacataaaactttatttcaactatgtacctaaatgtttatgcgaacacttatttctaaatctacggataagtattctaaaactaacgcttctattggttattagttattaggatagcaccgttaaaaaatagacatg

SEQ ID NO: 107095 - DNA, 1789 bp, Oryza sativa
aatacaatgtcatctttagaaatgagtgaagttgatcactaaaaatatatatagctaaacaaacacgtgaccgtgacaatgttcagagtattatatcattttttatattttgacaaagatctatattttagcatcttgtttgttttcatcacctattgtccataattgcatgagacacctttactaattctaaaattgtatttatttcccaaaattatttataataactaatttgttgaggtgcacttgtagttatgccactatggtttatgtcattacattcatcaattatcacttatgaccattatattataattcctctactataagagaatatatcatgaatagtttcatgctcatgttataggattgttcatttgttatcaaacctatttggcaaagaaaaaatgtatatgaccatagttcttgtgatggattaaggggtcgtattatagcaagatcattgcctgagcataccaatccaatagttatgaaaaattaaaaaaaaactttgagaatctcaatctcacacaaactaaaattaaatcagatataattaaaaaatataatgttgtttcatttttcatgcatgtatatttcagttagtgttatataattgttaagtgatatttgaccataaattatgatgtgaaattattttgaagattatcatgacattacttattatatgtcagctccaggtgctataatgtatttagttataatataactatgatatgttatcaacatttgaatacacctgattataagttgactataaaatttaaaaataatctaaaaaactttgcgtgtaaacacatttaatttgttttttatatttatctagtttaacttgcttcaatcgaacatcgctaaatggtttctctcgtatgcatgagattaaaaggaagcgggctaatcaaataatccaaaaataatatatccatcattttgaatgaaaattgacaacaaaattatagagtaccacgtagcattctaagagtgcttgctgaaatgccacatggccatatttgtggagtgataaattatatttttatagtatggcaaatcctattttaaaaagaccatctattacttactttttttaagggaacagtatatctaattgtttattttgttttatagcttttttaatcgtagtacgtactctgataaatattttttaggctttataactttattatcgtatgtacgtatggttctttgtatttgtttttcaatcaaacatccagtaaatggtttctcgtatacataggagattaatagtaagcgggctaatttaattatctaaaataatggatccatcattttgaatgaaaattgacaacgaaattatagagtgccacgtagcattctaagagtgcttgcagaaacgctacatgatcatatttgtggagtaatgaattttatttttatagtatagaaaatcgtatttttaaaagaccgtctattttttcctaccgacgtatatatatttttagggtcttatggcttttatttttactcgtgtatccgtacgtactttttctagggaacaatatgtaaaggtttattttattttctagtttttttgggctttattatcatataaatgtatatgtctttgtattttttcaatagagcattcggttgtatacccaggaaattaagaggaaatgggctaatctaatgatctaaaataatggtccgtcattttaaatgaaaattgatagcaaaatgttagagagccatgcatgtggcgatttaagagtaattgtagaaacgctaa

SEQ ID NO: 107096 - DNA, 2102 bp, Oryza sativa
aggcgcgaccttgtagggccatggtaagggtaagacaatcttcgggtactaccagccgtaacaagagcataggggtttacaggtataagagcaaaaatcaaaaggcgtagtggcgccggcctaaaaatgctgcccaggcgggtgcccaccggcgcacaatgaggagtgagttctggcgcggaattttaacgaagaaggggtgaatggaacggcccgcccaatggcgaatggcgacggcatggctcggcacggcatctagcggcggctagcggcgactgaaaaggcggtggcggcggcggccaggagggcgacggcgctagggcgatagagagcatgggagcactcggcgagatggggaaaaagagagaggggatggcggtggtgcttaaataggggaggaggggtacgaacgtggccgggagaggcgggaatcgccagcccatgtgggggagtgggagaggagagagagggaggtgggcgcggggcacgcgggtgcgagggcgacgtgggcgacgtagcctgggagacgcgtgagcggggcggggcgacggttgcggggcgcggcggcgccggctggactagggagacgggcccgacaggtgggccccacctgtcggcgacccggagagaggagggggctcgggcggctggctaggccgtggccttcggccggcccagcggggaggggaagagaagagggaatgggccggcggcccattcgaaagagaaaagagaaaaagagaaaaagaaaaagaaaacgaaggaaatgaattttccagggattaaatattgcttgtgctaaattttaattggttaaaattatttctagagctctgaaaattccactaaaaatcttgttagcgtatttcgacacgtagaactcaagaaaaattccacatgccaattccgattattatttgcattgatttattagggtttactcttgttttacaccggtattttcttgagaccatttctaaattcaatttaggcttgggagaagaacttcaggatgtgacatgagttcatctgtgacgggctctagtttcggcctgattgaggacagtagtcatctgtgacgggctctagtttaggcccgattgaggtcagtagtcatctgtgacgggctctattttaggcccgattgaggtcatcagtcatctgtgatgggctatagtttacgcccgattgagatgagtatcatctgtgacgggctctagtttaggcccgataaaggttagtagtcatctgtgatgggcgctagttgtggcccgatagagataggtcatctgtgacgggctatagtttgactggtcgtctgggttaaagctatcggtgacgggctttacttagggcccaattgagatatattcattcgtgacggccgtttgcccgattgagataactcttcacatcagtgacttctagcctgtgacggatgctgtgtccgattgagatggggcttaccgtccgattgagatgagggtatccgttctagtgatatatgaagaaactggaaagataccattgggaaaatgggggactacgaaagaaaggggatgggggaggctcctacttaagcttggggagggctagctgatggcaacgggggcatcctagcacatggcgaagtaagtggaggctctcacctttaaggaggaggcactcgctccaggtcttcgttgttggtggtgaaaattagtgcgtattctcgccaaggatctggtcccatgcatagcctagttagccgcgtggtgaagtcaataaagtgaaatggcccctcttgtagggagcaccatggtgttgagagtggatcatggaccatggtagaggagacacaacgtcagcgatggggacaaaggaagatgtgtggttgagaaggtgcactggtgtatccatgcggcgtgaaagaaacgggctacggtggttacaaaggagcaggagtgtacaagaaaatcgagtgagacatagaactaaagtggtggcatcgatgactagagaatgaatggcactagatcttggcaaatgacggatcataggtggaggcagccattgcacacttgagggcaagacactcgctccatgtccttgtagttggtgat

SEQ ID NO: 107097 - DNA, 945 bp, Oryza sativa
  unsure (1)..(945): unsure at all n locations
aatggctgatnancnctgggtgatcngtctcacttatacatggngaattcgagctcggtacccatgacatgtagaaatgtgtaccttgcaatgccatgcatggatcaaaatcacacagctcatgataacgtattacaatctcacttaattgaacaaattctacatgctgcactttgattgacaattttgagggcaacaccaatcttgatttgagtgaaaacttgctttatgtttctatttgttccatttctgtcttttcacatgcaagtgcaaccttatttttttatgagacgttgctgtacaagattaccagcattttcttcccaatgaacaatacagaatgttgtttcttattaatgggtctatccagcaatccagtcttctataggttgtcctgttttttgagcagtattcaggagggcagatccctcccttgaatttggaagtgactagtatattcaatgcgtgcgcatatgcaatgctctttgcaggcacacaacattattttagcttcattgaattctgacatttgctgttttggcaaatagttatgaacctctcaacaccagtctgtgttttgtaggtaccctactttgaatatgctcacttgcttgtaatttgcagtataattgattaaagttcctcctgaagtaacttccatcaatctattcgcgcagttaatatgtgtacgcatgatcaagtttcagtattgctatttgtatcacagttattctttatgggttggttttatttactttgcttcacttacaagactgctcagagattataagcaaagctgtgtctttgtaatatgtgggggtagaccattccttctttaggaaattcctgatgctgattccctgtactggaatctgatagtagaaattttttaagaaatttttttatgctgattccctgtactgtaatctgatagtagaaatttta

SEQ ID NO: 107098 - DNA, 743 bp, Oryza sativa
ccgcgccatggtagaccactgataactatccgccgaattcgttctcggtacccagtatccctctaaatctacaatgcaggtactattaccgatggttctcaaactggtagtgctttatcggtctccaacaattcatcattatgcatcaaatatcatgttaaaagtcacaataaaaataaatggcacttatataacatttttaatgaaatgaatggtcgaatatcatattatctaataaaaaccggtgtcatattatttattgaacattatagttgtttagcaaacattgtgggattcgattgaagagctggtatagattcaatgccctctaatgcagcggcggattcagaaaattttatgagcctaggcaagtcaaatgatagatgataaaagcgcacaaatccgtataactctgtacaaaccatttctcattgatgtaaacaatttgacactacatagttattattttggagagaaactaatgcaaactacaaataatgatttgaacctcaattactaatttcataatttgcgtggttaatcttccctttattagaactaacagtgtattaacagtgtatgttcatgaggcggagcctgggcaatggcccaggctggccgggccttggctccgccattgctctaatggtttagaagttgtgaactatcctagatatcgacaatccttgaaataaaataagaatttatcaaccatcatatgtgaataaaataaacgggagaaa

SEQ ID NO: 107099 - DNA, 2355 bp, Oryza sativa
  unsure (1)..(2355): unsure at all n locations
cgagaccttagaagcccgccgccgttgcaccgttgcaaccaccagcttccgggcaccgctcaaatggctgtgagcgctaccntgcatctccaggaatggcggcagcggagcccaccaaccccaaggcgcgggggtcgccgccgccccggtaaggaggggccatggcgggggtcccggggcagtccgggccggcaggggagagcacacgggcatgcgcggctaggatgcggtcnaggagcgccatggcgcgtgggatctccgcgaaggcgtccgggctgagggcgttgagctggcggaagcggttgaggcgaaccttgtaaaccaccgtggacgggtcgggcggcgtcccggcgagcgtcttgaacccacgccggagctccgcctcgagcaaggcgccgatgccgccgaggcgccctcctagtgtggcgagggaggaagaaagcggcggcgggccggctcgccgaaaaagaggattggagagaggggaaggaagaagaaagggggatgagaatgactggtggggtccattggttaatagagagtataatgcggagagtctgttggaatagaatgcaaatttgactctctaaacttttgttaggttggccaaataggtatttggagagctaaaaatgaccactctattaaagatgctcttcgatttgaacttctttcatgggggatacataccgtcttatagcagcttaatttagaacacgatggcgaagaggacactccattagagtagcaaaagagtgcatggttgaattcaagcatgaggcaagcaataagaatcaaataataaaaaaagccagatttggtggagaaacgtcccccaaacatttttttcaaaattttttgctataagatattatgacttcatggacactctgtaaacgtcagagccgtcctaacaattttggggccagtgaaaaatataaatgagaccttattttctaaaaagtaattgattaatacataagggttatatatttggaacggatattcacagccactgtttttttaccactgtttgttctttgatatgcactgtctgacaagcacgtcaggaaaggtagcatcgacctaatactcttttttaagactgtttttagatcgaggggcaaaaaaaatttttaaggtgtcacattgaatatacggatatacatttgaactattaaacatagtctaataacaaaacaaattatagatttcgcatgtaaactgcgagacgaatttattaagcctaattaatttatcattagtaaatgtttactgtagcaccacattatcaaattatggagcaactaggcttaaaagattcgtctcgcaatttacacgtaatctgtataattagttttttttttctatatttaataccttatacatgtgtccaaatatttagtatgatagggtgaaaaaacttgctaggggatctaaataagcccttagatatattctgctattaaacaagtaggaattgtttgcaatcaatgacaactaatggtatatcaaataagctcattcacctgtatattataatggcgatctggttaagtaaaatatcgttgcaataattcattttttcttactaaatagaaaaatataatctaagaacgcatgttcacatccccgtcatgaaactttacgattaccatcgaacacttgtcggaattgagaaaaaaaaacagcttgttctagtggtggagcaggaagagtgaaattcaaaaagcataatctaaagatcataaacatgtcagaacatcaatttcaattgaaacatatggttattaagcctctgcaggcccggtaaatgtaaaaattagcttatgaacacgtcattattataatattcatttctagttgaataaaagaaaaaaaacccataaaaaattttgaaatacatctggatccacatgtaaggtatctatctcaacctctatctccaattgcccttcatcctcagcctaaggccggcgatcacctcgtgatgtggttgttcaacgcattcgaaaggtccaacgttctacagtaaccaaacagaaacatcgaatttagataatcttggactaacctagccatcagaatgtaaagtaatagtggcatatatcctatccatatgagagtaaagttaccctgtttctcaaaaaaaaaaaaaaaaagaaagagcaaagtaccctttaaagtacggataatttttcggacgtcggatggagatccatcgtctcacagccctccccttcctctctaccctctaccgagtcgagcgtcgcgtccgccgccgccggcgccgccgccccccgcctcttctcccacccgcgcgccaccgctctccgccggcgagccgtaacacta

SEQ ID NO: 107100 - DNA, 810 bp, Oryza sativa
tgccccatgctatagttgtggtatctatgctcgttgccctctagggaaacaaagagaagatggatatgatgcaaatagttattcggttcttcccataaaatatagtttctttatgttttgtttagacacaattttgtttatggtggtaatcaaaactacttaatttttatggtacaaatacaatgtcatctttagaaatgagtgaagttgatcactaaaaatatatatagctaaacaaacacgtgaccgtgacaatgttcagagtattatatcattttttatattttgacaaagatctatattttagcatcttgtttgttttcatcacctattgtccataattgcatgagacacctttactaattctaaaattgtatttatttcccaaaattatttataataactaatttgttgaggtgcacttgtagttatgccactatggtttatgtcattacattcatcaattatcacttatgaccattatattataattcctctactataagagaatatatcatgaatagtttcatgctcatgttataggattgttcatttgttatcaaacctatttggcaaagaaaaaatgtatatgaccatagttcttgtgatggattaaggggtcgtattatagcaagatcattgcctgagcataccaatccaatagttatgaaaaattaaaaaaaaactttgagaatctcaatctcacacaaactaaaattaaatcagatataattaaaaaatataatgttgtttcatttttcatgcatgtatatttcagttagtgttatataattgttaagtgatatttga

SEQ ID NO: 107101 - DNA, 564 bp, Oryza sativa
cagggcctgaagaagtttaaggtaaacagtgcaaacagtggtggatgcagggcctgaagacacttgtagggacaccaggcctcaccatcacacagcaaaatggagggcatgtcataccactagcgcttgatgacgccagatgctagctgaagttgtttttgcccaagtctagaaaacttctaggtacaccactaattgccaactactattaccaatttaccatgattaaagagggttcaagaaaacatattccagagtcgtctagtttatctttagatttcaaaataatagcttgtgttttacgcataaaataggcagcatccgatcaaaaaaatctgcaattaacattgtatcgtgtactttaaagcaacaaaattatgtggtgagtcaatcagtgatcaatattgaaggtccaaacatttcatgtcataaatcattcactaatcaaacaaagaagccaagataaaagtcatgcagtagcagttcaacataaatccagaagccggtaataaacccaaaacaaatttacagcaaaataagattatgtttcgtgattaatacctg

SEQ ID NO: 107102 - DNA, 702 bp, Oryza sativa
gcctcagcgtcaaagcccgtggtgctttggcattgtagtaaagttccatttctaattatgtttatgttaaggtctagtcaaaatgtctggcataaatcactcctatgtctaaagaaactggttattttatcactagacattttattcttgtgaccttccacatgaataataattagcaaaaaaatacgaacacccgtactgtttaagaatttgaatctaaatgtgtagatttgactataaaaaaagttatgctcagttcatgttctctcgttttattttatatccatgataaatattgattatccgtatcagtagcagcgtcgtttcaacttgtcggtaatttagtagtgtccactagaattcaactagcgtatggcatgatcaaacactagacttatccaatttgtccgcttttgatctgcaagctacattgttttggctattttcctttttatcaatagacattatcttgggttagcacactaatatcattgtaccaccttgtgcttaattaatttcaatttcaagcttcgctgtatggccatatcaagcttaataatatcagtattattttttgttgtaaacattatcctgttatggtcatacgaaaaatgttgttatcatctcaaccatgatctatggtagcgcatcatttattaatctctgctcttacatagatttcgagtatcgtaataaacttgt

SEQ ID NO: 107103 - DNA, 1273 bp, Oryza sativa
ttcggtgttacaaaggagcaggagtgtcaagaaaatggagtaagacagagaactaaagtggtggcatcgatgactagagaatgaatggcactagatcttggcaaatgacggatcataggtggaggcagccattgcacacttgagggcaagacactcgctccatgtccttgtagttggtgatggacattagcgtgtattctcacctaggatctagtcccctgggagagcctcgcgagccgtatggttaagttaatgaaatagagcggcctatcttgctggctagcagcatggtgttgagagtggatcacggaatgtggcacatggggtatagtgtcaacggtggcgacaaaggaagagacttgacagaggggatgcagtggcacggatagcagaagaggtgtgatgaaggcgtaccggtgtgtccgtatagtgagtttgatacggatcagagtggttacattggagcagtagtgcataaggagatcgagcaagacagagagaaattagagaggacacgcgggtgaacaactaaacaaacatcagtacgtaacgattccaaaaaatataatagaccctttattgatagaaaaatgtccgaattacactcttgaactatagaactatagagacatgcaaattacccctcaattcaaataccaggtaattaacattctagttctcggggctaattcgcaacaggtcagatgtaaccggaaccgtcactgatcgtgatgcactatatatctattactacatcgatcaagtgcagtgtgtgctgcagtagtcggcgcaggacgtcaggcatttcctcttggtaactcgcaggcagttatcgcatgcctcggcgggtgactgcccgtcgcatttgtcgccgcacgcggatggcacgccgctgccgtcgcacgaagcgccgcatatgatgtcacagtcgccgcagaacctctccgccgtcgccgggccgaccgaggaggtagacaggatcagcgggatgcaaacggcaacgacgatggctgccttaagagaggctgcacggcaagaagccatgttaaatggtgtgttggtgattcacaagcaaagatggagatagctcgagatctttgattgctaaatgatgagcaattgagcaggtgtggggtgcccatgccatggagccactggtgggaaaagcgtttgtagtaccggttcgttacccccccttagtccccgtttcttaaccgggacttaccattacgggactaaagatcgctatcttttattccaggtgaaataaccg

SEQ ID NO: 107104 - DNA, 817 bp, Oryza sativa
ctttgcaagttctgcaggtgaagcaacttgatcctgcaggaatgaatagcatgagattatgttacccttgtagtcacggaacatatggcatatcaatggtataaacaacaaatgtgtcaggagataaaatagttcatggtacgagctttgctattttgtggcaaatgtagatagaatcgcaagtgaaactcatgtaggaatagaaaaaagaagtatgtgtaccagggactactaaaagttgggtttctaaagtcgaaaattgcacatataggcccctaaacatgtgtatgtgcataagtacaggtttaaaccatgcctaataagcaactacagaccacttatacaagtataccaaaaaaaaaagtaggatgactttgttgacccacttatacaattttatgtacccactcaaatccagagacccaagtgacctgcaaaaatttagggaataagggggacctatgatatgctttcctcaacttcgaaaaaaaaataacaaactattctgctggtcaagggttttaactcaacaatatgccatatctctactattataaaaattgaagatgtttttgccggtattttggtatgtcatccgggtttgagtcggtttttaagttcgttcacttttagaaatacagatccgtgtttgagttggattttaagctcatttgcttttggaaatacagaaggagtcgtataagaaatatcattaaaaaaactcgcatgctaacttgagatgatatacggactcttgcagcttatgattttcaaaaaaaaatatccaagcgaattcccacagtgaattttaccctag

SEQ ID NO: 107105 - DNA, 1578 bp, Oryza sativa
tagaaggtacagaagagaatgtggtagcaataaccaaacgtatgagaaaaagaagacacgggtaagaaaaattatctaaggtaacagaaccttccagaaatgtcaatggtattttctacaactaactaataccaaagtaaatgccatacaactgtccatttcttagttcccagctttagaactgaagtacacttctttttctcctaaaaaaagaaaaaccagttagggaaacccatgttttctatagcctcatggtttatattttcttggtcacatagaaattattattagtacaaatcatttcatggtaatagtgtgatgctgtgttatgaacttcatggatgtaccccatcattgcagatcaagttcagttccttaggtgtatgctgtatttggggtattatgcaattaaaagatatatcggcggtacctatgcctaccagttactgaaatgctagcaacaaatctaatactgctcaaattacttgctaaacatgagcctattaatgttatacaaaaacaggtacttgcctcgtgaatgtcctctgtttcaatagttcttcaagatccataacgtcatagctatcagaccttctaagaatgtcatctccatctttggcagaattctgaggattgacaatggacagattccacatataaagcaacatgtgtttaggaacttgatcatatggaagattcaatagggtatcaaggtaaaataagtagcactggcactggacaaaaatgtaagtgtgtaacttaagaagacttcatatggttacacatgttatcttattatccattcaaagaagtatcaattaataaatcttgcaagaataataacgaccatatatttcaagtgaaagaggttaaattctaccggcttaaaatagaagtcaatgttttaatttctatataaacttatagtgcttaaaaaagcatagcaaacatctaaccatgataactagtaggttattatccgacaagtacaacgtggaatacgcaaatttacaatatgcatttacagagccagcttacattagccacggttccggtgccctcttcttcttcttccggaatgtcatcttctgtgtatacaaacaacaggaaactttgtaagtttgccagcagtcactaacaacacgtgaaccgacaatcgccactttgtatgaaagcatcgattacgccgtcatcccccaatcgtcggaagaacggacaaaataaacaacagctactacatagtaacatagctaagagtccatatgcaacgcaacatgccgatctacattgattgaagctactaaattaatcgactacagagatttagagttggtttggcctactgcgaaatgattgcaccaaactgcacatcatcacacatcaccaacagggccccaacaaagctagcggcgaacgctgtcaaacaaaccctaaaagcgaaggcgaggccaatgcggagaattaagcgctccgcctgcgagggcggcctcctgaccaaattggcaaaaaaggcggttagcgagatgcaccccttcccgttgggctcgagtgagggggggggggtgacggaaaaggagg

SEQ ID NO: 107106 - DNA, 660 bp, Oryza sativa
atgtctgcatagtttattatgctgataagtgataagttcccttctattcatttccatgttggctgtttaggtaataacgcaagtagtttgtttggtaatggtttcgtgattttctacctatttgcttaatgcttataatttattaaatttccaaatctccccttcagaaaactcgtgagcgtttcagttggatagtcttgtatccacactgtatattttgtccaccctaagtgtttgacctctcctgtaatgatatggcaaattcacaatttgttccaatgatctgcttcatgataaatacagtggtaccatcatggtaatcacgttatgaattttactcttaaaataatattttcaaaattttctacaattgcataagtttctgtcaatattttctatgccttaatcatacatcaataatttacttcattactttggcagagaaagggaatacaccataaaggataacaatttagaagggaaatacaaagactggcagaagaagttacatcctgacctagttcattctaaatctgaggtctctccctaggccctggcattcttaccaatctatagtattcgtacctttgtcttcaaaacaatttgtgacttggcttctgttttgtgtagaaagagagagcctttgctgctgagcaatca

SEQ ID NO: 107107 - DNA, 1056 bp, Oryza sativa
  unsure (1)..(1056): unsure at all n locations
cgggcggagaagaaggagaccagcctgcggcggcgctnccttgtcgccatgtacattcttcccaggtttgatttcgcggcgaacatatccccgttgtttaactaccgttttgcagaccggagatgaggaagaaaatgaagtggtgtgggcgggggaaggaccgggttagtgttacggctcgccggcggagagcggtggcgcgcgggtgggagaagaggcggggggcggcggcgccggcggcggcggacgcgacgctcgactcggtagagggtagagaggaaggggagggctgtgagacgatggatctccatccgacgtccgaaaaattatccgtactttaaagggtactttgctctttctttttttttttttttttgagaaacagggtaactttactctcatatggataggatatatgccactattactttacattctgatggctaggttagtccaagattatctaaattcgatgtttctgtttggttactgtagaacgttggacctttcgaatgcgttgaacaaccacatcacgaggtgatcgccggccttaggctgaggatgaagggcaattggagatagaggttgagatagataccttacatgtggatccagatgtatttcaaaattttttatgtgttttttttcttttattcaactagaaatgaatattataataatgacgtgttcataagctaatttttacatttaccgggcctgcagaggcttaataaccatatgtttcaattgaaattgatgttctgacatgtttatgatctttagattatgctttttgaatttcactcttcctgctccaccactagaacaagctgtttttttttctcaattccgacaagtgttcgatggtaatcgtaaagtttcatgacggggatgtgaacatgcgttcttagattatatttttctatttagtaagaaaaaatgaattattgcaacgatattttacttaaccagatcgccattataatatacaggtgaatgagcttatttgatataccattagttgtcattgattgcaaacaattcctacttgtttaa

SEQ ID NO: 107108 - DNA, 657 bp, Oryza sativa
  unsure (1)..(657): unsure at all n locations
tccccatactatgcaaataccggaatcgcgacatcaaacatcgacaatgttaagttgcttttatgatttatgtaaattactttaagactttattgaatttactttcataaatgcatttaattaaaaatcttctctacatttttctcgtgaatttactctacatataatttcttatttcaactcagtcataacttagttgcttctaatctatagagagttacaatttaaataaattacttttaaattaataaaatgtttaaatatattcaacatggatcttgttttatcatatattttatgtagagtacaataatataaatatatcttgaagataatatgtaatttaaaagatataagttattaaagatgttaaaaaaagacatgcaccatatactaaagggagaattatatatggaatggagtggtctactgttaggactaaagcactaccatgcgagttcagatcccctggagttgatgccaactccaccagataggtttggctaaatctgaacccttcggttgcttctacaggtggcatncttccnccccnnnnnnntnncntgcatttattaatgtccatttggagggaaaagtttcagggtgttctccataaatttgatcacgctcttcctaaacagaatacaaggcacattt

SEQ ID NO: 107109 - DNA, 892 bp, Oryza sativa
ttaatatatggtcaatatgtctctctcacatatttttttggtcttgtgcctaagccggctgtaatcgtgccatccgcttcttctctcactcctctcctctcttatccacctcagtattcagtcttcttatggccttaaaaaatttatggaactttatatccttatgtccggtgagtacaaaagtaaagtggaaggaataatttttttttgtttgcggggaaaaaggaataaattttagaagggtaagtacaaaatgcaggatctggggtacttgcccatcctgatcagtatacttatagctgtgtctcagatatccatttcacctataacttttcaacatgccaatgcacgagaagcactcttaccaagaatatcactatcaacacaactatacaggtactagctagctagatccaataaacacgcttgttttagtagtgcgtctgcaagcaattaagctaggaatcaatcagataacataaacaaggaccggatctatagtcgatactactagatctggtaaatgcatgcgttcattgactaaatctacacagccttcactaggtgatatcgcttacgtagttgggaaaaaaaaactatagttgttttggaattgttactgacatttagtatagtcactgcttgcataggactagtaaatgcatccatagcgtatagttcatatgcgatactagagaggtgggacacacatcaatcataacaattaggaaaatttgttacagggtataaaacacctatagaaataatcataggactcacccatattaaaatagaggaaataatagagaggtgtagcttgcaacctgtaagcacgatttatctgacatgagggtccaaagacactctcgtaccatttgaaccaaggacgagt

SEQ ID NO: 107110 - DNA, 1853 bp, Oryza sativa
ccagtgaacccgcgagcggctccggcgggcgcgcgcccggagtcggcggcggagcccggtgcgtgcaaggaggcggcgaggtagggcgcgcgactacgcgaggaggcggcgagcggcttcggcaggaggcggtcggcggcgggctggcgagcgaagaaacttttttcgttttctttttcgctttgatcgatccctaaccgctgttaagacgtgggagatcgctaattgcagggcagatccaactcttagtatgagccgttggatgaatagatctaaggatcagaaaacatctgatttaatgaacttacgtttcatgctttgtatttgggtagaagcaagaattatgcctgtggtagatgtattttgaccatggttcaaaatctcatctcagtatatgtgatattactcagaagattaattgttgagtactaaactccaacaaggtatagatttttcctcaatttccgttagcacgtttttcaaactgctaaacggtgtatcgtgcgaaaactttctacatagaaattactataaaaaatcaattaaatctatttttcaagtttttaataattaaaattcacttttgctacacttaatattcatcttgttagagaatctaacggagtctaaggacgagatttgttagaggatggaactggatgtatatgtactcgatcagaagtacgtctgtccactatctggcctatgtacctacctttgacacgtatatatcttgagatgtgcgtactttcaaaaggaaacaattactcccacctcaacaattttttcctggtgtttctgccatcgtgctcgtgccgtgagccaaaatcaattctgaatgacaggaaataaacaaaaagttaaaacctaaatacatgagatggtacacgagaatgcttcatcttcataacttgtccctacaatccaatttccatctgaacacgaataggaatccttcgtctatatgatgcgaccatgtagtggcatagagtaaatgaaattgtacccgttcgaccatatatcgatatgggagaatagagtagaagaggtacacagaatcaatgccaggtttgtaagaacagatgacattcaaattttaacaaattcgcaatggttcatgagaggataaatcatacaaaaattcagttcaaaaaacagtccattgggtacctccatagctcatgtgccaaaattcggatcagccaaaagaaaacactggcatctttgccagctcaggcaaacactcctggtataaaatgaagaaatgtgaatttctgtttgccgatcgcctcagccctgaaaaaccagagcaatttgcaatgcaggctgtaataagttctcatgatccttgtccttgacagaggacgaagtgacttatttctttcgcttaacttttagaattcttcttgcagacttttcactgttgccaccagtagtgcctattgagaagccacctggggatgattgactatgctggccaaattggaacatgcccggtgaagcggatgtagctgaagcaaactgagttgctggcgtactaaacagagttggagtggatggtgaactgcttggaagaccaaagggtgaagctgctgaaaaagcaaacgggttcttgtccccagccatctgacctccattcatctgatcagttcctgtacttaaaccaacagtcgggctcggtgtaccaaaaagtggtgttgtaggtgatgcatttggtatcgtaggcgtagctgaggtaaatgagaatacagggctcgaggttgagctaaaaggtgaagtggcaggggagccaaaaggtggagcatttgtgctagttaaacggttgcaaaaaattggtgaagatgctgaagcag

SEQ ID NO: 107111 - DNA, 1372 bp, Oryza sativa
  unsure (1)..(1372): unsure at all n locations
tcatacaagtatacagtagaggttcagccgatatgatctttatgtatgcccggtaggtcaatacgttctgctacgggccactgttgacgcgtggaccgaaaaggagttttcgggttacagccgagtatacatgaacctaaagggtcgcacacttaatgggccggaataaggggattggatggagatccaatatgagcttaattcggatagggatccgaataggagtcctacgggccatgtaggcccgagtgatggatcctatatattcgtgaggggtgtgaccggcggaggcattgcatcacgtgagaaaccctagccatcacttccctccccgagcaaaaaattagccgcacgcgggtgctagcacatctgcgcgtggcgttccgtccttgtacgtgtggataccggtagaggcgccgctggtttgtggtgctgatcggcgtgggagtacggtgaggagaacgcacgaggagcagaaggtcgagctgatgcgatcgactacttcctctacatcgacgcgcgctacttcgcgagagttccttcgacttctcagcgtcttcttccgctgcgcagcgcgtcgagtggtaacgatctatgatctaatacttgcatggttcctggtttacgcgatagaaaattttgatttatgctatcgtagcctacgcgtaacccaacacttcttaccgggctgctttgctggacagaataaaacgcaaattgtgcatcttgttatgttgtgcttcctgtggtcactagcttaatacggtgttggccttggtggtgtgtccaacagtgtaatccagagagaactccattgacaattgtgtaactgtcattatcaaatagtggaatttttggagagggccgagtaggtcccgtggttttttactcctcatctcgaggatgtttttccacgtaaatcattgtattatttgtgcaagttgctttgatcctttataattacttctgcagcatccttcacttctagagatgggctaagtgaaaggtttggaactgtcaatgtcatacatgaccgtcttccaaatcatgcatggtcgtgtgtatgtgttacacactagtacagatccttctatctgtgacgggctctaatatgcttagaaatagtgggccgtcacaaggaagtcatctcaatcgggctgaaaagtgcccgattgagatatggtcgcatagacatgttagatgggtataaaacttaagcccgtcatggatgacacctatcagtgacgggccccnngnnnnngncccnnngcnnnncgcgccccccgctccagcccgcccttccggggcttgccccccccgggtcggcggttttcgttggcgcgcctcggccccttgtcgctttttcgcgcac

SEQ ID NO: 107112 - DNA, 831 bp, Oryza sativa
cgcggatctggaggaaggggctgttacaaaatggatcagagcccgaccctccgggttgcgcgtacggttcagtgtgcgggcatatggggcatgggcaatgtgcgcactgtgtgacgcacaaggcatggaatatggcatcgacactggacgtacggatgtgcgctaagagggggtgtgttcctggacatttgcctgtgtggctgggtaagttggaccgacggggacgtcgggtcctttgagggggggtgtatgcctgtgtggcccatgtgagctgtgtgcgtatgtttagtaccaccttactagattagcacgagtggaaccgacttataaggcatcttccctccaaccacatcactcccgggttaacccttttacacgaaacgaggacgaaagtgtaagtggggtggtgtgtgtaagtgggcccgctcgtcggttggggtgggctacgctgttctggagggagggctgttacaatagaccaatgcattttttttattgctggagctgaagcaacgaaacttcgagcccagaccaaagccttatggttttgaccccattccatatttctctcctctactcttggctagtcacggcaacgaaatcacgtcatctctcctctgctagtcgtcgcagtggaccttgctcccacctctctccaacccacaactttactcgagtggctgcccttatcatagcactgctagttctctaatattctgtgaaaaatgttaagcatattacgatgaatatattctgccaagaaaaatatgcatgaatatattacgatgcaaaaatatttatgtttgtaaaactacttttatgatatatgta

SEQ ID NO: 107113 - DNA, 717 bp, Oryza sativa
actttcaagatttttttttaaaattttcacccagaattttgaaaattttcatcatattttcgaaactttcaacttaactatttatgtattattttgataataaaaactataactagattaatccatatggttagcgttgttattagtgctaatgacgcgtggctgtagtggacccacacgcttaacctcccctgaagcgatgcggaacagaaaaatatacaaaacgacgaaacaggaggaagttacggaagtgcgcgctacaaaattatctggcgcgtctgcgctaactaggagcccccccgcatttgtgcctattattgttttcgtagtatattccacggtgttaaggtgttgggcctcagcgtcaaagcccgtggtgctttggcattgtagtaaagttccatttctaattatgtttatgttaaggtctagtcaaaatgtctggcataaatcactcctatgtctaaagaaactggttattttatcactagacattttattcttgtgaccttccacatgaataataattagcaaaaaaatacgaacacccgtactgtttaagaatttgaatctaaatgtgtagatttgactataaaaaaagttatgctcagttcatgttctctcgttttattttatatccatgataaatattgattatccgtatcagtagcagcgtcgtttcaacttgtcggtaatttagtagtgtccactagaatt

SEQ ID NO: 107114 - DNA, 723 bp, Oryza sativa
tagtgttacatccaagttagcaccaattttagccaggtaggccaccaccaaagaccattaagtggcgtgtagccccccaagtaaattatgtaaccatgaaaatttgcacaggtatccaattcaaaattaattattaggcatttaaacaatgttatgcactattggtcatttaacataaaatatatattgtccaaatactgtgtcactacttgctagcaatatataaactgtaaatcgcatcctgaaaattagtgtatgctatatttatgcattcggtaactacaatagtagggtaaagccttaaggtagtgcaaacagtgtaaatgcagggcctgaagaagtttaaggtaaacagtgcaaacagtggtggatgcagggcctgaagacacttgtagggacaccaggcctcaccatcacacagcaaaatggagggcatgtcataccactagcgcttgatgacgccagatgctagctgaagttgtttttgcccaagtctagaaaacttctaggtacaccactaattgccaactactattaccaatttaccatgattaaagagggttcaagaaaacatattccagagtcgtctagtttatctttagatttcaaaataatagcttgtgttttacgcataaaataggcagcatccgatcaaaaaaatctgcaattaacattgtatcgtgtactttaaagcaacaaaattatgtggtgagtcaatcagtg

SEQ ID NO: 107115 - DNA, 723 bp, Oryza sativa
  unsure (1)..(723): unsure at all n locations
tcccccagagttatagtattggcgatgacatgtatatttcaattcaagatcaatttgaagaaacaaagttatattttctacatatnttgcagatgatggagatacgtgaagcagttaatgatgccaatgattctcaaaccctggagaagatacaatctcaggttctgttaagcacaattatgtcatggttgttatttcgaagcataaatacgcttgactgatttctaggctcgcactatatcacctttatcagattaagagaaagctggaaacctggtcccattccttccaggaagcatttgaaaggagggatttcgaccgtgcagtgaaagctacacagagaatgaggtattatgaacgcgcagtggaagaaaccataaagaagctctaattgtaaagtgtacagtggcaacagatgtggaggctagcccatgttcttggatgacccatgtttactacattgctcttaggatgaaataatgccggatgcttcctcaccaccactcaaccagccagcgctctcttcactccatggttgcaatgctgcaggaaggggaaagacatatttccacatttctcctcgctgtaaaaatatttcatcacagatatatacaggcagcactaggcagacaatgaaatggaaactgatatttgttattaccaagaattacattcattctttgctcaataagttatatgtaaaatgtgctacacttgaaaagt

SEQ ID NO: 107116 - DNA, 722 bp, Oryza sativa
cgaacggatcgaaagcccagcttacatttcctagcccggtgccaaagtaagtttaagtttgtccatggttcaagcctcttaaggtagttcgttctcccttgcttgttaacagtcttttctgttagtaataaccacccgttttagtaactcaaatagggtggtttgatatctcctttgaaacccaccgtctttcagcattccacctgcaagtttcttgcacatatcctatttgggtgatatcaccaaaataagtatatttcagcttgcttgccaataatactagtggagggcataccccttactctagaacgctactccggttagtctattacccatcatgtagctgcaggcactccaaactctggcatgcacaataatcctcacaagatgtccaccggcgtagcctcgatctcatacggcggccgtccccgtctccaccatggcttgcgtggtgctggttgtcctctcctcctccgccgtcggctcgtcgacggcgaatatgttttgctgacagctgtagtcgagtcatgcgcccattcgtgtgagtacaccgacaccgtcgccccggcgtgcgcgccgcagtgagtcgtcgactgctcgcctaaggcttgccagacttgcgtgctggcgatgagccaaggatgcttgatcatctgcggcgacgactgccgcacactctgcacttaattaattagcgtacgtaaagatcgagtaaaccatga

SEQ ID NO: 107117 - DNA, 718 bp, Oryza sativa
aggaagttaagaaagtgcgcgcttcaaaatttttggggggtctgccctaactagagcccccccggctttgggcctatatggttttcgtagtatatcccccggtgttagggtgttgggccccagcgtcaaagcccgtggtgctttgccattgtagtaaagttccatttctaattatgttaatgttaaggtctagtcaaaatgtctggcataaatcactcctatgtctaaagaactgggttattttatcactagacattttattcttgtgaccttccacatgaataataattagcaaaaaaaatacgaacacccgtactgtttaagaatttaattctaaatgtgtacatttgactataaaaaaagttatgctcagttcatgttctctcgttttattttatatccatgataaatattgattatccgtatcagtagcagcgtcgtttcaacttgtcggtaatttagtagtgtccactagaattcaactagcgtatggcatgatcaaacactagacttatccaatttgtccgcttttgatctgcaagctacattgttttggctattttcctttttatcaatagacattatcttgggttagcacactaatatcattgtaccaccttgtgcttaattaatttcaatttcaagcttcgctgtatggccatatcaagcttaataatatcagtattattttttgttgtaaacattatcctgttatggt

SEQ ID NO: 107118 - DNA, 723 bp, Oryza sativa
  unsure (1)..(723): unsure at all n locations
aaaagaagtaaatatagtcacccggttttcccattcttataataccaaggaatggacggtgtagccggaggttataaaaccaaagatttaattccatgcatgtgtatttaatcacatcgttccaatanaaccggacagtgatccactacatgtcaatgatatgcacacccctaatgttgcacttgaagcattggctcaattcgtctagacggtttcatttctttctttggttcgtactccgtaaaatctattagggcagtcccaaccctccacctaggatggtgtctatggcattaaatacattgctatgtaggatttttagcttatgtggcactatatttattaagagagagaagagaggaagaaactgggtctcatgcaagacacagcttcaacacgagaagctatgcactagacactgtcaagttttgcattgggagataatagtgtcttcataatagatgaaaaataaatatgattggtagagaagagcgatgatgtatttattaatggcccactttaagaaactatgggttgtagagtgtagtttatattatgatgtcttattgacatggtaccatagacactacttatggacactatgggttgggagactgaccttagggtctgtttggtacagctccaactcctaaatttagctctaagagttgggtctggagtggagttgtggagctgacataaacccagctccacaactctagt

SEQ ID NO: 107119 - DNA, 1215 bp, Oryza sativa
cgccccgtatagaattttcttcggctaattaaaaaatttttgaatttgttaaaaatttcaaggtggatttttttccatccgaatttgtcttgcccatctgcttacccatcttgaattttggattgcattttcggtccccgtatagaatattcttttggctaattaataaattttttgaattttttttaaaaatttcaaggtggaattttttccatccgaatttgtcttgcccatctgcttacccatcttgcctatatggacgtgactaggtagagtgcgggttcagatctcctggagttgtggacgaccccaccaggtggatttggccaaatatagaccctccttttcttctacggctgagatcatatctcttaataattattataaaaaaaatctaagttttgcttctactccctccgtcccaaaatagctcaatctaggataggatgtgacccatcctaggtaagttatttttgggacagagggagtacgtccttaggcgtgtagcctggcgcagcggccatggcttgtcagtggcacgcggtgccgacgatggccagtgcgtggcctcggggatataccatacggttctcctgatgaaatgtgttgaatgttgtcgctctgaattgctctaacaagtcatgttgtgtgtggagaaagagatgcatgtttgattagtttattgcactacgtattgatttgttctttgtggaaagaatgtgccttgtattctgtttagcgagagcgtgatcataattatggaggaacacctgaaaactttccctccaaatcgacactaataaatgcaggggaggggggggggggggggaggatgccagctgtagaagcaaacggagggttcagatttagccaaacctatctggtggagttggcctcaactccaggggatctgaactcgcatggtagtgctttagtcctaacagtagaccactccattccatatataattctccctttagtatatggtgcatgtctttttttaacatctttaataacttatatcttttaaattacatattatcttcaagatatatttatattattgtactctacataaaatatatgataaaacaagatccatgttgaatatatttaaacattttattaatttaaaagtaatttatttaaattgtaactctctatagattagaagcaactaagttatgactgagttgaaataagaaattatatgta

SEQ ID NO: 107120 - DNA, 688 bp, Oryza sativa
attgcgcgctcgcggagggctttttttttgggagaggcgaacgaataaccgggggaagaagagccccgtgggggacggagggggggtggggtgggatggttatttaaaagtgttgcaagggggtttagagaccaacgttttttgaggtctctttctttctgacggattattatttttatatgttgcatgataatacactccaacgctgtgctccgactgatttttttctattttgaaggcgtttgcttatatatatatcaactgtttttttttattttcttataatatatggatatcgatgaattgctttttaattttttctatgcatgcttgtgtttttgcgacattaatttgtctgaatattttattttaattttctgcataatttgttttttacagtatctatgataaaaccttttgttaattcgtatattaatattgtttttactcccatattatttttaatctttttctatggacgattttatactcttttagcataaaatccatctttatttatcttctccttatccttgaatgtattttttttactgagtcctatcggttttgttaacatatatttgttttataatcattcttgttcaactggaaacgaaatgtctatatactcttcttattttcctatctgccttgtattattccgttttaatatcggtgtaatgacgct

SEQ ID NO: 107121 - DNA, 670 bp, Oryza sativa
tttagcttttaatttctactatcttcttgttggcttgataggtggtgacattggtttgcagatatgtcggatgaatgaatatgatagccgataatttggtcatctacttttgcgcgtattggagtttgttagcttattggttgcattcttctgcttacatgttctgcactcaaatatgtgctgcctctttgttatatttttatacttcacattttagataagcttaattagaatcaaacaattagaaccatgtctatcaataacttttaaaacttttagtttgaaaacactagaacacacgacgtttgagtagtcttaaagaatacttttacaaaattagatgtttactacttttattaattacaacagaatatcatagtcaaatatatattttggtgatgatgtcattgtcccaaaaacattgaaaatccgggaactggagggagtagatcttgtgtttctatttcttggaggagcagcggcttgatctctcctattaatattgatatttctttacataatatcatcacatagccagacttggtttaagctatttttaatacggggctgactgaaaacttgttgttattttaatcagctctctggaaggtttcgggaacccgcacggggcaatcttatttcttaaacgaaattagcactttataccttt

SEQ ID NO: 107122 - DNA, 735 bp, Oryza sativa
aaaacggaagagcagcaggcaggctcggctcagtcggccgccccgcctcgccacgcccattgccgaggccaactcggcgcacgcgcgcgtgtgtagcagtccaaccatcacctcaaccggtcaatagggaatctccaatatcaccctatttaagttgaggttcttctacctaaattttcaaggcagtattattgtctctaacattacttgtgggctcttgagattttagttgaattaaattgggcctagcctatttattccaacaatccccaccaaatttcatggctcacaacaaatgttctcaaaactgaacctgttagttataccagtgttttgatggagactgttaagttgaacttccacctaggaaaagagctacaccatatcacaactgaacaatggactatgcattgaattgtcagtcttgtgcgattcaggtttcactcaaacccttaactggtactgggctgccggttgcatcccctctgtttggatcatataagtcatactcctggacttttcatgagtatctagagattacccagatctcatagactataactagcaattggactcatataggtgtggtccttctaagatattctgtaggatgacattctctgctttatgaaaagccactcggatcacattaaggtgtataccattgtcccatacagaaattgaagagaagcgcatccatgaagaacaaactcattttgagggtctgttctctct

SEQ ID NO: 107123 - DNA, 678 bp, Oryza sativa
  unsure (1)..(678): unsure at all n locations
tatatcaggggtagaaaggtaaatcaataaattccaaaatgattattcctctttattcttattattttgttatcttaacaattccagtttccgggccgggtccactaacttccataaaaaaagagtaaacacctccttcatttgaaaaaaatgggcaaaaaacccaaaactcgaaaaaaaacacgagcaaaaccataattgaacattaaagtaggagcaaaacaaaattgttcctaataaatataagtcgttttacgtaagcttgcatataaatattcaaaaatggataaacagtccatgtctccatttagggctgatatagctagtgtaatatttttttttggaggaaaggaaagaattggttttacagatgtcaaaggaatttcataggatatatagagaaattcctctacattttggagaatttctagcataagatcttcaaaatacttaggagatttgcaatctaacttatgtatctttcccttctttctatctataagaaatcaccccatttgccgcgcaagggcgcagcaagccccaccccctaaccgccgtgacttgccgtcgctcgttgcgcctggccaccgctcttcacaggaagacgagccttgccctgcctgtagcggttgggaccgtttgccacangaagttacgttgccctgactctccacgcct

SEQ ID NO: 107124 - DNA, 1469 bp, Oryza sativa
tggaactagggtttctcagtccggattggaaacttttctaagtccctgctatagtgtcccgcctcctttgaaccctagccccacccccaactcaactttccccgcccccgccaccgagaccgtcacccgcagccaccgagccctccacggcctccaccgagcccgtcgcctccaccgaccggcgacgccctccaccgaacctggcgccaccgccaccgagcccgccaccaccgccctcgccaagcctgccgccgtcgccaccgacgctgagcccgcggctgccgccaccgagcctccttggcccttcattcggaccaccgccacctcctcactgacgacccccaccgagcccgcgccgccgccaccgagcctctacaccgactggaccggtgtcggccttcctcgtcgtcgccgcccgcgtcctcaccgacgcacgttgccaaccccccaccgagcccgacgccgcccgcccggcgccgacctacccgaccggcatctccactgaccggcgccgccctccaccgagcccagcgccgacccccaggtgagtcctccattgcgcatgaatgatgaatagatgaatgtggttcgattgatgaatgtgatgaataaatgattagatgaatgtatttgaatagttaaatgtgtatggatatatgaatgtggatgaatagatgattagagatgaatgtggatgaatagatgaatagatgaaatatttaatttatttatatgtgatattcaattcattttacatgtggatgaatagatgattagatgaatgtgtttgaatagatgaatgtttatgcatagatgaatgtggatgaataaatgattatagatgaatgtggatgaatagatgaatagatgaaatgtttaatttatttatatgtgatattcaattcagtttattagatttgtgagatgtgcaatttagtttatttatgtgaataagtgattttagaactttggattctaagccattgaagcactgaattgtgtattttcgttattttgaaaaaaagtagacgatgtctcagcaaggtgaaccaatgtcgacgacaactagtgggtcctcaagggcacgtactcctaggacagggaacaaaatccctaaggaacggttccgcataacagtggtggacgccgtagggttgccgacatctccaaggaaaatattgagccgatttaggtctatctgtggggtcatagggaggcagaaattcagtattctgcaagatgacatcaagctcatgccggccgcagagaaggacattgcttggctaatgttcaaggagagctttgattatcctgtggagcatgaggaccgtctcaggcgggctgctttcaaggttatgggcaatgcttggaagaacttcaagactaagctagtcggcgagttcgtctacaacccggcgaatctagatccaagagagaaatttccttggatcacggaacaggtctgggag

SEQ ID NO: 107125 - DNA, 719 bp, Oryza sativa
tgcatatgttctattgaataagaactgcatggtctattatgtttatttatgattaaatatgcttatttttcttcagagcaacatctaaccaactatgtataatctaagaaattgagacatatccctattgtttcaaatttcaaagagtgctatgttaatttccttttcttagattagtacattctaacctttatttgtctgcacataccaacaattcttcttgcattaatgtatagttcttaaattgacataagctttatattatgagtattacacattaaagaaagcatcttatatcagaccatactcaggcttttatgttaatttcttaaatgcaaattaatatggtgtttggttattcaaaagaaaatggaacaatgaaaacaaacgtggattttttcacaagaatttcttttttctatcgaagtgtcattgtcgtgctgttatgagaggaaatacttctctctgaatttattgatcatggcaaatggacatgtgaaattttcgtatgaatgaaacaacagaattatatttttattttacataccacctgtgatgctccacttgtgataatctagattttctatttattttatttttattctcacattggcattgaaatgatattgtttttgatttacatatatgcacatgattcctcacttcactttcatgcccccaggtcgctacacccatcgccgccgttgccagtcctgatg

SEQ ID NO: 107126 - DNA, 715 bp, Oryza sativa
aatttaatttcggttttccttgggaaaaggacaaaaaatcaccccctacagcctcccaccaaaatagtgaacagtgggatacaattacactaggtagtggggggtatttatactgtgcaacaaatatctgtaatggccctaaaacaatcaaccgtgacgggcatacaagtaatctctatcgagtcttaataaaaggcctaaaaaaagagtgtcatctgtgacgggcaccaaacttatctcaatcgggcctcaactatagcccgtcatagataagtgtcatccgtgacgggctttagttttatgcctatataccatgactgtgcgaccatatctcaatcgggcgaaacttcggcccaattaagattacttccttgtgacggcccgcaaattccagtcttgttatgggccgtcacagatggaaggatctgtactagtgtatatgtccgtcctcctccattatggtttttgccttttctcctacactgcttcttctccagatccggttatgaggaagtggttggtccatgatggcaacggtgcatacagtaacgacagatcatatagagatgatgaaacgcagccagtactttttctcccgttattttattcacatatgatggttgataaattcttattttatttcaaggattgtcgatatctaagatagttcacaacttctaaaccattagagcaatggcggagccaaggcccggct

SEQ ID NO: 107127 - DNA, 1638 bp, Oryza sativa
ctcatgtcagataaatcgtgcttacaggttgcaagctacacctctctattatttcctctattttaatatgggtgagtcctatgattatttctataggtgttttataccctgtaacaaattttcctaattgttatgattgatgtgtgtcccacctctctagtatcgcatatgaactatacgctatggatgcatttactagtcctatgcaagcagtgactatactaaatgtcagtaacaattccaaaacaactatagtttttttttcccaactacgtaagcgatatcacctagtgaaggctgtgtagatttagtcaatgaacgcatgcatttaccagatctagtagtatcgactatagatccggtccttgtttatgttatctgattgattcctagcttaattgcttgcagacgcactactaaaacaagcgtgtttattggatctagctagctagtacctgtatagttgtgttgatagtgatattcttggtaagagtgcttctcgtgcattggcatgttgaaaagttataggtgaaatggatatctgagacacagctataagtatactgatcaggatgggcaagtaccccagatcctgcattttgtacttacccttctaaaatttattcctttttccccgcaaacaaaaaaaaattattccttccactttacttttgtactcaccggacataaggatataaagttccataaattttttaaggccataagaagactgaatactgaggtggataagagaggagaggagtgagagaagaagcggatggcacgattacagccggcttaggcacaagaccaaaaaaatatgtgagagagacatattgaccatatattaatagttaagagctaaccagttagctaagaggtagactgtaaagatctatatagtaaacagctggttatattattagccttgcactaaggttctaaggttctaagcacaaactccaaagtgtctatgcttaaatgatgttgtggaggagagaagacaagaaagagagaagcagccacccctcgtataaggggaaccctccacacaaactacaagaacaaaagaaaatgagaggggctgattggtggcaagtgtattgagactagtgtataagttagttttattttttggatagatgacgtggataaaattggaggtgtgaccaccacctctattataaaacttgccctaagagttagagggtgtgaccagaaaagattgacgtggcaccaataagaattctctcgacactgtggtggaactaatcatcattaattaaacatcctaggtaatgtgctaatcagccattacttgtttcaatcacggccataatactccctcgaacatatttcttttattactaagatcaaataagaattaactagaaccaagagataattaatattaaaatggctcattggatatcagtcgacaattaatttagtatgtagagactataaatatgatcatttgtttttaaaataacaaaaaaatgaaaatacttcacatttttaaatggagggagtaattaacaagttccacgtacgtcctagactcatccaaaagtcagaccatcgtatgccaaatggggccgagctcgaattcgcccatagtaatcggtactcaccgcg

SEQ ID NO: 107128 - DNA, 5279 bp, Oryza sativa
atagatgacgtggataaaattggaggtgtgaccaccacctctattataaaacttgccctaagagttagagggtgtgaccagaaaagattgacgtggcaccaataagaattctctcgacactgtggtggaactaatcatcattaattaaacatcctaggtaatgtgctaatcagccattacttgtttcaatcacggccataatactccctcgaacatatttcttttattactaagatcaaataagaattaactagaaccaagagataattaatattaaaatggctcattggatatcagtcgacaattaatttagtatgtagagactataaatatgatcatttgtttttaaaataacaaaaaaatgaaaatacttcacatttttaaatggagggagtaattaacaagttccacgtacgtcctagactcatccaaaagtcagaccatcgtatgccaaatataggcttatgtattggcttaaataaatcagaagatctagctagcttaaattacatgggaaaccggacacaattaatttatagctgctgagattaaattacatgagaaaattttcctcccaaagccaacctcatttactagcattcatggctggtgcatgttactcacacatgtaatttagtgatagggctaattaggctaagctatagatagctcctttttgcaattgcatcctgtgtataaattttcgtaccactgcggcttaccttgtcaattactaacacatagtcatcgatctcgtcttcttctctctctagctacctagctatcttcctcaagctttgcaagcttgacacgcagaagcatatggctcccggcgctgcttcccctaaggcggccaccgtcgccgccgccgccgccgtcttcgccgcgctggtcgtcctgtcctcctccctcgtcgcgccggcggcggcgaagatgttctgcagcaactgcgacgacatctgcaacgcctcgtgcgtcaactccgacaccatcgccaagctgtgcgccccgcagtgcgacggctgctcgccggaggcttgccagagctgcctccaggcgctgaagcaggagtgcttgacgggctgcagcgactactgccacaaaaactgcacttaacaacgtatggagtaacgagaccctgcgtgccagcagccttgtgtattgctacaggttgtaatgttaggattctgtttaataaaaatgaaagtgtttttttttaatttttcagaaacttattgagatttgaggaaatgtaataggaggtagcataagtttgcaatatctttgaacttcggcgctagtgctacctttactggaacagtgaggaactcaaataaaggagtaaatatagtgcaaccggttttccattcctataataacaaggaatggacgtgtagacggagttataaaaccaagaattaattacatgcatgtgtatttaatcacatcgttccaataaaaccggacagtgatccactacatgtcaatgatatgcacacccctaatgttgcacttgaagcattggctcaattcgtcgagacggcttcatttctttctttggttcgtactccgtaaaatctattagggcagtcccaaccctccacctaggatggtgtctatggcattaaatacattgctatgtaggatttttagcttatgtggcactatattaattaagagagagaagagaggaagaaactgggtctcatgcaagacacagcttcaacacgagaagctatgcactagacactgtcaagttttgcattgggagataatagtgtcttcataatagatgaaaaataaatatgattggtagagaagagcgatgatgtatttattaatggcccactttaagaaactatgggttgtagagtgtagtttatattatgatgtcttattgacatggtaccatagacactacttatggacactatgggttgggagactgaccttagggtctgtttggtacagctccaactcctaaatttagctctaagagttgggtctggagtggagttgtggagctgcctaaacccagctccacaactctagttcattttgtgagagagctccacccagctccactcccaattttggtggagctgaaactgtttggttgagctccaacttcagaaggggtggagctgaagctggagctgtgccaaacatacccttagtgttggttcttaaatgtaccagcactgatggccctccctcataaatgcccaaagtttttttttaatttcaatttagggaacctgcactgatgtggcttcccatgtagcactaaaggcatttttgggagcaccgtaggaaaagtccccatagtaaaagttatattaataaaccaaaaataatatctacaacagggttaactaatctaaaagaatttgtctatcatctaatgagaggcgaaaaagaagaaggtaaaggtcttttttaaagaaagacctccaagaactgatctaaaggcttcttctatctttagttactgatgtgtgattaatgattgggtacttctatctgtaatggatcacgcataatggtgaactgttatagggtaattaatgaatcattaacgtttaagaaccataagttcctgctccctctgcatccgaaaaataatactatatttaccttttgatatatattcatatatgtgtcacaaggagtatctttttagatgcagggtccatattaggcctcttaacatcacttcatgtttttttcagattttagccatccaaccaataaatagtactcccttctcctccttattttttctctgtatttattaatggaggatatgatagtctgttgacatatttcttgatatgcctttgattttctaaaacaacagcttttttgggatgagggatcgagtagcctaaacaagccgtgaccaaattaatgtcactagatctggtaattggatgcgtgcattgactagatctggtccttgtttatcttatctaattgattcccaattaaattgcatacaaacgaactaaattaacaagtgtgtttattggatccaactacactggtggagaaatcgtttttagtcccggttcgtaaccctcctatagtcccggtttttaaaccgggactatgaatccgggactaaagatccctatctttagtccccgttcaaatacctaggactaccaaccgggactaaagatgggagtggggcaatagtttttttttcatttatttactatttaatctctaatttattttctcccaaattaggtgggatgcatattcctaaatcaaaccctaaaatcaaagtaccatcccaaatacacaaatcaatcaatcatatacactacagattatacaccccaaatcaaagaatcatcccaaatacacaaataatgtacatctcatatctatataatgagattccaaaaaagaaattatgcatctcaatccatacaatgaataacagattcttcatctcattctatacatggatcgcaaattcttttaaaaaaaaaaaaaaaaaaaggaagcaatgttgccagccggttgagccggctgccggctctccggcccccaacgcacggccctccgcgccggccgccgccgcgctgccatccgccggccgggccgcccaccccctcctgctgcgcacacgggatcgagttgggaaggggagttgggaagggataagaaggaaaagagataagaggaagggaagaagggatgagataggcttagagatggagggagagaggagtttgtgtgaatgagaaaagagtagatgagaaaagaggataagtaatagggattatatagtgcgttttgatctttacttccggttcgtaactccaaccgggactaaagatcctagaggagcctgacaacacttgacagcatgtgaaccgggactaaagatcacgtagtcccgttctacttataaactaggactaaaaaccttctttagtcccggtttttactgcaaccgagactattgtggtttttgatcgaccgggcaaagatggtttctccactagtgctagtaggacctgtcttgcaagtttttagggttttaccaataaattatttggataattacattattagatagctttggataatcttggagctaggcttgtttagagccttttgtttttaatttctactatctccttgttggcttgttaggtggtgacattggtttgcagatatgtcggatgaatgaagatgatagccgataatttggtcatctacttttgcgcgtattggagtttgttagcttattggttgcattcttctgcttacatgttctgcactcaaatatgtgctgcctctttgttatatttttatacttcacattttagataagcttaattagaatcaaacaattagaaccatgtctatcaataacttttaaaacttttagtttgaaaacactagaacacacgacgtttgagtagtcttaaagaatacttttacaaaattagatgtttactacttttattaattacaacagaatatcatagtcaaatatatattttggtgatgatgtcattgtccaaaacattgaaaatcgtggaactggagggagtagatcttgtgtttctatttcttgtagtagcagcggtttgatctctcctattattattgatatttctttacataatatcatcacaatagcgagacttggtttaagctatttttaatacggtgttgactgaaaattgttgttttttttatcagttctctgtaggtttcggcgaacccgcacggggcgatttttatttcttaaacgaaaatcagcatcatcataccttctcttgcttcgaatgcatggggaactgagcacgcgcaatttatcagtaggttagattagattctttcctttcaaagccaacaattagcattcatggtcatgtaatttactgattagggatagctagctactccttccatccctcaaagtaatttcagccagggttggaaattatagaacgaaatcggtcatttcggacccctccgatacgatattatttcggcagaatttttttatttttttattttttttcatgaattttggtaatatttgttcaaattcaactaaactttattcaaaattacggaaatttcagcatttcggcgaggtctgatcaaatcggctaaaccaaaatttccaaacctgattttagcctataacttttacgttaagtatatattgataacaaagacaatttagaaatttgccatgaaatgaaaaataaaattttagtagtttcatgctttaatttctaact

SEQ ID NO: 107129 - DNA, 1401 bp, Oryza sativa
  unsure (1)..(1401): unsure at all n locations
ccaaataggtttgataacaaatgaacaatcctataacatgagcatgaaactattcatgatatattctcttatagtagaggaattataatataatggtcataagtgataattgatgaatgtaatgacataaaccatagtggcataactacaagtgcacctcaacaaattagttattataaataattttgggaaataaatacaattttagaattagtaaaggtgtctcatgcaattatggacaataggtgatgaaaacaaacaagatgctaaaatatagatctttgtcaaaatataaaaaatgatataatactctgaacattgtcacggtcacgtgtttgtttagctatatatatttttagtgatcaacttcactcatttctaaagatgacattgtatttgtaccataaaaattaagtagttttgattaacaccataaacaaaattgtgtctaaacaaaacataaagaaactatattttatgggaagaaccgaataactatttgcatcatatccatcttctctttgtttccctagagggcaacgagcatagataccacaactatagcatggggcacacatatggttgacttgatgcaggctcaatggaggccacattgataatagtgctcaacttcctacttactggtgcaatcgtctttaagggtgtcgacagtgaactaggattaattaaaattgtgctccacaatggtcatgagactgtgagaggcacgactatatcgacctatgcttgaaggaatcttgatggttcccccattagaggggcatgtctattttttaacggtgctatcctaataactaataaccaatagaagcgttagttttagaatacttatccgtagatttagaaataagtgttcgcataaacatttaggtacatagttgaaataaagttttatgtattaatgatgtattagacttattttggtggtttagatggagttccatttattaaaatcatatctatcttttaagaacaatgataataagtaatggtgataataggagagtttacacttacctggacaaaagtgaattttgattaaatctaagagacattcttatcatttatattaaagtctacggtctatttcacaacataattttttattactacgaggcaaaatctataatttgttatatgtatatggtgagatataacttaattctcttagcattatttatataaacaataaataaaatgcccgtgcatctgcgcgggcttcttttcttgttatttataaattgtggatatttttccttacaaactaaactctctcgagttgatttatttcgagacggagggacttaagcagtattggattaagggtaccgagctcgaattcggcatataacagtnggtaatcagcngttttctactcat

SEQ ID NO: 107130 - DNA, 717 bp, Oryza sativa
cttcctatactattagacggtagcaatgatagatgttttcctcgcttgatctcattcctcgtcatccttcacaattgcgacaccgccatcaaccaccacaatatataggatgactcggcattagttagaaattaaagcatgaaactactaaaattttatttttcatttcatggcaaatttctaaattgtctttgttatcaatatatacttaacgtaaaagttataggctaaaatcaggtttggaaattttggtttagccgatttgatcagacctcgccgaaatgctgaaatttccgtaattttgaataaagtttagttgaatttgaacaaatattaccaaaattcatgaaaaaaaataaaaaaataaaaaaattctgccgaaataatatcgtatcggaggggtccgaaatgaccgatttcgttctataatttccaaccctggctgaaattactttgagggatggaaggagtagctagctatccctaatcagtaaattacatgaccatgaatgctaattgttggctttgaaaggaaagaatctaatctaacctactgataaattgcgcgtgctcagttccccatgcattcgaagcaagagaaggtatgatgatgctgattttcgtttaagaaataaaaatcgccccgtgcgggttcgccgaaacctacaaagaactgataaaaaaaacaccatttttaagcaacaccgtattaaaaat

SEQ ID NO: 107131 - DNA, 1217 bp, Oryza sativa
acacatctcattatctcttgcggttgcggatggctaattttacggtcgctcgtgggctcccatcgctcactgcccgatccgcgcatgacgtttgtgactgtgatgactcaggggaggcgaggaaagaaggggactggggaaagaggaatgaagggtaagttttcagatggaatgcacgagtttcacagtgaatttacatggaagatatcggccgcgtctgagatagctgaaattgatgcaataatctgtttcttttatagcaacctgaggtataaatgaatcaataactactataaagttgagaaaagttactttgcaaaaaatatttcgaaagaattactataatgcatcattttttttgcgaggataatgcatcgtttttgggtatataaactttttttttgcacaaaatgcataatttaaggcataggaaaggatacaaacaaaaaaaatcaaaattacgcgaaatgagcgtaactttacttattagattcgttctagtggaactaaccggatgagttctggagttgatatgagtgttcgtatttatggctaattattcttttagtggtaggcgacctttagtcgacacggaggcgtcatggtgagtggtgacttcgtaaatctcaagatatacaaacgcagacttctggagatgctcatagtgatatgtgtgcgtgtgtgtgcatgcattcataggagtgagtgtgcggttgtgcgcgtgttgtgagcatctgcgtttgtaccgtgtttcttaagaaaactacaataggaaatccaaagttattcttattcatctcaagcggttatttattttcggatctcgggatggttattaccatgtcatttcaaactagccctaggcaccatctgtaaatttctatttttagcaagtttactattgcctgtaaatttgaacaaatattggctaattttttaaacataaaaataataattttcatatttttttagacaagttttaaattttaggaatatatgtttaaatacatagcctcagtagcaccataggtaatgggttcgacttcccatggagtgaattttgcaagatttaacggctttgtgctttcagtggtaggcgacgtacccgtcgacagcgaggtgcctgggtgatgtcaatctccaggatggatttaccggcccagtcttcgaagatgctcataggggtagtgtttgcgtgcgtatgttcataagggtga

SEQ ID NO: 107132 - DNA, 683 bp, Oryza sativa
ttggacagtaccctaataaatcttatagatctcaatgtccaaattagattaaattcaagaaaaacctattaattttttatttacacgtaagacaaaccacattcacatacgcacgaatgcactttctaacacatactcgataaatctctaacctcattaaattaattttctgttaaaagcataatatgcatactatttgtgtacaccaacatttgaaccatagtgaccaccacaccataagtgaccttccaaaatttcatgtctaaactatagtataccgggagtgtttgacaggagagaaaaagtaaacattgagaagatacgaagggagccattagcacataattaattaggtattaactattttaaattttcaagatggattaatatgatttattaaaataactttcctatagaaattgttttaaaaaacacaccttttaatagtttaaaaagtatgagcgcagaaaactagacaaatcttctctatttcacctgctgctgaacacggaaaatgagaaaaattgtagtttattaatgaccagagcaatacgtacttgtgaaaagcactaaaagtccatgtttagatcccatctcaaaactttacaccttgttctatcaaacatttgaactgtatgaagtattaaatgtgggctaaaaaataactaattatacagattgca

SEQ ID NO: 107133 - DNA, 700 bp, Oryza sativa
tccttttctttacggataacagggttaactaaccaaaaacctttgctgttcatcaccagttacggatcgtaacaactatcaccatcaccccgatcactccgataactgatacccagtgccgcgagtagaatgacaatgaagcgagtctagaggtaccggcaagttctcctgtgaaaagaagtggaactaaacaagctagtgtttttaatatgaaaggaacgcgggtcatacccgtacaagttcagaaagaaatcctgggaaaagacgagcagataaaagttctcttgcccgtaaaaaaggcttaaatgagtgttttttatttgagttacagggcttttcaacgattaaaaagctctctatgacggcggctaagtcgaggagtaggcacacaagagtgctttttttgggggctcaacctgtataggtactgggtaaagctagctctattgggcgccgcacttacttattgtaaaacatgcgccagaatgcccaagcctgaaaactatatatgataatatggtttttaacaaacttgcctctctttatattctaaagaattgtcagccctttgccatgttacttcttacgcgggaattatgggcaaaagttagcccggaataactaaagatctttgtttgcgggaaagggagggatttggtggaattcacaagcaagagtactccactgaaaaagcacaaat

SEQ ID NO: 107134 - DNA, 696 bp, Oryza sativa
aacatgagttgctctcaaaggacttgacttctgaaatctctattctacgtttttcaactaatccacacgagaaaatcctatctttcaagctttctctcactaacttcgccaattgtccttcgctccagatggtcaatgtcttcagactagccatcagcccttggcttctgtacccttcaaacgcaaataaataaaaataaagaatttcagcacgcgcatccgttttcttgctcgaaaaaatgattcaatctgactttatcggtattctggattgagtaaaaaagggatatatgaagttcaaggccttgccaaaaccgtcatggccctattatgtataggccgtactaagccaatagtgaataacaaactctttcctgctccctcgaccctaattaactcccatcctgccaagcctcagctgccagcgcattgtatctaagcacactgcggcaaattgatacaagtagctaaagatctcgcattcgacatccccggccgaacggttaggcaacactagggcgcctgggtcccaattcccgttaccaaacaagatgtcgagaggcgaactctgtaattcccccccagcaaaagtgatagcagctgtagcatccgtgtggaagagggtaagcttttcggcacacctttttcaagatggaaaggatgaatactcgtgttgggtcctgcagaccaagatag

SEQ ID NO: 107135 - DNA, 702 bp, Oryza sativa
attatgctcgcaaaaaaaatgatgcattataggaatcctttcgaaatattttttgcaagagaacttttctcaactttatagaaggtattgattcatttatacctcagggtgctataaaagaaacagattattgcatcaatgtcagctatctcagacgcggccgatatcttccatgtaaattcactgtgaaactcgtgcattccatctgaaaacttacccttcattcctctttccccagtccccttctttcctcgcctcccctgagtcatcacaggcacaaacgtcatgcgcggatcgggcagtgagcgatgggagcccacgagcgaccgtcaaattagccatccgcaaccgcaagagataatgagatgtgttgatgatcaggtaccggtcctaattggcttaaccaatcaatctatatgactgtagcccgcctggatccggctgatccgaattttgctgatactttttccggaagattttccagctcccaagagaaatcctaccgaataaacgcatttctgtagcatcgtcgcccgtatcaattcggcgagggattacaggcacctgtaagcaaaaaccctacctttcctcaacaggttggataccatcgggagaaatttcgctgcgtttcaaaggtcctttcgtctcctttatattacccggcgataagaaaccccgcttaattctataacgttacgggag

SEQ ID NO: 107136 - DNA, 1064 bp, Oryza sativa
aaatgtagcatatggtctgaacttataggtcctttcctataaacttttccttacactaactatacctctttctgcttcttcaagtaggtggcgtggacggtgtgtcccttgcctattcttaagtggctttgttgggattcggtttatgtgtttttctaagaattggtatgttgcactcgtgttctgtaaagtgtgctaaagtggtatgtatgtgccttatgttctgtgcattgcgggctttaattgtgtgatagtttgtttctcggacagataactagtaaacagctttaaaaagatggaaacataggttgtttgtaactataaaagacagtacattatcagcagcattaggtaataatgtgtctctagtactaaatcacgcgtaccagcatgtacagatatatgctcaattggttgttataagtaccttcaaaacaaaagatgatcgaaatgccaaattgatcatagtagcaaacaaaagagattagggtcagaggagatagcaaacatggagattaatgcttcttcaggttctaattgcttttctgttgcactattgcttaactcctcctgtggatcttcctcatcctcaccaacctcttcttcttaacccaatagcatgtttagtttgattttacactaatgcaagctctgccaatttgtttttataatcagcgatatatcttcgataaagtgctaagaaaagaacaagtaaactattgcatggtcttgtgaagctgtctttcgggtccaacttaactatattggtaggtctgactatctgtctttacctgctatcgatgtaaaactgccctatgtggcagctctggtcctccctttacattaccagtaggtaatttgtctagtgcctgtaccctttcttttgatagaggagtcagtgtaagccaatgcttaggtcttcacctccagccaatcagaatctgaagtcagcggggtattccaatatagctacttctaaggaggttccctagcactcagaaaccctgggggccaggcagtgaatcgttccgcagaaagatcacccggccacacctcggagccga

SEQ ID NO: 107137 - DNA, 674 bp, Oryza sativa
aacaatcaggaataggactaggagaatgaagtctaaataacggagtaaagcagtaattgggcttagtgctccaattggccttaggactaggacgaaaagcaaggcgccctctagtctcgttcgctgggtggtcagagtacagcttcgccttctcctcgggcggcaacttgaaaaactccattccaatccccaacactttcctcagcatctcctctgttatccccttacgatatatgcacattagaaaaaaaagttggaaaaaaagcatgttatctctcatttttcatcggtaagatacttgtacataacagactagcagtaccataagcagtaggcttttggactgagctacaagtcacagtattttgagtaaaatagggtaataccccataccagcatgaagccatttacaaaaagcccataatttggtatcatgccggcaccagagtcatacataaaggtctgtcttctccttctgctcgaaagagtctaatgctacatcctttcactcatgtagattgtccagcattttatttgacaaaactccttatgatctgaggaagacgaaagttatgaagctgccaagcaagatattgatggaatctcgacaacgggttcttatgtatgatgtgtccattaagtctcaaaatatcaacacggaatgtacacagagt

SEQ ID NO: 107138 - DNA, 700 bp, Oryza sativa
cggctgcggaattcaccgcgccacaaaaggggggctgccccgtgccctgctgggacgggggcgaaccataaggtgtggtgcgatcggtaaaagggggttatacgaagggtcctgtcacggcctctttccggtatgtcgtggtggcatgtcggcgcacggaaccgtgtcgtgggcctgtgtcttgtgggtacagttgtacacctctgatcagagtaaaactattcgaatagccgtgcccgcggttatgggcggtcgaccagattcaccgtgattagtttcaccctagttagcttttggaactgattagtttaggtggtggtttgggcctgttgcaacgtggtgtaacgttggacagtgattggttaatatggattaattactacaactgttttactgctttcaactactgttttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatat

SEQ ID NO: 107139 - DNA, 711 bp, Oryza sativa
  unsure (1)..(711): unsure at all n locations
aacctcgttagaagtagctatattgaattaccccgctgactccagattctgattggctgnaggtgaagacctaagcattggcttacactgactcctctatcaaaagaaagggtacaggcactagcaaaattacctactggtaatgtaaaaggaggaccagagctgccacatagggcagttttacatcgatagcaggtaaagacagatagtcagccctaccaatatagttaagttggacccgaaagacagcttcacaagaccatgcaatagttaacttgttcttttcttagcactttatcgaagatatatcgctgattataaaaacaaattggcagagcttgcattagtgtaaaatcaaactaaacatgctattgggttaaaaaaaagaggttggtgaggatgaggaagatccacaggaggagttaagcaatagtgcaacagaaaagcaattagaacctgaagaagcattaatctccatgtttgctatctcctctgaccctaatctcttttgtttgctactatgatcaatttggcatttcgatcatcttttgttttgaaggtacttataacaaccaattgagcatatatctgtacatgctggtacgcgtgatttagtactagagacacattattacctaatgctgctgataatgtactgtcttttatagttacaaacaacctatgtttccatctttttaaagtttactagtt

SEQ ID NO: 107140 - DNA, 801 bp, Oryza sativa
tgaagcgattcaccgggacacccgggcggaccaaactccatcacgccaaccctcgcgtgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccatgtagtgtattttaattagccaacaccattgcggtggcactaatccaaagctattgccaataatcaagtctatgctttaatgtggtccccttttgtgcactagttgaactaagcatggctaagcatctcctaaaccaacatctagtcattttaatacccaagttatcaatggcataagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgcgaaaccacgaatcgacgaaacgggcgaaatctacgcgacaaacaaagcacacaagcaaaacatgctataagactactgaaacaggaagcaaaaccatttttaatggattctacacatttttatgaatttactgagacttgaatgggattaatcggagctcggatgaattagttatgaattttagaagattcactgtgtttattactataaaagaaaaacccttaatcaatttattgcgcaataatt

SEQ ID NO: 107141 - DNA, 666 bp, Oryza sativa
atttaatgaaattttatcttgccccattttatattggaatttattaattaaaactagatcttctcttcaagacttttaaaattatttctaaaaattccatttaaacaacaatttatatattttgaaattttcagggtgtgacacctactcaaggcccactacgggtagcgagcaattaacaaatagagacaaggatgaggagaaatgacgcatatacgaccggcctgggtcactcatgatgttggtagttcaagtgaattgtcgtagtgtaaggaagattgattggttttctgattgctacttggctggcataagaaagaaggcgccccggcaggaattctgtaagcttgacttgcgcgcagcgtttgggaatcaaagataaaaaataactctatgggacttacggaactggaaaaaaggtagcacctaggcgtaagaaagaaagtaaatagagacagcacctactacgctatctattgaagcttactatataatatataaaagaaaaaaaaaggccatataagtgagatcctagccagagaagagcaacaggagctataaaaaaagaacttatggacttgaatcagagattgggttgacatccgaaacagagaggaaaagagggaacatacatagctagctcacgaaagaaagcttgcaactact

SEQ ID NO: 107142 - DNA, 716 bp, Oryza sativa
ctctctagtgatgtcttcagatcaggcagttgtctatgccgctttgcatcattgtcagataagggcttgtccgtatctccgtatgttgtcattcagagatctctcttatttatgtttgattggatatggggcacccgacaccagatacattgatatatacaacattcgtttcatactataagccgttttgactttttttttaagtcaaccttatttagctttggccaaattttataaaaaaaatataataatttttcaacataaaacaaagaagctattaaaatatatttaatggtagatttaataaaactaatttaatgttataaatgttactgtatttttctataaacctagtaaaacttcttaacttagttaatttttttaaaaaaatcaaaacgacttataatattaaacagagggagtagacgagtagtgtatattgataagtgatgagtccagcctacctgaataattcttttgagttaatatggaatgaattatgtaggaggtatccatttggacaccacttcagagttcaagttgatgtcaagtgctccattaagcacactgatgtagtcccttttctgtagtaagaaaaaggcaataagctagataaccttccattgcaattgtaatgctactcatagctaatgctgtagggacactttgatggtccaccaaatcagaaatattacaatgacaaaccttgtctgtat

SEQ ID NO: 107143 - DNA, 687 bp, Oryza sativa
atgatattgcatattttcatgaggttaaatatttaattattgctagtgggtgatgatgtagaatggttgtatgttaagctttggattgagtgggttgtaactttatgaaaaagctttggagtgagtgggttgtaactttatgaaaagtatagatttatcttcttggtatttatggcagaatcagatcatattgttacaatcacaaatttaaaatatcaccaatttccaccttttggttttgatcgtgttgtgaacatgtagtttacagtcatgcacacgtctcctggagcatacaaatgtttgcattgtcactatatggagatgtagcattaagaaattccaacaattcatgtacaaattctgacgggcgaacacttcagacttcggagcgagacaaaagaaagactattaatcagagtttgaaggaatctcttatgagaaccccctaatcctttttccatagtagttattgcaacggatacggaaataaaagagtttatgttgtgttgttttgagatatcgacttaaaaagaaacttatctcaaactatcgatatgtggaagagtgcattgttatcgatgtgaattggtttttaaagtagttaagatatactatttagaagacactgagcaataattgctataaagagtcagatcaatgtgttcgatgttggattatcaagcctac

SEQ ID NO: 107144 - DNA, 677 bp, Oryza sativa
ttgaacaaagtggcgtaggactgcaatatccctcagattcagaccagcatctcaatctaggaaatgacaacacatgaaagaaaattcatcttgaaccagagtgctaaatcagctagtatttcatatgcacgccccttcagaaaacatcaagttgatgactctcaaatttattaatgggtaggctggtagcaacctcagcctgcatctggcttcagttggtgggcacgccaaatgtgccaattcacagtacatcgcaatcaagcaaatcgctgcctcaagcatagcgcaggagcaggttcagtaaacccgggcgcttacctcatttctcccaacttcctccttccaatgatcggcgccccattcgccaacccgcgatgctccagagcacatcatcacgtcgaggtcagtgtactcacgaatcacctcgaattgctacagcacaaatgcagagcaaccagctcccgatcagaacacatcgtccacactccatttgttcacatgttgatgaaaaaaaaaaagaaaaagcaacctgatggacgaggtgcacggtgggcgcgaggaacaccacgatcccgcgcggggccttcccggcgcgcacccggcgtgcgtgctcgcgcgcgagcatgacggcgaccatggtctttcccgaccccgtgtcgagcaccgcgatggtgttc

SEQ ID NO: 107145 - DNA, 751 bp, Oryza sativa
ttttccttgggaatgagaagcaatgttatatagcgttgttgggaccaatttgtggtgttcagctcagattatgagcggtgacttactgttgcgttaattagtgctattatttgtatacaactgcagaaaatgagaatttctgctttatagattccctatgaactcttgtgggcttcaaaagttgatatcagctgccgtttaatttgctgatcaacacattgcagcatttatagttcctagtggcggtgaagattcatatcagattttgttaactcctgtttagcttcagtagccgatggctagctcatactttatctgaagaaatttcttgtttagatatacgcagcagcagtacgagttgtgtttataatttttgttctcattttactctgcttttatcttgatctgatgataaacatgcctgcttacgttttgctctgatacaaaatgttgtgagattagtctttctcttctcatgtgaaatgttattaagctgataagttcttgcacacaaaactgttgaacctttcatatcgatatataaccaaaattggtcacaaaactgttagtaatcagttcatcataattggtcacctgaaagctgtttatgcagcagaagttacatggctctttaatgtctcagcataatctggtacttcctccatttcataatgtaagtcattctagcattgtccacattcatatagatattaataaatccaaacatatatgtgtctagattcattaacat

SEQ ID NO: 107146 - DNA, 647 bp, Oryza sativa
  unsure (1)..(647): unsure at all n locations
attggttatatagcatcaaaagtttacgttttcgattttatagcaccaaaagataccggttcactttaatagcactcaaagttcaccccgttcctatttttaacacttctgtcaatttccgatcgtttttccgtccacctcgatcgctattgacccagccacgcatgcgatatgacgtttctacccctcacaagtacaagtagaattcatggcatatgaggggtagaaacgtcataccacgtcttcggcgaccgcggcgaccggagcaggagtgccttggggtccaacagcgacgttgggctcctcaacgccggttccccgccatccgccaccccgcgcttcgcagccagcccaacaaacacaaccttggcacggcgaacagcgtcgcgccaccgncggcttgaacccttcccaccttcccgctggcggcgccgtccggatcgaacaccatcctccgcagcatcggcggcaatctaacaaactcacaaaaacgacactttcactttgacatgtgggacccacgtgggtcccacgctaactcagccactacgtaggataaaaccgggtcaaaactacttaaggatctattgtgaccagttttaattgggtggatttagttacacgtaaaattaaaaatttgggtgaaa

SEQ ID NO: 107147 - DNA, 694 bp, Oryza sativa
tggtcgagaaaatttgctaaagaagggtaggtaaattcaatctcatctggaaagacataatgcttttgctgaattgggtcaattattacaagggatggcattctcgatccaccagttaaagtttgcagaagcctataaccaccatcagagaagaagagtgaacccgcaaaatgttcatcaggtatacttggagtttcctgctctgtataatatgtgttatcgcccacaaggctactggaagagcttaatgctgcatgcacaggatatttgctatcactttcttctgatccttcatctagaataaataggttatcctcataaatggcatcctcaattcttcgagattcttgacccaggactgaaaacacagcatcttgctgatttgctgatcctgacttctgttggttaaaattcacatttgtcccatcgggttccaaaatgtctaaagcttctctaactgtttcctcatctttgtgtttgtgtaatatatgaccaacttcattgctggaatgcacatcagtggagacttcttcctgaagatcagcacttgttttgaagcctcagtttatgttcttgttctcccatttttgtatcactacagtcaagatcttctttattgatctacaagaaatttttaggagcattgctactgtgcacatcaacaaaaatatctttctgcagatcaagggcttac

SEQ ID NO: 107148 - DNA, 631 bp, Oryza sativa
tatgcaattatcttgatgacataatgttgtattatatagaaatgacatgtcctggatgcattctatgagtttcttctttctttctgtaatgacctatccagtgacctttcgagttgcatgctatatgtgtagatggatattgatgcaagtggtatcgctacctttcctgcaagtagatcatcggctattctatttattgatagattgtcagattcttcaaaagtcagagatgaaagcaaactatccctcaaactactaagggaatatgtgcagaaaaattatccatctcatttcagtactggtggtctaactagtggtaaatccagaatgagctctaaagctgttccttccctagttagcacaggtagatctgcccatactgaacgaactaggctgaatgattgggcctccaaattaatggaaattggggagaaaatgtcagtaatggtggtcaatgatggagaaagtatttcgtacagaagtgatagccaaggtagtaccgataatccattatatgatattctaacaaaactgatacacaaaacaagaccagcacataggtcaaagaaaacaaagataagttttgttgcaaaagatgttgccataaagaagctgtctgatgattctgaag

SEQ ID NO: 107149 - DNA, 545 bp, Oryza sativa
caatggcatgcgttagcctaattcagtagctgtaattaagtccgataggtactaacatagcaaggatctaagaaattgaaccccaaagttacagaacttcagctactttgaacaaagtggcgtaggactgcaatatccctcagattcagaccagcatctcaatctaggaaatgacaacacatgaaagaaaattcatcttgaaccagagtgctaaatcagctagtatttcatatgcacgccccttcagaaaacatcaagttgatgactctcaaatttattaatgggtaggctggtagcaacctcagcctgcatctggcttcagttggtgggcacgccaaatgtgccaattcacagtacatcgcaatcaagcaaatcgctgcctcaagcatagcgcaggagcaggttcagtaaacccgggcgcttacctcatttctcccaacttcctccttccaatgatcggcgccccattcgccaacccgcgatgctccagagcacatcatcacgtcgaggtcagtgtactcacgaatcacctcgaattgctacag

SEQ ID NO: 107150 - DNA, 844 bp, Oryza sativa
  unsure (1)..(844): unsure at all n locations
caaccagcccgcagcaaacgacacatgtcggcngcgnatccccccgaacatnntgaagcatgaaatnaatgagaacgagacacctnnngttnctccccncncccccccagagcgcnatgaaatgaatgacaacagcagnnagaaacacaaacaaaagcaaggcggcgcacgaggagaaccccagagacccccgggatnggccggagaaagaaagtacagaaagatattaaagaaggggcgaggaagaaatgaggggggggggaacaaaaaaaacgagacgcgaaaggaacaatacaaagggcagcggccaaaacgacgcgactgggaaaaccacgccagaaacgaaaacaggccgacaagagaaaaaaacgagcacagcaggcagaggcagaaagggaagggaaccaccaacagccattcaaaacagaagcgaaaaaggaaagggaaaaagacacgcccgaaatggactgagaaagaaagaggaaaggagaggaaaccgaacaaatgaacaaaacgagaaaacaaaccaaaaaacgccgggagccccacatgaggacacttctaaccacgccacaccagaagggcacccccggacagctggaaattgtgggcccaaaagaaggatgcgcaatagggacattaaagcaccccagaaacaataaaacctagatcaggatgaaaaggaccaaacgaggccaatcaacccgaaaaaaaagggaaaaaaacggggacaaggaaggcaaggaaaagaacaacggaaacaagggggaaaagaaaaaaaaaccgaacacaaccccgaacaaatataagggaggagagaaggaagcagaggaaaaagaaacat

SEQ ID NO: 107151 - DNA, 567 bp, Oryza sativa
cctcccatgtgtacagaccatttatatataatctgataattaatcataatgggcatacatgctcgatggtgggtttactctcgcaggtggccgtagccgcagaagcagcccatccaatccagattagtaattaacagcgacgcagcgagaacaactatctgtgtacgggacaaggagctatctagcgctgacgaaacaatgaactgactagtagtaatgacgtgcagattaaatacgcccatgcatgtgaggtggttgttcataacgctgcttgccttcatgtatcatgattctgatagtgatgatagcttaatgcttattttaatttggaaatatatatatgtggcactacagctcagtgagagtgaacgatttagatgttatgtacagctagggggacacaagcaaaatgtgcatgaattagggtgtttttttaaaaaaaaatgcgaagaattaagcgtgcattttgacagaagaatctgaactgctcgtgatatcaattaagtgggtggtgaaaaggacttgggttaaattaacctgtgaggatgtcgtggaaactaccataca

SEQ ID NO: 107152 - DNA, 733 bp, Oryza sativa
ctaaactaatatggtaaggtggaggggagaagaaaagagagagtgggagttacaacttaacttacatggataaaattaggggtggcatttgcctcttctataaaacttgctcatagacagaaatttttgttaggctcttcaaccaaccgaaattaatttggttataattcggttagcactctcgattaattgacattaggaaatagacctaattatgtatcttgatcggtgttaagttgtaagttaaatctagtcaaaagccatgtgtgttgctgcggcactataggatgaacatatggaaaaatattaattatgcttcacaacactcaatattgtacactaaatgaaaaaacatactccgtaccaaagaaacaaaattgattgtggataacaaatctgcgatctatataacccatgttcttcgggagggctagctgattcttgtcctttcatatatccttttcatatccacatcattacagattaaacaaaaaattccctgtcaaagtttagtgcattagccattaatgcggtaaaaggcaaactaccataataatatcgttgaccgttgtaaacatgtaagaatggttgaaaaatatagtaaattcaaaattaaaatgaattgcatgggacagacccaaatgttcgtaccaaaatgtaaacctacttgatagagtgtgttgcacttaagcaaaatgagtaaccgcacaaaataaaatcaagcaaccaattt

SEQ ID NO: 107153 - DNA, 687 bp, Oryza sativa
cagccttaagtggtgctcgaccccatatcttcttttcttgcctcgcacgggaacatatgaacaatttgtatgataaaagcatgttagcaaaattttgtaataatatcgtgattatattgttttagcttaacacacataaaaaatggatctttgggagaggacctactcaaaattgtgctaattggtcattgacacaatccccatattcttattctcaagagtaaataggcacacctatcacaaaactactggctaagcattttttacataaaaccctaccgttgggggcatgttgtatcctacaacccatatttctttgctctcctcctgccaccggttacatgacctcattccctatttccacaatgaggatgcacttctctgtgctctccgcatcgtcgctaggcgtgaagtattggcgccaacctagcatatttcctgtcatttctctgccctagcccaacagcgcagtacgtgatttaatcgatgcctaatgaatgatcaaggagacctatatgaagggagaagagaagcctgttctgaacttcgcagcaggtaataattcttttcccccacttatttaatgcagatttggctatcttaacaaaccataattgtctatatggatgatggatttgaaatttcccctctaattgcaagtactatgctataaaagtacttattatt

SEQ ID NO: 107154 - DNA, 742 bp, Oryza sativa
caatgcaaacaaactcattgtttataatcatgaatgtatttatttattacatgattgctgcaaactcccgattacacaatgataagtagcgaactgaaaaccacaaacatggctactcattctgattctgaagaggtatagctggcattgttctagtgactgcatccttgattggttctgtgatgatgtgataggactgcatattgctatcattcacaggagaagcttccttctgattgctattcgaagcagagaacggtcttctgcttggtatcgccctcctgagattgattgccctttgctcggcctggagtaggtcggggagagacacaacttcttccatcgatgacaattctttgctgaggctgtcggtgcagagaatggttggtgctgaaggtattattgctatgatttattgcagagtcaggtgcagcaggaggagcattggtgctgtggatgatatcgtcgatgttgctgttggagctaactagctgatgagacaatcgtagggttgttcgttggatttctgcggtcttggtcaacaacacactgagttggcaatccttgggcacatggtttgtaccttcgcacagaaaacatgtgaccttgcgggtgggacattcacctggtggatggtcttccccacaatgagggcagagtgtgagacacatgctagcaatgtgtccaatttctccacaacggttgcatgcttttgattccatctctgatgaactatgtacca

SEQ ID NO: 107155 - DNA, 589 bp, Oryza sativa
tttaaatgtgcctttcacgtgctattgtaccagctggcatactgcctgtcacaaaatagaagtcctattggatcactattgagccttttgatgcaattaaatctcttgcatcctactctgcaggattgtggacagccagaattcaccctgtcagagaggcggcgcttcggcaatatattgtcccagtacgtgaaagctgatacatttctacattggcaacttttcttatactatcttttgaaacttgatgtcaaaaacatattagcactacatgaattaatttcatttttataacgttttagaccataaaagatgatatgttctgatccaacccatcttgttaaaatggatttaaatctgtaatgtagtttacagtgcactggcaaccattatggatttgagtcaaaaatatataatatattggctactagctagtagtcatcacagatatggttcatgctctcgttgaatatgtctcacactcaccttgagctaactttagagaatcttcagtgatagttttattcacatcctcatcctacctaagccatcccttaagatctggctatgagagtgatgaactacttgc

SEQ ID NO: 107156 - DNA, 2381 bp, Oryza sativa
gtggctcgctgatcaaaggggatttttctctcttccaccatgggcagaaaagagggagctcggattagggtttcttgttggagctttggatgcggaatgctaggacggatggagggcgcttgtgcgtagcaagatttgggagagatttggtattggattgagtggaaaaggtcaaacctagcttcgacggcgacaggtggtgaacaaaagcgcaaaagttttcaaggaagacaaagcagtggagaagacgacaggtggtgaacaaaggcgctgttacgcattttatttgcaatgcagttggtttagtgctatgcacttgattttataaagtcacgtatacatgttttgtttttcttggactagtatcattggcttaatgctatacagtatatggcattttggttatttaattggcggttggtacttggtaacaccacatatgccgtatttttcgtaatatatgaaatcactcggatgtttaatttcttattcttgactttacgttttgttgctttcaactaatcatgtattcagggctacacctaattaggtgtatctattagttagttttcattattctcatttttttcagataagagctccacatcctcttgcaagcatcatgatgacgggataggagaaaaagcactcggaagattacaatgagaatattggagcacttggctttttattgaacaagcttgggataatatttttttttcgattgtaaaggtctcggggctgttgtggagattatgagtatcccatacccactcggtctgcttatccgactagagataggaggtgggccggatctatgtattatttaataggttaggacttgggaattatattgccttgtttcttactgcatggccatagttcttattagatacaattatgtaaacataaaaagaaaccgatgccatgtctgtctaactcttcctcttcgtaactttgctcccaacctatataagatgaacaagaagcacgactaaatcgtcagatcaatacaacacctgacggattcaatcctcaagcaggagtagggcattacttctcatcgagaaagcttgaacctgtctaaacctcgttccctttactcatcctcttttatagaactcatgcgctactctttttcttattggcgatttctataatcgataattcttttagtagtaggttacttacgttgacattgaggtaccagtgatgacttaatcgatctcaagatatactagtctggaggtgtttataggagtaggatgatgtgtgtgtacgttcataaaatggtgagtcaaacattatatataggccgtgtttagatgagactaaaacttaagtccctatcacatcggatgtttggacactaataataaatattaaatgtagactattaataaaacctatttataatcttggactaattcgcgagactaatctattgaggctaattaatccataattagcctatgtgatgctacagtaaacattctctaattatggattagttaggcttaaaaagtttgtctcgcgaattagtttttattttgtaagaagtctatatttaataattctaaattagtgtctaaacacagagactaaagttaagtccctggatccaaacaccaccataatcgtactcccgtaacataactctaaagataaacaaataaagtaggtgtttagttctctacataaataaaccataagtttgaactggaactcgacaagacaataatccaaacattatctaaaattgtattgtaatatcctgtaataatatataagttcaaaaaacaacctatcacaaaaggtaaataaggcaacaaaccaaaacttagtaaaacaaaggttgtgttttagatccaggtatgaaaatctttgtcatgtcacatcgaatatacggacacgcattcgaagtattaaacacagtctaataataaaacaaattatggatttcgcatggaactgcgagacgaatttattaagcttaattaatccgtcattagtaaatatttacggtagcaccatattgtcaaatcatggagcaattatacttaaaagattcgtctcgcaatttatacgcaatcagtgtaattaattttttttctatatttaatactttatgcatgtgatgtgataggatgaaaaaacttgccagggatataaacaggcctaaacatcgaaaaaaccaatatctatcaacgctaaaaaaaacttcctgtagaagttaaatattgacaaaatttagcatcaaaaccgtagagacaaaacgacagaagttatagggttggtttggtttggggcctaaatatgccttaccaaattttgtcaatgccaaattttggcaagactaattttggtaaggcaaagggctg

SEQ ID NO: 107157 - DNA, 637 bp, Oryza sativa
aatagttactccctccgttttaaaaaaggacaaactctgatttccgtgcgccaacgtgtacaccgttcgggttatttaaaaaaattatgtgagaatactaaaccgaccggtctcgaataacatattaatcatattttagtacctaacagcaatgaaaattcgaattatgaaaaaattttatctacgacggtcaggttaaattgtacacgggagctgagggtttgttttttttctttaagagggggggtccctcatagagaaatatccagtgtgaaaccacatctatcaagtctaaatcttgaaaagcggacctccgaaacctctaggttgataaaagatacacggcgatagtttatataggcatgaattgcattaccacttaatgtctaatacgaaactaaacttcttttttcttacgaaaaataattttcaaggtaatggtgctaatatttccccttccaaagtataacaccctgttaacttaggagcaattttacagacaccgcgtagcattaaaagaccgcaatttttagcgcaacttagtttttttttctaatcacgttgaagataccaggagatacctttttgttagataataaggcaccttcaatgcctactatgaggaccgtaagatcgc

SEQ ID NO: 107158 - DNA, 706 bp, Oryza sativa
  unsure (1)..(706): unsure at all n locations
ccgagaactgaaaccngtgatatcanccangcnanagnnancaaacgnaactgggtaatgtcacatctctccaaaatacattatattatgagtcggagggattacaaatgctttatatttccatatcagcactaacaacccaatgcttggatcgctacaggagtcaacttccaacccacccacttgagttcaactccccaccattcccccttttgttggtgatttttgcctaaatatctagttatttcgagcattcgagttaaatgggccttcttccggcttatttaaacaattcagatgtctaggccagtccgaccaagaccaatttatcacggttcagtaatcaatgccaactatgctcagtagtaatcaatgccaactcgtctctctcctatctctgtcgtcaataacaagagtattaatttactggaaaagctacaaatctatcaacagttttttctctaaatatatttcgatttctagtccattgatcttgtgttaagatccgtgctagttgtatggagaaatagaaacacagcaaccacaagtgtggggattcgatcccaagaccatgatcacacacatcacttcttaacaaagtgagcaatcagacagtttatagaattaaaactagagtgaattcactttggactaggtttaagtacatatgttacaaagtataccaggcataagtaagccttcctag

SEQ ID NO: 107159 - DNA, 684 bp, Oryza sativa
  unsure (1)..(684): unsure at all n locations
cggcccatgaatgacagatccacagnaccncancaatactactgagtcgagtttgaggtattccctttatgtttgtaccttaaaatggaaaaggggcgtggtgccttttttcgggagctgtaacaccacttggtgcacaaaccaaaccaaccttgtatacccattttaatatccctatcataagggtaatcatgtgaattcccctataactaaaccctagagggtatgagcctatactaggactataaatagccccctaggccatgtaatggggtgatcctaaaatatttttaccaatcaatatattgttttactattgcaacaattcatcgagtttaccatatccttcgacgtgaaacagaagtcattcgacaatagtatccttgaaccacaacaccaaatatcttgacccttcaactattaaaaccgatgcaaaccgactacctttgtttctagagggcagtgtccatgacgatgcctctacatggcaccattgactttgtctataacgtggactggtctgttaaatggtgtcagagtttagatcatatctgtgggatccatgtatcgtccacacacaaaggacaaactagtataaccctacagttcggacttacatgtgcttctagcaaaaccccttgcctctctagcgaaaatatgcaagagtctctcccatttttattt

SEQ ID NO: 107160 - DNA, 691 bp, Oryza sativa
  unsure (1)..(691): unsure at all n locations
cacgtccnatgacatgccactcgcacaggagcncatcaaaggtggggtccataaggtaaaaaaaatcggcactcctcaattccttcacgcgagttctggatcgatccccaatttctttcgttgtttccaccgacgctgccaacccctccgtccccacctatccatgcggcaatccactcccctcacccaaaaattgatgtcgcaaacccctccgcccctctactaacaccggattcctctcccgccacccaatgccgcaatcccctctatatctgccacccgatgccgcattcgctccacccccaccatcgacgctgcaaacccttccttctctgcaactaggcgatgctatcccttcatccgacgccattatctccgttacccgactataggtaaactgtggggattggggaaattatgattgggagaaagtttggggagccttggtttaacaagttcatgaaacttctcttggagggatccatcccagctagcaaagattcacagaaatgtgtttgtgttgaaaagaaatcttgagccatccctgttttttttttgttaaggatgaagatggcaagaagcacataccatgcaacggttggctgggggaggagcaacgacaacttgcagttttaaatttgttgtcaaaaacactgtgcacatgccatttntttttccttcgctactggag

SEQ ID NO: 107161 - DNA, 2497 bp, Oryza sativa
ccccccccccccccgagggggtcaggcctcgtgggcgattgctcctgcccaagcctctagtcatgatactcccggtcccatgtcaccgacaagtggagccaggatcaagttagttatgatgcatagaaatattttttacataaaaattatgatgcacataattttttacatgtttttttcccattatttttgttgtttaacgtcatttttgtaaaagttactatcagctacgtacccatcgccactcttgacgtacataatatagtctttaaacccgttttaaaaatttaattctaactatgaaccgacatatatacttatcaagtacataactagaattaagctcttttttagacggaggatgtataatgcaactcgggcgcttgcgatcacccgaggtatcttttgagttaggggcttagggccaggaagaggccaaaacaaagcagaatccatacagttcgttaattagccttcagcaattaaaggcgctaggtatacattgaaggctgccaaggaccaaaagttaataccacaattagagcaaagaacccccaaaattagctggtgctttataattaagtttgttggagctaagctcttaactaaatgctttcattagcagatcgatctattgtaggcagatatatttactttccatttcaaaatataataagtttattatatatctaaacaatatgcatggatatatatctagatacttaaatacataactaaaagttaaatttagaacgacggtagtaataataaggcctataacaacccaaacactccctaacgtccccttaaaatacataaaataattttgatgagtactacatccgttctaaattaatgaccgcttttttttcttgtaacgtcattttatttaaaaagttaatgtaaatataaaaaaataagttatacttaaagtatttttttaataataaagtaagtcaatcaaaataataataatttcataattttttaaataagacgaatgattaaacattacaaacaaaaactcgacaagtattttaggacagaggaaacaaaaactcgacaagtattttaggacagagatagtaccatcaataatggtcaaagtataagctagaaagggtgcgtgtgcattattttcaaccagaaattcctatgcaattaattagctgccagtacgcccgtacattatccactgattgctcgtctgtgcgctataataaattttctggtagaaccgtatattctcccatcgtttaccctgcacgtcataagacgctactaaaatttaaaattcaaaagttgattttaagttttttatcatagttatttttcacattaatttttaaatcactaaaagtacatataaaatactatattttttctgataagccgtacagcctaaaatcagaattatctaaccgataaaccttcatcatctgcctttttttaaataaaaatagatctaacattgtagttaattttaacaaataaaagcatggtctggttaaattggtatgaagtgcatatactcctttcatcccaaattataatgtagtatctagatgggatatattctaatattacgaatctaaacaagaaccaaattataagaatctagtactggatgggtagaaagcctgtcttaggacgtgtcccatctagtaatattcttatattttggaacagagagagtattaaattggtgattgaaatttttgaaaaatttctcatcccttacatcacaattcaatggttcgcatcactcttacatgacttattaagaacaagagaaatttgtataaactacctcataagtcatctgaagtttatattttaccatgtaagttgtttgtttgtaaatatccaccccctacttagggcccttttgaatcgtaggattgagaaaacgtagaaataggaaaaatgtaggattttgataggaatgtaagtgtaaaacagatgattgcaaaacacaggaaaaacacatgaatggccgtttgattgaaccgcaggaaaaacgcatgaattggatgagagagatacactcaaaggaaagttaccaagagattgaagctcttactaaatttcctccaaaatctctataggattgttcattctataggaattttaaaggaatggattggattcaatcctttatttcaaagggcttcataggaaattatcctataggtttgaaatcctctaaaattcctatgtttttcctccaattcaaatgggcctttagttttgtttgaagaaccaccgtaatacgcatgtgcttaaccggatcgatatgtttttataaattgtgagctgttaatgtggtatttgccaaaattaaatagagtgaaagtgcaccagctgtccctaaacttgtgtgggtgtgtcatttaggtccccaaactctcaaaatgtatttttaggtccccgaacctcgtctagttgtcttgatgtcatataggtccatccgatgacgtggcatgccacggtggcg

SEQ ID NO: 107162 - DNA, 5071 bp, Oryza sativa
tattttctcctctctacctccgcgtcgagctccgccgcctccgctcaccgctcacgctgcggtcctccgctcgccgcgggcgaagcacctgcgccagtcacgtagaggtagtgaggagaaaatatggtttttaattttatttttatacatatgactgaaatgtggggtccccaccgacacgtaggtgccaccgtggcatgtcatgtcatcggatggatctatatgacacccaagacaagtttaggaacccaaaaatacattttgagagttcagggacctagatgacacatccggacaaatttagggaccgctggtacacttcactcaattaaatacttctagtagtgtagtatcaacactttttttttaggttccacaaattgaattatgggtgagagcttaaacgttgtcacaatgagttacgcttatgcacaagtattcaatgaaatataaatgataagtttaatgcaaacacttgatcaagattgactcgtctagcttagcttgtggtgtctctacattagtgaaaacggactgactcggttaagcacgtgcgcactatggtgcaaaacaaaattgagtaggggtgagcatttgtaacaaagtgacttatgagatataatttcaaattttaagtgatttatggggtggtttttacaattcttcctaaaaaaatccccttttttaaaaaagaagtttgaataataaattactccaacctaagcttgaaatacatataaaattcataaaagatatacaaaattacataaataagtattcaaacttagataaaataaaataaaaccatattcaatgaaaaaattatagttaaaatgaactgaaattgcatattgcatagcaccacagttttctaaacttagcaacgtgtaattctaattttgaagcacctgaaatatttttttaaaaaaaaagacaattatagaaacattttggtttcgttttaatgaaatgtaggtgctaattaatgtttcacataaagctagcacatcaacacggttatcctgttgatctataaagctagcacagcaattgtaaggctgtgattaattgggtttagcaatgcgcagttggctggtggtcaccatattttagctgcaagcaacaattaattaagggcacgtttaggacatggaaaaaaatcctataaaaactgaacctttttccttagaaaaatgtataaaattccaatgatacaagtgtacccttacatttggcatggccaaacctgagatttccttcccaagactgatttacgtagcttcttattcttactctcaatcttgttcttactctcgatcacttaagtcggtcttacgcaaatacataggccccttcccttttgccgagttgtttagaaggcgctttctattctacggtcctttggagcgaagggttagggaggtagtacgagccttctgacttccagctatgtgctgtgtgcgattcccgcgaagcgaatgaagggaagctcttcgagctttctccgcctgcggcttatggtgccgctgttttgagcatagcgaaagtagcagaatcctttttttaagaaaagaaaaaaacagggcgaaatcatcttaagaagaccattattgttttactattaattgggctattgcaacctaattcagtacatgtagctgaattttctacagggaatctggtagatccaatctaccactcatgtggtgaattaattaagaaaagagccaaaatatatgtagtgccatcacaatcatcattcatcaactctgtccacgtacgatctaaattttagtccagttgctttgctgtctcatgttaaatgcagtactaccaaaaatccaaatgatgatgaagtatgccggccctaattaattatcacacgatggaaaacagataccaaccatcaaacatacatgcacatttaaacagtttttttaaaaaaaatgtgagaaagaaatttatttaatgtggctcctaattggatgcaggataataattttcttttattagataatggatgaaatccggcctttactttaatagtttagaagctacatctaattattacataattgttggcttaaagcaaaaaagcagctaccgtaagatgaaatggaagacaaataactactctgtcgtggagcctaaaagctacttcctccgattccataactcttaatgttttgaacaatgacacgttatccaaaatatatctttgactatatttttttattataatatatataataaataaatatatttttactttattatgttggtttgtaagataaatcaatatatgttgttttagtgcctttaaacaaaatatttttaaagtcatcagtagtcgaagttataaagatttgacctcaaacttatcaaacacgtcaagaattatgaaaccgaagagaagagttcactgctagagaatgcatctatactcctggttcgcaaccccctttaatcccgggtatgcagccggtatagctgattgcttgagcgagactgaacggtctctcgcttttccattctgcgagaccgcgcggtctcgcactttcaccgcgcgatatcgcctgcgacgtcattttcacgttatttttgcgcaacggttgtgcgataccgacggtatatttctataaaaaatttgcatcccgaatattcctgagaaaaaaatagaatgaacaatatattttcaaattttattcgagggccatcatccgctcgtcccctttctacctgtgagtgctacaattatggacataaattttctacagtaactgttctctctattaaaaaaaatgtgcaatagcttatgaaacgaccttgagctcaaatattatgccttgatcatcaatttatacaatgttgtttgtcacacccttgctctatgaaggatctctaaggcctagttcttttcttcaaatccaaacttcaacttactctttctcgtttgcatgcttttcaaactgttaaataatacgttattttttaaaaaaaatctatatagaagttgtataaaaaagttcaaataaatttatttttcaagtttataattattaatacataattaatcatgtgctaataagatttcttgttttacatatgttaaaaatttctctcttttgaagttgatcgagcgcagcctaaggaggagaaggtagcccaccaatgaaaacgggttgtgtggggatagctttcgtttgagggggaacagatccgtttccctgacatgtaaaatgaagttgtggataagtgcatgattaattaaatattatctataaaaaactaaaaaaataaattaatatgaatttttaaagcaactttttatagattttttttaaaaaatatattgtaacagattgaaaggtgtgctcacggaacacaagagtatgagattggaaaattgactatccaactcagcctaaagaaaatctagaatattttgatgaccatgttctcctatttatgagaatgcttggtatcatcctttgttatatgcaaatcaaatatcccatcttaaatctgaaaacaaactcaaattatcccttggataattttgggaatggtttcaccactattacaattgttgtggttggctccaatagtctcaagtgaaacggcgataacatgaatagacacactttatgaatgcagatagcaatggacactaatatgcatgctattgcttgagtcacctccatttttttttcttggggagtcatctgcatatcagacgctacgctgacaaactacatatataaccactctagaggtttatttgaattggctttctattatagaaacaaaacagtcaattggttgaagagttaaatagtataaccccattgcaaatcaatgtttacatataaatatataactcccagtgaatttgtttaccgtttatttatactatatccgtcctacagtatagtatatagatgattctggcttgttttgaaaaaaagttatgaaggaaggagaaagactataacattctcattaaatgagagacatgaggataatactgggaagatggttagaagtaatattgggagatttaaatgagagttgattgattgaataattaataatctctcatataatgtgacagagtagtataaaggatggtggtttgctagtagaaagtctatatcaagcatggtgctagtatgacttctgaagagcacgtactccatccatctcaaaataaatcaacttctatcttctttctagtgagttcccaactcacctccctcgtgttacacgtgtacgttttttaaactgctaaatggtgcgtttttttacaaaaaaattatatacgaaagttgttttaaaaatcatattaatccattttttattaaaaattaataaatacttaattaatcataagaaaatgtgacgcttcgttttgcatgcgcgggagggtcagttcccaaactcaccgaacacagcctaaaggttttgtggtctttcgttcctctctttaaattcttttttgatgctagtgtaagttatttttgacatagtgagtatgatatattgctatatacacaagtgtatataagcgttgatgtgcacgggtgtaaacagccaaaatttttccgaacgtattttcacaaaactaatatagaaataataacataattatgtattgttactatttctaaagtttgattttcttaatttctgtcagcctcgtataaaatctgacatcgcattaaaattgacactaaatagtgaaaattataaatatggaaatttcccaactgttcattaaaaaaatgatgatatctatgttttatattataagtcgtttgatttttttcttattcaaagttaccgagtttataaaaaaattagcagcatctacaacacaaaattagtttcattacatttaacattgaataaattttgataatacatttgttttgtattaaaaacattagtaggtatcttatataaacttagttaaacttaaaaaaaatttaaaaaataaacgatttataatataaaacggagggattaccatattttactccaacgtgacaagcatgcacaagcttgagta

SEQ ID NO: 107163 - DNA, 672 bp, Oryza sativa
actgaccaagaagggttggtaacaacagcttaattaacctgaccaggagatagaggctaaaagagaaaaaaccaaaaaccaaagagctaagctaaatctaatgcactgagtggagacaagtgggtctccaacgggtgggtcttccagggagtcacagagtcacagagagtttgagctcaggggctactcctgagcagggcttaaattccagctgtttgctgtgtgaccataggcaagtcgcccaccctctctgagcctcattctgctcatcggagatcctgctgttcaccctgtgataatacagtgtaaagctagcagcctgcaacctggaaaagggcccactccagaatctgaccatgctgccaccttaatgtgggacttgcagcctctagaactgggagaaataaatctttgttcttttagacacccagtctgcggcatgtgtgatagcagcccaggcggactaagacagtgctcttatttggataggggtctttgcagatgtaattaagttaaggatctcaggatgagatcaacctggattaggacgggcccaaaccaaatgacaagcgtccttagaagagaagagaaggggaggagacacatccaggcggaaggctatgtgaggacggatgcagaggttggagtgatgaatctacaagccaaggaatg

SEQ ID NO: 107164 - DNA, 606 bp, Oryza sativa
ggccgcttaattaagacggatccccgactacgtagtcgggattcgcggccgcgtcgacgtcgacgcggcggtttctcagtagcttgaggaatagcctatgtgtgtgaaaggaacaaggtcaaaagtcaacacaaagccttcaatgctttaggaaagatgaataaagttagctcaataagatcagaatagatatgaaactaaagtttgttttccagtctttcacaaggcctatgggattctcttctggatacctggagttctggagtatgaatttgtaatttcaggaaataagggaaaaaattgttctgaaatgtataggttggaacattgtttcctgttcccaagctgagtaaatggtcctgtaaaaactctaacttaatgcaatcctgttggtatacccagggttaagagagacaagtgactccgaacgttttcagtacaaaagcaaacaacagatggtgggcagggactatccaaatctgttgggcatacaaaaaaaatctcacaataaggaaattctcttctccctctgccttgttgttacctcaactctaccaacttccagaaagtattcattcgtcgacgcggccgcgaattcttggcctc

SEQ ID NO: 107165 - DNA, 560 bp, Oryza sativa
ccccaaataatgatatcctgtaatctagacaccacgtctaaactaccagatactactctaatatcatcgtcatgacatagagtaattgcatacacaaacattatacctgcaccaaagcatctcccagataagctagcagtatattcagtataacatgaacataatataaagtaggcattcatatactcggaaagtatttcaataccataaatgtataaagaagagtattctaataaaagtacaaagcttacaaaagaggaaaggaaagctactagagtcatacccgaactcttccgaaggcttccggactcctgatttctactctattcttattccactagctagatactactaaactaaacttgagagaatatgagagagctattgcttgaggtgtgtgagtgaagtgagaagagcaactccttttatagcctcccaatgacgattgtgatggttggaatggtcagaaataccctccaaccgtcattgggggataatccacaccgtccaggcgaagccctggatcagatggcgctgatgagggttcggcctaaccccct

SEQ ID NO: 107166 - DNA, 739 bp, Oryza sativa
catgcaataaatcacaaattctaaaaaaaaaaattcacaaagacgccggccggccgctgccgcctcctttccacgcgggccggccaccgttgcgccgccgcgccgacccgctctcgctctcgctcgatctggatagagataaggcagcgctctcgctcgatctatcaaaaagaaagagataaggcaggaaagaggaagagagttagagaggaaaaaaagagatagagagagtttgttgtgtggacgatataagaggataagtaatagggattatatagtacgtgttagatttttattcctggttggtaacaccaaccgggaataaagattatctagtcctgttgttcttataaattgggactaaaaatcgtttttactcccgatttttaatggaaccgggactactgtggatttgggtcgaccgagcaaagatggtttctccaccagtgtatgttagtactaccttcttttttttttggcatatatgctccaatgtaatctgccggttcatcaaattgcatttgcctctgactgtccaactttatccttgttcttgttgtctcgtctaggtgcgccctgcgacaatgttcgtgattgtacgtgtgccattcgtcgttgagccatagcgcaatgtatcgcaactcgcaagttgcaacgtatttggcccgcgtaggagtgcttgaacccatgcttcccaaagtcattacacatttttctctatgagagagagaaaaaggat

SEQ ID NO: 107167 - DNA, 1001 bp, Oryza sativa
ataactttgtcggatgaaaaaataaccaaaataaaagttatagatcttgatgatttatacaactttgttattgatgaattttttagttgaaatcaattattatttgaaaatgctgtttgaagttgttataatttgaaattcaaattcaaactgttcaaacaaagtcatatagaaaaatgaccaaaacaaaagttatagatcttgataagttatacaactttgttgttcacaacttttccatttcaaatcatttattgcttcaaactattatttgaatttcttatattttaaaattcaaattttatatagctcaatcaaacttggatggagaaatgatcaaaagaaaattggtagacctcaatgatctctacaactttgtttttgacaacttttcacatgagttcatttattaccacaaaattagatttaatgttcatttttatctaaaaagtctgatttgcctcctctccctctctaccacttcaaaatttcagcaaccttatctccaaccttatcttctctccaccattatttctcctcaaccccccctctctctctctctcacacacacacacagcaaggtcgcggcgggcgtcggcgacaccgaggaggcacgcggtggcggtggccgagggcggcgcggcgtgaggcgggcggtgggggcgaacgaatctggcaccgtgcggcggcaggctagggtttgggatattttagatttttattttttttgtttgctgaatttattttcacatgcggccggtataagcaaccgcatgcgaaaataggattttcgcatgcggttgggccggccgcatgcgaaaagggtgatttttgcagacccttctcccccatgcggttgccccaaccgcatacaaagatgccttttgcccgtatgcaaaaagcctttctgtactagtgtatttagaaccagatggagctagcacaaggtagtaagggtgtgtttagttcacgctaaaattaaaagtttgattgaaattaga

SEQ ID NO: 107168 - DNA, 837 bp, Oryza sativa
cgggagagggggcaaacggaagaggagaacaaggggaagctttatatggcattggatcgaagagatcgaactccaaacgagaggaatcgattcgggaagaaatcaaactcggttttagggataaaatcaaaacgaattcgattcggagagaatactcaacgattcgttttgattcttgggggaaaagaaagaggagaacgagaggaacaaaacccctaaatcaatcggactcgaggagaccggattggagcggatttggagggggaaaacggcggctcgggcggcttgcgcgacggcggccggaggttgaagacggccctgacatgtgggccccacatgtcagcggctggaggaggagggggcgggcggctcggcttgggccggcatgggccggttcggccgcgcggagagagagagagtattgggccgaattcggcccaatgaccaaagaaggggttttttgaacttttttaaataaaacaatttgtgaaatgttgtttcaattattaaaaatacttcccttgctcaaataattcccagaaaattctagaaaatagaggagcaagcatagtatttaataaaattttatctagctcatttttatgatgaaaattttcctagaaaattagggtttagcttgtaggcttttaaaatagtttctaaaaatgatttaaaatatgcatttttaatttagtcgatttttagggcgtgacaaacctaccccccttaaacagaatctcgtcctcgagattcagaagaactggcgaacagatgaggatgagctgacttcaattcatcttctctttcccaagtagcttcttcttctgaatgattgat

SEQ ID NO: 107169 - DNA, 679 bp, Oryza sativa
ttttaaaatagaacatgattatcattggtttttttctttttagaagtttcagacctttaaaaattggacttgtagttcaattttttataattttaaaaagtctcgtcaaacaatgccattatgctcctctacggcccgtccgccgcctattctttattgtcattgtgattctaaaaatctaacataactatcattggaattcatttttcattttgtggaagtcccgtcaactgtcagcggctctgcaactatactcctatacaccccgcccgctgcttctcctttttattgtcattgagattttaaaaatcaaatatgattatcaatggggtttacattctagaagtcccagcaaccgccttactcgtttgcttcacggcctgcctaacgtccctccttttaatcgtcattaggattctatttggtgttttattaacaatttttatatgtcgtatcaaccgccaccactctactcttttataggcctattacttaatttatctcgtcatgtgttttagatggtcttttctttcaatattctctatttttatcacaagttttagttatttataaattgtattcataattgaaatcttatttttctttttctaatttcagaatttttttaaaaaattttagttaatacgtttttctaatgtttttattttttattttcaat

SEQ ID NO: 107170 - DNA, 520 bp, Oryza sativa
tatataacttatcagccttatcagcctaatccatagttctttttaattttcaaagttggagtataacacaatcgcatgtctatggctaaaattattcaaattaagaaggaaacatggaaaggcaaggtcagagaaattagactaggggatgtggtaatccgaacaacaacctatggtcctatcactagtacagaatatgtcataggtgccggtttgcaagtgtctataggtgctggattttcacccggcaccaattagttggcaccagtagcaaaacccggcacctatacaaaaatagaaccagcacctataagttcacacgagccaaaaaaaaaaaaaggggaagagccggctcgaatcgagccgagctcaccaactgcgttctcacgccctgccccacatggccacatcgattgctcccgacaaattcatccacaaattcacaaaaaaatcattcacaaccatacaaccatactccacaaattcacaaaaattcatccacaaccatacaaccatactc

SEQ ID NO: 107171 - DNA, 506 bp, Oryza sativa
tttttccttctttcttaatgtacactatttgagttttttatttgcaagctattttcctcttgttaggtcagtatttgatgcattggctcacgagctaaatgatcaagctcgagctttgcaacgagtcgagccgagctgggtatttagctcgtgataataactacttaacgagtcgagctaagccaactcgttaattatcttaacgatttagatcgagttgagctgactcgctatccaccctacgcgcggcacagccatgtggcgcgcgaggagaccctggcggcgggagggcgcgtggtaaggtgacatgtggcggttttttctcgcttttcttttttttctaggtttttcttttttcctttttttgttttctaatatttatatatatagcacatatacaaactttgtataagtagcgttcttttggttttttaatacgtacgtatccaaattttatatacgcacataataatgcatatattttttttacacattgaaattttacc

SEQ ID NO: 107172 - DNA, 522 bp, Oryza sativa
gaaaaaaaacatttcaagatataacttaattgggcagtaagcactcatacattccttactgatttgccatgtaacctagctagggtaatcactggtttgtctcataatttagctggggcaatcactcgttcgtttggcagagcccgagcactggcccatgatgtccaggccttggctcgggcactgcaatccccctatctctaacttgggaagcacgtgtatgttccactgaaaggaaaaagtacaccgaagggccctcaacttatcatcgagtcataaaattgtcccccaaccacaaaaccagatatctgacgtcttttaacaatcaaaaccgggcacaatagatccttcggtgaatttgactcgggttttgttctacgtgacgggtgagtcagcgtgagacccggatgtcagccttttattccttcctctctcctgccctttccacgagcgacaggcgtgcacgggaggaggctgggcaggcagctgggtggcgtcgccaggggggggggggggggggcc

SEQ ID NO: 107173 - DNA, 545 bp, Oryza sativa
aatattttgtaacgaataattggttttgtaaatgatttatttgatgaaattggattgtgaatatgcgtggatgttggtgtgagtgcgtataacttgttgacgtcaccaccacaccgaggcaactcaccagaactccagattcaaccgatggtgccacctccacagccaccatttgaaccgcggtgatgggagaaagaagaacccgtcaccaccgtccttgcgcccatgggaacttcggcgacattctcgggtgaaagaaacataaagcaggagccaagaagtcaaagagttgatgcggcaattaccactactagttgtttcattacatttctgccaaaccatcagtagttctacagtacactaaatgatttattgtgtttacaggttcttatattctcattcctcacaacaaatacatccaaaatagagaacaacactcaatatacaaaaacctacaaatgacacaacgaagacaatcaagatagatctactgatcatctagcgaatgttgtgcttaacacggccttattatcaaggctgtaaat

SEQ ID NO: 107174 - DNA, 676 bp, Oryza sativa
ttgaggatttggtgatatcttttgtgctgtgatctgtgttgattgatttggggttgatttgtggatggagtgaaatcattattcgatgttaaaaacaataaaaaaaggaaaaaagaaacctgccgcctggctacatctttagtcccagttggtaaggattcattttaactcccggttattttaaccggcatctttagtcccggattgggcatcctggtttgaaactcaggagtaaaaagagttacaaaccggaagagcctttccccggtagtggaagttctaaaattaaaagtatggtacagcttacaaattaacaagcaaccatggcaattaatttcatgcaatatactaaatttaaataattttccataacacttctttgctaaaataacatgtaggtttacgaaaattgctaaccacgcacaggaaaagttaagggcaaaactatcatgccactaggtttagaaaactatcattttactaggttgatatataaaactaaccgaaatgtcaaataaaggataaaagctgggaatgaggagcattagatcagggagaaccaattttacgtgagcaaatgagggaatcaatcactttcgagagcaaattgagagttttctttaaaaataattaagtagattattgaagtagtatggttccaactgatatataattg

SEQ ID NO: 107175 - DNA, 507 bp, Oryza sativa
ccatttgattagtaattaattacttgattaacaattaaataataatagttagtgattaattatccagattagtgattaattaattattaattaatcgctaatcaggataattaatcgctaattaaatcggctaggaatggtttcgctctttgcttgtgcgatagcgctgattgcttgagcgagaccgcgcggtctcgcactttcactgtatgataccggccacgatgtcattttcacgtcattctcgtgcaatggttgtgcgagaccgatggtatatttgtacaaaagattttgcatcctgaatatttctaacaaaaaaattgaatgaaaaatatatttttaaatttaataggaatttgtacctgtgatattttatttttcgtaaaatgttcccttacattattcccatgttttatataatttcaaattttgttacagcatcacaggttataaaattttcaaaatgcttgggaacttccaaattagtttctaatgacacacaaatcg

SEQ ID NO: 107176 - DNA, 537 bp, Oryza sativa
cccattcaacttgcaaaattcatctaattttgagctctacatgtttgtttagtttttatgtactgtttccttagtttttattagagtttttcctcgttttgcgtgccagcgtgtagtttccgtcgtttcggaggtccgcggtcgcgaggaaaagagttcggaagatcaaagtgaagaagcaaggcaagtcgcacattcccccttgagcatgttgatcctaatttataaatgttttaccgtttgcaaataaatatgcatgttttgctaattacatgggatcagggtttacctatctgctcgcttgtgccatgtttacttgatatctatcctttgtcaaccttgggtgataaatcgactagctcatgttacttatgtgacctagctagaactatatgcttagccatgcttaattaccactagctcagtcgatgggataattgcagtattagacattctagtatcttgttgagccgcgtgctcgagacatctggccatgttttatggtcgtaattatccaactaaaatgcgactgaatgg

SEQ ID NO: 107177 - DNA, 501 bp, Oryza sativa
cttctcaagatacccgtgggaacatggtgaaaaagcttgagaggggatcaacagtagcttgcaccaagttctatcaagaaaacaataagtccaacaacaagattaagggacaaattcaaagttggatcaaaactcccattacttgcttcatgtctaagaaagtgggacactatgccttgatgtgtttcaacaagattgatgaccaagccacacttccaaagaggagaacaagaagagcaataggaagtgctatggatacaatgagaagggtcatgaagttgcatcatgcccccacatgaaagatgactctgtgtcatcaaagaagaagcttaatagcaaggtagcaagtaagatgcaatatgtggtgaagaagacaccatgtaaagacaagaatcgactttgctacaattaccgtgcaaagggacatattggtaaaaattgtcctctgagtaacatttctaaactaaactcctcatttgattatgatttgcttaggaaggc

SEQ ID NO: 107178 - DNA, 684 bp, Oryza sativa
ccctaaaatacccaaacaaatgaagggtctgatttagtttctactacactactacacccagtaataaaatgtactgtaaaaggcccccagaaaaaacaaccaagaggtctgcctgatgaaaagttctctttaacgaaaaatttcgtaactgtccacaaacaagtaggctaaatcactctttatctgcgtgtatctgtggtattcaattatcctttttcttaagaaatcactcgttgtttttacctgtctcttcctgcaggttaaggtagtaaacatgattgtttcgatagactcaagctaataattagaacaagacgaacaaaatactgctaaaattaatctggatggggtaacaattaaaatcatgcagtgataagtttagctagatgcatcctggagcttatcttattttttgtggcagaaaaatagatcaggaagtgaagggttatcagtgagcacagcacactagtggacaggatagcccaccagatgaatcaggtttggagataccctgacaaagaatgtctcgtgaacatgccgtatgcacgctcaatccagcaatagtgtgtgtattgcctatatatctttattcatctgctgttaatcattctctataaaaatattacctgccaactgtctgatagcaggttcataagcttaccgattatggatcagcgcgagtat

SEQ ID NO: 107179 - DNA, 743 bp, Oryza sativa
taaatcccctagtttatttgcccatatatatataaacaccaccacctgctttcctacttaattaacttttgaatgggaaagaacctttggaaaaactctttgattggggaagagaacctacagaaaagttgaattagtgtgcagcaaaaaagatagatggttgatcttaattggcttcgaaaataacatcatgtgtaaattaactaaggttgcttatgggttcctaattaaacattggttagctagaaattaaatctccacacaaattaaaaaccatacaaatccgcagaaaataatcatcaccatgtaactgagaagatcatatctcatctcataaaataagaatctcccacccagctgatttgtgcatatatattgcggtcctctataggtcgagtaaagggatttgtgtgcatatatagtgttgtctataataaagaacattaaaaccaagaacaggttgtttttcgcagtaaagaatcttattcatcttaagttgttaacataacaagcagctgcttatgtgcgaagaacatccaaagaaataagtactaattaacagcaaaactcattattcctcaaaaataaatttgaaaaaggaaaaaaaaactcatgcacatgaatgttggcatagttagaatcaagcaaccactttcagactcgaacaatcagtacacaacaaataggcaaatagaaaacctcaagaaacttctatcaacagaaatcaatcgatgagagcaaca

SEQ ID NO: 107180 - DNA, 706 bp, Oryza sativa
tggaacacgggtaaaacatggttttgtaatatgtacagttcgcggcagccggcaactgcgatctgcaacttctagtactatacattgactgccgctgtagttttactgatgtgagagcgtaccagctcagaatgctcatgcctaggtaggcttgtagccttgcagctcggttcgatatgtgagagcgattgacttgcgaactcttgggacagatgagccgaatcgcattatcctaatcgatcattatcacagagaggaaatgccggttgaattctccggcgacttgttactcgtagctataaaagccaaagctgaaattggtaacgattatttgacgcggctcataagagcaaactcgatcagtgctgcatttcgaattaagttgtgagtttctaaaagaacctcatggtaggccaaaacgatgtcagctcaaggatggaaatgcttggtcgaagagttttacttggacataacacgatgttgttaaagttttattatcattatctaattatatatgagaacatctatagtatttagaagtatattattacttattagtaattatcgtgcgcgaaggtagcgtaactcaactggctaggtttcttgtagtggaaccaaaccacccaggttttaagtcctaaacttggcatgagtgctcgtatttatccatcgacagtaagatactcgtgatccatctacagcgaga

SEQ ID NO: 107181 - DNA, 1346 bp, Oryza sativa
catcttatttagaagtgaacagtgcctaactatacatgttctcttgattgttgggttagctttgttatcttaagttgcgttcaatatgcacttttgaagatagatttttagcgtgtggcccgccatgtggaggaggacagcggcgtggcccacgacggggaacgagtgatgacgctctctctcgtggcccgatcttctagtgaggggataattctcgctttaatcgagtgtgacgtttgtgacgtggctaccaaccagaactagtccaggacgccatgcaatcgctacaccacaaacgatatcgtaccaaccgtgacgcgcggtagatgatccctgcaatgcaaacgagagaacactgcaagaataagataagattcaatttaatattgcgaataggtgatgaagcacaaagaaatagttacgattgaagtggtagatctaatcgacacggcaaatcaatacaccaactattgggggctctaaatctatagtcgtcgactaatcgagcgaggactagagacaaggtgaatggcacttggcaaaattcaactaaacaaaacccaattatttttgaggatgtacaaagctatttgtagaggaaaataaagctagggttaagtgctaattcgtggaggtggagggagacacttccgagatggggctagtctattacaaggcccaaggcccaagttcggtttcagcaatagcattgtcttattttggcgattcccgttgactcgagatgaatttggacatgagactggatgtgtttgaaaggtagcgagataagctttccacgaagtccaagatcacccaaatcggagttggcatgaagactctaggtccatttgaagtcagtactgtctccggaggccgagctggacttggacttggaattatcattggaacgtgtgaagttatgagcgtatccgacgaagtgatgtcctcatcatcctccccttcttgaattggagtcgtcctcgactcaatcccatctttttgattgtgtgcactctctcgtctagtggccatccttggaggtatctcatcttgaaaaacattctcatattcctgagtaacagtgggtggcaaagaatataaagtactaggagcagtagcgaatgtgagtataggatctttgcaaaatagagcatagcaacaagaatctggctcatctagtgcacaaatattatatttagaagccaacgaagcacccttcaacttaatttcattctttgtggtacttggttctattttactagttgaagcaagatgtttagcaataatctgattatcacttttcactttcttttcacattcaagtcttgcaagatcatctttcaaag

SEQ ID NO: 107182 - DNA, 663 bp, Oryza sativa
gcaaccatgtcgcctacaccactaggctaacttgagctccttgtttaggtaagactatgcataataaatgatgtttctggtgcaacatcagaccaatcaacccaacggtgcagcattcatcataattatctcaaatgcaattggcggccgacacgcgtatcaacgatcatctcgatgcaattagttgacagctcaaacactcattgcatcgaaacaacatatgtctagcggttattctcagcttataattagtgctggacttctcgtgaaagctcaaggatacaaacatagttgaattgtaaatacaactagcatgtaacaacatttagattttaacatgaagttattctgctattagcatatggttctgttgaataaatgaatcatgtgcattggtttccttgagccacaacttttatgtgttaatatttcttttcttctgagcatgacactcttgttaataatgattataatgatgtttctggtgtcctaatcctaatagagacgggtatattgctttagcaccaacaaaggataatagtgaaatgatttttttcgctttcacccattaactaacaatccgttgattagttatatgtaaattaatctatatccattgatttagaatggaaggattagattgacataatatcacactaaaac

SEQ ID NO: 107183 - DNA, 677 bp, Oryza sativa
tgcagccaggtaggagtacagatttttcagttgcgtagtcgcatcggcagccggtcgggcagccggcctgttaaatgaatgatccaaacgtttgatgattcttcacatgaaaaaggctacaccagcaaaccaaggggcacctacccactgtctgaattactttatccgtcccacaaaagatcaaggggtatttacaaatttgtcatcggtttttctaatattgcaaggatgcaactcgaatgataattctagtggcatttttgtaattttctggtgataattttacaataacgatttaaaatagtggtaaatttgtaattgccctaaaagattcaatctagaagtttcgtccagatttattataatggattatgttaaattcaattttagattaatttttttttggatggaagaagtgtactccactttattactccttgttactagtagcaccagaaagaagtggcaggttgatcgctcgggcactttgctggctgctgctagtacaggtgttgaagtgtaggtacaagtgttgaagtgtaggcacggtcgtgtgatctgtgtgctgaatcttggactcgtcggtagctctgctcagcttcagcacgctggaaagggaagcagccaagccaaggcaggtctgcaggtggtctgtctgtggatcgctgagcagtaca

SEQ ID NO: 107184 - DNA, 715 bp, Oryza sativa
cccctggggaaataatactatccataatactcagtgtagtagtggcggatatgatccgttggatgcaacgaatggatgatccatgtttacccgagggtacagtaaaaaaatcctttttctgggcggactatgttgcaagatggccagttgcagtgagtgcctgaaaatgcatgatttttctttggttgcataggcttgaacaaataaacatgatgtttctctcattctgtgaatgaaaatatttaacctgtattatttgaattgatctctagtgcatgatagggacggatagactcaggtcagaatgaaatgacatacagtgcatataagagaaaggtctagtaggcttaactctgcccatgtgtccagctagctcattgcgacaagaaatcttaggctgtgttagagaaaggggagatagataagattgggaagatacgcaaaacgaggtgagctattagtgcatgattaatcgagtattaattatttcaaatttcaaaaatagactgatatgattttttaaaacaactttcttatagaattttttttgcaaaaaacacaccgtttaatagtttgggaagcgtgcatgcggaaaacgatgtgcaatctatctccaatctcctagaacgaacgctgccttattatctcttaccggtgacagtgtatctccatgcaaaacagaacaaatggagaaccttttcccagacaaaatgag

SEQ ID NO: 107185 - DNA, 794 bp, Oryza sativa
ggcatatatgagctagatattacagaaacatatggggtcactgcgcatcgccgaactgagcttttgctcaaagctactccagtgtatgcatgattggtcggtacacctagtcagatatgtactgtcaagacaaatgtctggtctcttaaggccctctttgtttaggcttaggcttattggcctagacttttaagtcagcttattggtttatatgatttataagccagtggatttaatgtcctaagtttagtggtggagtcatacatctatctcatataagccaaaaaaagcttctccaacctagcttttggcttaatagtgttagagtggcttatggcttaaaaaagccaaatgaaaaagctacttgtttattttggcttagacttttcgacttataagttggcttataagcctaatcaaagagggcctaaacactgtccatgtttgcctacttttgtttatattataaataagaaatgcaaaatgtggccacagcgagtcgatttgagaccctgaagatgtacccaagtttgatgtttgctcaatatagcactcgcaagtcttctctgccatttcaactaggagttatcgggttgtgaaaccaaaaggagctagacatgagtgaagtggtctgaaagcttctcgacacactgatctttgcctagaggcaactcctttgttgccacagcctgttggatcttacgatatttcttgtaggagcactggaacagctagccacgtatctttcagaaagaacagctaaacggtgtgtttgcaagggggtgttcccaaca

SEQ ID NO: 107186 - DNA, 2704 bp, Oryza sativa
tattgataactctcaattaaatggcggaaacttgacacacatgatccagcttccgatcaatataattcgaaccctacaatcaaagcaccacatctcctttggttatcaaccgtgccctgcccagttgacctcatcgagaagactaatccctacatgcgaatcgaagaacacgagtaagaacaaggtagattattgcaactcgattgcatatgaattattaagcactcgaatttagggttccacaaaccgaacaagcgacaaaactgcaatgccagaaataatctaagcaaaacccgacctgaaactatgatggctactgaataaatatgattagggatgtcctagggtttacctagggcaccacccccttgggcttagcccatgatacaattacaaggcccaaagccaaatcagactcagactgaatgaagtatatggcttgttttgcagattcccaatggctgagaagaaattttgatgtgggaccaaaaccatctgaaagtagacttcataaaattttcaacaagtactcgtgagccctaagattcattctagatcggtggttaggtccgtttaaagttgatactattaggagacccgaatccgaatccaaaacgtgcagaccttcatctgttaccttttgtagactaaaagtgatgtggtgaggtaggagtaaatttggggaagatcttggtttgttccccagtcaacttttttttgatcatccaagcactttgttatccatcactcctttccttcatcaatcaagtatttctgcaaaccagaatacatgaaactcatagtgcaataacgtttgttcaaatatatagcacataaatctctcatatagatcatgcacacatttggtgtataaatataaggtatgcatggtcatatctgagctagtaatatcctcattatacaacgatcttcaaagatactagcaaaatactcatgtgttgcaccagactcattatagtattagataagttgattaaaactaaatcattgatctcaagttctgaatattgatgataggacaaacagtatgttgtatagtgcatatgcataaagcaaataaagcttctcactttaagtatgttgatcaagaatgataggtccataagataggtgatggtcctcacttgccagatagataggggtggcataacaaccaccaccacaagcatcttttaagatagtatatatatatttagagctttccctttaatatatatgtttctttctaatccgtcactctagtgtctaccagccacaaaatgatctaattctgttgtatattttcatttgcaaaattgtttttcctagttcagctctgcttaccttttgaaggaatatgattttgtacagtttgatcttttgtttcagacaatgtatgaaggattttgtatcccttgaaccttgtctttaatctttattatgaatattgagtttttctttaaaaaaaagaccacaaaatggagtctaaaaggtagtactagccaattgagatttgtccaaaaagaccataaaatggaatcgatacatatttagtgaaaaatctaaaaactattgtaggattaaaaagtggacgtctgagatttatccacatcatcttgagtaaacccacttttagatcctacggtaatttacatattttccatgtgatttgtattatgtattttctctatttttgtatgtactagcaaaatgcctgttacaacaggcgaaggaaattttaattgtttggataaaataaaattttaatcatgcacacattttgtatatgcgtgaatgatattgttatcagcgtagtatagggtgaatctaccatcactataatctagacaggtgggatcataggtcagtcatccctcctctctcccaaccatttcatgtgtattcctccacaccttttattaggagaagacattgcagaatgttgttttggttatttttaaaatgccaaaactcatgtgtctttttctgcttcctaagcaccagcgtccttaaaaggttgtatttgggttattttcctttttcatttcatctaaattccatgatttttgccttcactgatattctaaagttttcttgccgaagggctctcctccaaattcaagtatctattcctttattcaaatactccttccttaaagcaataccgtcaaaaaaaagttcctttaaacttccatttccgaaaataaagcaaaaacccacatattcatagagtccatgaactacatgttaaaatttatcttcaaatcctaaatagcctccaaacaaattcttttgcattgcatcccttttagattctattaaaatcatcccctccaaaatttcagaaaactattctatttcttttgggccgaaatcccttcaaccggtcatccttctttttctctctaccacgttttctccctcctgggttgattccatccccttgatttctgggcccttcaggccttctctcccttacacggcctagccaggatgtggcccagctgatccaaccgtctccttccttccaaagggcccatgtggcacgtgttagcacgtcgttgccgcccctgccgcaagggcactgccaccgttttgccgagtcaagaggaaccaccaccgtgtcgtgctcctcctcatccactgcttttactgcctcccttgctctagcccgttaccatgcctattgccgctacaaaccgtg

SEQ ID NO: 107187 - DNA, 734 bp, Oryza sativa
tcatagtttctgtcaagatttttgttgttttgcaaaatttgctctttaatatttgtacaaatattgtactcatcatccaatcatgtgaatttgatttgtatggagcaatcactactgcagaaagactaggtacaaaaggaacactgctagtgtacttctaaatcaaggttcacacaggggcacatacacgcgattacatacagcgggacgacaggtacaatgccacagaacatttagcacatacttctgtctaaaaaaaaataaactttagctacaaatctggacacgcatgtgtccagattcgtagttaggattggatctttttgggacggaggggtaggccacaaaagtggctcatatataatgactagtcagcatcccgtggcattgcatgagctattattttttttatattataattatttaaattctaattatatatataataaattagttagattagaattagaagagactagctacgtcaattacaacactctgattattgaatttaaatttcgaaactaaattaacaaattaaggtccaagataggtaactctatattcaatatattgattctaaagaattactaatcctaaagcattcatggtagtagaaactaaagagaatctatgatgttttcaatagaccgctttattcttaatattatcaacgttcacaatatatgataaatccaactattaaagggccacatctattttttattaatgca

SEQ ID NO: 107188 - DNA, 641 bp, Oryza sativa
tcaaagtaacttcattgaatcatccaactatctctagtttctatatctaagatatttttatgatcttatttgaggtcacgcgaaaaattgaaaaatagaaaaatgataagagcctatagaggggcaatgaagaagatgaggggggaaagtgctagatagggcagtgagccagtggaaccaagttgagcctaccctataaatgtatacatatactttttttaagctaaacataatgccatattactattacttatttgatcttattactcggttactcattcaaccatatccaaccctatccagcggtacgactatcttttttttatttggttttcttatgtttttcacattcaacttgtgagttgcttattgttacttcgtcactccatcattcattcaatgcctatttctagtgggtttttctctctctatggttctttcactttgtggttggtgactttgtgtaacgccatttaaaagctatttaaatgtttttattattatgaatattatttcgctgatttggttgtgagtttgcatgactaggtgtaagtgggtgtatgagtatattaaagcgagtgtgttttcaccatgaagtatattcaacttccatcacatctttacaaatttctgctttgatg

SEQ ID NO: 107189 - DNA, 538 bp, Oryza sativa
tttacatcctaattatccagtaaagaggtacttctgtttgatgtttttcttcctataacttcagcaaaacccatttagacatgccaattcttttaagcctttctctagaaagaagagaggacctgtacatgttttgcatgaatagtgttcctttttgaaacttagtagtattatggtaatgaacttctggcttggtttctgaagtttcctgcattggttatggtcttggtttgccaatcgtcacatttctgtacatatggcagaacacttgttctacactgacgacagagctcctgctcttatttgaggtcttcccaacagagaagtttgagtctgctcatttccttttactgtattatctgatttggtctactctgtgcctgtggtttgatatttcattcccaatggtatgatcgattgcctttgtggtttgatattttatcccaaggcaggacctgctgcatcatatatatgaatccagagttccattgccgactaatgtggatgatcctattaataggatcaacacaccaaattg

SEQ ID NO: 107190 - DNA, 1222 bp, Oryza sativa
tattgttggaagtgtataattttgttatataagactattatattcatgattttattgtacaaggtattattcatgacaaagtttatttttacataatgacataaaaactaatatttatttacttattaaaagattatatgtagcatttttttatggtagttcaatatttttttcctgtcctatatattatataggaatgcttttcaaaactatgtttatgatttaaagaaaatgctacacatactttttaatatttattaaaatttctatgtacaacaagcttatgaatattataatcacacaataaatttctatgcttccaacaatatagtttacaaatttctacatattcctcacgtattgaagggcaaaactaacttttctatacctattaaatggtcaactagcgatcaattgacggcaagggtatggaagagatccaaatcaaaattcagaggtatacaagcgagtgaagaaaattcagagacatagaagggatcggctaaaattttaagggcattaaagaaattttctctttcgtttagtacatgctctgaatgtatctctgaagtctgataattttatggggttcagaagacttgcaagcttcattactttggtcgtatgtctatcggcgagatcaaagatgtaattaaaccatttaatttccgttatataagaaagatcgatcataacagtaatgctactgtgacatctatatgatacgctaatgcatgatgcagaatcagcacaaataatcctgctacattcataggatcgatccaggatgaattaatacagagtttcagcggcagcttcttgtcactactcatgcccgatcaaaaggtcaattgattgccaatatgaaatggtacggtacccactgcacaataatttgtagggttaagatcacagcaattatggcatatagatgatacatcgtctatatgcgcctggagtcttgtgatgggacgactgatgcatgcgttgatatagacacgcggatattcactgataaggggaaacaaatttttttgtattagtaactttgctagctagaacatgctgcgaatttatattacacactattgcaacaaaagaacaatggtttagtagtatatattattagtctacaaattactcatactgtatattatcttctgattacaaaagtcggcatacaaatggtggaaatcagtcaatcattcaatcattcatttca

SEQ ID NO: 107191 - DNA, 642 bp, Oryza sativa
cttatgttctgaattttgtttcactattgtattggttttgagtactgatatatgaaaataattcactgattttgagaactgatatacgaaaagaaatccactgatttcatgaagaaaaatgaatttaggttgagcctacttatcttctgtattttgttttactattgtattggttttgagcactgatatatgaaaagaattcactgatttgtaacagatgctttgctttagatttaacatttaatttcaataagccgatccttatataaagtataaataaataaaattgcaacaagcgaaatggattgttccatctgttacatcacgattatgtaagctgtaaagttaaataataagcctgtttacctgtgtaatatttgattgttttgagctatgctgcaggcagcaaatcatatctctgatgaccttgtacctcttgttgttccggacaaagctgggacagctagggcagtgcgtgtgatcttcactagttctccagaggataagaaccttctcctgggttgtatctcttcagattggcagcatgtgcttgtataaaataaaaggaaggtgtcacgtattcaggatcccgtcttatggaaattattttcagatggacataaaaaaaatggaggatgaaca

SEQ ID NO: 107192 - DNA, 585 bp, Oryza sativa
tcttgctcgatcaggaccctagctttattgcgagccaaaacagctgcgctattctgttctacaggtagtatgaaatttccccttcctccaccactttactagtctcggcaggttgttcttcctctaggtctctccattcccaaggaagcttgcttcttcgtgggctataagacattaacaactggctctcgagtattcctatcatcaagtttttctatttccattataaagttcgcgggtataagtcaaaaggttagctcgcttatttggctaaaccatccaaacaagaaaaagaaatacggcaccgacatttccaatggtagtcaagttcactggaataggttctttgagctatgatccaccactgtcgaatcagcagtaacgaagtaagtgaattattcatcgagaacttcctatggcattcagccttttccttcagcttagcgccctcactgctacttctctctattaagctgctctctgggtccgtccataagcatgcatactggcgctctcttattggctaggcccctatctaattagcgggttattataacaatataaaaataagataatgtttggagt

SEQ ID NO: 107193 - DNA, 611 bp, Oryza sativa
cccacatccatcaaaggaatgctcgcttgtcaagctatgtgctttctttcctttcaaaactctatgtattcattggctttcttaccaggcctacccaggaaaggggtatagatagaagaagggatcctccgaccataggtctattgaatcgaaaaaacactattttttatccagcagctgcttttattttctctacgaagagagtggctagctagcttctttgccaacttcgagtgactgtgactactcttactggccgtaactcacagaagaggcaggaagactttttactcaaaattgataagcgatcaaaccctttgttgtaaccttctcttgcacccttaggttctttttccaataatgctaaaaaccagtgaaattcacctcttcttgttgtttggttaaggatcgagtgtggactttcgtctttatcaacctgcggctaaggagaatcaagcaccatttagtggtttgttcttagaccgactcaagcgattgagagtaagaacaagaagctacgtacggctataaataaagataaaatcagtcttgggaaggaaatctcaggtttggccatgcccatttatgagcaataaatataagaaagagca

SEQ ID NO: 107194 - DNA, 639 bp, Oryza sativa
accagttcaaatctggttcctggcacagaaaaaaggatctaccgaataggtattgatacaaattactcgagatggattgggatacatattcgttaaaaatatagctagagtatgatttattcatctaagtagagaaatctctaaatagagacacttctttttagagaagggtaaaaatctctggttcttttctttatggtacagaaggaggtgagattaggttcccttttcttcatttttgcatttcttattccgctattccgaatatttttttttctttcttatcttatcttactttcctagttgttccaagtaatgcgcgcggtacaaagttcgtggtagggaacttctttgagtcatcgtatttttctgtttatatgaaggaaatgaatatgtgattttccaaattggagaatcgaaatgaagcccttttttgctcagtctatctggacccttttgtataataggaattaattccaatataataggtattctgtttctagacgaaacagaacgtcaaaatattccttgacttgaataaaatcaggagttgtgttgtataagtgagcatgaatttcttatcattcaatgagcatcttgtatttcatagaaattgggggttatatagtccttacgtaa

SEQ ID NO: 107195 - DNA, 696 bp, Oryza sativa
tgaataagatttttctcgattttagatcggatttggcggcatggccaagcggtaaggcaggggactgcaaatcctttatccccagttcaaatctgggtgccgcctgatcaataaaatacttaggcttatagtactgatccaactcgaaaaattcgtaccccgcataagttggggcaagagaataactaggcccggcgatacttgattttgagaacccacagttctttcctcaaactagggtttgttttggcagtagtggcccaaaccgctaccaatagggatgagatagcgtttccttattcttttattaatttgaattgattcttaattgattcgattcgagaatttaaaactaggaggctaagatgtcagaaatcttggtgggcacctgagcacaagactttttagaaaaggcctgcccgggatgtaccgaaagatagagatgctgcatcgaaacagtcagactaccgaggaaccgctactccataccacgctgaccaacacacggccgcgagagaagaggcaaaccacgcgatcagcaccacgacttcagctacctgatcaaactatgaaagcaggaatcgcgtcgtctgtatccctgctcaatatcttgttttggccacatggattggatataaacaaaaaagcctacacaagactttgggttcactttggccctcgtggaaaggacctatg

SEQ ID NO: 107196 - DNA, 865 bp, Oryza sativa
agtggtaacggatttcaagcaaacggcgaaggtttgaattgactagcttgatccctactattacaaggaagaagtaagcaagcaagaaagaaagtaggttcagtctcttatttcgaagttcgctgtgctcttgtccaatagacattctgctggaactcacctttatctttagagatgatgatgaatattctttagagactcctctaaaataaaagaaatactttacaagaaaataaaaattatgtttatacggacggaattcggtctatcctttattgaatatcattgggcctgcctcctatctatcaactcattactctcctttgttctctggtaagctctcgcattgccttaaaacaagcattctttcgtattcaaagaaggtttgcttgcatgttctagcactggaagagacgaatattggttgccggatgctattcacatgttaaagcacaaaaggtacctcaaagtttatagttctaagctgaagaaatagcctgagtcaacttatcttctttacaacctccaaacaaacgatttaggaaatggaaattggaaccttttggagttacctagtagcattggaaaccttatgttccttcgataccttggcttctttgatttagtgattaagctacctctacctatatgtttgcttcaacaacgttctagcttgcgtattctgatcacacaatggaattcaggtggaccagggtttgggacactaatctttaaattatagatgcattataacatgtcaagggaggcgccgagatatgatatgaccaaaggccttgttgttgttgcgagcccggctcgaactgacgaggagagtggagaggaatacagtagtagtagtcgggcc

SEQ ID NO: 107197 - DNA, 535 bp, Oryza sativa
atggtgtttcacgatcagtattgaaaatgaaagctgaagaagttatcgaaactcggaaccacatgttcaatctttttttagcggtttccccagagatctttatcattaacgcaaccttcattttgctcattcatggagttgtatttagtacctctaagaaagatgattatccaccgttagttagtaatgtgggttggcttggattacttagtgttgcgcgcctaggagggcagcgcgcttggggtgcggaggagctattatcgcccagctccctaacctaatgcggccggaccgcagggaaccttagcatggggggacgtcctaatccttttgccgccgcaaggctggctaatcgtacgcagcaggagcaagggaactcccctggttcaggaaggcacatgagtccgaacgctattatgaatgtgcgaccgacactacactacgtaggtacctgtgcatgcaggtgaggcgtcggtcggtcctaaaaacggcggcagctagcgaggagggtaccgagctcgaattcgcctatagt

SEQ ID NO: 107198 - DNA, 816 bp, Oryza sativa
gtacttgctcattcttgtgatggatttcttactttacctgaatccgatcttgaaagaattagcacagcgggactgctgagatcacctctccagggcattaagccatgtcttctctatgcggatgatgccccccctcattttcctagatccgaagccgctgccattgctattattaaaggtactaatgaagctcttttaccaaggaaggtcaacctctccaaatcggtgttgttagtgactacggcttgcaatagcgagccacttcgtgtggctttactgcgtcattcagacacaggaacacgcgtaagaaacgaattaattgtactcaaaccatacactatttcctctttatctcatccctccggtgctgccttcatagcagcgcttactcactctacagtgaaatgtgattcttcgtcatgggacttctcgttaagtggttggcaatccatcaggaaactgcgatcttgcccggccccaacctgccaataggaatttcactgtcttcccgcaatccttctacccattttctgttcaatggtttcaatacaataaaaaaagaaaccatgatactgaactgaatcaatggcattccccagctttgtttttgaactctggtggtggcgatgaagtgttgtagccttgtagcacccttggatgcactccatgctctttcttatatttattgctcataaatgggcatggccaaacctgagatttccttcccaagactgattttatctttatttatagccgtacgtagcttcttgttcttactctcaatcgcttgagtcggtctaagaacaaaccactaaa

SEQ ID NO: 107199 - DNA, 544 bp, Oryza sativa
ataactgtttgcaagatccacgtatattaaaagaatatataaataaatatgtgcaaacgcactatgaaatccgttatagatattatagtcctaattggaataatatgtgcttattccacaataatatcgaattcaatcaaccaattgtgaggtttcattataattatataagggatatgctttctttaaggagtctctctcctatgaaatttggtgaactctctatgcgaagcagattatggacatctttacaaagattaacagaatcttcaaattatacattgaccgctaaatacacacacaatgtttagtgaatcttatgacaatccaatccaaggatggaacatcgtttgtatgtgggaatttctatgctcttgtcaaatttgggttttatacccgggtatggatcaggtatataccagttagcggtatagaagcggtacccgttgatctgtttccagaaaaatatcatgtctttctcaatgagagggcaaatgtgactgcctataagaaggtagttttcgtgggaacgaaagatcttact

SEQ ID NO: 107200 - DNA, 689 bp, Oryza sativa
agataacgaaaggaagctattagtttttcttgtactcgactcggcttttctttactgaccgcttgcgtaaggaaagttgacaataggaaaaccaggtgagaagttttagagcaaccgatgcctaccgtccggcgatgtccctaggtggagctggcttaccacattccgatacctcggaaccttcccttcgtaaatttggaataacgaaagtctcaaccgcttgctggcatgccaaaacacttattatgtttatgtgaagtggattcatcggaagagagaggtaaagcattttaatttcttcgcttttgagcagtaagtatttcgcaaggcggcccaggggtcttcttcgtttaaggggcagttgagcaaccaatcatactacgtagtacgggaattgtagttcacaagtgaagcctcccatgagtgactagtttggtggtatattataaatgggtcagttataaacaaatccgtcttttacggccgaccctagaaatagaacgctctttgacgagaaagccgtctagcacctgtagctggcttgcttcacgtcccgctgtttgcttacgagtttggtagcgagccgaggcagacgtttgtagatcttgcctcgaagcctcttcacagttgatagcatcacctgcgaggtatcagccctgcccctcatcattctttgagaatcataagga

SEQ ID NO: 107201 - DNA, 1833 bp, Oryza sativa
tttgagtgctttgtggcaaaaaacacttcgtattcgccggcgaacttttttgaattaatgccaatattgccataggtgggtgcattgttttagaccggaatgaaaaagttcaaaaagcaccaaaacatgatttttggacatattggagtgtggttggtgcattcgtggaaaaaaatcacttcgtgattcgcgcggcgaacttttgtcaatcactgccaatattgccataggtgggtgcgatgtttttcaccggaatgaaaaagttcaaaaagcaccaaaacatgatttttggacatattggagtgtgttgggtgcgttcgtggcaaaaaattacttcgtgattcgcgcggcgaacttttgtcaattaatgccaatattgccatatattggcacacgtgggtgcgatgtttttcaccggaatgaaaaagttcgaaaagcaccaaaacatgatttttggacatattggagtgtggttggtgcattcgtggtaaaaaatcactgcgtgattcgcgcggcgaacttttgtcaattactgccaatattggcataggtgggtgccatgtttttcaccggaatgaaaaagttcaaaaagcaccaaaacatgatttctggacatattggagtgtgttgggtgcgttcgtggcaaaatatcacttcgtgattcgcgcggcgaacttttgtctattactgccaatattggcataggtgggtgcgatgtttttcaccggaatgaaaaagttcaaaaagcaccaaaacatgatttttgaacatattggagtgtgttgggtgcattcgtggtaaaaaatcactccgtgattcgcgcggcgaacttttgtcaattaatgccaatactgccatatattggcacacgtgggtgtgatgtttttcaccggaatgaaaaagttcaaaaagcaccaaaacatgatttttggaaatattggagtgtgttgggtgcattcgtggcaaaaaatcacttcgtgattcgcgcggcgaacttttgtcaattaatgtcaatattgccatatattggcacacgtgggtgcgttgtttttcaacggaatgaaaaagtccaaaaagcaccaaaacatgatttttggacatattggtgtgtgttgggtgcgttcgtggcaaaaactcacttcgtgattcgcgcggcgaacttttgtgaagtaatgccaatattgccataggtgggtgcgatgttttagactggaatgaaaaagttgaaaaagcaccaaaacatgatttttggacatattggagtgtgttgggtgcattcgtggcaaaatatcgcttcgtgattcacgcggcgaacttttgtcaattactaccaatattggcataggtgggtgcgatgtttttcaccggaatgaaaaagttcaaaaagcaccaaaacatgatttttggacatattggagtgtggttggtgcattcgtggaaaaaaaatcacttcgtgattcgcgcggcgaacttttgtcaattactgccaatattggcataggtgggtgcgatgtttttcaccggaatgaaaatcacttcgtgattcgcgcggcgaacttttgtcaaatactggccattattggcataggtgggtgcgatgtttttcaccagaatgaaaaagttcaaaaagcaccaaaacatgatttttggacatattggagtgtgttgggtgcattcgtggccaaaaattacttcgtgattctggcggcgaacttttgtcaatactaccaatatttgcatagttggtgtgatgttttcacccggatgaaaaagttcaaaaagcccccaacatgattttgtgcatattggagtgggttgggtgcattctggcaa

SEQ ID NO: 107202 - DNA, 2389 bp, Oryza sativa
cgtgattcgcgcgcggaacttttgtgaattaatgccaatattgccataggtggtgcgatgttttagacggaatgaaaaagttcaaaaagcaccaaaacatgatttttggacatattgaagtgtgttgggtgcattcgtggcaaaatatcacttcgtgattcgcgcggcaagcttttgtcaattactgccaatattggcataggtgggtgcgatgtttttcaccgaaatgaaaaagttcaacaagcaccaaaacatgatttttggacatattggagtgtgttgggtgcattcgtggcaaaaagtcacttcgtgattcgcgcggggaacttttgtcaattaatgccaatattgccatatattggcacacgtgttggcgatgcttttcaccggaatgaaaaagttcaaaaagcaccaaaacatgatttttggacatattggagtgtggttggtgcattcgtggaaaaaaatcacttcgtgattcgcgcggcgaacttttgtcaatcactgccaatattggcataggtgggtgcgatgtttttcaccggaatgaaaaagttcaaaaagcaccaaaacatgatttctggacatattggagtgtgttgggtgcgttcgtggcaaaaaatcacttcgtgattcgcgtggcgaacttttgtcaattaatgccaatattgccatatattggcacacgtgggtgcgatgtttttcaccggaatgaaaaagttcgaaaagcaccaaaacatgatttttggacatattggagtgtggttggtgcattcgtggtaaaaaatcactgcgtgattcgcgcggcgaacttttgtcaattactgccaatattggcataggtgggtgccatgtttttcaccggaatgaaaaagttcaaaaagcaccaaaacatgatttctggacatattggagtgtgttgggtgcgttcgtggcaaaatatcacttcgtgattcgcgcggcgaacttttgtctattactgccaatattggcataggtgggtgcgatgtttttcaccggaatgaaaaagttcaaaaagcaccaaaacatgatttttgaacatattggagtgtgttgggtgcattcgtggtaaaaaatcactccgtgattcgcgcggcgaacttttgtcaattaatgccaatactgccatatattggcacacgtgggtgcgatgtttttcaccggaatgaaaaagtttgaaaagcaccaaaacatgatttttggacatattggagtgtggttggtgcattcgtggaaaaaaatcacttcgtgattcgcgcggcgaacttttgtcaattactgccaatattggcataggtgggtgcgatgtttttcaccggaatgaaaaatttcaaaaagcaccaaaacatgatttttgaacatattggagtgtgttgggtgcattcgtggtaaaaaatcacttcgtgattcgcgcggcgaacttttgtcaattattgccaatattgccatatattggcacacgtgggtgcgatgtttttcaccggaatgaaaaagttctaaaagcaccaaaacatgatttttggacgtattggagtgtgttgggtgcgttcgtggcaaaaaatcacttcgtgattcgcgcggcgaacttttttgaattaatgccaatattgccataggtgggtgcgatgttttagaccggaatgaaaaagttcaaaaagcaccaaaacatgatttttggacatattggagtgtgttgggtgcattcgtggcaaaatatcacttcgtgattcgcgcggcaagcttttgtcaattactgccaatattggcataggtgggtgcgatgtttttcaccggaatgaaaaagttcaacaagcaccaaaacatgatttttggacatattggagtgtgttgggtgcattcgtggcaaaaagtcacttcgtgattcgcgcggggaacttttgtcaattaatgccaatattgccatatattggcacacgtgttggcgatgcttttcaccggaatgaaaaagttcaaaaagcaccaaaacatgatttttggacatattggagtgtggttggtgcattcgtggaaaaaaatcacttcgtgattcgcgcggcgaacttttgtcaatcactgccaatattggcataggtgggtgcgatgtttttcaccggaatgaaaaagttcaaaaagcaccaaaacatgatttctggacatattggagtgtgttgggtgcgttcgtggcaaaaaatcacttcgtgattcgcgtggggaacttttgtcaattaatgccaatattgccatatattggcacacgtgtgtgcgatgctttttaccggaatgaaaaagttaaaaagcaccaaaacatgatttctggacatatttgaatgcgttggtgccgttctggcaaaaaattactttgtgattc

SEQ ID NO: 107203 - DNA, 2830 bp, Oryza sativa
cagcgcttgaaatgcactatccagattgtacagtagttcatcacagggcagcgccaacttctgacggccgccacgacttcatgcgaactccgatttgggcgtgcaagtacttcatggaaagcttatcaagtctaatttcaaatggatccagccacatgtccatatctgttctggagcggccgcaattgtcattttactcccgactattttctgtccatggtgctgcgtcatctcttttggcccaatgggctgtgtatccatgttgggcccattaggggcgcgtcctatggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatttcagtgcttgtcctacttgttcttgcttgttcttcgattgcttgcaggacgagtgtcctcgtggccgggttgacgcgcaccacaagttcgcggcgaccattggagacggtgtatcggttgctaaggcgcaacgtctttggacagttgtagtcgggccgtgaacgtcgacttcatctaatcgagttatcccttacctctcatcgaaagatcgggccacaaaccctagcgggttcgcatcatgcacccaacacactccaatatgtccaaaaatcatgttttggtgctttttgaactttttcattccagtctaaaacatcgcacccacctatggcaatattggcattacttcacaaaagttcgccgcgcgaatcacgaagtgattttttgccacgaacgcacccaacacacaccaatatgtccaaaaatcatgttttggtgctttttggactttttcattccgttgaaaaacaacgcacccacgtgtgccaatatatggcaatattgacattaattgacaaaagttcgccgcgcgaatcacgaagtgattttttgccacgaatgcacccaacacactccaatatttccaaaaatcatgttttggtgctttttgaactttttcattccggtgaaaaacatcgcacccacctatgccaatattggtagtaattgacaaaaagtttcgccgcgcgaatcacgaagtgatattttgccacgaatgcacccaacacactccaatatgtccaaaaatcatgttttggtgcttttgaactttttcattccggtggaaaacatcggacccacctatgcaaatattggtagtaatgacaaaagttcgccgcgcgattcacgaagtgatattttgacacgaatgcactgatgaggacatcaacaccatcgatacatccacgtccccccatatacagcatgatggtcctattacccgcgctcgtgcacgtcaactaaattatcaggtgagttctttcttgagttcatattcctcgtctttatacctcgaagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctaatttcaaatggatccagccacatgtccatatctgttctggagcggccgcaattgtcattttactcccgactattttctgtccatggtgctgcgtcatctcttttggcccaatgggctgtgtatccatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatttcagtgcttgtcctacttgttcttgcttgttcttcgattgcttgcaggacgagtgtcctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcatgcacccaacacactccaatatgtccaaaaatcatgttttggtgttttttgaactttttcattccagtctaaaacatcgcacccacctatggcaatattggcattaattcacaaaagttcgccgcgcgaatcacgaagtgattttttggcacgaacgcacccaacacactccaatatgtccaaaaatcatgttttggtgctttttgaactttttcattccggtgaaaaacatcggacccacgtgtgccaatatatggcaatattgacattaattgacaaaaggttcgcgcgcgaattacgaagtgattttttggcacgaatgcacccaacacacttcaatattgtcaaaaatcatgttttggtgctttttgaaccttttcatttccgtgaaaaacattacacccacctatggcaatattgggaagaattggcacaaggtcagcgcgcgaattacgaaatgatatttttgcccgatgcacccccacaacttcaaatgtccaaaaatatggtttggggcttttgaaccttttcattctgggaaaaacatgcaccacccatg

SEQ ID NO: 107204 - DNA, 9762 bp, Oryza sativa
  unsure (1)..(9762): unsure at all n locations
aatgcaccccaacacacttcaaatatgtccaaaaaatcatgtttgggtgctttttgaacttttcattctggtaaaaacatcgcacccacntatgccaataatggcagtaattgacaaaagttcgccgcgcgaatcacgaagtgattttcattccggtgaaaaacatcgcacccacctatgccaatattggcagtaattgacaaaagttcgccgcgcgaatcacgaagtgattttttttccacgaatgcaccaaccacactccaatatgtccaaaaatcatgttttggtgctttttgaactttttcattccggtgaaaaacatcgcacccacctatggcaatattagcattaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatggcaatattggcattaattgacaaaagttcgccgcgcgaatcacgaagtgattttttgccacgaacgcacccaacacactccaatatgtcgagaaatcaagttttggtgctttttgaactttttcattccggtgaaaaacatcgcacccacctataccaatattggcagtaattgacaaaagttcgccgcgcgaatcatgaagtgattttttgccacgaacgcacccaacacagtccaatatgtccaaaaatcatgttttggtgctttttgaactttttcattccggtgaaaaacatcgcaccaacgtgtgccaagatatggcaatattggcattaattgacaaaagttcgccgcgcgaatcacgaagtgattttttgccatgaatgcacccaacacactccaatatgtccaaaaatcatgttttggtgctttttgaactttttcattccggtgaaaaacatcgcacccacctatgccaatattggtagtaattgacaaaagttcgccgcgcgaatcacgaagtgatattttgccacgaatgcacccaacacactccaatatgtccaaaaatcatgttttggtgctttttgaactttttcattccagtctaaaacatcgcacccacctatgccaatattggcagtaattgacaaaagttcgctgcgagaatcacgaagcgattttcattccggtgaaaaacatcgcacccacctatgccaatattggcagtaattgacaaaagttcgccgcacgaatcacgaagtgatattttgccacgaatgcacccaacacactccaatatgtccaaaaatcatgttttggtgcttgttgaactttttcattccggtgaaaaacatcgcacccacctatgccaatattggcagtaattgacaaaagttcgccgcgtgaatcacgaagtgattttcattccggtgaaaaacatcgcacccacctatgccaatattggctgtaattgacaaaagttcgccgcgcgaatcacgaagtgatattttgccacgaatgcacccaacacactccaatatgtccaaaaatcatgttttggtgctttttgaacttttttattccggtcaaaaacatcgcaaccacgtgtgccaatattggtagtaattgacaaaagttcagcgcgcgaatcacgaagtgatattttgccacgaatgcacccaacacactccaatatgtccaaaaatcatgttttggtgctttttgaactttttcattccggtctaaaacatcgcacccacctatggcaatattggcattaattgacaaaagttcgccgcgcgaatcacgaagtgattttttgccacgaatgcacccaacacactccaatatgtccaaaaatcatgttttggtgctttttgaactttttcattctggtgaaaaacatcgcacccacctatgccaataatggcagtaattgacaaaagttcgccgcgcgaatcacgaagtgattttcattccggtgaaaaacatcgcacccacctatgccaatattggcagtaattgacaaaagttcgccgcgcgaatcacgaagtgattttttttccacgaatgcaccaaccacactccaatatgtccaaaaatcatgttttggtgctttttgaactttttcattccggtgaaaaacatcgcacccacctatgccaatattggtagtaattgacaaaagttcgccgcgtgaatcacgaagcgatattttgccacgaatgcacccaacacactccaatatgtccaaaaatcatgttttggtgctttttcaactttttcattccagtctaaaacatcgcacccacctatggcaatattggcattacttcacaaaagttcgccgcgcgaatcacgaagtgagtttttgccacgaacgcacccaacacacaccaatatgtccaaaaatcatgttttggtgctttttggactttttcattccgttgaaaaacaacgcacccacgtgtgccaatatatggcaatattgacattaattgacaaaagttcgccgcgcgaatcacgaagtgattttttgccacgaatgcacccaacacactccaatatttccaaaaatcatgttttggtgctttttgaactttttcattccggtgaaaaacatcgcacccacctatgccaatattggtagtaattgacaaaagttcgccgcgcgaatcacgaagtgatattttgccacgaatgcacccaacacactccaatatgtccaaaaatcatgttttggtgctttttgaactttttcattccggtgaaaaacatcgcaaccacctatgccaatattggtagtaattgacaaaagttcgccgcgcgaatcacgaagtgatattttgacacgaatgcactgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctaatttcaaatggatccagccacatgtccatatctgttctggagcggccgcaattgtcattttactcccgactattttctgtccatggtgctgcgtcatctcttttggcccaatgggctgtgtatccatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatttcagtgcttgtcctacttgttcttgcttgttcttcgattgcttgcaggacgagtgtcctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcatgcacccaacacactccaatatgtccaaaaatcatgttttggtgttttttgaactttttcattccagtctaaaacatcgcacccacctatggcaatattggcattaattcacaaaagttcgccgcgcgaatcacgaagtgattttttgccacgaacgcacccaacacactccaatatgtccaaaaatcatgttttggtgctttttgaactttttcattccgttgaaaaacatcgcacccacgtgtgccaatatatggcaatattgacattaattgacaaaagttcgccgcgcgaatcacgaagtgattttttgccacgaatgcacccaacacactccaatatgtccaaaaatcatgttttggtgctttttgaactttttcattccggtgaaaaacatcacacccacctatgccaatattggtagtaattgacaaaagttcagcgcgcgaatcacgaagtgatattttgccacgaatgcacccaacacactccaatatgtccaaaaatcatgttttggtgctttttgaactttttcattctggtgaaaaacatcgcacccacctatgccaataatggcagtaattgacaaaagttcgccgcgcgaatcacgaagtgattttcattccggtgaaaaacatcgcacccacctatgccaatattggcagtaattgacaaaagttcgccgcgcgaatcacgaagtgattttttttccacgaatgcaccaaccacactccaatatgtccaaaaatcatgttttggtgctttttgaactttttcattccggtgaaaaacatcgcacccacctatggcaatattagcattaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatggcaatattggcattaattgacaaaagttcgccgcgcgaatcacgaagtgattttttgccacgaacgcacccaacacactccaatatgtcgagaaatcaagttttggtgctttttgaactttttcattccggtgaaaaacatcgcacccacctataccaatattggcagtaattgacaaaagttcgccgcgcgaatcatgaagtgattttttgccacgaacgcacccaacacagtccaatatgtccaaaaatcatgttttggtgctttttgaactttttcattccggtgaaaaacatcgcacccacgtgtgccaagatatggcaatattggcattaattgacaaaagttcgccgcgcgaatcacgaagtgattttttgccatgaatgcacccaacacactccaatatgtccaaaaatcatgttttggtgctttttgaactttttcattccggtgaaaaacatcgcacccacctatgccaatattggtagtaattgacaaaagttcgccgcgcgaatcacgaagtgatattttgccacgaatgcacccaacacactccaatatgtccaaaaatcatgttttggtgctttttgaactttttcattccagtctaaaacatcgcacccacctatgccaatattggcagtaattgacaaaagttcgctgcgagaatcacgaagcgattttcattccggtgaaaaacatcgcacccacctatgccaatattggcagtaattgacaaaagttcgccgcacgaatcacgaagtgatattttgccacgaatgcacccaacacactccaatatgtccaaaaatcatgttttggtgcttgttgaactttttcattccggtgaaaaacatcgcacccacctatgccaatattggcagtaattgacaaaagttcgccgcgtgaatcacgaagtgattttcattccggtgaaaaacatcgcacccacctatgccaatattggctgtaattgacaaaagttcgccgcgcgaatcacgaagtgatattttgccacgaatgcacccaacacactccaatatgtccaaaaatcatgttttggtgctttttgaacttttttattccggtcaaaaacatcgcaaccacgtgtgccaatattggtagtaattgacaaaagttcagcgcgcgaatcacgaagtgatattttgccacgaatgcacccaacacactccaatatgtccaaaaatcatgttttggtgctttttgaactttttcattccggtgaaaaacatcgcacccacctatgccaatattggctgtaattgacaaaagttcgccgcgcgaatcacgaagtgatattttgccacgaatgcacccaacacactccaatatgtccaaaaatcatgttttggtgctttttgaacttttttattccggtcaaaaacatcgcaaccacgtgtgccaatattggtagtaattgacaaaagttcagcgcgcgaatcacgaagtgatattttgccacgaatgcacccaacacactccaatatgtccaaaaatcatgttttggtgctttttgaactttttcattccggtgaaaaacatcgcacccacctatgccaatattggctgtaattgacaaaagttcgccgcgcgaatcacgaagtgatattttgccacgaatgcacccaacacactccaatatgtccaaaaatcatgttttggtgctttttgaactttttcattccggtctaaaacatcgcacccacctatggcaatattggcattaattgacaaaagttcgccgcgcgaatcacgaagtgattttttgccacgaatgcacccaacacactccaatatgtccaaaaatcatgttttggtgctttttgaactttttcattctggtgaaaaacatcgcacccacctatgccaataatggcagtaattgacaaaagttcgccgcgcgaatcacgaagtgattttcattccggtgaaaaacatcgcacccacctatgccaatattggcagtaattgacaaaagttcgccgcgcgaatcacgaagtgatatttttccacgaatgcacccaacacactccaatatgtccaaaaatcatgttttggtgctttttgaacttttttattccggtcaaaaacatcgcaaccacgtgtgccaatattggtagtaattgacaaaagttcagcgcgcgaatcacgaagtgatattttgccacgaatgcacccaacacactccaatatgtccaaaaatcatgttttggtgctttttgaactttttcattccggtgaaaaacatcgcacccacctatgccaatattggctgtaattgacaaaagttcgccgcgcgaatcacgaagtgatattttgccacgaatgcacccaacacactccaatatgtccaaaaatcatgttttggtgctttttgaacttttttattccggtcaaaaacatcgcaaccacgtgtgccaatattggtagtaattgacaaaagttcagcgcgcgaatcacgaagtgatattttgccacgaatgcacccaacacactccaatatgtccaaaaatcatgttttggtgctttttgaactttttcattccggtgaaaaacatcgcacccacctatgccaatattggctgtaattgacaaaagttcgccgcgcgaatcacgaagtgatattttgccacgaatgcacccaacacactccaatatgtccaaaaatcatgttttggtgctttttgaactttttcattccggtctaaaacatcgcacccacctatggcaatattggcattaattgacaaaagttcgccgcgcgaatcacgaagtgattttttgccacgaatgcacccaacacactccaatatgtccaaaaatcatgttttggtgctttttgaactttttcattctggtgaaaaacatcgcacccacctatgccaataatggcagtaattgacaaaagttcgccgcgcgaatcacgaagtgattttcattccggtgaaaaacatcgcacccacctatgccaatattggcagtaattgacaaaagttcgccgcgcgaatcacgaagtgattttttttccacgaatgcaccaaccacactccaatatgtccaaaaatcatgttttggtgctttttgaactttttcattccggtgaaaaacatcgcacccacctatgccaatattggtagtaattgacaaaagttcgccgcgtgaatcacgaagcgatattttgccacgaatgcacccaacacactccaatatgtccaaaaatcatgttttggtgctttttcaactttttcattccagtctaaaacatcgcacccacctatggcaatattggcattacttcacaaaagttcgccgcgcgaatcacgaagtgagtttttgccacgaacgcacccaacacacaccaatatgtccaaaaatcatgttttggtgctttttggactttttcattccgttgaaaaacaacgcacccacgtgtgccaatatatggcaatattgacattaattgacaaaagttcgccgcgcgaatcacgaagtgattttttgccacgaatgcacccaacacactccaatatttccaaaaatcatgttttggtgctttttgaactttttcattccggtgaaaaacatcgcacccacctatgccaatattggtagtaattgacaaaagttcgccgcgcgaatcacgaagtgatattttgccacgaatgcacccaacacactccaatatgtccaaaaatcatgttttggtgctttttgaactttttcattccggtgaaaaacatcgcaaccacctatgccaatattggtagtaattgacaaaagttcgccgcgcgaatcacgaagtgatattttgacacgaatgcactgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctaatttcaaatggatccagccacatgtccatatctgttctggagcggccgcaattgtcattttactcccgactattttctgtccatggtgctgcgtcatctcttttggcccaatgggctgtgtatccatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatttcagtgcttgtcctacttgttcttgcttgttcttcgattgcttgcaggacgagtgtcctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcatgcacccaacacactccaatatgtccaaaaatcatgttttggtgttttttgaactttttcattccagtctaaaacatcgcacccacctatggcaatattggcattaattcacaaaagttcgccgcgcgaatcacgaagtgattttttgccacgaacgcacccaacacactccaatatgtccaaaaatcatgttttggtgctttttgaactttttcattccgttgaaaaacatcgcacccacgtgtgccaatatatggcaatattgacattaattgacaaaagttc

SEQ ID NO: 107205 - DNA, 879 bp, Oryza sativa
  unsure (1)..(879): unsure at all n locations
acacacactatatgccanaatcagtttgggccttttaacttttcatccggtaaaacatcgcaccctctatgcaatatagcattattgacaaaagttcccgcgcaaatcaggagtgattttttcctcgaatgccccaacacactccatatgtccaaaatcatgtttggtgctttttgaactttttcattcgggtgaaaaacatcgcacccacctatggcaatatgggcattaattgacaaaagttcgccgcgcaattcacgaagtgattttttgcaacgaacgcacccaacacactccaatatgtcgagaaatcaagttttggtgctttttgaactttttcattcgggtgaaaaacatcgcacccacttataccaatattggcagtaattgacaaaagttcgccgcgcgaatcataaagtgattttttgccacgaacgcacccaactcagtccaatatgtccaaaaatcatgttttggtgctttttgaactttttcattccggtgaaaaacatcgcacccacgtgtgccaagatatggcaatattggcattaattgacaaaagttcgccgcgcgaatcacaaagtgattttttgccatgaatgcacccaacacactccaatatgtccaaaaatcatgttttggtgctttttgaactttttcattccggtgaaaaacatcgcacccacctatgccaatattggtagtaattgacaaaagttcgccgcgcgaatcacgaagtgatattttgccacgaatgcacccaacacactccaatatgtccaaaaatcatgttttggtgctttttgaactttttcattccagtctaaaacatcgcacccacctatgtgttgcgttaccatcagacggtcatcaagggcg

SEQ ID NO: 107206 - DNA, 1574 bp, Oryza sativa
  unsure (1)..(1574): unsure at all n locations
cgacaaataatatttaagttattcgccagaagaccttttttgatttaacgccaatagtgcataaggggggtgcgatgtttttgcctgaattcaaaagttcaaaacacacttaaaccatgtttttagcattatttaaagttttttgggtgcataattcgtaacccgctagggtttgtggcccgttcttcattgaaaaggtaaggtataactcgattaaatgaagtcgacgttcgcgggccagtctacaaactgtccaaaaacgttgtcgccttaccaatctatacaccgtttccaatggtcacctcgaacttgtggtgcgcgtcataccgcccacgagaacactcgtcttccaagcaatcgaagatcaagcaagtccaagtaggacaagccctgaaattgctagataaagatgagaggtttcactatcggacacaatatggtggggttccgattacaggcatacgggcggtttagccaacacgcgcgctgcaagccggtagcaagaagctatctctatcatcaaaacccgcctgttcttggcggcgactagaggtataaaaagaggggaagaacgaccatagggtcgtgctccaaccttagaacgcgcccctaatgggcccaacatggatacacagcccattgggccaaaagagatgacgcagcaccatggacagaaaatagtcgggagtaaaatgacaattgcggccgctccagaacagatatggacatgtggctggatccatttgaaattagacttgataagctttccatgaagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcagtgcattcgtgtcaaaatatcacttcgtgattcgcgcggcgaacttttgtcaattactaccaatattggcataggtggttgcgatgtttttcaccggaatgaaaaagttcaaaaagcaccaaaacatgatttttggacatattggagtgtgttgggtgcattcgtggcaaaatatcacttcttgattcgcgcggcgaacttttgtcaattactaccaatattggcataggtgggtgcgatgttnttcaccggaatgaaaaaattcaaaaagcaccagaacatgatttttggaaatattggagtgtgttgggtgcattccgtgcgaaaaatcactttcttgattcgcgcggcgaccttttgtcaattaatggcaatattgccatatatttgcacacgtgggtgcgttgtttttcaacggaatgaaaaaatccagaaagccccaaaacatgatatttggacatattggtgtgggtaggtgccttcttgcaaaaactcactctcggatcgccg

SEQ ID NO: 107207 - DNA, 769 bp, Oryza sativa
  unsure (1)..(769): unsure at all n locations
cgggcccttgaaattttgatgacagttgcacatcatctngaactttttcattccggtgaaaaacatcgcacccacctatgccaatattggtagtaattgacaaaagttttccgcttgattcacgaagcgatattttgccacgaatgcacccaacacactccaatatgtccaaaaatcatgttttggtgctttttcaactttttcattccagtctaaaacatcgcacccacctatggcaatattggcattacttcacaaaagttcgccgcgcgaatcacgaagtgagtttttgccacgaacgcacccaacacacaccaatatgtccaaaaatcatgttttggtgctttttggactttttcattccgttgaaaaacaacgcacccacgtgtgccaatatatggcaatattgacattaattgacaaaagttcgccgcgcgaatcacgaagtaattttttgccacgaacgcacccaacacactccaatatgtccaaaaatcatgttttggtgctttttgaactttttcattccggtgaaaaacatcgcacccacctatggcaatattggcagtaattgacaaaagtttgccgcgcgaatcacgaagtgattttttgccacgaacgcacccaacacacttcaatttgtccagaaattatggtttggtgctttttgaactttttcatttccggtgaaaagcatcgcacacacgtgtgccaatatattgcaatattggcattaattgacaaagttccccacgcgaatcaccaagtg

SEQ ID NO: 107208 - DNA, 1033 bp, Oryza sativa
cgccccttgaatttgatgtcacctgcacagactcatactgccatattggcataggtgggtgcgatgtttttcaccggaatgaaaaagttcaaaaagcaccaaaacatgatttctggacatatcggagtgtgttgggtgcgttcgtggcaaaaaatcacttcgtgattcgcgtggcgaacttttgtcaattaatgccaatattgccatatattggcacacgtgtgtgcgatgcttttcaccggaatgaaaaagttcaaaaagcaccaaaacatgatttctggacatattggagtgtgttgggtgcgttcgtggcaaaaaatcacttcgtgattcgcgcggcaaacttttgtcaattactgccaatattgccataggtgggtgcgatgtttttcaccggaatgaaaaagttcaaaaagcaccaaaacatgatttttggacatattggagtgtgttgggtgcgttcgtggcaaaaaattacttcgtgattcgcgcggcgaacttttgtcaattaatgccaatattgccatatattcacacgtgggtgcgatgtttttcaccggaatgaaaaagttcaaaaagcaccaaaacatgatttttggacatattggagtgtgttgggtgcgttcgtggcaaaaaattacttcgtgattcgcgcggcgaacttttgtcaattaatgccaatattgccatatattggcacacgtgggtgcgatgttttagaccggaatgaaaaagttcaaaaagcaccaaaacatgatttttggacatattggagtgtgttgggtgcattcgtggcaaaatatcacttcgtgattcacgcggcaaacttttggcaattactgccaatattggcatatgtgggtgcgatgtttttcaccggaatggaaaagttcaacaagcaccaaaacatgaattttggacatattgcagtgtgttgggagcattcgtggcaaaaaagcacttcgtgaattgcgcggggacctttgtcaaataatgccaatattgccatatattggaacacgtggtggcgatt

SEQ ID NO: 107209 - DNA, 918 bp, Oryza sativa
ttggattcctcaggcttttgtcaattcctgccatttttgccctgggtgggtgcgttttttttcaccggattggaagggttcaccacgccccgaaccttgttttttggcctctttggggtgtgttgggtgcattcgcggcaaaaagtcacttcgtgattcgcgcggggaacttttgtcaattaatgccaatattgccatatattggcacacgtgttggcgatgcttttcaccggaatgaaaaagttcaaaaagcaccaaaacatgatttttggacatattggagtgtggttggtgcattcgtggaaaaaaatcacttcgtgattcgcgcggcgaacttttgtcaatcactgccaatattgccataggtgggtgcgatgtttttcaccggaatgaaaaagttcaaaaagcaccaaaacatgatttttggacatattggagtgtgttgggtgcgttcgtggcaaaaaattacttcgtgattcgcgcggcgaacttttgtcaattaatgccaatattgccatatattggcacacgtgggtgcgatgtttttcaccggaatgaaaaagttcgaaaagcaccaaaacatgatttttggacatattggagtgtggttggtgcattcgtggtaaaaaatcactgcgtgattcgcgcggcgaacttttgtcaattactgccaatattggcataggtgggtgccatgtttttcaccggaatgaaaaagttcaaaaagcaccaaaacatgatttctggacatattggagtgtgttgggtgcgttcgtggcaaaatatcacttcgtgattcgcgcggcgaacttttgtctattactgccaatattggcataggtgggtgcgatgtttttcacccgaattgaaaagttcaaaagcccaaaacatgatttttgaacatattggagtgggtgg

SEQ ID NO: 107210 - DNA, 1269 bp, Oryza sativa
ttgggtgcgttcgtggcaaaaaatcacttcgtgattcgcgcggcgaacttttgtgaattaatgccaatattgccataggtgggtgcgatgttttagactggaatgaaaaagttcaaaaagcaccaaaccatgatttttgaacatattggagtgtgttgggtgcattcgtggcaaaatatcacttcgtgattcgcgcggcaaacttttgtcaattactgccaatattggcataggtgggtgcgatgtttttcaccggaatgaaaaagttcaaaaagcaccaaaacatgatttttgaacatattggagtgtgttgggtgcattcgtggtaaaaaatcacttcgtgattcgcgcggcgaacttttgtcaattattgccaatattgccatatattggcacacgtgggtgcgatgtttttcaccggaatgaaaaagttctaaaagcaccaaaacatgatttttggacgtattggagtgtgttgggtgcgttcgtggcaaaaaatcacttcgtgattcgcgcggcgaacttttttgaattaatgccaatattgccataggtgggtgcgatgttttagaccggaatgaaaaagttcaaaaagcaccaaaacatgatttttggacatattggagtgtggttggtgcattcgtggaaaaaaatcacttcgtgattcgcgcggcgaacttttgtcaatcactgccaatattgccataggtgggtgcgatgtttttcaccggaatgaaaaagttcaaaaagcaccaaaacatgatttttggacatattggagtgtgttgggtgcgttcgtggcaaaaaattacttcgtgattcgcgcggcgaacttttgtcaattaatgccaatattgccatatattggcacacgtgggtgcgatgtttttcaccggaatgaaaaagttcgaaaagcaccaaaacatgatttttggacatattggagtgtggttggtgcattcgtggtaaaaaatcactgcgtgattcgcgcggcgaacttttgtcaattactgccaatattggcataggtgggtgccatgtttttcaccggaatgaaaaagttcaaaaagcaccaaaacatgatttctggacatattggagtgtgttgggtgcgttcgtggcaaaatatcacttcgtgattcgcgcggcgaacttttgtctattactgccaatattggcataggtgggtgcgatgtttttaccggaatgaaaaaagtcaaaaagccccaaacatgatttttgaaccttttggagtgtgttgggggcatt

SEQ ID NO: 107211 - DNA, 624 bp, Oryza sativa
  unsure (1)..(624): unsure at all n locations
taccaatattggcataggtggttgcgatgtttttcaccggaatgaaaaagttcaaaaagcaccaaaacatgatttttggacatattggagtgtgttgggtgcattcgtggcaaaatatcacttcgtgattcgcgcggcgaacttttgtcaattactaccaatattggcataggtgggtgcgatgtttttcaccggaatgaaaaagttcaaaaagcaccaaaacatgatttttggaaatattggagtgtgttgggtgcattcgtggcaaaaaatcacttcgtgattcgcgcggcgaacttttgtcaattaatgtcaatattgccatatattggcacacgtgggtgcgttgtttttcaacggaatgaaaaagtccaaaaagcaccaaaacatgatttttggacatattggtgtgtgtttgggtggccgttttcccggtgtgggggccaaaaaaaaaaaaaaacccctttttctaaaacccctttttttttttctccggggtgggggggaaaatatttttttttttttttggngnnccccggggggccccccccggggggggggntctcttgtaaaaaaaaaaaaaaattttggaagaatgccaatattgccataggtgggtgcgaa

SEQ ID NO: 107212 - DNA, 571 bp, Oryza sativa
  unsure (1)..(571): unsure at all n locations
cgcggggtgatgaactnctcgtagtagttcatcaaatgcacccaacacactccaatatgtccaaaaatcatgttttggtgctttttgaactttttcattccggtgaaaaacatcacacccacctatgccaatattggtagtaattgacaaaagttcagcgcgcgaatcacgaagtgatattttgccacgaatgcacccaacacactccaatatgtccaaaaatcatgttttggtgctttttgaactttttcattctggtgaaaaacatcgcacccacctatgccaataatggcagtaattgacaaaagttcgccgcgcgaatcacgaagtgattttcattccggtgaaaaacatcgcacccacctatgccaatattggcagtaattgacaaaagttcgccgcgcgaatcacgaagtgattttttttccacgaatgcaccaaccacactccaatatgtccaaaaatcatgttttggtgctttttgaactttttcattccggtgaaaaacatcgcacccacctatggcaatattagcattaattgacaaaagttcgccgcgcgaatcacgaag

SEQ ID NO: 107213 - DNA, 774 bp, Oryza sativa
ccgatatttagctcgtaatagaaatttctaacctattatatggatataatgctcgggaagagtaaattaaaaacttatgacaacaaaataattatacccgcaaaatagtttaaatcgaaattgggtttgccgtagttcgcagatagtaaagttaataaaaaggaatcgactttcgcatttgactttcatttggatttatttggatttttatttgaattctaaccgaattcaaatcaatttttgcacgtaaccatagagcccgagggagttgcggatccaagcgaaggccaagacccgcaagactttgagcaaggcaagtcatcactattccttgaacatgttgatcccaattgcaaaattgttttgtttacaaataaaattgcatgcaatgatgaacatcctacttgtgattatgccatgccttgattattgtttacccttaaaatccttgtaaccataattacgtatgagtccctagtcaattatgacaattgcttagaaatgccattctagaatcatgcatactcatatttatcaaatgctatatgcttggtcaattacctttgggaaggtaattgagatgcggcatgtggagacatgagcgccacattgccatgatgttgatgacatgatttgtgaaaggagaaataaaattaaacaattgttttcgactggggcggacggaggatttggtggtatctgggaaaggctagtaccgtcccccgtcaattaaagaccgagccatgaagttagcatgaaacgacccccgtacaa

SEQ ID NO: 107214 - DNA, 1080 bp, Oryza sativa
ccaccaaatcactttctatttggtttgatctgttgccgatagcgtttgtgagttaccttgtatcctgccaccactagaaaggaaatagaaccctgattcgagtgaccttccttaaaacagtcatatctttttcatacggactcgaaattaggcttataatatatccatggacatctacagaaaaagttacatccaattcttcccatcttcgccgggttcggcaaatttaaaatcgccaaattccgcttgcaaaattctgttttcgtggcgaaaagctttgggacctattcggatagaactttgaaaaattctacaagcttcatactttgtccgtttgagataagattttctgtggttggttccagtgtgctcctagttgtgcaaaaaatatcaaaaaaataaaaaaaataaaaaaagtcgtgtctctctcctcagccttagagagagaaagcaaaaaaaaaaaggcagaagagaggaagccgacttgtgagcacaccccaccattcccccttggtcaccaccttccaccgttcgagtaaccaccattccccctttatcgttgctgtttggtttgtgttttgtggcatcctttgtggttaggctcacgtctctacttcgactagcctaggaccagcactgtacactatacccttgagcgattattcaacttgctttgactaacgtggtttatagttttctcttgagcattgctttcagcccaccgacagctccaccacaaacccgactacagcttgacaggtcttgttgctacagcactaatacacctcgttccacggttgctaacttgtgtgttaccgtcccctcctgtgtgcaagataagaactgttaagagcttgtgagataggctgcgagtgagcattttgcaaaagctacatcccaatagttgtagggcttatatcacatcctctattgttttgttgtccttcttttctaaaccatggcaggtcccgaggataaagacgaggagggtgcatctcattccccacgcaccaaacgcatcatccaatattttacaaggcaagtgaagcaacacacagaaggacatgatacagatttgca

SEQ ID NO: 107215 - DNA, 1051 bp, Oryza sativa
acaaaggatccttttggttaaaggacattattgctttggttgatgtttttagaggaactgccaaatgcaacataaggacaggcactacagtactattctggacagatctgtggaatgatcaattcaaatgtcagcaatatcagcatctttatgcttcatctctacacaaagacgattcagtacaagctatgtgtgccagaccattggaagattctttcatgttacaactctcttatcaagcctattgtgagtatctcaaccttcaagatgaactgacacatcttcacctggaacaaggaaggggagattcatggtgtttcatctggaataacagctgttttacccccaaaagattctacaaactcaattttgctgcaattcaagcacccagacctctgatttggatttgaaagaccaagtgtgtcatgaaaataaaagtctttgcttggctattcttctaggacagattgaatacaagagattgtggataggaggcactgtgccaaacaagatgatgatctatcatgtgtactgtgcaacactaaccaaagggaaaccagagatcatctcttctttaactgcccatttagcacagcttagtggcaatctctgggaatttcatggaatgctaatctagaattttactaaagaatagcttttgcaagatgacagttcaatcagcctggttttcaggaaatcctctttatggctgcctggcacatttggaaacaacgaaatgggctcatcttcagaaatttgcagccaaccttccattcttggaagtctctctttacaaatgagattcttctgcatctctacataatgaaggacccctgaagcgatctgttgttaattggttacaatctttatagggtttttttacattttctcttgtttcttcctgtaaatattacctataattattccttcaataaatgaaaatcacactgttgggcaaagacctagcagtactttcagtcaaaaaaaacaactgactgacacgaacaacaaagctgcaaagctctgtgttatgcaaagaagtaatattggg

SEQ ID NO: 107216 - DNA, 940 bp, Oryza sativa
tggattaatattgtttaattattacttaacagtttcattaaattctgaaatgtttattaaatgctgtttatgcaaataaaaccctactatgccatcctttgttatcctgtgcacttgcatgtttgctgcgtggcttgctgagtatgtcatatactcaccttgcaatcattcatcagaggaagagttctacaatgatgttgatggtgtggaggattaggtgtagccctggtcaagctgcctgtggagtggagccgtctgcgccatttatcttattttccgctgcttagatctttattgattgagaggaactatctacctctgtaatgacattttattcgtttattaattagagtaataattgtactctattatcaatttgttattgtgtgcctcggctgattcctggacgagggattcacacacatgtaagcgtttgaaattttggatagaaattccgggcgtgacacaaggccatatgcaagtacattaatgatcaaccttattatgcaaatgattgcttgacattatattgagctttgtcaaatttatatgactcgtgttagatatctttcatactctcatgatcgaggggtcatttccatttccatttttccacaatatataattaagctaagcttctacactagaagatggctttccacaaaaaaaaattccattcaaataaactcctacattagactatgctttcttctcttggaaaaattcttgccaaaataaaaaaaaaggggaaggaaaggcatggctatgaaaaaaatagaaaagagaaggaaataaagtttgctcccaaaacattgagcaaagttggaaagaacatatagtaatgccccttctatattcatgccgagaaaaccaaaggggagagaaagtataagaaaaagggagattcatttctttattccatcattccacaaaatatttt

SEQ ID NO: 107217 - DNA, 521 bp, Oryza sativa
atgctaggcatcccgtggtcgcccttccctcctccctcctctttttctttccttccttcttttaatgtaaccttctagcccttggctattgtacagtttttccccctaccttaatacaaaatacaagtacaccccgacggggtttaaaaaaaataccctggtgatggtagtaagattatgccctttctattttggattgagatgaacatatgcttgatcatgttcacttcaatcaaaacaggtgaaatgtgtgggatattgtgtgagaaacaactttgaatgtgtacataacttagctttccttgaatttaactttattgagttttactatggtgctcaaatctcttttttcatgccatcagtggttgcggacatatattatgattaaatatgtattgaagtgattacacataattgcgatattaaataaactttttcaaacaaaaatatgatatgctttacttttccttaaatatatttcatattatcatatatgacccaaatcaagtaaagctcatttg

SEQ ID NO: 107218 - DNA, 559 bp, Oryza sativa
aaagaaatcccttttacaccctcaaaactaaccctactgccagcacattcagtttattcttaaccaaattctttgccaatctagagatcttcaagattcccactgcaatcaattcaaccagatacacaccacaagagcctacattttttctgtcaaaatttcctaggctatgggaactttggccccaagttgtacatgagggggagctgctaacaatgtctatgggggcctgctttttgagacgactgtatactcagtcttggcacattatatttcctagaatcttgaaaagtatccatataaacagaacatcaatgaagcatgcaaaatacaggcagccccacaacacatgggacacacctactcttccagcacttaccaattcagatcattgaaaaggcatcctctcacactgaagcaaataccatgcagcattttaacaatccaaatcctaaaactctaacccgttaccaaaaacaagaaccaaatactgtaaggtacaatgcgtaaagaaactcagcagaggaaacttcactaatagatctacactctaagcaca

SEQ ID NO: 107219 - DNA, 686 bp, Oryza sativa
agtgttttaattcttaaaccctgcttaacaactaaaaggtggaacggatggcctgggatggcttgggacgagctgggacccagggtcgggttgccagttcggtatgaatcatcgtaggccttgggttaaggcaggctcgtgtgggttcacagccttgattaataatattgtatagctctggaaacgtgtttacaaaatagctttgagcaactaagtgtcttttaaggctgtttactacaaaccctaaccctttatatcataacccccttgtactcctttacatttatcctgcacttgtgggtgtgtcttgttgagtacggtggttgtactcattcttgctcaatttttccaaacccagaagaggagtccctggaagatgaaggctttggtgtctagctcgtgcctgccgtcaagcgcctgtggtcgtcgccctagtcttccgctgtttctcgtttgtctttgtgtgtgctgggccctcgctgcccatgtaataaattaactatttacgcttccgcttgataaactctgaaatgtatcaacttttggtgtaccttgcctcctgggacaaggaataatacacgcacgtaaggaacgcccgttgggttaattccggtcttgacagatttgcccccacaaatctcgccggcgctattgatggcggccggacctcccgcgccggttttctt

SEQ ID NO: 107220 - DNA, 656 bp, Oryza sativa
  unsure (1)..(656): unsure at all n locations
cgccgctgattgagcagaggtggcaaattggggcaagatgccagcccctgcgttgaaggttgtcggcagtaaggcaagcgctcttcatcgcacaaaacataaagaatttgcatcgttccgacgcccgggatttccagatgatcttgccaagagcgcagcgagaccgtcccgtggacaaaagtgaataagccgatttgacggagaaagttcccttagagtctggacaccacctcaactcatcgcgcaccccatgatccagctgcactagtgctagaagatcccaaagcgcgaagaactccaggagggcctggacagacaggccgccccgaacgtctcctacccaagaattctcgtgcagcccttccgccaccgattttgtcttgttgcgaacataggagaagagcataagggaacgatttgcgattgagccccctcccgagagccagctatcagtctagaaggatgtttgttcaccattgcccagttgcaccatgcagccagccgcaaagcagtgcgccacttttttgtctattggctacacaaaattaacccagggcctcttaggctagacacggcagagccattgccagcgagttctcaaggcgacgcccatgagacgcaggtccttaatgccgagaccnccgttctcgattggt

SEQ ID NO: 107221 - DNA, 656 bp, Oryza sativa
caacatttacaagtactaaatgattttacttgaaaagttcattaacatcaaagttgtataacttatcaagatctataatttttatttgggtcatttcttcatccgacaaaacgatttataacaatattcacaaaatatacatatgtcttatatagtttataaactataagatagatatgttaattttgtgaacaatgttactatccctttactaaatgaagaaataaccaaaataaaagttatagatattgatgagttatacaactttgatgttgatgactttttcagttgaaatcatttagtatttgaaaatatcgtttgaagttgtcataatttgaaattaaaattcaaagtgtttaaacaaagtcatatagaaaaatggccaaaacaaaagttgtagatattgatgtgttatacaactttgttgttgatgacctttccagttgaaatcatttagtatttaaaaatgttatttgaagttgtcataatttaaaattcaaattttatataggtaaatcaaactcagatggagaaataaccaaaataaaataggtttatctcaataagttatacaactttgtttttgacaacttttccacataagttcatttagtatgataaaattcgattcaaaggtttaatattttaaaattaat

SEQ ID NO: 107222 - DNA, 1741 bp, Oryza sativa
tgtacttttattagaatactcttctaaatacatttctggtattgaaatactttccgaatatatgagtaccaactttacattatgttcatgttatactgaatatgttgctagcttatctgggagatgctttggtgcgggtataatgtttgcttatgcaattactctatgtcatgacgatgatactagagtagtatctggtagtttagacgtggtgtctagattacgggatatcattatttggggttatatattgcggatgagagttgggccggtgatggtgatagctcagtacggggtattcctccgcgcctatatataatcctaagttaatttcctggggagggtattcctccgtatttggccccggttggatggtcatgacgggctgttgtaaggaactcggcagtcaggggtggcttctcgaagtaccaggagggcatcggatagagggtattagctaatatatcagttaactagaatatatgtatactatgtatattagaagtataggaatagattctctttctcttttctttccacctagcttagattatttcttatgaggatgagtagtaatgcttgtgagtcactctacccttggatgatcttaacccctgcttagaatatgattatcacaagtaatatataaattattagttgagttctctctacatgatcttcccacgggataaaataaatacgatactcttggaatactctcgggtgaaatgctacaatggtatatccgtgcgcttgcggatgaactctgtaaccataatataccagaagtatttctttgccattgctggaaattatatttctagcaatgtcgttaagaaataccaacatacaccacaatgccgatctcggctggcccagcaattaccgggagcgagaatggcgtgggtaagaccccggtggactccatgtcgaaagatcctcctgcagaagcggagaacggaacatcgataacatctgaggccgagaaggatcctaacgtggccaaatcttgtccttccgacaagaagcatgagctgactaggataacctccggggcgacaagagcttggtgtcctattcacaggactagcaagcacaccttgcaaacttgttcagtttttctcgatgtataagctgaaatccgtgcctgccaagagcataggattcaatgtactcctccgactcgtgatgtctattatcctatccacaagacgaagactcacgacctctcaagctgaaaagtccttctcagcgctatgaagacatcacctcctaaggtccagcagtcacaaatctctcctagagatgcggacaaggaacaaggagcagcgattatttcagatcgattcgtcggggtaatcgatatcgatccccacgagccgtttgtcctatatctgcttgaagaccaggcctcatcatcgacaagtacaccacacaacgtgtacgctatcgatgggaccagcacatctagaggcgacaacacggtaacggaggatcaatcggttacgccgacgccggcccaacatataaagatcctcaatgcgatattgagcgaaagccctttcgatcccgtcctgaacgctgatctcgatcaatgggcagaacgactatgggaattagtggctaacctcaataacgcatttgcagaagctgccgctagggtaccaccggaagaaccgccgaccaacgggggtaatggggaatagcctgaacagcggacaccaccgcgttaagctacccc

SEQ ID NO: 107223 - DNA, 659 bp, Oryza sativa
gatacaaggcccataatccgtgacagtttatcgatttcgtcataaaccggcccaaaacctgttacgttataacaatttcgtcgcgatttaaatacttcaaaaccatataagagatatgcaaattttgcaaattttgtgaagaatgttactatcactttatcggatgaagaaatgaccaaaataaaagttatagatattgatgagttatacaactttgatgttgatgactttttcaggtgaaataatttagtatttgaaaatgttgtttgcagttgtcataatttgaaattcaaattcaaattattgaaacagagtcatataccaaaatgaccaaaacaaaagttgtagatattgatgatttatataactttgttgttgatgacttttacttgtaaatgttatttgaaattgttataatttgaaattcaaattcaaattattgaaacagagtcatatagcaaaatgaaaaaaacaaaagttgtagatattgatgatttatataactttgttgttgatgactttttcagttgaaattatttagtatttaaaaatattatttgaagttgtcataatttgaaattcaaattttatatagttcaatcaaactcggatggagaaatgaccaaacgaaaaatggtagactaaatgatttctacaac

SEQ ID NO: 107224 - DNA, 620 bp, Oryza sativa
ttccgcgcaccgcgtgattgtggggtttcacggtctcgggttgtgtgggttttctagggtggaattttgggtggtggccgatgggctgatgggcgcccgggggtttgggtggtggatggattattagtccaagttaggtttaatcagcgtgtggttggtaaaatcgcagtagcttagctttgtttgatgctattgtattggcttagtcagcttagctcatgattcgggaggcctttttcttcgatttcgtctgtggttttgtgaatttgtgtggagcaagtagaaattgctttttcttctttttctttttctgcttttttgtattgtagtcctcacttgttgttttctcgatgggatgatctcgtctgtgatgtgaacagttaaaaagtttccagcgcagtttgatgaactcgctgaatccaaagtggtttagagcggctttggttgctttatggttgactaattcagctcctaattatatctgtttggtgttcaaaccttctaggcgtgttgtacttacttgtggttcagattagtattgagatttttcctctgtgtatgcgtacgatggctttgctagtgtgtgttgacttggtgggaagggaaaattctgccttttg

SEQ ID NO: 107225 - DNA, 1571 bp, Oryza sativa
gtcaaaggtaatggtcaatactgaccaattcgtttgcccgtcacaggtatcccgtcagaggtgtgaggatctggcgtagtatgattgatccagctagctgctaaagctagaccccatgaattatatgattctcctctctagccagtacgtacgtagctataatttctgccgcatagcctcaccctcgctggttatatatatgcatgcacatatatatagcgcgccggcctctagctagtatagctagttgtatgcttatgcacactttatttctagacaatttttatggtggtttgtactggtagaagaataaatttattagattgataatattttctcatccaaaatcggccctatctattaatactacctcatcaactactgtatagagtgtaatagcttttcctgctagtaataggattcataaatccatattgaagacgtcttgatgcggatggcccatggccataatcttcagtggccctcccttctttggggcttccttcccctaaagggtgccggcaggcattgatgcaagcagcaacataatgaagtcgtgctttttatggactaatgcgggtggtcctcgacaatcacagtcttttgatcgccggaaactcgagtcgatatgctcgtggcagaaatggccccccggctttattgttttatggtgtttcaaattctgcgtgtgaagcggatgtggttgagatagggtctagcgttagtgattttgatcttggtcaggtgatcttgtaggtggaaaatgtcaaagcttcccctccagagtccagactcttaatcttttgtattctcttctctgtatctctcagtactttctctcatgttatcctcaagggctcctatgcttggaaactctcatgtatctcttcgctgtaagttggttcgaagtaatcccccccccggtgaattttcaaaaaaaaataggactcataaatcaatgacttatattgtttctatagtgataatgctggtagtcgaaatactagtataagctaacgtaaaaatactcctctcaaagacacacacacgcacacacatatatataccccaatatacacgtacacactcatttgtgtgtccgttctagtaaacattatggagacatgagatatataatatttcttaaaaacctcagcaaatttgtactaaaagtatagctatttgtgtatagcatatatggttgttgggatttaaaccctaacagttataatcataatagaaattttttatggtccttgagaaaagtacctagatatatactaaaattttacatacctcgaggtaccaagttttatgctataacatgtggtacattctaataccttctcaagaatgataaaattactttaatcataaacatacaataattaatgtgactttgcaataaccataccaaatgtgctatacctatataggtgcacagttactaaaatgttttagcacacgattaagttaattaaccacagcacgttaactgttaagcatatttgatcttaaagttggcgatgcaaaagcaaacaaaaaaaatatctggtagattttccggtgat

SEQ ID NO: 107226 - DNA, 3974 bp, Oryza sativa
tgtttctcccaacatggacacgcatcagcagtggtggccggtgagctcgagctcgctagctcgtcaatgggaaggtaaaaaccaacgactggtgatgcggtgaggagcttctcacctaggcctcctcgatgctgctgtagaatggggggagaaagagagaggagaggaggcagtggcgactaagcaacagaagaagatgtttgatggcaaaggagagcagaggctaatggctggggaactcgctccttggctgactaccatcgtcaacttgttcttctcactatcggagagagaagatgggagagagaggtgtcgaggaggaagaaagggatgccaatgaagacatgtaggtcctactattttttttaattgttaagcaccacgtaggacgatgaccgggtcaacacgccacgtggggcaccacgttagctaaaaccgcttagggatttaatttgcactggttttaaagttaagggtgctcaatatctacttttggggtcgagggatacgattgaaactcaacccctgttggagggaccaaatgtgaacttttttccttacctactgggctgtatttggtagttactgatcgaccatgggttacttggacctttttggtgtgctttcatgagtttctgtgggctggcctgacagatattcaatccatcaagtaaataggccttagcattggcacgtgtattgcaatactgcataggtcctactgcatatacgtgtttacaatacacggtcctataatagaccctctgaaaataaagacggcatgtgtaattgtgtacgtctccttcagaaaatgcaagtgcagacacgcatagttatccaacattgtgccagttcaacggtgtaaaggaggagcttgattcgcaattacctgaaagagatgacgacccagcaatttgtttgatttaccatagggactccacgcacgttccttcagactccgaaagatggatagatgttgcctccatcagactggtcaaaatgatatttgcaccgtcctttcagttctgtccaaattaaaagataatgacacaaaatggcgacaggacaatgatagtaagaggctaggaaggtcagagctgaagctgtttcacacaggaaaataaaagaaaggaggtgaactggtgcttactacaaaaggtatgtgtagcttgtaagcatctggttgctcttgtccactccaagccatgatcatgcatgcatgcgcgtttcttgagccgctaagcaaaagctcacaagatgacagaccaaatgcatctcctcttacatcacacggccggccagtcaaagatacctaccaactcttcccgcgccatggattaatacaggagaagcaagcagctttcttcacttattcgtatgccccatgtgcaccggagggacactctagcaactcgctccatttccatctccatcaccaacatggattcagacctgccttagaaaaaataaaatcagtttctttggtcatggcctcgtgaggctagaacactcaaaaaaacttcctccatataagccaggcctgcatgtctctatcctacgaatgaaaaaatttaagcactagctcactgcagctattaaccctgatggcatcaaacaaccgtgtcaaaattaacaacacaccggctagaggacgaaaacgacctgaccttgctgtggcttgcattttctccggcaagggcagccatggggcccttaggtgttcccttcagcaagcccattttttctgccagtgcgaatctgtaactccggtcggtggccctgaatgcagatttcatcgatcaatctggacagttaaatgtgccatccaacgatcggaagcaccttatctgtacataatttgaacccggtaaggggaagaaagttgatgaagaactgcttcctggatttcagcaaggatcattacgacaccgacacttgttttctgcaagatgtgcctcatgagtggagccctgcatacaaaggctgagggattattttaggcaaataggtgatcagcatgatataccatcccattaggcttaacagagacggaagagtactcatgtgagcacatacttaacacctaagaggaaaataggggggttaattttcagataaggaagtatactaatctaaagttgcttaatcaagtgagtgttcatgagcaagacaaaggggaagaccccgtgaaccttaactagtgattctagcaatcatgcacacacgtgcatgggggtgtgatctgtccatcatcttgattcttgaccagtctccaagtgggtacaaatcatccgctatactgtaaccaattaatttggtgtatgcgtgcagttaactctagcttaaattctgttatatcattgtttgtcgcggtgcatcttcataatgaagacaaatttgaccgccaagaaaaatcctccacaatcagcacttcagcagcacctgagattcacctttcagttcaggcacaaatgctttctcaaaaacagaaagaaaaggaaaccaatgcttaattacaatcatagtgttaagtgttaacttgttattctacgatgctgtcagttgcttcattttaatattaccattgcttttacaaaaatatttgccggttttactcctgtcgttaccacttatatgaattcgagcgctacatacagcgatgaatcctattattttttaagaagtatgatgttgcaaagatattataagtgttgaaaatcctgcatgtaaatgtctagggaagaaatgcagtacggtgacttgatctttatgacgcagtgaccatttttaggttgagaatcaaaacaatctaacagggtaatccgggggaccaaaccagcagagtttcatgcttaatacatgcaaatcaattgtttcctttataagttttgaatacgagacacccaaaaaaaaagtgaaagtcatattatgtcagcttgtataccagaaccatcacacataagttatggtagcacacattcaactccagtcattcaaggcccgattatcccattatctaaaaaaaactctagtaattcagtttgatcactagtgcaggaaaggacttcgtctcataatcaagtggttttcacttttcatactcaagtagttaaatagtgttagcattatttttctaatgtagtcaatgtcatattgtcatgaggtggtttacataatagttcaacttctaaagcattctattgtgtcatggacgtgcactctttgccagctaacaactataaagacaagcacatgaacaggtgaagttctgaagggctcaaaatgcttttccttgtgacaaaaataaagatgcccatgatgaagttatcatgcattataaactaactgcataaggcactaaaagattgacatgtaatcataaagttccaaaaacaacaaatgatttacgggtccactctaaatacccaactcaccgaccacttcacttggtttcccacagggtgggacccttatataagctccaaaggttatgctgatgcatgcattactaatgtgcaatttggagcaaaagagctctacacgtgtgtctcttcatttcaagatttagcatctaaacttagtttgtgatgggatcatagcaatgcttgatgaaacaaaaatactgaacactgctgataatttctctgtgctagatttgtaacagcatggtacgtacgactacattttacaaaacactacaattgttaaggcactgccaggaacttaggaaaatctcccagtaagcaaattccgtagaaatatttcatagcacaataaccatgtgacagaagaaggtaggactctgggtacaagactataaataccaaaaaaaaaactaactttaagcaggccaaacaaaataaggtttcccttatggaccctgtaggccaatcctgaaacaataggtaccagatcaactatgaaagaaggataagtaattatgagctgtacacaagctgtcaatttgtggctga

SEQ ID NO: 107227 - DNA, 934 bp, Oryza sativa
atatgtagttccatagttagtgaaagtaagttgtttggtttctgcaatactaaaatcgatctgtcctgaaaaaagcatgagttggaggttgagaggaaaaatatgattatggcatgaacattcgcaattgatgtttgcaaaatgggctaaagctcaatgatggaaaaatagttagacgggcgtaatgattgaaaagcctaagcaaatagataaaaggattgcattgcatatagatatagaatgtggaaaggcatatttgaggggaatgtgcagatgaggacgttaggctagcgtgagtgtgtgacaagtcgtggggtgcgagtgaaacatagtatcgagcaggtggtgggcatggcctggcctggccgggccggtaagcacgacataggcggatcgctggtggcagtgcgcagaggagaggaggaggatatcgagtgcgggccggagggaatcaggttaaaatataatataccttgatgccttgtcttccgtcgaggctgcgggctctgctattgctctgcccgcatccctccctcgtctcgtctcgtggattgccgatgaacggaggcaggcagccatccagagacctcttctcttcgtgcacgccgatgaagattgatattacctgcggccgccggcgccgctgtacatgtgcgtgcggatacatagatagcgctgatgagagacgcggcgctcgcctcgaacaccttgcgcgcaggcgcagtggtctaatctaagactggagagattcagaatttcattaatttgatttgaaagggccggcccataaaatggtcaacttgcgtaagcccaagtaattaggaacgagtatatgggcccaatttccatttatgggctggggctgtggaccgccagacttcatcgtctccgtcgtcggcgcagatctccggctcctccatccatcagtctctct

SEQ ID NO: 107228 - DNA, 560 bp, Oryza sativa
tagccaaaccaagttttgtcttgtatcttggagtctaatttatttgtagtagcctgctatcttaattatcactattgcacttggagagttataagagattatatatttttttcttttaagtttggcgtcttggctggatggctggttatccctcacaaaaaaatgatgaatactatcaactggtaacaagctgtggttacaacttctgtaatattgtgaaacctgtttcatctctgttataatatatggagtaactactaggctggtttcctggtagtacttcccataaaaaaaactggctggtttcccgtccgctgtctgtggtgcctcgtgacaccacacatccctcataaatccaaaatcatataggaggaaaaaatacagaaaatcgtggtgatgcaaaaacaaacaaaagaaggggaaaaataaccgcagctagccttcatgaaaaaacactcgtgtaattgggtcaaagtctaatatacgtacactcgtgtaattgggtcaaagtctaatatgcgtagacatgtgatttttggtatgggtaccgagctcgaatt

SEQ ID NO: 107229 - DNA, 850 bp, Oryza sativa
gcattaactcgatctgattttgaagcatcaacatgtagtacttatctattgcttttagtgtgtgcgccactcgtattcactggtgcatcaagtttctgtttctatttgtacatctacattggattttgaagttcttcacccttgcttcctttcattggtgtgaactgtatttgtaaactctgtatcatctgttcctgctcaattgttctatgtatattggtgtttgtttgtcgggtgctaggacccgcgggtgccccgtacccgctgctgggacggggacagtgagaaaccttcccctgagcacggggatggggatggcgaacgggggaatttcatcacctcgggggcggggacggggtagtgaaacccgacgggtgtagccccattgccatccctacagccagcttaggcacatgaaccaaaaaaaaatctgtgagacagacatgtggaccatatatttatagtgaagagtaaaccactacatgagtaagctgagagataggctataaagaactatacagtaagcagctggttgtattattatccttgctctaagagtagtgtgctccgaaccaaattgtaaacaataaatgcaacccttatattgtagtaaatattgtggaagtaggaaataacaaccaccaattgccctacaacttggtagtaaggaataaaaacattattttctcacctatatgtgactctctcctttctatcaattccgccgcgcattgttagattttttgtgtttattggatccacttgattacctcatacatagtagatattaaacttttggatggtatacattgttgtcctaatatctttctttgggagattgatgtgcact

SEQ ID NO: 107230 - DNA, 1175 bp, Oryza sativa
actatagggcgaattcgagctcggtaccctggtattctagcgaagccaatttaagtgatggtatttctgcaagccaatcttatgcgatggtagatatgcaattttctcgccaaaactagagtttcatttggaaatgtaaagcccctccgatggtccaattcttcatgtggctgcttgcgaaggaaagattgccgacaagagtaaacctccacaaaaaaaacacattgtcccaacaccgatctgtgagctccgaagtggagaagaagagactgcaacacatctctggtggtgtttgggaaggaggggacctctatctgagctgtccatttgctgtttttcgtagtatgacctattccttgctcatattgatcgctaaatacatcgaggacgccatgctttgggtggaacgtctctatagcgaggatagagtagttgtggactcctggtaaggaactcttcccccctccccctcaaatcctatcttactataaagttatcctccactaactccttaagcttaacatgcaaagatgccacatcatcatacactaacaagatgccacatcatcatccactaattaacaagatgccacatcatcatccactaacaatcatcacatttaaacatcatgcaaatatgatatatctttatagtttttataatttaagagcttttcaaatacaaacatgttaaattatcatccaacataattcacataatgtttcaatgtatatctttattatgttttatgatatcctatatacttatatagttcatcctcacttagttagtgcttaaatgattaatctatggtccaaattatttttctccttttttcctctaattaagtcatatacataaattgtttttagcctttagatgattaatctacggtccaaactatctccctacttttcttcttccataaagtcataccaccctattttttacgtttgaatcaccattctacgtactatttaaatttaaattatcataaaccacattaatttacttaatctgatgttatctagctatcttacacgttttttttattgttatcatactaaattcccgcagcaatgcgcggggtttcacctagtctaatgtaatctaatcccctttaacaaacctttgctaatgaaattcacgtggggaagctctccccctgtgaaag

SEQ ID NO: 107231 - DNA, 922 bp, Oryza sativa
ggatcaaaagcagttattcatcggatcgagaaattaagatatggataccaaatattttcgagaccaaatcggtcacacattatcagaacgtaatacgtacttccggtcacaaaaaagatttggcactttcaaaaattgacatgattttctctacgcaacaacgctacagctttgaccaccagttcgatctgtaatacacaagcacaggtaactatataagaaagttattttttcatggtgatcggcacaaaaattacatacatatatatttttagatataaacataaaatagttttcttgaaaggatataaagataatatggctcgactatgtgtgagatatatatatatatatatatatctcacacacatatatatatatatagctagtagcgctctctcgctaggtagctaggaatctaggatgccatgccacttattttaaacattactcgtacccttgtaaatttttcctggtgatcagagatacacacacgcctcgatatatatcaaggtgtttccggtgattatttggatcatcctaaaacgcatttattcctgtaatgaatttgaagcactggtcatccgcaaatcgatgaattcatggaaatactagtgtttaaatggtagaatcttaattaattaatctatatattccatgcatgattacatgctttcactagcatatatttgctctaggttacccaattcttctaaaagttcaataaatatttaagaaaataaaataaacctgacctctacatccaaccggatgtcatccacgaattcatatattaggtagcagagaatatattatgttactgctagcttgcatatccttgcagaaaaataatatattatctaatttattcttgccgcttatacaggcttactgcatccaatattaactatattctgctaat

SEQ ID NO: 107232 - DNA, 1011 bp, Oryza sativa
ttatttaacctataaaattgatgaaggcacgggcgagccggtcactttaatttcttgtctgataatgtatatacattagtattctgacaatatcttttgtagttagcatgagtgttaaattagtagtatagtttttgtatgcaatacctctgttcccatttttaagtgcaattgtgggtttcggtatccagcatttgaccgtatatcttatttgaaaattttatggaataataaaatagtcacaaataaagtattattcatgttttatcatctaataataacaaaaatattactcataaaaatttttaaataagacggacggttataaaaagtgcaaacctatggtctttttgagacgaagataatatatatgtagttacaaaccaccaaccccttgtggtagactttcttagcctctctctctttatatagtatatatatatatatatatatatatatagtttaattagttcctgtggtgcttatccaaaagaaccatatatccaactagggacctcttagtatgccataagcttattgggtttataattaatttggctgactttttctttaaaaatatgtagtttatataatcaagcaacttttgaaccacaaggccaagagaagagtactcacaagtactccaatccacaaaaaccaataaatccaaacaaaatatacgcttatttgagctttacgatttttggcatacaaatcaacttgctaattagtccaaacaaacggatccttaatatatgtatattatccaacggtatttgattgaaataactaatgaataagaatagtgcccacgttttttatatgaaaatagctggaacaaccttttaataatacaagtttgtcgaggagtgaccctctctagcggaagatcgtgagaccctcctttcgtaagtccggccggggaaaaaaactcgcctctagaaatcgcatatccgtccccaaggctcctagctagctcgcacacaaccaaattatatagggtaccgagct

SEQ ID NO: 107233 - DNA, 1366 bp, Oryza sativa
ttactgctagcttgcagatccgtgcagaaaaataatatattatctaatttattcttgccgcttatacaggcttactgcatccaatattaactatattctgctaataaaggatggatttgcatatatttttttaaagcgaggcccttcacggaaaattaatgatgcctgagcacgcattgtccttcatgcatgcgtatatatatatatatatatatatatatatatatatatatatatatatatatatatatatatatatgtagtacggtatttaacttgttcataaataattataattaagcacactgatcttgtcgtacgtcgaaacttgctgaaagatacatgagcgaccatatatatatatatgcttggtcccaaataattctcccaatgaatcaatatcattacatttgtagggacatggaagaagatctagtagtggcctggtaacaatatatataatctagttgattattagctagtgagcaaaggtgcatgctgagcttctcatcaattgttttgctgatgctgtaagggagaggcatgtatacgtaatcgaaactacgtaagtctagggatgcataaatatataataggtacataaacaagagtaaaattggagacaaattaaaggctttagtctaaaaataattggagataaattaaaggctatatactgccttatagaatactgcacagcgaccatcgattggtgtgccaaagccaaaagaatgaatccatagtgacgaccttttcttaactaatcaattcgctcccttggaatagctctatatataaatatatcattcgatgaataggcatggtttcatattgatttgccgttgtttgcatgcgcatgcatgtatatatacaaattaaaaaatatactgaattattaacctatatagttagctgcagtacactggaggaatcagatgcatttttttgcgctggcattttgttcttgggtaaaggcaaacattttcactcttttgctggatttgcgaatcgtcctcttgtctttttatcctaccttaattatatatgcatgcatggatgtcgtttccagaagaaaccacatacgatgaccctgactaaatcagaaggacatgcatgagcttcaggacgactatagagtcagcagtattgtgttctggtccacctagctagacgacatgctgggctgtatgagctctattgatcatacatattctggcccaaatgatgtagtgttccatgggccatcagcttaatatgggcgttcaatcattgttggtactggcccagatggttgattgacatattatttggggattaagttcacttgactcccttaattagtggtcgaatcacctaattattaaaa

SEQ ID NO: 107234 - DNA, 1431 bp, Oryza sativa
tttttaaaatttttcataaattttttaaataagacggatagtcaaatgttggacacggatttctacggctgcatttattttgggacggaggtagtactaggactgtcagctgtccggctgcttgcttgatcgtactgttgagctctgtgcagatgcatggagtaaaagtgtactccatctatgacgatatgcacctcctcatcgaaacgtacgtcgatatatctatcgctcctactgctcatcactatgcaatgcacgcggaaactgatctccagcagatgagaccatcatcatcggatcaagtccattgccattatgaagctactactttaccagctagcatgagttaatgtgaataatgcattaatcattcgtgcaggtaagccgtccatatcgatcaccgtaacgcaaactgatccatccatcaggatcgggatcggaatcgggatcgggatcgagatcgagatcgagattgagagagattgctcttccaccggtcgacgatcgatatatcttcatgcatgatcgattggtagtgctggcaagttattggcgtgcgtgtgcagtcgacctgacaatgatgcatttgcaagggtacttcgatgctgtaggccaggatcgaattgacatgccacaaacgccgagttactaggtgttgtctagtatcaaagttactacccactccgtcacatgatataagggattttaaatctaggtgtttcgtcgtgggaattgctaagtaattttaaatatacttcagaagataaagttagaagtaaaaatgatattgttattaacaacaatgatttgtcaaattatatttggagagagataaatttagtatacttcataggaaatcgtagaaaaaaaaattaaaatcttgatcaagatttacgtcgcaagaaacgagagatatggaaaaaaattgatgagaaatcatggtttattagtaagtcaggttttataagtattatcacaatacaaactaaatgatatctttgatgctgaatactatatagataaatgtcctttaagtactataaatcaatgcatatttaaatattatgaaaatgatactccataagttttgatgattgcataagcttgtggattcaataaattatagatgttgtagtatgcttttatgagttttgatatgtaattattagtggtgaatgattatgtggtatatttgcatgatgagttttaagattccgtgggttgatattgatcaatgaaatactccctccgttaaaaaaaatgaaaaatcggatgtaacacattatagtataatgaatctggacagaggtatgtccatatacgtagtcctaggatatgttacatccagtattagtttgattgatatgtcacatccagtataagtttgattttttatgggacggaggaagtattacataactgcagtttgat

SEQ ID NO: 107235 - DNA, 672 bp, Oryza sativa
actttaaataagacgaacggtcaaatgttaaagataaatagtgtaaaaatgtacttattttgagacggagggagtagtatcttttcttgattcgatttctggatccatctcctttattagtattcgtacttgttgcctccctcgatcgatcaagacgtgtcttggatcaccaataaaaattgcaatagcagtgatgcgtttttagatcgacctgtctgcttcctctccttgtctcaagtagtcaacaatcttatgaacccattttgcagcgcttaacaatcttccaacgaacctttgcatcaatgcaaagttgtactgtaaaagtacatactcactcctactacggtatcgtccatccatggctcctcatgcctagagcatcttcaagattcatgctagccatacggctcttcctatcaaattctagcgacattgcattcgcaggctctcgacagctgcaaaagaccagctcccaccaccttacagagatgttgcaggaagaaatgcttcaaaaccacaaagatattagacacacggaagacgggggccgggttggcctagtctgcaccaagcagatttatgaaagtatcccagctcctctaccccctcgccaaaactgagaaaattgcatatctaccattgcataagattggcttcgcagaaatatcatca

SEQ ID NO: 107236 - DNA, 611 bp, Oryza sativa
atctggagggatcgacctcgatctctatctcaagctaagctagcccgctctcctcttgtgtgattaatattctgctcctccgacagaaatgatcccctttaatttttcatccggtttgtgtatggttgcccggccggtgctatatatgggagaagactagctttgctctatcttattatatcagggatttagcgtgtaactaagggtggtttgggggcacttaattgttctattccaagttgtgttggtgtacatggaatatgtgtacaagcatgacatataaaaaaagtaaaagtagggaggaaagagtgaaaaggctacgtacaccctttcagagggtgcaccttacaagtttattaattactatcacgccatgggtagaatgttggacatatgtggctttatttcttgtatcaacgcttgctatggattatttaagctataaaattgatggaggcacgggcgagccgttactttaatttcttgtctgataatgtataatacattagtattctgacaatatcttttgtagttagcatgagtgttaattagtagtatagttttgtatgcaatacctctgtcccaattttaagtgcaattgtgggtttccg

SEQ ID NO: 107237 - DNA, 636 bp, Oryza sativa
ccgacaactgcagcccgcgctccccaacttgcattgccattccatgctttttgcgtcagcctaaacattcgcttactactcgttaatttcttgcttggtgttcaactcattcaatttattgtacttgtcaaggtaattaattagtaatggtgttaagcaaagcatcatattcatgggtgccatactactgcctaccgtgtcatgtgcgcagcagaacgagaacaacaatattctggagtactccactactgtgtaactaacctactactactccccctgttactaaatgctaatgcagcaggcaggcgtgtcagctactcagctggcaagaataattaatgaagggccggagtgttaaggtttaattaagcaaaccgcctggcaagagctcatgactccatgagcgagcggcgagccccatcaaacaagagggaaagaaaagaaaagaaaagaaaacaaaggattgattattgggaggaagaagcgggctgacattcctgacaaaatgtcaagctggaatggaatcatcccgagcttaggattccttgaaatttggcaatgagctgcagtgggcactggagtggacaagtgcagttgatgagtgggtgctgcaaaagggcgtcacatcttctgatc

SEQ ID NO: 107238 - DNA, 581 bp, Oryza sativa
  unsure (1)..(581): unsure at all n locations
cctgtccatgtgcttgtctttatagttggcatgctggcatagagtgcacgtgcatgacacaatagattgctttataagcagaactattatgtaaaccacctcatgactgtctgacattgactacattagaaaaataaggctaacactatttaacgacttgagtcttttggccgaaaanaaaaaaagtgctaactacttgattatgagacgaagttctttcttgcactagagagaaaactgaattactatagctttttgtagataatgggataatcgggctcttgaatgactggaagagaatgcgtgctaccataactaatacgagatggacctggcctacaagctgacatatatgactctgactgggcattcgtggggctcttatgcgaaacttataaaggaaacatttgatctgcatgtgttaatcatgaaactctgctgcgtgcggtcccgcagattaccctgatagatcgtgacgattctaagcctaataatgggaactgagtcatatagatcaagcatccgtactgcattgcttggctagacatttacatgcaggattgtcaagacttataatatct

SEQ ID NO: 107239 - DNA, 505 bp, Oryza sativa
acaccggctttgcaggttggggttagatcgttttgcactatataataccaaggatggagtttttatcgagctggtagaaataaaacggcttaatttggaattatttactgatggcccatgacttgttttcgtgctaactgcagaaggtgactacttatagctttgtacagtaacacggcaagagttgggcactttcttgtgtatttgctagtataaatttccagattgtctgacatatttttctagggagaaatgaccccaattttttccatcgaagaaaaatataaggacggtctgaacatctgaatgtgagatcaacacattcgagaatccaaaatagcattatagaaacagctagaaaagaggaataaagacatatcattcaaggataaattattccactgttccagcctccaggaggtcccgacgcatcgttaatagtccttagctcactgcaaatattttgttgtgaggaacatggcggggtaccgagctcgaattcgcc

SEQ ID NO: 107240 - DNA, 632 bp, Oryza sativa
tcttggagccggccgccgttcgcgggggcgccggttgcgccggtcaccaccgcgccgtcctggggctcgccgcccccggcgctggtcccgttcatctcgtggtcgtggtcgccgcttggctccttggacgccatgtcgtcgtcaccggcgccggtggtgtcgttgttgccaagcccgagggatgggtcggcggctgtcaccggcaggctgagccgcccctcgtcccaccaccggctcgccagcttctacctgcggcctatatatccaggctaggctagggtttaacttcttcttcttcttcttctcggcttccgatcgatcgatagatcccttcaattgattagcttctggctagctagtgcttcttgctcgctgcgccacctggatatatatcatatgtatcgatccattagctagctagtactactagtttaattactattatgctgaaattgattaagctctatctatctatcaatcggaagatgcacatcacaggttgaagatcgagctagctagcttgcagttaatcgattgaggatctcgcaggctagctagaacatcgatccacgagtggaaattaacatcaaattaattgtatatatgtatatcattttgatggaagaaaaatt

SEQ ID NO: 107241 - DNA, 585 bp, Oryza sativa
ttctggtatacaagctgacataatatgactttcactttttttttgtgtgtctcgtattcaaaacttataaaggaaacaattgatttgcatgtattaagcatgaaactctgctgcgtttggtcccccggattaccctgttagattgttttgattctcaacctaaaaatggtcactgcgtcataaagatcaagtcaccgtactgcatttcttccctagacatttacatgcaggattttcaagacttataatatctttgcaacatgataattcttaaaaaataataggattcatcgctgtatgtagcgctcgaattcatataagtggtaacgacaggagtaaaaccgcaaaatattttggtaaaagcaatggtaatattaaaatgaagcaactgacagcatcgtagaataacaagttaacacttaacactatgattgtaattaagcattgttttccttttctttctgtttttgagaaagcattgttgcctgaattgaaaggtgaatctcaggtgctgctgaagtgctgattgtggaggattttgtttggtggtcaaatttgtcttcattagaagatgcacggcgacaa

SEQ ID NO: 107242 - DNA, 521 bp, Oryza sativa
ctaggggtgaaaacagggtgggtatttcctgatcgcctgcccgggtgtattaatttgtgacaattttaggttaaaaattgaggtattcgggagtttttactgttttcaggtccaaatataggtattttctgttggatataagatcgggtttgggatgacgatatcttacatatgcgtgttatctggtataaaacacggatattacctttttaaatatctggattttacccgaatacttgactaccacaaagttcgttccaaccacagccacaaggcccaaatagcccactgctccaccaactcaccagctaaccactaattgtggtctaaccctagccgcatacagctcacgggcaataaggcaggcgtcacaaccatacatctcactccaccgccgtacggccacaaccttccgcatatctctgaaaccttcgtcttagacatcctgcatcgggagaaggcactaataaagatttttggaatcgctcgtgcgactgctcggtgttcgtccacaacgactc

SEQ ID NO: 107243 - DNA, 768 bp, Oryza sativa
cgaaatatgtggcttgtggaatttttcaaagctctaccgaaaaacttctctcctcgaaaacacaatcttgcaagcggaatttggaggttttaatatcgccgaacccagcaaagcgggggaaaattggatgtaactttttctgtaaatgtccgtggatatattattttcctgatttcgagtccgtatgagaaagttacgcctattttaataaatgacacccgaatgatttttcgatagagctttggaaaattctacaagtcacatattttgtctgtttgagtttattttttctatggttggttcttgtattctcctaagtgtgaaaataaaatatcaaaaaaataaaaataaaaaaaactgcatctctgtgtactgtttaacttatggctatcatttcatgtggttatattttgaattagagattaagtaatttcatatagtggtagagtgcattatgtttaacatgttgatcaaagggttttactaaaggagttatggtctaattttgatgaaggtgcaaagtaggctaagtggtatgctatatttcgttcgagtttaaatttttttttgtggctggttgtatcgtgatcctaagtgcgaaaaaacatccgaaaaaataaaacaaaaataaaaaggttacaactctataagaaacaggaatggaggcgaggggtggtgggggatggggcggcgccagcagccctactctctagggcggcgccagccatgttggcgctctcctcctgccacgtcggttcgcgtgtgcca

SEQ ID NO: 107244 - DNA, 803 bp, Oryza sativa
ctcgcaaaatagcctaggggttatggaatcggttttgtcggtaatctacgtttaatactcctaaatagcaagatttctgagggctatttaatagctcggaggatccaaacaaagccacagttacactgcacgagctatagcgatcgatctatcgatcggctcgccatttagggtctgttcactttaatgtcaaaaaaaacttatcaaattttgtcattgctaaaaatttgatatagttgtcaaaattttagtatgatttcttatatagttactaaaatttgacagcgaattaaatatagctattctttttagcaacattaccaaaaattagtaagattgaaaatagcttcaaagtgaacaagcccttgctgtctacgctgggcggcttctggtccggtctggtggttggcgtttcccttgccgccattacttgctgatcgatcgccgaggccttcttcttgggttcttcctcctccgtcacacatgctctgcgcccaaggatatgatcgctccgatccaccgcgcgcgccgcggcggccacggcccacggaccacgtgtgcttccgggcacgcggggcgcgtgtcgtttggatcagaattagctgctgcgttattgtaagctcaagatactgaaagaagctatatagccgctagaagttcttcgagcagggccacagctaaaagagagatagagaggagagtgtctggtcaacatcacattttactactccctccgtctcataataggtgacgtttttgactttttatttgcaacgtttgaccattcgttttatttgaaaaat

SEQ ID NO: 107245 - DNA, 616 bp, Oryza sativa
  unsure (1)..(616): unsure at all n locations
cctaaacttattgtgcacgcagagatcctcgcgttattgttttattatttaaatacattatgttttcttaattgtgaagctttttaattcatcgaaaagacatataagattacccatgtgtgtagagtttaaattacaatccacaggtaccacctaggtttatattcatctcagtattccataagtcgtagagctacaaaccaatgaaatcaaattaactaactgttctgttttttttaaaaaaaaaactactcttatgcagtataaaaactactagaatacaaaagcaatcttaaaaaacatatatactggaaggtgagatataacttgtgcgtgtgtgtatgttgtgcggggaataaaaaatgaataacaggagttaaaagacttagaatgagatttactgatttaatttgcaatatcaacaattcaaattaagcatcggaaacttccgcgtacctgtcagacattgtacgccgcaatttccaaacccccattttccaaaaaanaaaacccccccaccctataaacagcttctctctgcatagcagcatagtgcatatgcaattaggttgtccagcaaaaataagacaattattcagttacatactactgagaa

SEQ ID NO: 107246 - DNA, 1357 bp, Oryza sativa
taaaaaaaattaaaatccggttcctatataaaaaatctgcccatgtgataatactccttccgtttcatattataagtcgttcgattttttttaagttaaacttctttaggtttgatcaagtttataaaaaatatattagtattttcaatataagacaaacatatgataaaaatacagttaatgaaactaatttgatattttaaatgttattaaatttatctataaactttgtcaaacttaacaaaaatttgactaggaaaaaaaatcaaatgacttataatgtgaaacgaatagagtagttttttttaaacgaaaggcacaacacaccaattcatcgaatatagaaggagagctttatttacaagtaaaaataaagcgagaaaaaaatatttatagacaaggcagccgcctaaggcaagaactctgctaggtgtttggcttccgccaaagcgccaatgtccaagattttgactcttccttaatgttcgcaataaggaccaatgagaatagtttcttgttccgaaagattctctggtttcactcctttcatacttcccaagaggttaggagaattagggatatggtccctttcttaggtacaccctggcatgttgctagatttttcatcagttctaaactgtggtcacttacgttcagtttgtccacctcatggggtcacagactatctagttgacaatcgcttcccaaattgtccttatgtatgtgcaatccaccattaggtgaagagaggtttcatctgtgcatcagcataatggataactaccattgttctgccagtctcgaatcaccggtctatctgatgtccatactctattctgaataattagccacgtgaaggtttcatggagcctagggtttccgaaataagtggtcgtagtttattttgaacgacccaaagaattatgcctagtaggttgaggtggtggtgtattccccatagttcatgagatttcaagagatatcgtgggtctcgtccagggttagtgtgacatgttgaattgccatccacaggatgacctgctggtcaagttcccttaatttagacctgtgctatttccattcaaatttgtttctaaaatcacatttgattttagacactgtactttgatttgtgtttgccaaatggccggatttctttggaccccggcgacgcgactggatcctttcggtgggccgccggcccggatggtcgatcgtatgatgattgatgaatgttgtgttgccaccgggatcgagcatggccggcgttcgtggcgacgacgacgacccggcctaaaatgtcaaatcaagaacgagtctcacacaagcttggaacaacccgaacggaaatatttgt

SEQ ID NO: 107247 - DNA, 604 bp, Oryza sativa
ttggcataacttttggaacaatcacaattgaatctggatatttaattattcgtctcctctcatagactggaatttgtaaattattcttctacttcctgctcactactttcccaccttttacctaaattattgagtaaattcagacaaaatcaattacatatagcaagcattggcagcaattatttttcactcttaacatacacacaaatgaaaaggttagaaccagattaattttttttagaatgatccaactttgcatcaactctgccaggtcaaatgtagtaggagcaagaacaactactacactatatgcaattctaatatgaaataaagacaaacagtggcatgcaaaatactcaatacatatgcatcatgcatccatatcaagttgttctgagattgcttccatgattgcgtggtggcactcaaaatcacagctaactaagtgcagtttagaggtattatcaatgtttgcacaaatcagtatgataagtatcatttagtggttgaacatccacacccacataatagtatagatcttagtgtccacacaagctagaagtacttacttcagtacgagtagtagtatcatttagaggttgac

SEQ ID NO: 107248 - DNA, 686 bp, Oryza sativa
tgctatacatctcccgggtgattttttttaactgatatttcacgtttttctatccatagaattcctcgctaggatttatgcaataattggtggaggctgcatacgtgaataataccatgcgtcgaatggtaggcttggttcttttccctttacaaatttttgaaactataaaataaaaaataaaatacaaaattccagtcctatataactaaaattacatgtgtatattaggttgatatgatatgtaagcacattgtaattttgtaattttgataaaaatattgtgtaagtagatatgtattgattattttctttaaaatataaaattatagtaatatataactaaaattacatttgtaaatttagttgatatgacatgtaagtacactgtaattttgataattctttaaaatataaaattataatcctatataactaaaattacatttgtaaatttagttgatatgacatctaagtgcactgtaattttgataaagatattgtgtaagtaaatatgtatttattattttctttaaaaatataaaattacagtcctatataactaaaattacatttgtaaatttagttgatataatatgtaagtgcactgtaattttgaaaaaaatattgtgtaagtagatatgtattagttattctcttttatagtcaattggatgtaaatctaa

SEQ ID NO: 107249 - DNA, 599 bp, Oryza sativa
tcattagctgacagctgaatgccatctttttttgacagaacacaatgcaagtagcaggttaaataagattatgatcttaaagttagttttgataaatggcctcacatactaataaccgagatcaacaagtgtatcaaataagtacaacatgcttgcaagttgtaagatgctaaaaaataattgaatgctatagaaaagtagagtagctattgtatgattggtaatttaacctagacaatcacataggttcgtcaaatgtttaccaatgttcttgtttacttgcgattaatacaactatcctacatacgatgaaatcttgatcaccagaaaagaaatgtaatgtttcatggatgcaacaagccaacttgatcaacaatataaaagaatgactatgcatgttcagatgttaatgtttagcacccagatatgctatatcacacataatgcatggatttaaaagaatggaacaaattcaacagtccttaacgatgcttggaaataaaaaaaccacacagaacataaggatactggaaaaaagtttggccaggcttaattgacatccgcgagggtttatgttgcccctttgataagtttttgaa

SEQ ID NO: 107250 - DNA, 1372 bp, Oryza sativa
ccatataaaaacttttaataaaacaccaaatagaatcctaatgacgattaaagaaggaacgacaagcaggccatggagctaacgggcaaggcggtttctgcgacttctagaaagtaaaaaaaagtaaaccccattgataattatattcgacatttaaaatctcaacgataataaaaaggagaagcagcgggcggggtgaataggagtgtagttgcagagccgccgacagttggctggacttctagaaaataaaaaatgaattccaacgatagttatgtacaattttcagaatcccaatggcaatgaagagtaggcggcggatgggccgtaaaggagtatagtggcatcgtttgacgagacttctaaaaattataaaaaatgaaacccaacaagacaataaactctaaaaactaccagaaccaaattttaaaggttcgtaacttctaaaaagtaaaaaaacaatgataatcatgttcgatgttaaaatcttagtgacaataaagaatggaggcagcgggtgagccgcaaaggagtacaatggcaaagtgccgctgacggtttggcaggacttctataaagtaaaaaaatgaacccgaacgataattatgtttgatttttaaaatcccaatgacaataaagagaaaagacagcggacagaccgtagaggagtataatggcagcgtttgacgagacttctagaaattataaaacgaaacccaacgaaataataaactctaaaaactctaagattcaatttttaaaggtttcaaggagattgaatagaaatagtggtagatcgaacaagcaaataaataaggatatgatagaagtaaggggtagcggttggtgtgacttttaaaaactatataattagaaatatggggatgataaggtttggtctttcaaagtcttaagacaacgacatagctatttaataaattttaagtaaaatcatactaaaaatatatgattttgtttgggtgctagccgcgcagttgtgcgggccacccagctagtttttataatagtagagatgtgggcaacgctagacagacttacattatgaaacggagaaagtagtaagcaacttggctatagatgatttggagctagtagttggctatactattaaacttgctcttagatgcggattcagattaaacgtgggcacgcaaaacaaaatactccttccgtcccataatataagagaaaacggacgatatgccattctataagatgtgttgggataaaatgctactcaatacaaatgcaccggataaaatgccactcctaccggatgaaatgccactttgaagattttgtgcctaaaatgtccctggaaatatagggaacagagggagaggggagggcc

SEQ ID NO: 107251 - DNA, 1407 bp, Oryza sativa
agggacattttgggcacaaaaatctccaaagtggcatttcatcctgtaggcaacgcattgagtggcattttatcccaaaccatcttatagagtggcatatcgttcgttttctcataatataagaagttttagagttggacacggttattaagaaagtaggtagaagtgaatggtggagggttgtgattggatgagtaatggaggtaggtgggaaaagtgaattgtggagggttgtgattggttggaaagagaatattggtgaataagttatattttgggacaaatactaatggctaaaagttgttatattttgggactgagggaatagctattagcgcataattaattgagttttaattattgcaaacttgaaaaatggatatatttgatattttaaagcaactttcatatagaaatttttttgcacgaaacacacccgcttagtagtttacaaagcgtgctaatgaaaaccgaggtaaaatcttaatttgaagccatcaatgatttttctagttttcgctttactttcttcttcttatttgtttcttttttaaaaaaaacagatcttatttgtttcttctcttgtgaaatacctcacaaacccagtgtctatatcggtcgggcgataggacttaggtttttttaggaagagtttgggcggcgtcacgtctgcctctctcctactcttccttatatattgacacttgttaggctcgggggttttatctctaactaaattcgagtccattttataccgatcacacaaaacatatttatctcttttagtttgttttctcgttagaaaaagaaaccggtatttctttactaagggggtgttagattcaggggtgtaaagttttggcgtgtcacatcggatattatatagggtgtcgcctatggtgttcaggcactaataaaaaaaccaacattattaaaccacgagacaaaattattaagcctaattaatctgtcatcagcaaatgtttattgtagcaccacattatcaaatcatggagcaattaggcttaaaagattcgtctcgcaaattagtcacaatatgtgcaattagttattttttagcctatattttatactttatgcaggtgttcaaacatttgatgtgacactgtgaaaaatcaaccaacaccaacatcaaatactccgaactaccgatgcagatttggcgctcgacgcgccgggtcatcacaacaaacgagaaaatagtgggctactcagtaaaccatttctagatttttgagtgattttattttgatactacaaagtgcatgtttctttcctagagcggatacctttttttttttttttcttttagcaggggatgatgaagtcacagctgtgacaacccctgtttgtgaatatttgtgaaaattggaatatgttcagaaa

SEQ ID NO: 107252 - DNA, 1541 bp, Oryza sativa
gcgccgtcccgttggacgacggcgccagccactctggcgccccaaaaaggaccatttctgggataagtttttctaggggtctatttgtgaaataagttttttaaaaagaccaaaatgtgaaaaatccagattaattttacctgctctaagaaaattctatctgacgtggagtccttatcacacactattaattttacctgctctaagaaagttctatcaagttgaaggaaaccatcatcaaactctacggatgtaggctatgtttagttcacgccaaaattggaagtttggttgaaattgaaacgatatgacggaaaagttagggtgtgtttagttggggaaaaggagatttttgagtgtcacatcggacgtttgaccagatatcggaaggggttttcggacacgaatgaaaaaactaatttcagaattcgcctggaaaccgcgagacgaatcttttgagactaattaagctgtcgttagcacatgtgggttactgtagcacttatggctaatcacagactaattaggcttaaaagattcgtctcgcgatttcccccataactgtgcaattagtttttctttttatctatatttaatgcttcatacatatgtccaaagattcgatgtgatgtttttgggaaaaaattttggggaactaaacaggcccttaggtggtgtttggatccagagacttaactttagtccctatatctagacactaatttagagtattaaatatagactatttacaaaactaattacataaatgaaagctaatttgcaagataaatattttaagcctaattaatctataattagagaatgtttactgtagcatcacatagactaatcatggattaattaggctcaatagattcgtctcgcgaattagttcaagattatggatgagttttattaatagcctacgtttaatatttataattagtatccaaacattcgatgtgatagagacttaaaagttttagtcacatctaaataggacgttagaagtttatgtgcaccgaaaaattttgatgtgatgaaaaagatagaagtttgaaaaaatattttgaaactaaacacgtggtaatctccaaatgatttttcactgccatgactggatcacactttacgatgccagcagagtgttgacgagaatgctccttgatgtcctggatgacgcacctccacgaagaccaagatgtatttaggaccagcagatttgacttgcggctttgttcgttgctacctgagtcgcctccttaattaagatggcgtgggggcttacccaaaaacggatcgcagaaaagtaccctatagtttgtttcattttcatacttatggattatcaagaaattttatatccaaatcccatatgtcatgtctaatatgtggccatcaatttattagcgatatactccctatttggctaggttgggtaagcatgtgtgagtgtgtgaggtgattggccattcaaacaggcttaaatcttcaagtctgaggtgattggtgatccataattcaacttggcgtaactcgtg

SEQ ID NO: 107253 - DNA, 696 bp, Oryza sativa
gagtcgatttatccgctctgtcaaacaggagcccaaaagtcttcatcccttaaatgggactgacaaggggcacccctcgtgtcagtcgccatttaatttgacaggccccatcatcaagacgacatgcgcttggcttcccaagttaagagacaagacatgcatttaatgcaaagattgtaatatttctccactaagttaggttgttggacccatgtggtaaccccttaaggtataaaagaagatccaggcctacttagggagggggatggacggattgagggggccagcttctgcccctcatgatcaacaccttctactccaataaggagatcttgtaatttctcccacaatcagcatagcaaaggagtagggtattacgcttctcagcggcccgaacctgtataaaccccttttgtctcatcgtcttggaggggcctaaccctctcaagatcacacagtttcgctctccaagccttcgaatctcacccactgcccccggtcaaacctaaaaagggaggcctcacggttccctggaggaggagttcacccttcgacacgcacgttaacgttgttgtgtactcgtagtcatccgaaaatcagacgatctagttgtgtgtgtagcattttcgaaatatttaatctcggatggacgtcaagatttgtaccatgttatctggcctggaacacatttttagg

SEQ ID NO: 107254 - DNA, 672 bp, Oryza sativa
atcacatgttacgattgggccagcgttaggaatcccggccagtaatggtatatatcaaaattgtgaaagttacaatggcatgaatgcaattaagatttgctaacaatacttaccaataccacataaatattgtcaaaatgttggcattgacataaacttacccatattgcaaatatttttccatggttacaaaccaaataagctcatcgttgcggcatcggtgcaccactctccctgccttttgaaaccaaactcgacaaagaaaaaccattttatgggaaaaaacaacagaagggaaaaatctataattgaagaaaaaaggaaaaacaaagatagaaaatttctaaataagtagaattcggaagaaaaaaaacttttaaactgaaactcaaaaggaaaatattagtatagaaaagataaatgatgaacaattgaaaactcctgaaaaaatcaaaaaggataaatgaatgatgaattacattatgcaatgttctacagtaacagatgttccaaagaactccaagtctacaaacattcagttgatactaattaaagttggatcattttaattattttccttgaatgtggaaattatcagctaccttttatttgttttcacccaaggaacttagtacattaccatttgaaatagggtaccgagctcgaattcgc

SEQ ID NO: 107255 - DNA, 657 bp, Oryza sativa
gtcaagatcatgtcaagactatcctcctagctcaacccaaacagaaggacccgctaaggtttcgccacccgctggtccccgacaaggtaaaggttgctgatcccccgggacgagataagccccctcttgcgccaggtcaaagtcagccttccctggccccaaacctatcataccgatggcctttgttttgagatgatctggacttctagtcaggctttacccattagacttgtggttgcactgttatgcttcgcaacagaggtccgaagaccggtccttacagtggccgaggtgcttctaacaaaaccatgcacctcacgccccaccaaaaataggtttagagagttttgaatgagattccatcatgtccaggctcaaccagccacctaatcatcattctcacatattttagttgttacccacaggttaatgtataaaaagagattctatgtttgatctaagcgtatataagcccaacctaaagcaactaataagtccatcatatagggagccatactagtcattttatcattttactaaggttgtcaagagcatgggtagcaattcaataacatggctatataacaaggatcatatgaatattaactattaaataaataatagtgagcgtcatataatttataaaagcgattcata

SEQ ID NO: 107256 - DNA, 846 bp, Oryza sativa
caaaaattcaaatagattactatctattaaatacattcgaggaatgatggtcaggctattctggatatgccagccaaattactttccacatgtagcataattgtgcgtgtggttttaatttagttcagttggaaaaatgtatggaacaattcaagggcagcaataatattacacatcagaaaataggactgccatagccaagggaatgtattagtggtaaaaacttactaggttgcggctttaaataaagataactcattaacttgctgacatagtacgacactaaaatccaaacaagagaaggtacaaatataacatttgaacataatacaagactgcatgtgtatcatatccgagagcagcatggtcataaagacctatcaaagggatcagatattgacaaatcatgggtgtgcttgttcatactgaaatcactcgtatgggtagttttaaatgtaaattgagcattttgagatgctttcttttctaattgaagccgcctgtgttgattggccaaccatttctgattgcaattgttaaggccagctaactccatttctcttagcgcttttgcattcagaacaaagaacttggcaaagtcgacatctgaccttcttcctccataatttcttatcaccacttttttgagatggaactgaatgcattctattggatttagcgggtcatacctccgcgtatttttaataaccttaaacggttgagactgtaaatggaaagaaccatttgaaagcagttgctaactggttagcaatgtaatacttgacaagagtataataaaaaatgggaaatacttacagcaatatacagcctctccaagcaggggaa

SEQ ID NO: 107257 - DNA, 1176 bp, Oryza sativa
acatagcaatgttaagaataggactcctttgcggcaaccgggctctgccggcgagtgtagtgcggcgccctccgctgggatgtcgtcgagtggagagggcgggcctgcccaatgattgtcctcggtggtgtggggagtccagctcgcgcaacaaggctataagctggatgcttttgctacaaccaggctcagccaacgagcgcggtgtggtgccctccgccaccaccgtggagacaggctcggggttcggcaagattgatgccaagatttacgagctagaaggaattataagtcactagaacggataccctcatctcaatcgggcggtaagccccatctcaatcgggcacagcgtccgtcacagactagaagttactgatgtgaagagttatctcaatcgggcaaacggccgtcacgaatgaatatatctcaatcaggccctaagtaaagcccgtcaccgatagttttaacccagacgaccagtcaaactatagcccatcacagatgacctatctctatcaggccaaacctagcgcccgtcacagatgactactaacctttatcgggcctaaactagagcccgtcacagatgatactcatctcaatcgggcctaaactatagcccgtcatagatgactgatgacctcaatcaggcctaaactagagaccgtcacagatgactgctgacctcaatcaggcctaaactagagcccgtcacagatgactagtgacctcaatcaggcctaagctagagcccgtcacagatgatctcatctcagtcgagcatttagttatggcccgtcacagatgactataatccacaaaaaaaataaattttgttttttggctagcctcaggcctttgctagccatgcctgctgcaaaaatgacagaaacaaacatagatatccaatatccccagctccccagcatcacccattcatacatatgcattcacatatacagacatcaacatatttcacacaaccacacattcacagccatctcatatttcacatccattcacatatttcacatccattcaaatatttatcatatttcacctgcaaaaccgagttaattggatcaaatatttatttagcaagtcttaacataaacatatgaaatatatataaatataagcatcacagttacatcaccacagttgcataataag

SEQ ID NO: 107258 - DNA, 753 bp, Oryza sativa
  unsure (1)..(753): unsure at all n locations
ccacaatgttaaaagcaaaattggatctatagcaaagttatcttttttttgttttgtagcatcgaaagttcattgttcactttagtagaacataaattcctgccttttccctacatagcatttccatcgctccaactccctttctagttttctttgactgaaatcgacaaaaatggcaagacaattgacactatagggccaatttattcttgtccctattttgatgttcaatattaattttgcctctgctttttagggtttttgtttatgcccctggtttcttgaagcgaagccaagttttatctctactttagaaggagatgttagctgtgttaaatttttagcaaaaagacatccatacccttgcttgctactgtacattccgaactttggcagattcaaatcatcaaagaaaatctgacagattctagcgcagcaagaagtggcataagcaataaagcaagcaccagctccacatcttttcttcagctagcaagcaaccagcaactcctcacctcttcagcaagacagttgggcgttggcagcgatgccgcgaggccgtgagagacaacagcatgacgcctcaccgacgttgtgccggcaagcaggaaaggccacgccgaaaccattcacaccacgatggttggacgtaggggtgaaaatggagcgggattcgaccggatagtagtattccatattctaaaccatattntgttagcacattccgaacgggtgccgatagtgtaccgatgt

SEQ ID NO: 107259 - DNA, 568 bp, Oryza sativa
ccatgtgtattttaggaggatagcaaatagtaaattttcctctgtgaattgggatagaggcaaggctgcactatgacaccgatttggcagtgatcttgttagcataatggcaccaactctcggaccttcatagcaaggtcaataagagagcatgttgttagttcagaaaatatctgtcatctataagaaataataaatagcgtatctaatgtcaaaagtatgaataaataatataacacaaatagtactatgaacacaaatagtaccatctcttctactcatctcttctcttcagaacgacgatgactgcacacggatgcgttggacgatggcagcgctcgcggcggctagggtggatgaggacggagctgcagcggaacagggttatggcgatggcggcgcctgatggatgagggcaacggcggcggacgcgacgtggcgagcatagtggacaagctgtagcgacgaacacgatggcggcagcggcagccttggatgaggaccgtagccgaggtggacgaggaccacggcggtggcagcagagggcatcgatgatagccgcgactaa

SEQ ID NO: 107260 - DNA, 580 bp, Oryza sativa
taaaaaccaaaggctgcaactaatgtatctctaataagagttgatctgacagcaaaaaggccaacaccaaggggatgcggagcgtaatgagtgaccataatacccagttcattctagagatggttacaaatctgcaatctgtgaacatcccattcatcttttgcacttggggttcaatcttatcaagcacgtaagcttcatgctgcttttaacgagcaggaaccgtaatgtcagctttgtgcaaacgatttggactaccatcttgaacatgatgaccagctcccacgaatcaccccggattgaagacaatcttaagacctgtttagtacagcttcaactcctaaaattagctccaagagttcgatccaaagtagagttctggagctgtctaaacctagctccacaactctagttcattttgtgagagagctccacctagctccactcccagttttggtggagctgaaactgtttggttgagctccagatctaagagggatggaacatgagctggagctatgccaaacatgcctttagcatggcaagaatttccgacagcatattgaattgagaaggattg

SEQ ID NO: 107261 - DNA, 708 bp, Oryza sativa
ctatatgcttaaaacacgttgcactttgtaaaatctataagaaaatcattataactccattgtttgtgaaccaaatgtgttagtcttagaaaacacatctccacacccctgtaaagtctaatataataaaaatcactttacaaaagtattttataacactacctaagactatactactataaccgaataaaacttctaaaattcataactccctaatggaataagataaaataaaatttctttcacctaaattcattttagaccagtacctaatcactgtgcattaatcatgcattttagaacattttggattttcagctcttttggtgtttaattgcataacgtgcgtgtcctttatctagataattgcataatcggtgaaggagtggattaggtgctaacatttctctgatcaaggcaagttttctcctcccatactttgaacacattgaatcccatgatttgaggaatgaaaatatttgtttgcaaagttgcatgtgaacttagactatatcggtatttgaaattgggttaaggtagttatgacctatttgctgcatatcccaccttgaataatggatcctcttgctgtttgaacccctagaaatggttagagtacactctttatgctcaaatgggtttatatatgctctttgtgcaactacttgcttagccatgcttagaactatgcaaatgctcattccatct

SEQ ID NO: 107262 - DNA, 652 bp, Oryza sativa
tgctgcgggaatttagtatgataacaataaaaaattaacatgtaagatagctagataatatcagattaagtaaattaatgtggtttatgataatttaaatttaaatagtatgtagaatggtgattcaaacgtaaaaagtaaggtggtatgactttatggaagaagaaaagtagggagataatttggaccgtagattaatcatctaaaggctaaaaacaattgatgtgatatgacttaattagaggaaaaaaaggagaaagataatttggaccatagattaatcatttaagcactaactaagtgaggatgaactatataagtatataggatatcataaaacataattaagatatacattgaaacattatgtgaattatgttggataataatttaatatgtttgtatttgaaaagctcttaaattataaaaactattaagatataagcatgtttgcatgatgtttaaatgtgatgattgttaatggaagatgatgtggcatctttgcatgttaagcttaaggaggtagtgggggataactttatagtaagatatgattcgtacattcacatgtgctagtatgggatggccttagctggttaatatatttaggactagccttgcattctggtaagcccgtgtgtatgaattagtc

SEQ ID NO: 107263 - DNA, 646 bp, Oryza sativa
aacgcatgaagggaggagatgaccgcggctcgacgacgattgctgccgtccttcttcttcgcggccggttacgagattgagagcgccggaggagcagagagccttctccctcggcttcttcggtttgagagtgaggagtagtgatgggtgaagcggctgggagggaagagatcaagagatgttgggtttggagcggcgacacgtctcggccacgcgtcgacgcgccccagagctcggtcggctctctctctctctctcgttctctctttttctctcagtctttagatcggtgggaaggatctgcacagagttggagctagcttgtgacaccgtcaggtgggcccggggcgaagtacactaagctggagtgtggggatgggtagaaaactgtgtgaaagagatttttggacgaaatttcagattattttctcttccctaacttggtaattcatagattaattccaggtgcatatgaggtcgtgaggattttattggagggtaatgaatgtacctagttaacgttttctactcaaaaattatggatagattgctcacagaaattacagaaatttaaagaagatgggcttattggaaacttatttgaatttttaggagaactaagtagagaagattaattcttgaaaaa

SEQ ID NO: 107264 - DNA, 651 bp, Oryza sativa
ccgtcgggttctcgtcgtcgttccgaccgctgtagaccaagccaagccgagccgtcgcgccaacatattctccttgaagtcctcctcaaaacccttcaagaatcccaggcaatggcgcagcaagtgcggagatcggccaccgtcttcttcacctccggtcgccgtcgccattgtcgattccgcctcctccggtgagccattattagattactcgcgcacacaccatctctctggcctcactaacctcatggacacacatgcatgatagttcttggagccgattgagccgtcgccgttcaccccggaggttcttgccgccgccgagccgttacacgagccgccgtcgtcaacctagcttcgccagccttgttttacatctcggtgagcacactggaccccttagaaaagcacatgcatgcactcccttagtcgattcgcgcctatggcacaacatgcctacccatgccaaaacatcctccgctcggactcgccgccggcgttactccgatgtccactaaccgagaaaagtataggaatggaatcacaataacatgatcttcatttttattttggtcgtacccccaaacgagtcatcggttgcccccggcgagctcgagatcgagctcggccatggcgctctgttctcgcagg

SEQ ID NO: 107265 - DNA, 803 bp, Oryza sativa
aatttttgtgtagaggattttaaatggaatttaaaggagatgaaatctataagaagaatgtttgtggactttttgaatttgactagaattcaaaggggaaaaaattctaaaggaagatatttgtgaaccttttgaactttggacaaggaatttaaatagagttaaaggaattttaaactagaggaattttgaaggcagggttttaaataaattaataaattttaaaggagataaaatttaaaagaggaatgtttaagggtctcttaaactttataaaaggaatttgaatataaggtttttgaagcaaaaggagtttaaaatacttataaaataaaatcaagatatttatttttgagatataaatttgaaaaggataaacattaagatgctccaattttaaaagaattcaataagaaccaaatataaaacttatcacaaagattttctttaaaaattaaattaatcaaatgggaaggaaaggaaataatttaatttctaactttggataaatttgggatggtggcaaaaatagatggaggtaaataactaggattttagcctccaaaatatgtggtatggattctcggtgaattatttgtggctaaaggaagttggattttgagtagaagggattggaaataagtttcttagcacaagagcaatcattcaaatatttgtgataatattattctttgtgccaagaatgtgatcaagttataggaatcgaattggtgcatggatcaaaataggaacttaaccacggggatattttggaccgattaaaaggagacaaatgtttttgg

SEQ ID NO: 107266 - DNA, 1616 bp, Oryza sativa
agagattacagaaaataaatggaaaggttttataaaatttaaaagagagcgattaactttgcaaataaagtttaaatccaagttaaaagaaattaacagaaggcaagatcacttcagaagaatcgagaagagtgcaactaaaatatttcgcaaaaatttttcccaaaattttgagtccgttacaatcaagcatgtaagataaaagaagttagatcaggtaagatcggctgaaagtccgatactactctaatcggcaaccagaaagcagactagggattgaaattctaagcacgacttaatagatcaaactcaactgatgtagcattaagtatgaaaagaagaacaatatctagacaatcaagccgctggatgtttcatagagtggtagatatcttatataatctaagccaacctcactatttaacataatcggccgccttctactaacagatgttagccgattatagattagataatgataatgtcagagattatatagaatatatggtaactcgacgaattacataaacaagactagagtatcataaagatggaagcactaatcccgagaacgcaagccatcataataagttttacctcttgttgaagatcgaaaccgatgcagctcaaccttacatatggctcggggtctatttatacccgagaaatacaagatatgtccatattggacacgactcttatctctaacaaactcttagataccataagtctttgcggcagacttttgcccacatttatctctaaggaatttacataaaatatcctaattaatagatacaattgccttctcaggactctatccatgtgcggcaatcatcttgaagcacaccaactcgaacccgatgtcgtacaaaagtcgtattgtcggaatcgactgtatcactcaacccagtctgactcggacttagccgatcccagtcgtagccaatccggactccagccgattcttactctgtttccgcaacaatccttatctccgattccgctttgatcccatcttcatcttcgatgctgatattaccaaatttggtcgttaacacttgatgggataattacagtattagacctttttagtatcagaatgagctgcatgctcgagacatctggccatgcttcatattcgtaattatccaactaaaatacgactgaatggtgggctgtgggtgcatgggtttgctagttgcacccatggcaattaaggaccggttcgcgggatgccttggaagaacttatcgtacttaccacaagccagcgtaggcaacagttgggcttgtagtgtagctttcctctagccgacatacccagacgagggtgggcgtgatggagttgggtcggccggggtgtccgattgatcggcttccggattcaccgcggcacgagataggggctgcccgttgcctgctagggacgggggcgaaccctgaggtgtggtgcgatcggttagagggtgttatgcgaagggtcctgtcacgacctctttccggtatgtcgtggtgtcatgtcggcgcacggaaacgtgtggtggggctgtgtcttgttggtacagttgtacacctctgatcagagtaaaactattcgaatagtcgtgcccgcgg

SEQ ID NO: 107267 - DNA, 1464 bp, Oryza sativa
tgaagcggctgggagggaagagatcaagagatgttgggtttggagcggcgacacgtctcggccacgcgtcgacgcgccccagagctcggtcggctctctctctctctctcgttctctctttttctctcagtctttagatcggtgggaaggttctgcacagagttggagctagcttgtgacaccgtcaggtgggcccagggcgaagtacactaggctggagtgtggggatgggtagaaaactgtgtgaaagagatttttggacgaattttcagattattttctcttccctaacttgttaattcatagattaattcgtgttgcatatgaggtcgtgtggattttattggaggtaaatgaatgtacctagttaacgttttctactcaaaaattatggatagattgctcacagaaattacagaaattaaaagaagatgggcttattggaaactaatttgaatttttaggagaactaagtagagaagataaattctgaaaaaattatatttattcatgataattaacctaatatttgaataaattatttcccctatacacttccatgcagtttaatgcacaattagtgagggtaggtttttagccgattaaggattataattaaactattatttgactggtttgactgatttatttgagatattaaatttagttattaaattgtaccaaaattactatgagttgcatgttttaagtagagcctacatgaattttcccatgattttatcttgcacaaattattttagataattagcaagacttttctttatataggtttccaatttataaatggatctacatagttgtaagaaatttatttagactactcttgacctgaggtggtatcatttgacttcattttcatgtctttataattattgctcaagtgtggttataggtttgcttagtgaatctttatcttttatttatgctcatgggtcctaatatgcaatgccaaccaaaaatccaaatgcataaagaagactcaagttaaaatatgttttatgcaagtatgcatgcttacacttgtgtttgcatctatgctataggttaaagatgaaaaagtttgttctcaaattttattcatgcaagagttagatcaaagtttacctaggtttaaaatggaaatttttggctcccaaaaataaaaaacttaacttccaactattttgacaggaaatttttaaggtctaaaatttgggtatgttacacccaaacccaaaccagatttgctcctccgctccaccatccatcggcgcaaccacacgaccctcacaatcccttcactagtgccagatggaccaccggtgaagcaaagagatagaattggaggactgttattacaaagaacgccatcattttcacccatgcgacgaagtaggtgaaacgaagcccatagccaatcacaccccataaaatagaccaccgagacaagatggatagggacca

SEQ ID NO: 107268 - DNA, 1782 bp, Oryza sativa
tagaaccgaaccacactagagctactaaacatacagcagcagtaaatctccaatccacacgaaaatcctctcaatctattcacaaacaaaagaacctagtttccccagcgccgcacatcaccacaacagaaccgaaccactagagcagcagaggtaaatctccaatccacacgaaaatcctcgcaacgtaaccacaaacaaaagaactagggagaagaattcgagagtggacgaaccggactcctggagataccggaagatgaggaagttgagctcggccgaggtgattgcccccataggcgccggtcgacgaacgcgtggccgccgccgagacgggaaggctccggaggagaggggagaggggagaggggagaggggagagtggccaaggggacgaaaccggcgaagggatggatggtgtgggtataggaaaaattgatggattgagaattttaggtcatctcctgaagtcagtctggacacggtcaggatcgcgtgcagaaaaatcggacggggcatgagccccgtaggcatggacgggcctagaccgttcgtttgctttaagatccgtgcacaactggaatactaaatgctacaatgtaattctattgtatttaataacttttaagatcttgatttttctgttcgtcacacaaggcacacgtcgaccgttgccctttgagcacatagcatgagagcatgaatataaacccaaataatagttcgatatgaagtagatgtcaaattaatagtttcaccatgtataaccagattaacaattttgttggtcatctcgttatcgtcttcttttaagatctatatggcacgactattaaaatttgtcgatggcaaaagtaaatatttagagaggcatacttgttaacatagtcatggtattattccggtgcaaatgggcgcatgtagcacgagatggtatggagaagataatcacacaatattctacatgaatggtgatggcgtgctgtacagaacaagaggacattggtgagtaacataaagatcagcaatttactatcctctagattatgttttcgaattaattttgatcatgcgaacctatatttgctcactagtcaagaacgtctttatatacgatattcctagtgctcttccctgtggggtctacttctttctttggcttggctaaaatccttgttgtttgtcttgacacaccccttaacaatgcgacatacaactgaccatgtgaaaaaataggctatggatgatagatcccaacatttggggctgtgtcttgtgggtacagttgtacacctctgatcagattaaaattattcgaatagcagcgcccgtggttatgggcaatcaaccggattcaccgtgattagtctcacccctagtttagcttaatggaactggttagttcaggtggtggattggccctgtctcaacgtggtgtagtgttgagcagtgattggttaatattgattaattactattacagttttactgctttcaactactgcttttaaatgcctgctttatgcaaataaacctttagcctcctttggatatatcttgcatcataccttctcttctggtatgacttgctgagtgcagtggatagtactcaatcttgctctctcttccccacaccagagctgaagttcttctcagttgggctgtctcagagaagttggtttcgttgccgccgtcaagaatgcctgtggaatggagtcgcctcgctgcaggagtcaagtcttcaagcttagctcgtttttatctttctgttgcatttgtaaa

SEQ ID NO: 107269 - DNA, 686 bp, Oryza sativa
cgtttgaatcaccattctacatactatttaaatttaaattatcataaaccacattaatttacttaatctgatattatctagctatcttacatgttaattttttattgttatcatactaaattcccgcagcaatgcgcggggtttcacctagtaactttaaatgggtgacacaagttcggtccttatggacttgggcaaacactccccctatcggtatgcaactaacaccatatgcacaccacttgccgcccaagtataaaatcacattttacacattttagttcacaaatacccatcatattcattttattcaagcaaaggttcatgaatcaaaatcacattttaattatagatggaatgagcatttgcatagttctaagcatggctaagcaagtagttgcacaaagagcatatataaacccatttgagcataaagagtgtactctaaccatttctaggggttcaaacagcaagaggatccattattcaaggtgggatatgcagcaaataggtcataactaccttaacccaatttcaaataccgatatagtctaagttcacatgcaactttgcaaacaaatattttcattcctcaaatcatgggattcaatgtgttcaaagtatgggaggagaaaacttgccttgatcagagaaatgttagcacctaatccactccttcaccgatt

SEQ ID NO: 107270 - DNA, 575 bp, Oryza sativa
tttgatatcaaatttgctattttaagattttatttgaatttctttaatttattcaaatgccatttgaataaaatttgatttaatcttttaattgaatttacaacttaaacttatatttgctttccaaatattttcttttatttccaaaataccctgtagccactaaaaagccgccggttagaactttacgccttccatggggacgtttgcgcggtctacgaacctcaacgtcggaccgttggttgtaaagctcggcataaaccaaacccaaggttgaagtgctgctcctggcaccccacgccttgatgcgtatagcggtcggagcttcactatcccctcgacctccattgcacgccgcacagttagctctcgggctctgtgtgatccaagccgctccgccgccactcacggttgtcggagtaacacttccgccccactaaacctgcacccacctcctattcttctagccgatatgttgtctatcgacacggctagaaatgatactaaacctagtcgtcatgatgtccaactctagcgacgactagcaaacacctaaaaccctagccgatatttat

SEQ ID NO: 107271 - DNA, 836 bp, Oryza sativa
ccaacgcccacctaaccgcatttaaggcagtgtgagcgagcgcaccacaccgtattaaatacagcacgtggtgcgcctgaccggaccgtgaccagtctgtgaccagtcgaatgaccgatgtgtccagggtagtgcgcctgtgcactggttgcatgtcacatcccctgtcatgtccttagcctctcatcacaaccagccggaggtggtttgtttaacccggtcagggcagggtttccgtttcccgacgcgagtgagaacccaaaagtcttcactcattaaatgacgaatgacatgcgtgtcccccgtgtcagccggatagatttgatagggcccacgccatagcgggcgtactagaggcttctaaggcaagaaacaagacatgcatttaatgtgattatcctccctagatagactcggtggacccatgtggtaaccccttgagatataaaaggaggtccaggcctacttagggggaggggggatgagcccttttttttttctctagatcagttttcatggggatcatcaagagtcgacctccaggcatgcgatcttgtaaatcttcacacgatcagctaagcacaggagtaggatattatgcttctcaacggcccaaacctgtataaacccctttatctcattgttcttgaggggcccaacaccctctacaccacacttctcaccgagtcctcgaatctcacccgctgtccccggccaaaccaacaaagggggcctcactgtcccccgcttgcggagttcaccctccgacagtcagccttctcatctccatgcctccttccttacttttcttataagcccttgactatgcaaatcta

SEQ ID NO: 107272 - DNA, 676 bp, Oryza sativa
aggtccttaagtcagtttttgttaaaaaaaataaaaaaaaaagtgagaaaaaaaagggcagaaaggtgcaaaaaaaaaagaaaaaaaaagccgcaccaaaaaaaaatcagaaaagaaaaggaaaaaaaaaagaaaagaagaaagaagaaagaaagaaaagagaaaatattgttttgtttgagctgaacttcatacatcagagtgtgcttgagttgtttctggtgctattttgtggtaccgtttgtgtctaggctcgcgtctctagtacgttctagcctaggaccagcacggtacttgactttgaacaattattcaactttgcattatctgatttgagcatttgctattcctttgctacgtatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatacgcaagataattggggatagctgtgctcaacatcgacatcttcgtcgagacatg

SEQ ID NO: 107273 - DNA, 647 bp, Oryza sativa
cggcttattttttgccgacaagattcagtgccgaggacaaatcacgtctgctctaatgatggatcggctactcaatctatcgggacctcctcttggcagcattgaaaatattgagttggctggattcagaagcaaaaacttcgacagatggtggggtgaatagaagctacatctgtttcatcaatcagccacgatgtatatgacagatctgtcccccgacgtcataccctaggtaaacattgttactatcaaattgcgtagtcaattaatcgatttattacttaaccaatcttttgctcctgctttgcagacaacagagtcctcccctcctcaccaaagcaatagtggcaagaacattgagtatgcttcgggcttaattccaaatggaggtgggctatctccccctgttattggctactatgcccccaagacctcaactctccttcacggcctaactagagaaccagccgatgcaggcccaaaaaggaaaaccagatcctcggctgtgagcacttcaatcttggctccaaagaaaaggccaagttcaagaaaaccaaaccgactgacaagccgccgatgatctgccaccttggatccatctattgaacaagccttagatgaagagataattgagacgaagttgatca

SEQ ID NO: 107274 - DNA, 646 bp, Oryza sativa
ccaatattataatgaattgcttatgctaacaatagtttacataaatttttccatgatttcatcttgcataaattattttaaagaataagaataacctttctttgtatatgtgttcctacttcataactgcacctaatattattataaggattacattaaacttcttttgggctgtgaaaaagatattagaatttaatattaagtccacatgttatcaccctatattaactgtagttttgtttagtaattttaacccttttagtttatgctcatgagacctattatgaaaagcgataccaaaaaccaaatacacaatggactcaagcctaggcatgcattatgcacatgcatgctcaaatgcttgatgatatttctagtctaatattgggaatgaaaagattttattttgttctcaaatttcaatcatgcaatggtttaagttggtcatcacctaaattaaaacggaaatttttggctctcaaaattggagaagttaacctctaactattttgacaagaaattttaagtcctgaaatttcgggtatgttacaaacatacaaattattagtcaggttctctctactatgatcttcccacgggattaaataaatacgatacccttggaatactctcgggtgaaatgcta

SEQ ID NO: 107275 - DNA, 675 bp, Oryza sativa
tcattggacgcatgcaaaaatttatcacatccacaacacaaccctgccacgtcaacaaaagaatgatataagcttatcgctagagtgctagaccagcctccctccataggttttctcctcgtcatccagaccatgcacctctctggacatgcccccatgtcaagctcagttaagccatgtcaagctcactggtgggttcttattagttcctttcatcagttccttctgaattattaagttcttctctaagttaggttacatggagcaaaactggatgagttttggatttgttcttcttacttccactttcatattttagaaaatagaaacgaataatacaagtattccaagaaggagcacatactatcatcaaggctttctatgttgaattgttgaaaaagacaaatactgaaatgggaaataatgtgcatagagagacatatcgtcatgttggcttgtttgcaaaaatggcaatccctctcttggagtctatgtatcgtattcatgcccgtggaaccatatatatcaactgtgggtaacagataaatgagagaatatggcataatattcttcttgactcgttaggcacttctagaacaaaaaagcaccatagtagcacgaactccctatagcttggttctgaactctggagtctgagccatattttactctctg

SEQ ID NO: 107276 - DNA, 670 bp, Oryza sativa
tgttgaccacctcccgttttgtgcatcacagccaccggaacgtgaccacgccaacaacgccctgaagcacgcactggagcgccaccgcttcgacatcattgtcgaccggccattctcgtccatctcgaagcaagccgctgtgccaagaatctcgcctcgactacctcttcaagacgcctcgagaaccccagccggagacgtgaaggacttggagaacgcatcttttcttcccggcgtcgatctaggatcgcctccgccatcatcgtcgattaccgctgcctcggtgagccattgttcgattcctcgcgcatacaccatctccataacctcacgaacctcttggacacgcatgcatggcaggtccttgagttgttcgagccgtcgccgttcacctgaggaggagcgccgccgtcgaacctttccaaccgaaaccgctgctatccaagcttcggtgatttcttcctacagcttggtgagcctcctggacctcttaggaaacacatgcatggatgcatctagcaaaatcaaagcccgtaggcaacatgcagtaacagctcatgtatacctaccgctcaccctccaatgtctcctagccaagaaaactagaggaatggaatcgtgagagcattctcttcattttataatttgacctcattcccaatcgagccac

SEQ ID NO: 107277 - DNA, 667 bp, Oryza sativa
atcatccatttaaacaagttactagacattcctcgtaaacaagcaattcattaatatttacatttcttgatacccatgtaaccaatcttgtgaggaagaatagagagtcatgcattaaatccgaaaaaatcattaagatgataagttgttgaattgaaatatgcctatcaaaaatttttcagatttagaaatatgactatcaaaagtagatagaggaagtactatacataacagtcagaaaaccaaagctgactaacaaaagcgaccaaaatacctcgttattaattctaaaaccaacttataaaaatcaaaatagctaaaatcaaacagtgaaccttaaccaaataccctcagggaaattctgacgacgatgacatcatagcaactcagtcaaatggtaccatagcaattaagcatttgttatggtaatgacaaagataatctcgaataaacaattgttactaatatagtactaaatacgatgagcattgcgaagacatgatgttggaaagatttcgctctacacataactatatcctatggtcagtttctccgcaaggaaataactgtacaagcactggcaaactaaaggtacctaaaacctagagttaaggcaataatcctgttctccccagctgatcacggaagaacagatagccaagcatct

SEQ ID NO: 107278 - DNA, 658 bp, Oryza sativa
  unsure (1)..(658): unsure at all n locations
tgagccatattatgtaccatggtatgccttgagggataccggtagcggtaggcacgaccggcgactgatgtggccccaggcttgaggtgnatgcggtagtcgatagcccgtgccgacagcaagcctggggttcggcgaagaggtcctctaattccgccaggagatgctgcaaaatatcgtcgatgtcgatcgccactcatcacatcgggccctgatcagcgaggctgtagaacatgacctcgcgtgtgctgcgccatatggccatgcgcatgttcttgaaatcccacagtattggccccaacgtttgcaaccattgcatgcctaggatgatgtcgacagcacacaagtcaagggcgaagcagtcgaccgagaaggcctcgccatcgatgttgagcgcgaggttgcgacacaggcccgggctgacaaggcgatcaccattggccatgacaaagcgaagtccctagcacaccggctcaagatggaggaggtgatgcaccacctgtgcgtcgagccggagtcgacgagtgccacaagcccacaacacgtatgtcggctattgtaaccggaagcctcatggtgctagctccgtcaatgcctgatagcgtgttcacttgtggcaccgcatcgtcgttggctccgtcatcatccgtggagtcat

SEQ ID NO: 107279 - DNA, 706 bp, Oryza sativa
atggacttcccctcccaaggaattgcgctgtgcaccccatgtccttgcccgcacacaccatcatggcgaattatggccctatggggctgcctcgccaacctctccctccccaaactgcaaactgcaagcatgtgtcactctcagactctcctaattgcatttcttccatcatcatccctcatcatccttgcaggccaaagacatcctctggtcagtgacgaggaccaaattgtggcacagctatgcccttaaagagtgcggcagtatttttgccacgtcctacaggagaggtgctctatagagggattggtagttgggtccatctgtttgctcccctctgatctggtggtgtgctcatgaaatacattcccggtgtacccctcgatctccctctagcacgattgctcaatcctccctgctagtattggattggttatctgttatggggaggctacttgatttggtgggttcaatgatgactgcacatactgtccagttgctgatagctatagcgctgcctgttgttgttgctccaatccaactaagagttagttgagttaaatattctcacattgtgcctagaattttcacccaacaagtgtgtaaatgttatttagaacaatattacactaatagtagaaaactcacattatgttgtcaaattaattccagtgttagattatttcctattatgttctttccaaat

SEQ ID NO: 107280 - DNA, 1381 bp, Oryza sativa
actgcttttaaatgcctgctttatgcaaataaacctttagcctcctttggatatatcgtgcatcataccttctcttctggtatgacttgctgagtgcagtggatagtactcaatcttgctctctcttccccacaccagagctgaagttcttctcagttgggctgtctcagagaagttggtttcgttgccgccgtcaagaatgcctgtggaatggagtcgcctcgctgcaggagtcaagtcttcaagcttagctcgtttttatctttctgttgcatttgtaaatcttttatatgtttgtaagacgtggatctgtatgtcaaaaattgtcgcttgtgtaccctagctggtcctggataggggttttaatgtacattcagcttagaaattctggttcgtgaatttatgggcgtgacagtagcgaagtatctgctaaggtttagttgtttgctagtcattgctagagttgggtagcatgatgactgagtttggtatcttctctagccggtgtccacgaatagcatatcggctagaggaataggaggttggtgcaagtttagcgaggcgaaagtattacttcacaatcgtgggtggcgacggagcgactaggatcgcacagagcccgagagttaactgtgtggcgtgttgtggaggtcaagggaatagtgaagctccgaccactgtacacatcaaggcgtggggtgccaggagcagcacttcgaccttgggtttggttctgctggattttacaaccaacggtccgacgtggggcccgtagaccgcacgaacatccccatggaaggcgtaaagttccaaccggcggctttttagtggctaataggtattttgggataaaataaaatatttgaaaataaaatataagtttaaattggaaattcaaatataggagtaaatcaaatataaactcaaatggtatttaaataaattaagaaaattcaaataaaatattaaaatactaaatttggtatcaaaatgtagagtttgaatttatatgaatttaggtataagtttcactataatcggatctacactttaggagatatgggcttctaaagaataggatttgaattaaataaggaaaatacgaaaagttactgtgtaggggcccacctgtcagtatagatggccatgtgggcagcttgtcgggccggcacggtccgaccgacgcaccgggctgtgccgtgccaacccacgtgccgcactcacggcccaggcatggcccaacacgactcgggccgtgccgggccggcccaaaggtagagatggcccatcgtgcttttcctcagaataagactaattttcctccctcctattgggctgtgacatatatattgctaggaataagttcacttggtgaccctca

SEQ ID NO: 107281 - DNA, 1207 bp, Oryza sativa
agaataagactagttttattcttttctcctttttttcgactttcatctcggtgatttctctatgagctttatcagcatgggcaaaacgatatgggccaagagcccaaagagaggtaggttggatatggcagtagtactatgtgtgatttatttctaactcgatttgttcgccaagattttcaacatattgcaaaccccaacgctaggggggcttgggggaaaaaagattgtctaaaatacaatttcatttagaagaatctagaatacaatgggtctccttaacaattagaccaagtgaccagtccgactaggtagattagtcgtgctgtcctaaaacagcgtcaatataacttaatgctatttttctagattacacgacagagccacacatgtacacatcactatatacgcaaatacgcaataccacactgacaaattttgctataacttacaatcgtctaaattacatctaaaacaaaaatttagataaagaatcaattatccaaaatattaagttaattataactatcactgatcgattagtttgatgtatttgtgacatccgcatgcatagtgttactacatacccaccttgatcactacatatatgcatgtactgattaaccggccagcatgccatttggcctaattagaatactcaggagcatttgatatatttcccgtgttctctctttccgtccaacaccaaaactaatactccctccgtttctaaatatttggcaccgttaactttttaagaacatgtttgacctttcgtattattcaaaaacttttgtaaaatatgtaaaactatatgtctacataaaaatatatttaacaatgaatcaaatgaaatgaaaaaaattaataattacttaaattgtttgaataagacaaatggtcaaacatatttaaaaaagtcaacggcgtcaaatatttagaaatggagggagtaaaatagtgggatgatgtccagtagcaaggagccacattataacagtgtgtttctctaaataaatatttacttttacgctacaactaaaccacgaagtcgcaaaatccaataacagattttaccatatttggtgtttcagaaaagattaagtacccaaggataaaagataaatgtggcataaacaatatacatagaaaataaaaaattgttagcatttcatgttcacattgtaaactatttaaatttatctca

SEQ ID NO: 107282 - DNA, 660 bp, Oryza sativa
ctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacggctgtaatcaaatatgtggagctctgggtaggcttaaatacgtagcaaaggaatagcaaatgctcaaatcagataatgcaaagttgaataattgttcaaagtcaagtaccgtgctggtcctaggctagaacgtactagagacgcgagcctagacacaaacggtaccacaaaatagcaccagaaacaactcaagcacactctgatgtatgaagttcagctcaaacaaaacaatattttctcttttctttctttcttctttcttcttttcttttttttttccttttcttttctgatttttttttggtgcggctttttttttcttttttttttgcacctttcttgccttttttttctcacttttttttttaatttttttaacaaaaactgacttaaggaccttaatgtaagaatacagggacctcaacataaatattaaatttat

SEQ ID NO: 107283 - DNA, 661 bp, Oryza sativa
atatttgcgaataaatgaggaatttgacaaacaaaatgttgaaaaacttgaattttaagtttgggcctcatgtggtatacatatgttgactagttgtataccgatagggggagagtgtgcccagactgatctaaggactatactcaatgtctgttcattatgtttaccgtacatccacatgtgttattatggggtgaccttggcctactaagttaagtgctggtctaaccttgcattcgggaggccgttgtagcattcgggaggccgttgtagtagcgatagtgcctacgagtgaactgtagggctatttgtgtttatgtgtgtattgcaaaggagatgactgtaccaatccgctttttatgtgtatgatgtttatgaggggacgactgtaacgttccgcctcacttttatttatggtttggtagggaacgactgtactgttccgcgtgaggggacgactgtaatgttccgcctcacgtacaacgttgagtgccacataagaagcgattgtaccggcttgcctatggcgttatattggtaaagaccccccaatataatgacattaagattctagaattagtgtggaacaacacctattgtgctcatgcaaggattagacaagacttaatgtaaaagcctcggtgtgacctctagactcgct

SEQ ID NO: 107284 - DNA, 790 bp, Oryza sativa
agaagaagatactacaagcaaagcattggctcctttatctgatgacgtgaagaaaactcaaggaagtattttggatcggctagaggcatcatcactagacagcttagtagttgactgtggctcaatcaggctcggctgcatgagattcaagccttaatcccggatgagttagccgacatccttactccagctgtttaccttgagcaacaccaattcaagctggagaaagccaagttaagattagtcgaacggcgagaatgtaagaacattgaagccactatccaagccagccgacaacttgtgcatgaagagaaatccaagcttgaccaattatctgaaggcccaatcaagtctaacattgatcggcttgaggctcacaagattgacctcttagcacaacttgaagaatgtaacgccgagctggatatggagcgcaagaagctagccgatctccccaagtctattgaagaacagaaagcaagacttaaatcggctatcaagcatgttgctgaactgaccaagtccctaaaagttatccctcgaaccgatgctcaagatgcccaagccatagaagaagtagagcagattaggcagaaggctatttcggccatctagcgatacttatctcagtagtctttatgtaataatacttaagacttttgtaatcggctaaaacattctgatactttattgtcttaacaaccctttgcgccgattaatatgactttgaaatttgctcaaaaaattttggtactgcatactgcattttggatatatatatgccccccta

SEQ ID NO: 107285 - DNA, 687 bp, Oryza sativa
  unsure (1)..(687): unsure at all n locations
agaatatattagtttggatcttttcaccttttancaattgtatattaggcttgtataacaaaatttgtataataaatcgaaagctgttctgtatatcaatttgtacgtgatcgaaatcctagacgatcacgagtggattttcggggcaccaagcctaaattgggtgtcccacattgatcgatatgttaaatctgccctttacattaagattttgttgcatttaagtatattgggcttctgtttggtatattctacttgctttaacatctttatataaagtagtatcggagtattaaccgatacatgctagatctatctgatcggctatgctatgaatatattaaatgatttttaatcccgaacgaaaatcggggcgttacactgggagatctacttaactccagtgcaggtccaaggatagcctcgagtgtgtcaaaggcgtgccagctgatttgatcatgcaatcaacaagaaagacaaaagcataattagtcagtcgatggccgatagcgtatcattggtggtctcagccgatgtagttagaccaaatcggctatggacgggatagatcagggaataaaagaccctaaacatgcctcatcggctgtaacactgcctattaggtttaagaaagaagatttaagacaatattatgaaaatagccaatggaaaaatatttagagctga

SEQ ID NO: 107286 - DNA, 643 bp, Oryza sativa
  unsure (1)..(643): unsure at all n locations
atttcctatacttctaatatacatacatacaaccttagtcaatattatctactatataatcacatagccaaaacccccttacgatgccctcctggtgtttcgagagaccacccctggttgccgagttccttacgacaacccgccatgaccatccaaccggggctaaatatggaggagtaccctccccaggaaattgtaattaggattatatacacgcgcgaaggaatacccgtactgagctgtcaccatcagcggcccacctctacgtatccgcagcatataaccccaaataatgatattcaatagcctaagcacatcgcttatgttaaatgattcacttgatctctcaaagtgtatgaatatgaattcctcaccaaattttcctttttgattcctactctaaagttgatatgtggagcttggtactctaaagtccaaggccaatcgtttcatgaggagggtgttgatgcgaaaaacacgaggcctgggagatctgcttaactccagtgtaggtccaaaaatcttgcccttaggttcgtgagcgtgccaagtgattagatcctgcaatcaacaagaaataaagacaggaaaatagcagttaaattcataaatgatagccgatcagccaatcgncgatgacata

SEQ ID NO: 107287 - DNA, 628 bp, Oryza sativa
ttatttaaaacccctttttgaatttaaattcctttgatttatttaaaatacttctttttaaaccactcatataccatcctttagccaccaaaaaactgctgtggaaactttacgccttccatggagacgttcgtgtggtctcaaaccccgacgtcaaaccgttggtcataaaacccggtataatctaatcctaaggtcgaagtgttgctcttcgcaccccacgcctcgacgcgtatagtggtcggagcttcacttctccctcgacctccacagcacactagctttcgagctctatgcgatcctagccgctctgctgccactcacggcaatggagtaacactttccatcttgcaaacccccacaaattttcccgactctagccgttgtgctgcttaactgtagcatcgactagacgagccaaacatttagctgctatgctacccatccttagcatcggctaaccaactccacatatctagccgtcgtgctgccctattctagcaccgactaaaaaccaatccaccaaatagaccccacctatccaaaattattctttatttgattttattcaatctccaacctgtagaacacctctctttatttttcaaataaaacttattttaaaccc

SEQ ID NO: 107288 - DNA, 642 bp, Oryza sativa
agtaggttcatgtacactcggctgtaacccgaaaactccttttcggtccacgcgtcaacagcggcccccagcagaacgtattgacccaccgggcatacataaaaaccatattggctgaacctctagtgtatacttgtatgaatccctttgcctcacgatagagatatctctccataggaggggtaaatcccatcttgattattcatatcccactacatgtttcatagcatgcccgaaaactacttttataactacccaattacggagtagcgtttagcagtccctaagtaagctactacacatgttgggaaccatgataatctcaggtctaaggattcaacaccaacactaactgagatcaatgatgacacaacacatatggctcttgcagtgtctcatgttgggtatatccaacaacatgttcaccaacatgtgtccacattattaatttggtatctctataccatgatccatgagacatgatcatcaattaatatatgtgctgatcatctaaacatatttgttccacatatgatatttgatcagggatcctttagaaatagcaacacacaacataaagagcctcatgaaagaatcacatattcattaaccaataatgagttatctatttcaaggaacaaa

SEQ ID NO: 107289 - DNA, 642 bp, Oryza sativa
attttgaattcaaaaatttggaaacgaaatttgtgcggtttttcgcggtaaccgcacggttaccgcagtaaccaccataccgcggggggtcggtaagcccccccaaaacggtaaggtgaaccctggttggaacccattatggttgcgtcgagagggggttacacgaccctaaactctatatatcagtacccgccgccatctttaagtttttgggttttgcttaaattaatctgtcgagatcatttttgccgctagatcggtttgtaagaccccaactcgtgagcttaatcattcatctgcaattttggttattttctatctcgttcttgtttgtgttcttcgattggcaaatagggattagccttctcggcgaggtcatctgtgtttcggcacgggtgataaccagaggagacgtggtgctgcgattgcggggctcaagagcgtgcgcgttcaagaagcctgatcgatttatgtcgcgactccacccaaatcgttgtttatcagaacctttcggaagatcgggaaccctagtgcacatcagctaagtggaagaagaaatagaaagcactcaattcctatacttctagtatacattcaaattctaatttacatctgctaatttacaatcatgtgggcaatatc

SEQ ID NO: 107290 - DNA, 755 bp, Oryza sativa
ttggaattaatccttgaccaaacctttgatctagtcttatctctaattcttctctatcctgacatgttaccaatccttctgtagatattccaatagtcaaattcctttttcgatcgagcctccaatttaatccctatggcttcaacctccccggcacaagaatagtattattacaaattttggaatgattgctcttgtgctaagaaaatagattttaattcatcgttctcatccaaaatctaaattccctattagccacaaataattccccaaatattcatactaccaatttaaggattcaaatccttttttttttgcctctaagtattttccttccttattcccaaaaatatattttgtgagtaatcatattatttatttcccctcctatttgagtgctttaatatttagtccaatgtattctttctctcaaaatattgcactcaaataaactagataatatgtcttttggaaaatctttcttttgtgaatttcctccaaattcaaattctatccaaaccaaattttctaaagcccttctaaaattcagaaaacatttatttgggccgaagtcctctcccttctcccttccccacctcttttccctacggaataagttcatctaaggtcccttaacttgtcaacgaatccgattttcatccttcaatcggaaatccagataccacgggttccctcaacaatcaaaaccggtgcagatgaggtccctcagcggtttagatggcggttttggctgg

SEQ ID NO: 107291 - DNA, 608 bp, Oryza sativa
ccacaagagctcgcgcgtgacaattgaatttagatgtgagttcgttcctatgttcttctttatatgattttgagaatagattgctacctaatgattatattatgattaggaacaatggagaggacaaggagacacttaaagagggacttagaggcgtggaggaccagcaaaggcgtccaagtcaagatggaggcccaaaccaagtcgacttcgagtacgtttcggagtccaggactagtttgctctaaaacggacgcgcaggtcatatacgtgtttggattggggcattctttatatggatggaaagctaagaatataaaatttccaatggttctggtcccatgtccaaattctttccgagtcatcgggaatcgaccgaacaaattgacgtccagaatctgtttcggtgctgcgtcgccgtattttgccctttgggccgtgcatcgtgttggagcccattagggttgcgtcaaggggtgttgcacgaccctaagactctatatattagtagccgccacaatctttaaggtttgggttttgcttaaattaatctgtcaataacagttttgccgatccttcggtttgtgagaccccaacttgtgagctta

SEQ ID NO: 107292 - DNA, 1080 bp, Oryza sativa
acacatatttcaccaacactagtggaattgattagtaataatccctatcactaagttggataccatgttttatttcattatatgcaggtattgacggtcaaatattatgatttaaggaccgtcaacaaagattgataaatatacctcaaggattggtaccgtgtgcgccatttatgcgaatctgcgcaggctgcttgtgaacagaggaatctgctaccggagagctggatcgccggagaaggttgccggaggattagggatttctacaatgaagagcttgtcgaggacatagccggacaaaggtgttttgaaggaatgggcctctacttatgagctaaaagttaaaacagaaaaccctaaatttttgcgggttcaacaagagcaaattccactgtattatataatacagcggaattgggggcatgtattaacaacgaaattttgcattagattcggagaaaaagaagaaagatcaaagcggatttggtgtggaatcaagttgatttccaagtcggactgtgcatcgactgagtatcgtatcggctgaaaaccggacagaggcttgacttgatcaatatggcaagcagccgatatagtataacttgggctcgatatgggcctaaattaagataaccgtcactgtcaattagagatagagctcgaataaggcaattgtatctattaattaggatatttaagtcgattttgctagatttggcaagatacccccatatatggtcttgtttgtatgttatctttaggaaagtttgaattgtgaccataatggactaagtttgtactcggggtataaataagaaccctataccactgtaatacgggagacaatccaatacaactttggtgcatcacaacccttttttttcttcttttcggcaagttctctcgataaggggtaacccgtctcgatggtgtgtgccagggttgacgttaccactggtaaccgtgcggttaccaggcttaccgcgggggtacggtaatataaataccatggtaacctccttaaattcaaataaatttaaaaaataatttgaatttttgataaattttgcatggttttgt

SEQ ID NO: 107293 - DNA, 669 bp, Oryza sativa
acttaatcagctaggtctatacccatacgagaattgaggtcgtactcgtatgttgttcacatgtacttggcaattttatatcggttggaacagtactagccaccccgaaattaaccatttctaccatactgtcccaatctaagttaattaaattttatgcataatctaactaggcagggcttagcaaaagctagcatatctggtttgctatgttcaggttatgcatttgaaatcatgtatgacttatgcattgaacagagatatagaatatagggtatttatgctcaaaggagaggaataataacttggcttgcttcaacgcccattaataccaaataggccacctgattatctgatgcgtggaataccataggttggcattcatattaaattgactctactaaaagaagaggaagaacccaattcaattaaagccattacatagccagaaagagataaccggtaggagggctaggtttaaggtatagcttatctcttttatggggtatatggattactggctgatattttatatgtgggttcttaaagagttggtggctggcgtagagaaggaattaaaccgctaaggtcaccctatattttatgtgcacactcttattaagtggtggataggagtatagtggataattgaactggttgagcagatat

SEQ ID NO: 107294 - DNA, 2054 bp, Oryza sativa
  unsure (1)..(2054): unsure at all n locations
actacgccgctgctatcgccaagagtggagagaggagaggagaggcgtgagagagaaaaaggactgagaggagatgctctgcatggaaattttaaagtggaaaaagggatagaggggaggggagaggagagaaagaggggaaattttaaagtgggtgagagagganagagggagttagtatttttgcatgcagctctcttaataggtccgtacgggaaaatcgactcattttcgcgtgctgtccatttaagaggaccgcacggaaaaatcgatttttcccagaagcaacgagttaccgcacgaaaaaattgatttttccgtgccatcctctttaatagaccgcacacgaaaatgagccgattttcccagaagcaacaagataccagtccctgtccaagaaaatcgtttctgtagtagtgattcatgaagttccttctctacttgatcgatccattttctttgtttcttttttggcatagatcgaacacttggtggtgcgctcgtcggcgttcccagtgtccagagcgccaccatcgccccactttgtcattcccgtcgactcgaatcatctccggctgtaccattgcgccactgacgtcgcctaggtcccaggagaacgacgcccacatatgatcaagccaatacgccgccacgaacgcggtcggtcgccgttgctctcctactgcctctgcttctcttgccgccgagtcaccgacatgtgggcctggctgtttagccacttcattaggtgctaaggactttaattagtagaaatttaaatcttgtaaggttctttttgtaaaattgctttgtttgccatgtggacttatggacctaaatgcaattcacctaatgcccagggacttttttgtatagggtttagggcttaccctaaaacatgaaattactatttcatgcattcattacttgatataatagcttaatgagtatattgtactcacccttgctttaacccctctttcagaatcaatttggagtttttgccgaagccaggagtttaatcagataaattggtttcattccaacttagttcccaagtatagattagatagatggtttaattctatagcaaaacattagacttggctcatcctatagcttctacagtaatagttagccactaccctattatttcatgtaaagaaatctcctttggagccttaatcaaatgtatgcgatgaagattcagattgttgaacctgtatcaatctactaatacaggggttgatacagtttaaatatgtcggttaccgaatctttaattttgggacccgacatggtgtgtgggtgggggcccctgcgatttgggagcctagagcggccgtaccgcttgcgccccctcccccctgaggcggccctaactacatgggccttaaaaggccaaatggcatcttatgacgaattctgggcttgatggcgacgaaaatggatgccatagactctatgacgacagaaagatcgtcactagattaatgacaaaaagataagctttctttatagaacgccattagagacgcatgacaggtgacgaatcatattcgtcacacgaatgtcacagatttcatagcatgacttgaaattaaatttttatgacgtaaatgagcgtcacctatcataagattcttgtagtgatggcttgtttggctattagagaggcagtttgagacatacagcacacagtttcataccgtgtgcgtgcctagttggcaactggatcctagtagatgcaaattttgaatcattcaacccaacccaatccttcttctcttaatcttctcttcctacacttgtgtatttgtgtttgtgtgtgtgtgtgtctaagaggctagtagagttagctatcctaaaattttttgcacgttgcagctactaactgtgctgctggcttgtcgtcctctgcttcaacattaaagagagaactaatagatcggtgatccactttggtttcttggatgctatccagccacgtcaccatgcatgcgaattttgtggatggagtcagtggctctgcatgcacggagctgatttaatta

SEQ ID NO: 107295 - DNA, 3634 bp, Oryza sativa
agttttttttattccaaactacgagtagcatgcatgcctttgtcagagagagaaaccgatggaatatgcctcgtttcaaaagtccatgcataatgtgcatgctttgtggattcgtgctgtattttcctgggtagataagaccaaagaatcccacttaccaactaggttttttaaaagtctggtacatcgtgaaccatgctgcttcacgtggtcggacctatatacgttaggatcaaatgtgctcaacgtggtctggcacatcatggaccatgctgcttcatgtggtcggatctagatgtattaggaataatccttttcgtagtagtgaaactaaagaacttcacatgccaattagtttttttagagtccgaacaaagatgaaactttttggaaaggtgctccagatgaccaagttcaattcaccaactgaaatcgcacattggattttacatgaaaaatgcaagatggacaaaaatgatttctttcggttctaaattaatactcccggccatttgggaggagcaatatgtacatatgcatgcatcacacttcagcatttttgtctttttttttccttggagttttaagaatgctcataattagggcatgcaagttgatccattgatatattcgcaatatttgacgatttgtttttcattttaaaaattgttgacgatattagcttaattttggtaaggaaaatatcggttaatttatccccaatttttatcaagagagaaaatgaaccatgagaattggggtgctaattaaccacaagcaaatattcatcttaatttgttgtatatatatatatatatatacacgagcatgcatgtaaagatggaaatatgtgaaaaatataatggtgctagtagatttgtctaaaacacttccataatactatgatcaggacactcgataaggacaaagttcaattttagggattgtgtcattatcaaaattatcaatgaataattggccatagggccgggattagcaagggtctactactgtcctgccatttcattaattaattagattaagtccccgattccttgcatcccaaattggcctacgagaaccgacaaaaatcgcaagatgggaggattgtggtaggttatcttcagcaactgtgcctctcaagtggccataacatattagccagaaggataaataatcatcaatctgccttcacagttttgatcatctcatgagacatatatataaaccacccattagcaagagtctcctaggtgaattaattaactatgttgatacacatatacttaattggtataagaaaaattagtggtcgttaattagtataaaagcatcaatcaaatggagactattagctagctaggagaccgggcaagcaaagcaaagcattgatcttgatgaatcctccagagagattaattgcatattgccagttcctcctgacctattatatgcatgcaagtgctctctgtacttgtgcggtgcacggacgagcaagagtgcgtacgtttatagtagaactgagggggtgcgccttatatacaccggacgagcaacagtgcgtacgtttgtagtgacgtctccaattttagtttctatggtagtaaaatattcgacgtttgacacctcaaactgcagaaaaactggagctgtgaaatgttttcttttttcatatgcgtggagctctaaaatattgacagttttgtttttttctataaaaaaagccaagaacagttaacgacttgatgggtaggcgctcctggatggagggagatgagcttaaaaagttgtagtaaatggacccatgcagtggaaatgcggaatggagtggagcagtaataaaatttaaaatgccacgcgcagggcatctcgaccacgacaggactctccttgagatcttcaaacagtgtgtgcttgctagctgaactgcagcagtggaacagtaataaaatttaaaacggatgtacagtgtgttcacagtggacgagtgtgctctgtgttctctgcatgtgaatagatatggcgatctctgcttgtgaatagatttggcgactactattactgggtatacgtggttaggacagatgttagtttgttctgcttgtttggagatggatttgggagcaaatgtacatggttagggcgcaaatgttagtttattttgctgtggaggggagtgggttttgctagaagtagacccatgaattttgctattccaaaattcctcaactagctatcagcctcatcgtttggcatattttctgaatatgccaaacggcatatttgcaaacgaaaatcaatttgtgaataaaacttttatatatgtgttcttagcgatctaaaagcaaagggtgaaaaataaacttcgatgaaaaaaacctcaaaatcagctccaaatttaatgttaaaaaaaatcaaattttggctgataagcatatgaatatgccaaacgatgaggccctatatatctagctccaacaaatctgtgatgcctatatctcactagtcttgctatgtgctatgtcatgtacacgtgggtaaatacctaatttatgaattttgctgtctcatcatgattatggcaaatatacatatacctaactcatgaatttttctatgcctacttctcaccatttatgctatgtctaagctagaagattttgctatggccatacctactcttaaatttttctatgtcggccttgactcagccgccccaatagaagtgacgaaactactgttgttgcaagagttggattccttcaagaaagtgatagatgaatctgaggcatcaagggagcagcaatcgaagaaaattgaaagtttgattggcctaaatgctccatattttgctctgaaaagttgacagttatgttaccaatcatgtatcattgtcattttcatagccttcatcatggcgttgcgaatattgtgaatattccaatggatcaacttgcatgccctaagtgtgagcattcttaaaactccaaggtaaaaagtcaaaaatgctgaagtgtgatgcatgcatatgtacatattgctcctcccaaatggacatcatgcaggatcgggactggacaacacattaaaggctctcatgctacacgcttcttgcagctgtagttaaacaagggcatcaagcggtagttcgataacaataagattcattggccccaacatacccccatccattccaataaatatggcacgcatgtattttaagatttatctttaaccaagaattagtttaaatttacaaagataattgatagaaaattagcatcatttcaacgtgtttttcaatacgaataccacaattctatttatgcattactagtcatcaacctgtgcacttgcatgggctaaaaaaattatgtgacatcaattaactaacgtggaagctttattggtgcatccaattactaaatatatgatttattctttgtttctcaattctttcggtcaaaaacgtgcatgtgtgttattcatagaaacgtatgtagtatttgtaagaagtacaatatcgaatttccaaaaggtttcgaccttgtgcgataatatacacacacattaacctacataggcaagctagctagacctaaaaatataccatttctaaacctattcggtcact

SEQ ID NO: 107296 - DNA, 706 bp, Oryza sativa
cccccaattactaaatatatgatttattctttgtttctcaattctttcggtcaaaaacgtgcatgtgtgttattcatagaaacgtatgtagtatttgtaagaagtacaatatcgaatttccaaaaggtttcgaccttgtgcgataatatacacacacattaacctacataggcaagctagctagacctaaaaatataccatttctaaacctattcggtcacttactcacattggggagcctaactaaactaacatggactcacatggcatgcaagccagccatggtactaactcgtctactacgccatagtacgctacaaacacaactaagttatcttatgaaggactactcaatagtacacttaaaacagtgttactcgttgccttttatcttcatctgacgggtatgagctaagtgtatctgaaaatcatctccttctgtccatcggcgaaaacgtgcaaatttaaaattccttggtacgcaggactagatatgaagagtttgttcagaaattgtgcaacaaacatgtacatccatcaactatatacatgcataggatacatacatacaatgcaggtagccatttgcaccatatccataatatactagtaggcagccatccacaccttatgcataccaggacgatccatttgcacattattcacatcatcacataacgcttctgcctatatataagagcagcag

SEQ ID NO: 107297 - DNA, 954 bp, Oryza sativa
attgaaacaaaaatatatgggttaaagcctcacatgctaaccgtatacttgacactacacaaaagtagaagcgttactacataataggtgcatgttaccacttccaagtagatatgttactgcatgataaatgcagtgttactatgtcatttttacgagatgaagttcgaataggtgggccataggtaaagtttgtaggtggctttgagcaaggtctgaattatgtaggagtgttttgaataattttatacatttggtaaaaccatgttactgcatgtatatacccctgttactgtaaattacacattctgttactgcatgtggagggctaaagttcaaaatgtcaatctttgaaaagcaatatctcacaagatatgtattattttttaaaaccgtttccaccatgatgttatcgtgttactgcatgtggaggattaaacttcaaaatgcatctacgtactcccctcctcaagaaccatttttcctccctcttcttaagaaaattggtttcctccctccaatatagcgttactgcatgtatatgacgttattgcacttttgaccgtaatattgtggtgaattgcagtaattcaggaattgaaacaaaaatatatcggttaaaagtctcagatactaatcatacacttgttactgcacaaaagtaaaagtgttactgcacgacaattacacgttaccacgtgtttatgcagtaacactactcaaaaaatgtagttagacgctttcttactgcaaaacttatagtcttgcagtaccgttatcaagtaattgcagtaagacactatgttacgtgaaaattataatcgttactacatcttgtagtaatgacatgatgtgattgcagtaacgcaaaacaggcagtagtaaaacttttgatatagtattactacttgtggagagttaaatcttcaaaaacaaatctttgaagggtaatat

SEQ ID NO: 107298 - DNA, 730 bp, Oryza sativa
cgatgttcatcgtgcagtaacatcatgtcttacttgcagtaacaatattgaaacgtagtcataatataatcatgacggatctacttttgataagcactttttttctaacatcatggtgcaaatggtttttaaaagtagtacatgatgtgagagatattacccttcaaagattggttttttaaaaatttggctctccacgatactatatcataagtattactgctgatctgctatgcgttactgcaatcatgtaacgccgttactacaagatgtagtaacgattataagtttcatagtaacatagtgtgttaccgcgattacttgataacgttactgcaagaatatgtatagtaagaaaaaaaggtgcagtaacatggagagagagagatgaattggctcggtttacttatggggcaagtgtcacatcctgataaattcatcccaaaattaaaaattattttctaaaaggaataatagaattaattaaaattcgaaaagaaattggcaaacactaaaatacgtatcagaaaaattcgaatgtggtccggagaatttttgttaaattctccttggtttaaaaggagccctcaaattttacttgaattttcagagctccggaaataattattaagcaacaaaaacaattaacaaagtttactaaaagaaaaactaaagaaaataaatccccctcctccctttgggccccaaagcctccctcccttcctctcag

SEQ ID NO: 107299 - DNA, 1376 bp, Oryza sativa
caagctgagcacccgcgcccccgcgttgctctgttcttagccgccgcgaagtttttccggccgcaatcagtcgtttcaacccatctccgtgagttcttccatttcaaccatctgcatactacgtggattccattttagcaatccctttgcactgtcatgccaccccctgagctgcctacgtgagcacggccaccgccaatggaggcgctcgttggcaactatactcagcgccttgccaaaggtcggcaagctgccggaatccctctaggcacctcgtagatgctctagaacccctcccctaaccatgtctaactctcaacacctcgatcgccatctcggccaaaccgtgccaccgctcgccgtcaccggagatccctagcaccctcccctcgtcggctgcaaccactttccccctccatcgccgccgcaatcgccaaccctagcactgccggcctgatttggggaacggctggaggttgaagaagagaagagagagagagagactgacaggtgggacccacacacagtgccatttcacatttaatcgattttaactttagaagcccatatcttttaaaatatagatccaattccagtgaaacgtggaccaatattcttctaaaatcattcctatcttttgagcccctttttcctatttttgcattttattttattttctctatttttcttatttttggattttatttaaactccttttgaatttgaattttatatgtctaaccctaggtcttgaggattcttctgacacactagataatatcaatcaatctcaggacatcgagcaaggcaacttaccatataccttttgattatttaagcctatattttacaaattatttatttatagcctactattcaatattctattttatatgcataattcaatcatagaaacccagataatttagtattgcttactttgcttacaatctggttaaaataccttatacttaggttgggacagtacgtaagatttggctgatttccgggtggctagtgctgtctcgatcgatataagttttaccaggtacttattgtcgcgtcccaaaacgactctaaaatacatcctcaaaattgtgcatagaataagtaaaatccatgtgaaagcctccaacaattaaaatgtgcaaagttaaaagtcgaataaggcttggaggaattttgtatatttcctaaaagcctaaaatgcgtaaataaattttagtggaattttcagagcacaaataataattaagaagaaataaacaaagttaaaaaggttttataaaaagaaaaaaaccctaaaaagtctttttcccccttccccctcttgggccggctcggcccagctccctccctctctctcctctcccccg

SEQ ID NO: 107300 - DNA, 2059 bp, Oryza sativa
acacaaaaatcttggttgtagtaatgaatggtgaaagtgaaggtgaaaagtgagagctaggtgtcaacatgaggggtagaaacgatttaaaggagttggcagtgatttgaggctatgatcccacttgtacttcactcaacctagcatgagtggctgtgtagtggtcccatgtagatgtttccaatgagaagatgagaggtatggtgaagtttgggtgtaaattggactttaactccctctctctctttctttctctctttgaaaaaataatttaggatcaaagagatgattcaccaaggttggttgctgtgtttggacgacaaatgggcccatatatagatctttcctaaaaggcttggagtggtagagtggcattttgagtggaaattgaatttaaacccttctctaaccttttgagaaataaaagaaaatttaaatgagagaagagcagatgatgtgttggctatggttgtatgatatgtgggccccacaaggatttggtcccacatttaagagagatgtagaaggagagaactagaagctctaaattttccatgtgttggcactatcacaccaaactatattactctctttctctcatacatttaatttagaattaaggggggggggggtgtgggggacagggagacggcaaggtagacaaggatttgatggttcaaggtgccaagttccaaagtttacgtaatttatggctctcatttcatgtggttacatttcgaattagactaagccattgcaccagatggtagagtaaagtatgtttaacattctgaccttgagattttgcaagaggatttatggtttaatttcggtgaaggtgcaaagtaggctaattggtatgctgtttccagatttttagctgtgttgaaggatttatttgggttatcaattgatgtgataaattcaaactaaaattgctgggagcttagggtgttgtttagtatttatgggaattttggtaggatttattgctgattcatttatttttaggaattttctttagacaaagcatgcatatgcaacctatttaaaatcctcttcctatcttttggctgaaaccaagccaactcctatccctctccacgcaggcccaaaggccagccgggtaaagtctatctcttttccctcccctccctaaatcgaagccaataagtctagtttacatcggtctacgaaagagccctagtccacccctgccactgccgatgtcgttggtgctgatagatgcgatgcccacacctcagggattcgcgcggcatggtgtgcagccagtgaatcttccgccgcctcctgtccttcagtcgtctgacgaggaaaggttttaattctcctccgattccccccattgctacataagttagtgattcattggtagatctgcttgtgcttgaatgtgcaagaatgcttggtagatctgattgatgttgaatgtgcaagagtgcaagaatgaatggagtgaactaaagcatatgtcctggtatgcatatttcaaagtactgcgcatatctgtattatacacaagttagcatgcgcattgatcttttcctcttttgccgtaggccctagtatgcatatgtgtattataccatattgtattatgtagttatgctgtgaaattatatgtggaattctccattgcatatttgctcttggttaattagtttaggaaaaattgcaaatatggtttgttgtttgtcgatttagttctccgtaatactgcctaaatttaaatgtatgtttcgtgaactgaaatcagatatggttagtgctgtcataattttttaatgactatttgtccttgtgagtaaggttgtcattcctcgactgtattgcctttagtatggctataagtctcccaagactaagaaaacaaggaatgtgatagcagccgagaaattgaccatgtttcctccccccccacctatgccttcctagtaggattcggaatactctttggcatgacaatcttaattatctcccatagtctaaaactcacaaaaacatcagaaatccgctaagaataaattaagtaaagaac

SEQ ID NO: 107301 - DNA, 880 bp, Oryza sativa
agaacatagttcctgtgaaatgagaccctaggtctcctttgacagtaaacaattatacacataatcccatatcaacatcttccgaaataatcctcatagaacttgtttttattacacatgtctcccttattacatgaatacaaggccttgccttaaacaaaaagggaaggtgcttaacatcggtacattgcatcctcaacatgaatcatccataaccataacaaactcattgtttataatcatgaatgtatttatttattacatgattgctgcaaactcccgattacacaatgataagtagcgaactgaaaaccacaaacgtggctgctcattttgattctagagagatatagctggcattgttctagtgactgcatccttgattggttctgtgatgatgtgttaggactgcatattgctatcattcacaggagaagcttccttctgattgctatttgaagcagagaacggtcttctgcttggtatcgccctcctgagattgattgccctttgctcggcctggagtaggtcggggagagacacaacttcttccatcgacaacaattctttgctgaggctgtcggtgcagagaatggttggtgctgaaggtattattgctatgatttgttgcagagtcaggcgcagcaggaggagcattggtgctgtggatgatatcgtcgatgttgctgttggagctgactagctgacgagacaatcgtagggttgttcgttggatttctgcagtcttgatcaacaacacactgagttggcaatccttgggcacatggtttgtacctttgcacagaaaacatgtgaccttgcgggtgggacactcccctggtggatggtcttcttcacaatgagggcagagtgtgagaca

SEQ ID NO: 107302 - DNA, 509 bp, Oryza sativa
ataatgcacttgcatccaacaataatggctgcttccagacaaggttgggaatcataagggcctctcctcacatgtcaaaaattccacagcaccataatcttttgctttttatgagtgggcaaactcaactattggattggtagctagctactagctcctgattcttttattcctcatttcctcctcatctgcatgaattgaagagggaaatgcctccatctcctgcatgcctgctcttcatttatgacaaaaaccattttgcttgtttgcttctgcttgcctgcatgctatccatggagatagatagatagatctcctactccatttatgagggatgcagttgtctttgtcgacatgtagtactgtttgttgtttacttactagtttgccccttctgttcatgacagttgtgttagttcacctgacatacctggttgcagatattatttacttaagtataatttcaggaaaattgatcatatgccaccctttagattgcatccatttat

SEQ ID NO: 107303 - DNA, 1055 bp, Oryza sativa
cgaattcgagctcggtaccccacagcctatattgaacttattttcagattggaagaaatagacaattagacacacaggcctcttatatatctataaaattcatcttattaagtataggtaatattatttctctattctctcattaagccatatcatctcaattatttctaactcttggatgtttgatatatcgtccaaattatatcatttcctttttttatcttataaaatcatatcaacttagttttgtttttggataattgatttatatacctttttctctttctctcattgagtctcatcatcttagtcttttcttctaaacaattaatccatatatatttaaatgggtgaatagctaatttaatccctcaagtttcaccgaaggtcaattaggtccttcaggtttcattttgtccacgtaggtcctataagtatttgttttggcttaaaatcattcttaggcccacttaatatgccatatggctatttctagtcaatatttctgttagaaaatatcctttttgccaataatttgtatataactatacactagaaaagagaaaaccaagatgaataaataacattgcagaaatacttcccattattttaacatgtgcacatcaaacttaagcaatgtctatcgtatacacttgcaagtacataattattttcgttctacataaattccgatgcattatctataaaaaatttcattgcattcgattttttttctcttatatatgtgaatgagggggttaaagtgtcatttatcaagagagttgttagttatgtttggccatgtggcttctaagtgggttcaaggataaatttgaactaaaataaaaacttgaaggactaatatgtatatattgaaacatcaaggactaatttgagcctccgatgacactttggctattcacgctatttaaattgttataaaccacatcatcaaatgggttataattagccttttttttcaatagtcgaccagagatgaaaattagataaagtccatcaccggtccctaaacttgtaccgctgtatcatcccgg

SEQ ID NO: 107304 - DNA, 541 bp, Oryza sativa
atttacgtcatgcattattgtgaaaggggacaaagatgtttttctaaccacctttgaatataccatttgtgccacaaatgccgctgtcatgttcctgtgcaccagacgggtattctccaacaaacatgtatgttgctcaaccctcgaagctacccataaagtgtcatgttgtggcttgtaaccatgcactctccaaggacatccaccctgtgtgcacttcacgtcatacgtcgtcctatttgaaaccttcaccttgaattcacgcttctggtcaaatgcccacctcttcaccgcatcttgtaagtgacctttgtcatgaaacatctgtccaactttcacctgcttactatcataacaccagtgggcatctaaatcatcgtttaccttcatatgactcattgatatggtcgtccaatcatcgggtatgttagtttcgttgtcccacagtgttgtatcttctccttccactacaagcgcaatgtattcctcgttttccacttccatctaatccactaccgcctcattctcctccgctgaatca

SEQ ID NO: 107305 - DNA, 853 bp, Oryza sativa
ctgtagtagtatctattaagcacaggaatacaaagaaaacttttcaaaaaaatcgttgatggcacctaaaaaatgaaagaggatgaatacacactactacagaacatcaaatagatgctggcactacaggtgccggaagtgctaaaaccggcacctataggcctttttcggcctctacgggctgaaaatacaaaaaaaaacgggcatctttatataactatatgtatcgattctaaagaaaaaccgacacctatactatagatgccggtttttgataaaacccaaaacctttaatttattaaaggtgtcggtttataaccgagccaagccgggtggagacaagccagccgagtgggcatctttttatctctctcgatactgtgtccccaccttatcttttatcctccttccaccggctctctcccactgtctatctcccttatctcttcttctcctcccaccgactctgcggcgggctcgcggaggggacacggcggtgcgcttgctgaggtgaggcggcggtctaaccgcggggaggaggcggcgaccgcaggtggaggagccctcccctccaccagatccggcgggaggggaggcggcaacggacacgacggagctcacagatggaggcggcggtggtctcgccgagggaaggcagcggcggcaggtggaggagccctcccctccaccagatccggagggagggaagacggcggcaggggcggcggggctcgcggatggagatggcggcggtctcgccaggggtaggcggcaacaggcgacgggctcaccaaggggaggcgacacgacaggaggtggcgcacacgcaacggctcgaagacgacgactatgg

SEQ ID NO: 107306 - DNA, 864 bp, Oryza sativa
tcaaatgtgtccaaatacatagagcacaaaattattatattttaagataaagggagtacatagaaattactgggttgcaaatgctagcactcaataccacgcacgcgcaatttcatcaataaccattagagtttagttgttgacaaaaactagctagtttttttcagattatttactattaaatgaattatttgctaaaagaaatacattttctcagaaagctttcttctattaaattgtttggaccacttgttttaagttgtttgttaaatttatttactaaaaaaatatttatctccataatccactagataatccatagcaataatccgcttaataatctatttcaaaccaagccttgaacaaattttactttttatttttgaaaaaatgctcagtaatttgtaaaatatgcaatggaagtagtaggtgggatgggggcaaccaccaccttatttttagtatagtacaatattatatattaaaaatatatgcacacaacatgtcgataacatcaaccgggactaaagatcttcctcttataaactgggactaaaaattatttttagtcccagtttttaatggaaccaggactattgtgaatttgggtcgaccgaccaaaagatggtttctctgccagtgacagcaggttaataaatatgaaggacaaatttgtatgccacacaaatttctgctgaaaatatgatgatttaaataatgataaatgaagtcaagcaaccccacaattataccgtgctccaattcgtagggtgtgtttttattgttcttttcaagtaggatatgatatacatccatccatttcaacaactcgtacacacattgtgagggtgcctcttgtgcaaa

SEQ ID NO: 107307 - DNA, 633 bp, Oryza sativa
cacatcactatataaaagttactttaaaatgtcatattactctatttttcaggtttaaaataatcaatactcaatttaccatgtagttaatggatcatcatctcgtcttgtttacgtatattctcaatcttctcttttcttttcctctcaaacacatccagcaaagtgtacatcaaccatgagttagttgcacatcttctttaatttcacaagtgacccactactgtagctttgcgagttcttatctgcgagtagaagatattactgtgcctaaccctgtaaacagtgcgcccacagggcctacacttgcatgaatcagcaatccacaaacttttagaacaagttcggcagtgatgtttggttactgcggaactccggatgaattaaccattaaaaattaaaaaaagatttatttgatttaaagaaacttatatgtagaaaatgttttcacaaaacgcaccactatactcacggaaaactaggaaattaaagttgcttaagagcaagtttaatagtatagcccactactatctccaaatcatctatagccaatatcatagccaattcatgcaataattgcttactatactattaatacctggtcctacctgtcatccacacattacgtcttgg

SEQ ID NO: 107308 - DNA, 771 bp, Oryza sativa
atgtaattttatttttaagaaaacatattgtttaacagtttagaacgagacagccttattactgtacaatgtaaggaccctggtctgttgtacagtatattgtaatcttgccaagttgtaacgatctggaagcacacactcttctctcttccccgtatcatccggctccacgagacaaccaacaagaccaaaaactttttttttttgggggaaaacaagaccagaaacttgatgagaaggcaaaaataaacccagaaaaaaaaacaaagggaaagatttggccgagttcgagtggattccatcagctcacatgcgctgttgcccgccccacgagagccaatcctgaccgtccaatccgcggcgtcgctagctagaaaattagcggcgcgtcgtcgaggccgcggcagcagcagcagcttgcctgagctgagctgacagatcagtcgtgggtggctcttggcgcgacgccgcgccccgcgcaccgtgcgccgtgcgcgtgcgctgtcgtcaccgcccacgagaggagatccgatcgcccgcgccgcgcgtgttcctgctcttcctcctccgcctgggccggacaaggcgggatcttgcggcgccttcctccaggggatctcgctcgccgcggccgcgcctcgctcgtctcgtcgcccaagaggtggaagaagaggtgggattttactcttttttcttttatcttcgggggtggctctgggcgtagcgggtgggcactaattaaccaaagattagtgtagtaatcaccgggtg

SEQ ID NO: 107309 - DNA, 1266 bp, Oryza sativa
cgcaatgtattcctcgttttccacttccatctaatccactaccgcctcattctcctccgctgaatcaacacgcataggcgaatccggttcttcatcgtctgagtcattggcctcacgattagtaccacgaacaatgacctctccttgtgtattaccctctattacttcttcccctcgaccttgctcagtccgccaaacattttcaacttgtccaccttccaacggagtttcttccaccacggtatgacttgactcccccgatcgatcaacacatgttttcttctacaccactattgccaggctatagcctttctcccttactttactaacaaacttcctaaaactctccggttgacgcaacctccactactctccactgccatccatgttgacccctcactggccacacggcattttatgacaaatttatcatgcactggatctaccccaaacatattatacaaccaccctaacacgtcgttcaaacccatatactccggtgcattcagactagtatcatggaaggcatatacagtcaaatccccccactatcgcatatttgtataggagcatcgccataatacagacgaatgggcatatcacctgacatcctgataaaacatgacaaattgtctgacgttaatcatttaatccttcgataattaccctattacaacttatactacattgccgtgtactaacttacaactattagtaacaaatgactagtttaataatcgaaataaaatataatatctttgtacattttttaacacagaacatattaataacatgtactaactaagaactaatttaaccatacaaatacttacatacctctactaacatttaacaatgacaaatacgtgcaaacaataaatactagcattgaacaatgcgaaacaattaacaaatcacaaaccaattttttattaaactttcttatgcctcatacttagggattactaatgtataccttaacttcactggtggaggggttgccaaccctctcctcccagccggcgcctcctcggcctccactccggcctgctagctcctcccctcactccctccggcgcccacggcgatgaagtggcgactcggcggcggctggcgatgtggtcctcagaaaaatcgaagcagcatcgcgggctgggcgcacagggttttaaaccggcctgtcaaacgtccattgttcaacagggtcggttgcggggcctatcgatcgcccgctgttcgacaggccgcgcggcgctgggtggtggg

SEQ ID NO: 107310 - DNA, 1147 bp, Oryza sativa
cggcggccacgctgaacgtgcggtcgtactggaccaactgctcgagcacctccttcatcgtcggccgcgacgccgggtcttcgccggtgcagatcatgccgagcaggaacaccgccacggcgtcctccaggaacgccgccctgtcctggatgctctcgtcgacaacatcgtgcagctcgccgccgaccttttacctccgccacgcccactccgccaggcaccagtctgcgccgccgtcgttcgccaccctcccgtcgtcagctccagcagcacgacactaaatttgtgatactggccttatcatgtgtagtactttattttgttttagattataagacgttttaggtttttgaatagattagtgcatagaatttatgtatagacttaatacatgtgtttaaaagttatataaatatcaatagatctagacgagaactggaaaagccaaaacattttagatggaacggagggaccgagggagtaggaaagagccaaggactcaagactgcaataggtcaaggtcttcgacaactaaggcgaatcttcttgggcctcttatttcaaatgaaatttgggactatttaggcccacatgtcttttggttcttaaaaataaatggactcttctgctagtggatcctcaggtcgatgccaaagaatactcaggctggacagtttatatatggaaaatggtctgatgttactcctgaatatactgaggctgtgtttagaggtccagggataaaaatttttgctgtgtcacatcggatatacagacatatttaaagtattaaacgtagtctaataacaaaacaaattacagaatccacccgtaaactgcgagacaaatttattaagcctaattaggcttaaaagatttatctcgtaatttacacgcaatctgtgcaattagaatttttttatctatatttaatactttatgtatgtgtccaaatattcgatgtgataggatgaaaaaacttgccaagggatcaccctgaactcattttcattttggaagaactacaacacaaaggtatatatgtaagggtctgaactctgatttccccgaagcaaacaattgtgtccgggccctcatgttccaagaaacgcaaggaaatagactacaattactaagattttacaaa

SEQ ID NO: 107311 - DNA, 602 bp, Oryza sativa
cagtggtatttatttgaatcgacatattttcagtggcatatctgtaatttcgatccaaatattttataattgcattgaagatgtacatagtggtatatctgtaatttcggtcaaattgtaatgacatgtctccaaatagacaaatagtaattgcattttataaaaaaaaagttacagcggcgtggatctaattaacccttatatttttaattaaagacaaaaatgaatatgaataactgaaataaatacatattatttcgaatacaaataaatatttaatattggacacaagtatggaaataaatatttcttgaaacatgaaaacctagctaatttcaaataaaccattagataataggctaaatgatgccgattgaattcaacacatacgatcgatataacaagtataaatacatgtgaaattaacgaagcgacataaatacatgcctattaatttagattgctatttgcaagttgaaataatattaacagcatgcgctagtgttgtaggctaaagcaccattaaagaagggtaattttactatttcttcagaaggtaacggaggtatagattttctactgtaaaatttattatctcaagg

SEQ ID NO: 107312 - DNA, 710 bp, Oryza sativa
cctcatgcaatcggcattacaaatccgcaagcaattctccattaagcttaggaaaagattttgatctagaggactgaaatagggttgttgctcccagcactgacaaataaaggcctcacttccatgtgcatatctgtcaaaatttgtgttatccaaaaactatttcatgtgagaataataatgcatgataacctagctaggaacaaacatttctttccattctatctaaagttgttgggtgctagtggatttgtggtggcaacatataaaggaagaaaactcagttgggtggactcatttatccaagcttcatcgcatataatgatttttgtggatggcatacaatggattccgcttatagtttaactagaccaccctatatatgataccttttttttctgaaaagaaaaaacagcggaggatcgaatagccatggtcaaattatgcttgcagttgcagtccactgaggcacatattctcctttgaaattccaaaatcttttggggacaaaattccattgtgtaccatccatgcaattagaaatgcaagcctgaccatgcttgagccacagctgaaaccatgctgttgcctccattggtgcgaacaaatcttacaaccccagttaacctgtcgacagggctacaaataaactagcttaattatgtaggatatattcttctctaaacaggacctagtacggaactagctgt

SEQ ID NO: 107313 - DNA, 3377 bp, Oryza sativa
tgttttgtcttccccaatcaaatgtttagtttaggccgtgtttagatccatgggtgtaaagttttggcgtgtcacatcggatatacggacacacatttgaagtattaaacgtagtctaacaacaaaacaaattacagaatccgcctgtaaaccgcgagatgaatttattagaattaaatttgaaaatatactgttcattcaattttttctcaggaatattcaggatacaaaaacttgtgcaaaaatataccgtcagtgtcgcacattcgttgcgcgaaaatggtatcacacggtgaaagcgcgagaccgcacggtctcgcggaatggaagagcgagaccgaacggtctcgctgaagcaatcaacgacactgtccaatgggttccatttgattagcgatcgctaatcaggataatgatgaggacatcatccactattacccgctggcaaagatgcaaaagttgggcggcgaccatgtgagcctctgaataatcccaccttgcttagcttgagaggaggaagccactttaaaaggggagagccaccatttccctattggactagtcttttagggagattggacatttccccgagtgggtgtgcctatgaactgttgagatccgggcaaccttaagttatcgagcctcggccaaccccacctgggccggattgttatcagataattaatcgctaattaaatcggcaaggcacggtatcgcagtttgcttgagcgagaccgcgcgagactgtgcgatctcgcactttcactacgcgataccggtcgcaatgtcatttccacgttattttcacgcaatggttgtgcgagaccgatggtatatttgtgcaaaagattttgcataccgaatatttctaacaaaaaattgaatgaacaatatattttcaaatttaattcgaatttattaagcctaaatcatggcgcaattagacttaaaagattcgtctcgtaatttacacgtaatctgtataattagttatttttttcgtctatatttaatactttatgtatatgtccaaacattcgatatgataggatgcaaaatttgcaggagatctaaaccgggccttagtttattgggaaaattgtaacaatgccattataattttgtaaaattgccgataagcacgttgtacgaatggtaggagctggctttgaatgatatcttataaaataatgatctaagatacaaatgtaaaacacaaataatttgaatcacaacgatggtagcatctggacctgcatattttttttaggaatgtgattaatcatacgaaaacttacatgtttagttgccagccacactttaccacaactaacgttagataaattatgacagccacaaaagtgtggtggataaattgctagccaaaaagtttaaaaaaataaatctatggcatatgaaatatattatttaaaaagtatgacaagtcacaactgtgatcataaaatgtggtcatcacatcagcagaagcagtacaggggacggcaggagggccaattgaccgcagataatctttgtgagctgctagctgcgccgtccgtccgtccgtccaaaaggttgacggcgcggcggcggccggcagcacgcgccgcggcggcgctggcccctggccggccacacctacctacctaccttttctttctgcaatttatactcctacatgtattaaggaccaccgtcctaatggcctaaactaaacagaaagtagctagctaaagatggtatcaccgactataccacattttggttgttatatattctcttctcatctaacacacacccacgcctgcatgtattcatgccatgttttttttggatttcttttttctctcggtgaaatctaccaagaataatcttgtagaattgggcattttcaaatttctattctttgttatccgtacaaacttatctagaaaatcctgctattaatcacatgatgatatttctctacttctttaaaagcgtcctccttatgttccctttccttcgtactgatccctccgtcccaaaatatgaacatttttggactttggcacggtctccgagatattactttgaccaacaatatcaatataaaaagtagatgttttaaataaaaaagttaaatattatgatagtttgtttaatgataaatctagtaacatcaattttacatgattgatcttttttattttttggtattaataagaaatgttgaaaatatttgacttgccactatgcttaaaatgattatattttgggacggaggaagtatgtgcatagccacagtaaaatttattgatttattcttagtgatccaaagttttacacaaagccccccctacgtttacacagaactccccatattttgcaagaaaaataacctggtacgaccaacttaactttatttggtattaaaaaaacataaatttattggtgaactagaaaaaagtatccgtgcgttacaacgggtgaatgctattttaatcttattgttgctatacggtttagttatgatgaaattcattgtgagaattcgcttggatagttctttagaaaatcatgagctacaattaggagtccaactttcatcttaagttagcatgcgagttttttaaagagatttcttatacgactctttttatttccaaaagcaaacggacttaaaatccgacttacatacggatatgtgtttccaaaagcgaacaaactgacagactcaaatacggatggtgtaccaagagaccaataaaaacatcttcagtttttataatagtagagattattagtccacccatctagtcaatttctaattatataggcctataccggtgtataatatggacatattacaggttattaggaaaactagagttagaaatgcaacatttgcatagtgctggaggtataccacgaagggccttcggccggacctgccgaaaccaaaaactcgggcaacaggctcagaccggaggcaggcggcgaaggttgagaataaagccatatgggcgtaagccgtggcttgggttacgccagcttcgccaagcggagtccttgccagaaggctgcacgggtgtagatgatgcggcgaaagcctcggcatgaaggcacggtttcgccaaagtacggaacctcgtcgtcgggaagcctagcgggccgctacgtcctcaggaaattttggcagatagatgggccgagccatttaagtccagtaggagcccatatgtgtaaaggacacagtgtgcccttaataatattcctatcataagggtaacaatgaaaattcccctgtaaaatctaaaccctaatagggagaacttgtaatggggctataaatagccccctagggccatataatagggggattccaaaagtttttt

SEQ ID NO: 107314 - DNA, 963 bp, Oryza sativa
agatctacctttctcccgtacgtatgtacggtttgtcggaaggattagtaactatggttgttagaagttgagattaattagctgtcatattgtgttactactaatcatagctatatttattacatgcacggcaatacacacacacacacacacacacacacacatatatatatatatatatatatatatatatgtaagctaggagatttacaagaagattatacatagctaattaaatcagtttacatggctttaccgtgatattatgtagctaattcgaaccaagcaatccagttaaatcgtccagcttaaataggtgtaattaagattacctttttaagttattataatgactttaaaattaaaaagttttttaaaaaacaaaatacatgataattggtttttgacctaaatgatttagaaaaaaatagaaaaacaaagtcccctccacctcaccctcaccattagatacgcacaacactttctgccccctccacttctctctatattttttgagtagctatgataaagagaaacaaccatggttattttaagctacacatatcatatctaatctaactgttgctctatacataattaaaccaacaatttaaaattcaaaataaattaaaatcgataatacatattaccgtcagaacaaaatcaatgatctttaaaatataactttttaccatataaaaatatattactccacaaatatgtgcaaatataaactagatctataatataaataaaaaatatgaaatcaattatctctaaacgttcatcttttaaattattttaaattatataatcaatttgtgatcccgttgcatttctttaattaaataaaatatttgtgtcttataaaatttatattgcggttctaaatttatataataattaatgttatgataattttaaataatttcatattatattttaggatatcaaatatcactt

SEQ ID NO: 107315 - DNA, 681 bp, Oryza sativa
ttgggttaaggcaggttcgtgtgggttcacggccttatttaataatattgtatagctctaggagcgtatttacaaaatagctttcagcaactacgtgtcttttaatgctgtttactgcaaaccctaaccctttatattatgactcccttgtactcccttgcatttattctgcacttgtgggtgtgtcttgttgagtatggtggttgtactcagtcttgctcaatttttcccaaacccagaagaggagttcctgtaggatgaaggctttggtgtctagctcgtgcctgccgtcaagtgcctgtggtcgtcgccctagtcttccgctgtttctcgtatgtctttgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaagttggtatcagaacccccttgaccctaggacgagccgtagatcccaagccttagcagtattttcgaaataaaaatcctctgttatttgtgaaaaccctctagtctttctctgtcttgctgcttcatttatcgccaaaatctgccctttttaaatgttgcttttctttttgtttgtaga

SEQ ID NO: 107316 - DNA, 871 bp, Oryza sativa
caatcctctagtgattgaaagatgctctgatagagacatgtgagttgtcagttgagcactatgctatcctctttcatccaacttgaatgtatttaagattagaagcatgaaaaggatgatcaccttctggtgtagtacaagacaattacttggaatatgttccgtttgatatatatgcgattatatatcactatgatacggcactcgaaagcaaggacatgcagtgagaatggaaaaaaaaattgccgtttcctagtcgaaatgttcttattctgttctgtcgaaagtttttttatgctttacatacatatgttgttctgtcttttcggcagaaatgggggggggggggggcgagattgtatctactaccgtctcttgtagctgaagaaactcgtgtgattctcgatcgcccatatctgaaactctgaataattggtgcaggttcagagagttcaggacttcaggtatattcgccgcactctgtttctgaattcagtttcgtttcgttgtgcactgtttcttttgccacgtacgtgtgtaaatcatggaattctcacaagatgttattaatcgggacaaaaactaagctctctccaatggagtggtgtcatcgatttttattgatattacgtatggagaagggaaggtatctcacgctcatgatggattttatgttctaacatcaataatttgccacagtagcatactactataaatccggtttttccaaatgtccaattgtggagattatgagtatcccatacccacacgatatggttttccgactgattataggggataacttatatctatggaatatgtaacggatcatgacttgggtattacgtttccctgtttattatggaatagg

SEQ ID NO: 107317 - DNA, 702 bp, Oryza sativa
aattttgtatttaaactcccaccattacaatattccccaaaatatattaactccccatgctcccaaacctacttcccactgtgtgtgtgtgtgtgggagaggaggtcaagaggtggttattagggtggctgcaatccaaggtagacggtgcaaggcccatcgcttgtcttcacaacgacaatcgtgccacactgagttcgtcggattactctcttcctatcacatgatctatctcgactccgaggacctcctattactgacaatcaatgacaccctaatcaccatctctgcatctccacttccatgatcgtatggtggggggtcaatttaaagtacgttctatttggggaagcttctatctactgcacttccagaagttccaaaatttgaaagcataatgtaacacagaagtttgaatgcaaatttcccatcacccgtggatggccacatcaacgcatgagttgcgtcatctgcactttaaacctcaggtgatacattaaacgaagattaaaaacccaaatgtgtatttctacaagctcacatatctagatgacacttagtccatatttaaggaacggttgtgtagtttttactcttttatatattacagtagtatgaggatcatactttatgttgggagaagtcacaagttgataaatccaagctgtagtagtatctattaagcacaggaatacaaagaaa

SEQ ID NO: 107318 - DNA, 637 bp, Oryza sativa
accacttgttttgacaatttaagatttcatgcctaacggaaacagaagatagcttcaaatcctgatgaaacacaacacttttgactaactgcagaatttaagaactccgtaaaatttgaaaaggaagaacaaaaggaagttatttttctaatacctgaacattctgtacttgcaaacttacaaattgatcgatcaccacttctttctttttccagaattggattctagtttcggataattcctcaagttctattcttctcttggtagaatcgtctaacataagctttacttcttctatcctctgttccaactccttacttacttgtgcagccttagtctctaattgctgactgtgtgcctcatgcaatctctttgtttcttcaagctctttcttgagttctgaaattatactgtcattgttttccttgtctgtgagaagcctggccacatcttccttcttagattctaacaacctgcagctctcctcgtatgatgatcttaatgtttccgattccttcttaagtttcaaaatggtattgtaaccatcttctttctccttcatcaacctcattatctcagccttatccttaattgaccttgctgcatcttcatccgcgattttcttcaattcagcctt

SEQ ID NO: 107319 - DNA, 979 bp, Oryza sativa
taggcacggcttagaccagtggatcagtggaccagtaattcagtggattgacaaattcaatggatcaatggattgaacatgcaaaatttaaatttaaacatgccttagttaacaaattcaaatttcacaacttacttgacaaattcaaatttgaacatgccttagttaacaaatttaaattacacaacttagttgacaaatataaatttgaacatgccttggttaacaaattcaaataacacaacttacacaacttaattgacaaattcaaatttgaacatgccttagttgaattcacagttctagattcacatatcacctttacaaaaattcacagatcacagatcaaagattcacagatcacattgacaaaaattcatagatcacttgactaagatcacatatcacatggacaattcacagaagagtttcaaaaatcacagactcacagttgttgattcaaaaatttcaccaagtcaaattacccaaaatcacaaattttcacccaaactttcacccaaaaaacttgacttagatcacagatgacatggacaattcacagaagagtttcaaaaatcacagactcacagttgtagattcaaaaatttcaccaagtcaaattacccaaaatcacaaattttcacccaaactttcacccaaaaaacttgacttagatcacagatgacatggacaattcacagaagagtttcaaaaatcacagactcacagttgtagattcaaaaatttcaccaagtcaaattacccaaaatcacaaattttcacccaaactttcacccaaaaaacttgacttagatcacagatgacatggacaattcacagaaatcacagttctaagattcaaaagtttcacgaagtcaaaaattacccaaaatcataaactttcacccaaaaacttgacacaagtatttcaatgaataaagtagctgtgtagtgcaatggctgcctcgttaaaaacctt

SEQ ID NO: 107320 - DNA, 742 bp, Oryza sativa
agcaaaaagctagctgctaatgacaagaccctggaaaatataaatgttaagctagatggttttgcttatgcattccaaaactagcttagttttaataaaatgatcgaaacctagcaggcacaattagctgctttagtacctgctaatgaatctgggaggattcttggacaacggacccctccgttaaaaatgttaaggcaatcacgacgagggaaggtaagtccacttgcgatctgacatatcctaaccttgtaggagctggcaacaacaatagggaagcaccatctagcgatgcggctgaagaaaaggtttagcaagagaagaccatgccgcaggagtactgcgacacaaggctgctgccattcccccagagatacaacaagccattggtggactagcagttcgcttgttttgttgaggtgatccagaaaatccatattcacgtgccactgttggacgccatgcaagtgcccacctacgcgcgttacctcaaggacatactcaataacaagagaccacttccgacgaccgaagtggttaaactaatggaggaatgcagcaatgcgatactcgacaaactccctgaaaagaagaaggatccggggtgtcccacaatcacttgctcgatcgggacacaaagatttgaccaagacctttccgacctaggagcaagcataagcgtcatgcccaaagacgttttcgacatgctcaacttcacggtgttggcaccaacaccgatgcg

SEQ ID NO: 107321 - DNA, 852 bp, Oryza sativa
cctctgatcagagtataatctattcgaatagccgcgccctcggttatgggcaagccgagcaatgtacccaagttagtgttttaaattcttaaaacctgcttaacaactaaaatgtggaatggttggcctgggttggcttaggacgagctgggacccagggtcgggttgccagttcggtctgaatcatcgtaggccttgggttaaggcaagttcgtgtgggttcacggccttgattaataatattgtatagttctaggatcgcgtttacaaaatagctttgagcaactaaatgtctttaaatgctgtttactgcaaccctaaccctttatattataattcccttgtactcccttgcatttattctgcatttggggtgtgtcttgttgagtacggtggttgtactcagtcttgctcaatttttcccaagcccagaagaggagctccttgaagatgaaggctttggtgtctagctcgtgcctgccgtcaagcgcctgtggttgtcaccctagtcttccgctgtctctcgttagtctttgtgtgtgctgggccttcgctgcccatgtaataaattaactatttacgcttccgcttgttatactctgaattgtatcaacttttggtgtaccttgcctcctgggacaaggattaatgcacgcacgtaaggaatgcccgttgggttatttccggtcgtgacaagttggtatcagagccacctttgaccctaggacgagccgtagatcccaagccttagcaatattttcaaaaataaaaatcctttgttatttgtgaaaatcctctagtctctctctgtcttgctgcttcatttatcgccaaaatctgacctttgaaaaa

SEQ ID NO: 107322 - DNA, 2942 bp, Oryza sativa
ggttagttcggagagataaactaaaaacgaattcgattcggtttatccgggcaaaaatgatctccgaaactttaggggaaagggagaggataaggaggagatgatttcctttcaagcaatcgaactcggagatggccggctggggcggaatcgaaggggaggcggcggcgctcgggctcggctcggccggccggaggtggaagatgaccccgacatgtgggccccacatgtcagcggcttgagaggagagggtggggcggcggctcggcttgggccggcttgggccgcacggccgcgcgcgaagaggagagttgagccggaaacggcccaacggcctaggggagggttttaaagactttttcaattaaaataattcgtgaaatgatgtttcatttattaaaaatacttcccttgctcaaataactcccagaaaaatctagaaaatagataaacaagcaaagtatttaatggaattttatctagctcaattttatgttgaaatttttcctagattattagagtttaacttgtaggcttttaaaaataatttctaaaaatgcattaaaaattgaattattaaattaggcgattttgagggcgtgacattctttttcctaaatgttgataaaatcatgttctatcatgttattgtgttcttactgctattattttggccatcttttcttttgactttgttttatgaattaaaaagttgaatttcaaaaaatggcaacttcaaataatattttgaagcagtaaataatttcatctaaaaaagtaataaacataaatgtcgtagaactcatcaagatgtacaacttttatttggtcatttcttcatccgacaaagtgatagtaacattgttaacaaaatttacatatttctcttatagtttataaaaccatatgagagagatgtaaaattcgtaaacaatgttactatcaatttgttggatgaagaaatgaccaaaataaaagttatagatcttgatgagttatacaactttgttgttgattgatttttcttatttgaaaatgttgtttgaagttgtcatattttgaaattcaaattcaaactgttcaaacaaagtcataaagaaaaattaccaaaacaaagttgtagatcatgcgttatacaactttgttgttgataatttttctatttgaaatcaattacaacccaaaaaattatttgaatttcaaattgttgatgggtgatacccgtagaccggatgaataggatattggggtacgttggtatgaggatctacgtgatatgacatcaagcaaacaaggagacaaggattttactggttcagtccccttatatggtattgatatggaaaaccacagagatgggaacagatgaattcgacaatcacacaagtcttttttgcacactttgtcctcactcgtggaaagaatttcccggtcggtcacttatcccaaaattgctctaggccaagcatgcttaattcttcccggtcacacttcacgtgctctagctttgtaaactatggtgggtgtgttggcagtgagattcgatgatctgaatccctcagggggtgtcccttttataccgtggatcaccttgttctccaagtagaactcggagacatcggactccacactacatagaaaagaccccatcctctccgagtagtactctgctaatctctttacccgtgagaatattttctacaatatccagtaaatttccttaacgcatacgaaaacaaatcgtatgcgcaaaggtataccgtactcgtatattccgtaagtcattggatagaaggtatgccttattcgtacccatgacagttatattttaaaattcaaattttatatagttcaatcaaactcgatggagaaaagaccaaaagaaaaatggtagatctcaatgagttctacaactttgtttttgacaactttttcatatgagttgatttagtaccataaaattcgatttgaagtttaaagagccacatgcaaaaaatcgatttttgcatgcggacctcttaaggatcagcctatattaggtgatctatactaggtgatttgtctataaatgaaacgagtaaggagacatgcatattagataagatcgattgaaacccgatgctacccctattggcaatcaacaagtaggctagagattatggttctaaggacggcttagtagatcaaacttaactgatgaagcactaagtatgaaaagaaacataatatctagacaattaagcctttgactgatttttttacgtgacctttgactgatttttagggtggtagatgttgtcggactcggctgcggaacgaggagatcgaaacagactcggtgccacatcttggttggattcgtaatctaaaagtgcatcggctagaatcacattggttgaaggtgaagattcgaggtcagaaaagccagagtcaaattaagccgatacatcacaaccagggctcgtgtgggccaaactcggaatatccatcattgccaattagagataaaagctcgtttgtaggcaattgtatctattaattaggatagttaagtcggtgtgttcagttttggcaagaggcggccatatatggtcttgtttgtatcttagagttttagaatgttttgagtcatgtcggtaagggccatgttgttttttgagtctgacaagcaagaccgtacctcctttcgtttagctcatagatttcctacccgtctccggaggttatggagcgggcgtcttctgcttaacttgccacaccttcttcctcttaggtgtggttggcggcatctttggagccgccttctatggttttttggccggtgtaatggattgtaccgatgtcttccaataacgggtcctgggaacagatgatccctttctcaggaaaggttgcataaactttaccaggctatccatcttgggctgctccacttaaaccac

SEQ ID NO: 107323 - DNA, 1831 bp, Oryza sativa
atataactccaaataatgatgtcccatagtctagacaccacgcctaaactaccagatactactctaatatcatcgtcatgacatagagtaattgcacaagcaaacactatacccgtaccaaagcatctcttagataagctagcagtataatcagtataacatgaatataatgtaaagttagcattcatatactcggaaagtattccaataccataaatgtttaaagaagagtattctaataaaagtacaaagcttacaaaagagaagagaagagctactagagccatacccgaactcttcccaaggcttccggactccgatttctactctattcctattccactagctttagaacactaaactaacttgagaggatatgaaagaactcttgcttgaggttgtgaagagagtgaggaagtgaagtccttttatagcctcccaatgacggttatggcaattggaatggtcggaaattccctctaaccgtcattggggagaaatcctggacgtccacgccaaaccctacatccaatggagcagatgggctggtccaatccagcccattttcggctggcggcctcctagacatcttctctctgtagacttgtgaattttggctcaattggtcgtgtcatttctgagttcttggcccattcatacataagtctgatcctcgacatcgtccgattgatttatcatctggtttgatgtcgattcctctcccttttatatatggttattttctgcaaaaggttagtaatccaaatattagtggaatattattattctaacatggatatgcattgcaagcataactagttctcatctattttggtaatattgacggtcaaaactgatcgctaatgaccgtcaacagaggggaaggaggaaggaagagctgggcggtgagggtgttgggagatcggcaggagtaatcggcgtcaggaacagaagaaagcgacgctcgcaggaataggaagagattggcgcgccccaccaggaagtcgtgcgtcgcgcgcaagttggagatcgcgcgtgatcgcggacgaggaaaacggatttttgttgttactttaaaggagtgcccattgttagttataggaaatcaaatttaggctctctcttggagatattagttttttcaattcccatattgatgtttaggaaaaccaaaaacttaattttggaaatggatttctgtcattcccttggtgatgctctcaatcccgtcccgcaccgaagcccaatgggattttgccgtgtgaccaatgttaatgactacttggtctctacgtccctatttccctacctcccatattcccaatttccttcgttcttagggctacggccgacgactaagggatgtgcgggcgtgtggggaccgtcgaccagaacaacaacatgcagagcgtgcggctggcacggcagtggcggggcagggcggtgcgacgccaggcttcctgctctgctgcacaggcagatccgcacagtccgcacacaatagctgtatcctgtgttaatttgcagccaaacagtgttacgagcccaagcatttgtttttacatatcttgctcttcgtttcacagattgttgaacgatttcacagattgtctatgctctacaagtttgcgtatttaatgcattgcccaatcttctttgttttatgcttttccgctaaataattacatattccgttgatgtcctgttgctcctttaatctaattcgagttccataatatcatgacattgacagaacaacaatatttttttctcctttgtgttcattctagcattttcatggccatacttcttatttctctcaccctccgcc

SEQ ID NO: 107324 - DNA, 904 bp, Oryza sativa
gctctctccatcccctctcctttcccctccggggccttatctctccctcccctactctcccagcgcaactaccggagggcggtgacggcagcggctaccggtgatggcggtgagttcgcaaagggtggaggaggcggctgcggagggtggagaaagaggtggcggcggcgttaagggctttcctccctgggcaggagggaaggcagcacatctacaaatagtggcggtgccgagggtggctgatgcggttgcggcgcggacggtccaggcggtggcaccggtggctccctccctcccaaatatggccggagggcggtggcggctcccctctcacatcttcggtggaggcagcggtggagggaagcggtggtggcgcgaagggtcaaggtggtagcaggtcctggcagtggcggcttccctctcctccctccctctcggcggtggcaacgcggctccaggtggtgccagctcccagcggcagcctccctccctcccagatcaggccgaaggggggaggggctgtagcggcggcgatttttttggtagcaattttttttgttcacgtaaactattttcgcaggcgggccgcgcgtgcaggcggaccttcccctcgccaaggaaaatctggaaagacaatttttctagtagtggtagatagttcaaaagaaagatgttgtcgaacgacaactgcgtcacgtcgaagggtgtggttctctcaatagtagttgaaagtagaaacaactgtattacctggtaaaaatttttcagggatcccccattacatggccataagaggctattataactctattgcaggctccctctcttaggttttaggcttacaggggaatttacatggttacccttatgatagtgacattattaagggcacgctatctctttt

SEQ ID NO: 107325 - DNA, 688 bp, Oryza sativa
gaggcagccattgcacaatcacagcttatataaaccccttttatattctaactttctaaggtttgtgattctgagatggacttgatggaaaatagtagatgacttgatgtatgcatttgatgaattgatttgaactgattgtaaatctgtgagactgtgacttgatgaattggtgacttgaagaattgttcatttgtttgtaaatctgtgcttgtaaatctgtgacttgatgtatgcatgatttgataaactggtgacttgatgaattgtttgtgattctttgacttatttgatgaattacatgtgaatttcatgaatttgatgtgttatgtcaatttgttgtgttgaattgaacctttgaaggggttttttgccagggcgtgcctgggccggcacgggcacgatgggcttgccgggccgtcgggccagcccggcacggcccgaggctacttgggccgtgcctgggccgtggttgtagcccgtgggctggcacggcacggcacagcttgttcgtcgggccgtgccggcccgactgacctcggcccaggcccggtcgtgcctgggccgtgccgtgccgggcggcccatatggccaactatagatggaagatatgacatgtgggcccaagggtattttaaaactttcacgtgatttctctcccctctttaaccggaaaatattattttaa

SEQ ID NO: 107326 - DNA, 549 bp, Oryza sativa
aaaaagtttcgtaagtgtagacttttccattggaatttgaatatcaaattataatacttccaaacaacattaacaagtactaaatgattttaactgaaaagttcattaacatcaaagttgtataacttatcaagatctataatttttatttgggtcatttcttcatccgacaaaacgatttataacaatattcacaaaatatacatatgtcttatatagtttataaactataagatagatatgttaattttgtgaacaatgttactatccctttactaaatgaagaaataaccaaaataaaagttatagatattgatgagttatacaactttgatgttgatgactttttcagttgaaatcatttagtatttgaaaatatcgtttgaagttgtcataatttgaaattaaaattcaaactgtttaaacaaagtcatatagaaaaatggccaaaacaaaagttgtagatattgatgtgttatacaactttgttgttgatgaccttttcagttgaaatcatttagtatttaaaaatgttatttgaagttgtca

SEQ ID NO: 107327 - DNA, 832 bp, Oryza sativa
tttaatgagtagtacatatgcaattttctcctccctcgcgggctcgcggcccacctcggcctgctagctttctagcgcgcgcgatgggctgcccctgcctgctcggcatcagccccaatgaacacggtgcacagggatagtcacacgacacggcgcgattgcagtagcactgtacctaccgtccgtcccatctctcgatcggcttatggacaacgtgtatgacgcacgcccgtattaacgtcagttggatgccgatggacggccatgaatccatcggtccagacgcacgcatgctcctttgactctaccagctacgcataccattgctgagagcgtgatatgacgatcttgttgtccactccatattgacactttaacccagctgacgtgcgtaatcgacgctccgactcaggacctgtttagattcatgggttacttttcagtcctctttcaaatagctgcaaataatctaaaagttataaataggtgagctatttcagggctatttgaaaataacacatccaaaaaaactatcccccttaagaatactaattagggctatttcaggtggggcccactaaaaaatgtcttttctctttatctctctccatgagaaagtgcattaaagattaaatagctcttaaaataacccttggatctaaacaacttgagactattttattggatggctatttttttcttaaaaattagtagtttttaaaataactcttagctaattctctatacatgtctcaatcaaccacccaactcgcaccgcaccggttttattttacaataaggtgatattctggatatagtgcatgatgtcagc

SEQ ID NO: 107328 - DNA, 738 bp, Oryza sativa
agggtttttctttttataaaccttttactttgtttatttcttaataataattatttgtgctctaaaaatccactaaaatttgagggctctttttagacaaggagaatttaacaaaaattctccgggccacatttgaatttttcttgaccgtattttagtgtttgccaatttctttcggaattttaattaattctataattccttttagcgaatgatttttaattcggaatgaatttatcaggacgtgacaaatccaccccccttataagaatctcgtccccgagattcgagaggctagcaagaagataggttgggcggtcttctcttcttgtccgacttcttccgtcgcatcttttataacgaacttgcctaacaaaacttctccactctggactgcttggctcaatctcctgttgcagatggagtcttctcttcacctgacttttccctggttgcacctctagctgacttcgactggattgtggcacttgaagatggggcttcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaagagaac

SEQ ID NO: 107329 - DNA, 753 bp, Oryza sativa
atctcaagttagcatgcaagttttttaaaacaaatttcttatatgatttcttctgtattaccaaaagtggacgattttaaaaaccgaatcaaatacggatacatatttttaaaagcaaacaaacttaaaaactgacgtatacacatatgacgtaccaaaataccgataaaaacatcttaaatttttataatagtagagatatgttcaatgaaaaaaattaaaataaactctaaaatttaaattttgacagcggttaattctatatagaggaaccaatgggagcctaagctcttttcagttactgtctgttggcttatgatgacacgctttttatactgtttgtaaaaaacttctctatatatatttttaaaatagtcttttaaagaaactataataattaagtatttaattaattataaactaatgatcttctcgtattgcgtaagacaaataagatttgaatacgctctaccgaacgcaacctaaaccggtaaggcacaaggcaattaagtcgtaatctcgcaacttgacgagacgagacaccaatttactaatactaacaaacagcaaatttctaattagcatcgcgtctattgtcagatcattctcaggttccagtgcgcgaggtgactgacaagctagcttaactattcgttgagatttcaggaagaaaaagctgtcaaaagcttaataacaagacgtggcacctctaagctgttgattccggaaaaggacaaagaaaacgaggagagc

SEQ ID NO: 107330 - DNA, 555 bp, Oryza sativa
tttcaatttcaaccaaatttttaattttaacgtaaactaaacgcactccaaggtgaagtatctttggacaagttggaattggaagactgtaattgcgattggctttgcattttacagtcatgtactagtacttgtgtgctttttggacaggttgccgtgctgcacaaaaatacctatccgataaggcgactttgaatctaacatggattaagtatggcaatgcatgccgtggctgatatgggcgcctgcgtttggttgtcttgagctgtttattagtggcgtatatatgctcaagagaaatgtgcgtaatgtatttggtctactcatagtccaaccagatgatttgagaagtcaattttttatatctacaaggctttatccggctgagaagaaaaggattgccatcgatgtatcggagtggggcagtgctgcactgctgcccaagtgcccatagctggccatgcccgacacatccctaatgataaggtttttttttttcatttttatggagaactatgattatttagttcggcagctatatattgagagaagatt

SEQ ID NO: 107331 - DNA, 676 bp, Oryza sativa
tcctcaagtcgatgaattagctgctacacatttacaagcgtctatttctgtaggcctatagagaagacattagccccatcaaaatggctactaatctagcaatgagaagaccggaattccctttgcattgaaacttgagcatttcacaagtagttcttctccgacctcaaaatccttgtgtccattttcctgcaaaggtttcaatgtcagtgcaatgaaattaaaatacataaataatgatactacattgttatgtttagctaagtttttgttattgagggcaatggatccatccgatctgatattgcattgtcatgttcaatactgcaaatatggaaacataatttctttcctaactatcaaagatgttatatgtatgcgatagtcatatagcagttctttttcatataatagaaggacaaaaaggacaagcaatgtgatattaatattgcaaattccgaagcaaataaacttgctaactagagagtttaggtatgaaataaccgcaaattatgcatttcacgaaactcatcactaaactcaagtactaatccataagctcgtatttgggtagacctttgttgtaactacgtacccagcttattggacccagacctgaagtttgagggactaaaataggtcaagagggtaccttattttggtctggaatggcatc

SEQ ID NO: 107332 - DNA, 767 bp, Oryza sativa
gttgtgtgttaggtcccatgctttcttctgtccgttgggttttagccggttccccataattaaccgtgcagctgtatggttttcgggcctgatttcccttataaattgggtcgttgtctcttgtctgtacagtttctccctctcttaatataaaaccagcaatgctggcttaggtttcaaaaaaaaaaattgctctataagtaagaccggttcggaaaagctggttgttgcaacgctgctgagcagtatctacagtgctacagcagccagccaacagcggtcgtaggagcttttcagccagtacaaaacaactagctgcattcaaaatagtccagaccgctgcagccgaacggttaggatgtgcatcacagctgagattgacgtggaaacaggatactaaacatgccttaattcgaagttgttccatgttctaccaaacaaaatgtcttatcatccatcacattcatatatatgagcaaagttcttgatcatgtcctttgggacgaacagaaaagattttgcctacaactcaaggtcgtaggcaaagaactgtttctcatgcatcgtgacgcaagcatattagcactgtcttttcgctgggccggcttggagccctgcatgatgcatcaatatttttcttcctctgaaccagcagcagctcgcttgcagcacgggcaaatcatacgtacagatcacgttcagttcgccgaataataaccaaaactagaatactaatgagatcgacccttctagtagtagaaatgcaa

SEQ ID NO: 107333 - DNA, 2660 bp, Oryza sativa
tgtacatgctgcggcggcgccgtgcgtgatcacgctccgagatagcgttactggtttggcggcctgcaacgacgacacgttaatatataccagtaaccgcgtttccccgcctgacaaaacggagttttatacaattctagtgcactaatcaaaggttagcgtgttcaagtgcaagatgttagcacgtaactatatagttttctatggcaggagagctttgctctggtccttctaaagtccagctaaagggcccgtgtttttatctgaactttttttcccatcttacaagctgatgagactaggggtctttctctgatctgccgatagattaagaaggaccggtcggttctgatatgtcaactggtggattgggctttctttgctttgccccatcacgcatgctctttatctttagatcaacaaggtaaatgatgagtgctgaactgatgactgggaggatcgactgtgtatggctccgtagtataccatgaattaattcttttgttattttgaacgaaccgcaactgattgtgcaattcttttgttatgaattaattatgaatatactccctccattatatatttataagccgttacaaattatttttattaaatattatgtaaatatattttgataatatgtttgttttatgttaaaatatggctatattttttgaaaaaacttggttaaacttaaacgtgtttgactagataaatattaaaactacttataatataaaacggagtgagtagatattaggatgtgtgacacagcacaaacacgaatggaagtggttttcattttttactccaaatctttgtgtcatgataaagtgaacgcacgtcactactaagcgattagtttttgttctcttgaactagcgcaacttcattgttatatatccacttgcttctttatatattacattttccttggcaagaagtattgctaagttccggatgcaattatgcagaaaacgacttatcgccttaagttcacaactaaacatggagcatatggccaacttaaatttcatgcacgaataatatagaataaatagcatgatattcttctacatgtgtggttactattacaacatatgtccacacatgttctcattcaggtaataataacctaacttaaagggctgtaaaagttatactgttggacaaagcctgacaaccattcaaatgaaaaataacttaaaagaccactaatctacacgataagaatatattggtatacgcttgattgctagtagtgcttacctaagtggtgtgtttatttaagagtttgaacaattgaacagaaaacaagtatatgcagcatgtttttattgaaaattgcctgattttgcaccaaaaaaaaggcatagcctaacggcaaatctttaaggtcattaaatttctaactaaaacaaacccacatgcgtttactattagcgtgcaccaagatttaatctcaggtgagtgtagtcatacacttcaccatttccacataattcacattataaattagaaaaggacattactttattctttcgacgccacaaattactgtagctacggtgtaaagaaccatacagtttccatgctatactcccgtcaaagctagaaatactgttttaaacattgacaagttcttcaaaatacatttctgttgtaaaacattttaaaaacctaatgatattataatttcataaaatatttttaaaagcaaatgttctacacacatgatttttatacacccatctagtagtaattaaatattgggaaaattgcaaaaccaccccaaatatcactctaagtttgagataccctccctgtaagaaaatttgttgcaaattcccaccttctaatttaccttggttttgatttaggcaccttggtttggaatatatagtgagtttaccatgaaaaacacaatgaaatgaccatgataacacaacgaaatgatcgtcttatacagaacaaacaacataatctcttgctcccgccgagtgggactcggctgattttgccacaagattcttcatgaatcacgtacgtgtggagagaatgtgtctaaatcaaaccaaggtgaattaggaggtggggatttgcaacaaattttcttatggggaggcatctcaaactcagagtgacatttggggtggtttttgtaattttcccttaaatatttaaaaggatgcatgctaattaattagttttgtatagtttgacttaaacaaatttgaaatgatatgatatgtcgtatgtaaaaaagaaaatgatatgaaggaaacgctagtggttttgtgtggatacatgacttaatccactaccactagagtataaaattcttatacccataaaatattcgcatacgcacttgcgctatcaattcagtgatattagtgattttctgctagcctttatctgtttagcactttctccgttttataatgtaagattttttaacattgtctgtatgaatatagatattaatgaatctagacatataaacggaggaagtatgtattagagtacatatattttttatcggaaactagagtacatgcattagcgtgtacgtgtgtgatggtggtgtacgtgcgcgcatctatcttccgtgttatctaaaaacacaacacctgcatatgtcatatctgctacctact

SEQ ID NO: 107334 - DNA, 548 bp, Oryza sativa
tttaatttttttcatagcaacatgttttggtttgtacaaacaaaaaatcattcagtacacacggacacacagctagaggtggagactatcagtccaaagactagtgatgcgtgcacatattgatgctttctctgttggtcatggtctcatggatgacgcggtaagtcgaaaggtccctgtaagacgttagtgcttctcatcagggagtgagggtagtgtgcatgatggcaatgattgggtgcactcgcaagaggaattttcgcttcccctcttgctcccccgcctgtacaaataaagagaggttaagggagtttgtttgggagggtctagcccgtgattagtttcaaagtttttcttccaactttcagcttttctattacatcaaaactttcctatgcacaatctttcgccttttctgtcgtcatcattcccctttcaacctagctttcaattcccccgtgaactaaacacagctctaatgtagctggagtgctggacctggtgcccacaattggtggtgctgatttcctctcttttgtggtgggagc

SEQ ID NO: 107335 - DNA, 693 bp, Oryza sativa
tttgagcacttgagtgacaattaaaccattctcgtgcatcctcttcatgtacagcatacctggaccctaattcaaaatcaaaattaaagttaacttaaatcgctttgacacatttacaaattctttctcttgtttttaagggtcaccattcgtcaatgaatttcttgaataaaactaatgtctacttatttgttaaatacaccaatccattaatcatttttgacatcaattagtcaaaatcctcttagaggacctagatgcacttcaaatttaaaccaacgtaatttccactattaattcatctatctatcatagcggcctccatcagtaccctcctaaccaccggtccatccccttgattttacctaagtaagtgggataagtacttttattttttttctttatttaagaggacatccctcatatcttttcatgccatttaaatagttatatttcttaaaaaaaatgagagcatagataaatatgtgatatgattctatacacatacaagtttaaataaaaggaacaaattaaactctgcgtgtactattcacaatcacatttttttaacttgtatatgttgaatttaaacttgtatatgagtaaagtaatatatcacatattgatatatgatattaaaattattactattttgcatggttgacatgtacaacaacaaacgggaggcgacct

SEQ ID NO: 107336 - DNA, 1139 bp, Oryza sativa
ccaggccagtgtgtgtttttcgcatcaaaacattcataaaaaaattattgtgaacattggtagtcctatctttgtatgaatgcttctcattttttatgactttcttttaaaaaataaatacatatttttttatttatttatctaaaaataaattttgtgataaataatgcatcacacaacaaactcataactctagtagtcttatgcgacaaaattctactgcatttttaacaatgtaattcatgaatttctatgttcatccaaaaggtaaaatagtcatttttattaaaattagacagtcaactaacggttaactgacgggagaagtatggaagggatcaaaatcaaattttggagatatataaagaaataagcaaaattcaagagtatagaaagctaaattttaaaaggtatatatagaaaggattttctcaacaatatagatacagaggcgaagccacgtgggccttccctatgtacaggacacagggtgttaagcttgctcatcacgcaaattttctccgcacaacaattagtgccacttcccttcgtcccttaaaaaaagaatttaatatcggatgtgattgtaacatattctagtactatgtatctgcacatatttatatttatatttgtagtaataggatgtgtcatatccagtactagattaactttttactgaacggaggaagtattatacatgccaaatatgcatataggacactccataatttttattctagattcactgctaaacaccagctaaatagatgatgcaaaacaaccagatcaaccagtgaataaggtaatcacttctttaccacacaaaactcggactacataatacaaatctacaatgaatgcacaccgtacttgagtaaattaatactgttcaacgaacaatcccaaatctctccccaaacaccaaacaagacagcagatcgaggaccgccccattatttaacagctctcatatgcatctgaattctgtaacccgctgcgggcaacggccggacgtgcaatccaccagaccaccaccgaaaccgcccctgtggtcacactcttcctgcaggcgcgcgcatgaacacgatccaaggcggcaagccggcataactacctcccggccggggcacgtaaat

SEQ ID NO: 107337 - DNA, 773 bp, Oryza sativa
tataggaatcagacttcatttttccgtttttaaagtaatcggatctagcctttatttttcaccacttttttttttgccttttataggaatcggatctacggtttttttcgccacttaggggaaacaaaattttattgttgttgtttctcttttttgcagtttttctttttctttttctttttctttttatgcacctgtctgtcattgttctctcccttttattattttttcttaaaaaaacgatctcaagtatcttattgcaagattatagggactcaagtgtaaatataaaaattacagggactcaaatagaaaagtacaaacccaaaaattaaaatcatataaaaatggaatgctctcctccggtaggttccgtttttgcaaacatattttcaatccggcacatcaattttttttcaccaagatgtatgggatatcacggtatagattgaaaccgagaggactgtgcctgggatctcggactcaaactgagaccgagaggagtggtgtgttttattttctgtttttaaggggagaatcggatttagagtcggacttttttttttcgtttctgagagggagtcggacttttttttttggctatttattttgttttgacggatgaaggaaacatttctttttttaagtaaaatagtaagagattttgcaatagtataatcaaagttttttttgcataatttattagtggacatcgaaaaacgtgacatagctgaagaatatattttagaaaattggtaatttgctttgagaca

SEQ ID NO: 107338 - DNA, 522 bp, Oryza sativa
agttccagtttgtcttgtgccatcactttcaaaagaaccaagtggctttagtaccgtaatccgttttttctgaggtggtgctagattggtgtgagaccctaccaactgtcttgagaaaattgagttaggttcttcaagaaatttcagaaacaaatctttgtttgaacttacaaccctaagagcttcttgtaagtcctttgaatgaagcggcttctctgccatgcctaagcattttttctccatgacacttcctcgcaaaatatccactctgttacttgtgttcccagaagaccctcctttctgcgaaattttgtcctgaaaatagctcatccgtgtttgtgcttcagatacttcatacacatcattatattgaactgcttcctgacaaaatgggtggatatcttgtgtcgttgactttatgagacgatgctgctcttgttgctttaagtctttgtttagtgcttttaactggttacatgattgacttttcctgaaaccacttttggcctggtgttaaactgg

SEQ ID NO: 107339 - DNA, 558 bp, Oryza sativa
caagctgctggttgagtacgtgaggcagcacggcgaagggaggtggaattctgtcgccaagatcacaggtaggtgctatagctactgattgagtggtgttcttgcatgttcgtgaccatttcgatgttctctcgcacgttgtcccaaatcaagaagctcgatatatatagccttttaggaagaaattatagctagtagcatcagtttgcatttggtttgttaaattgcacgttggggcagtcaaacatgcaattagtacatgtttaaggttgcatatgtcgcccatgattgtcaagttgcatgatttgattccaattgcggcatttggtacgatcgtgttttcggagaataggcatttggtgcttgctctagcacatgcattaattaattaaaccgcgtatgaactgcatgcacgcgcgtgtaaattcgtcagaaccttttcctagctgtaaccgtggaaatccttttcctagctgagagttagcttcagatgattagcattaaccaagctttactttcttagttaagtacaaatgggagtggtaggtgtgtcatgta

SEQ ID NO: 107340 - DNA, 635 bp, Oryza sativa
tctaatttgcaatacgtaattcaaagtattatatgaagcaccaattcacagtcaaaattagtatatgaggaaaatccacttatctgaaacactggccacttcattttttggtacaaatactagttcaccgatcatttgggtccaaagcaaaaccaaagggattaaatattctattattctgtggcttgatagtaccgcagcatgtaacgatgatgagaatggttgttgctgtgagtcggagaattggctatcctatatactggtagagaaaaaatgatatatgctaaaagatggtgtagaaaaagatgttcataactttactaatttcttgaatctctcaatactcctaattcaggagatcaatgggtttgtcatgttggataaatttgtccagtcctgtaaaagagtcatcctaccatttattttttcattcttgatttttttgtcatatttagctcatgggtttattgtgttctctttgaattgtgtcccccggcagtttgaattgggtcatttggttttgctgggatcaagcctctcaaaaagggataaattttaagttgaggctattagtactactcattactccccctgagcatgctaggaagaaaacaaatcatttatttcttgtgggg

SEQ ID NO: 107341 - DNA, 559 bp, Oryza sativa
gtggaggggggtggacgcattttataggctcgggcgttgtcagatgctcgcggagcaaaccctaatgggcccgagagagtagtggacctgggagtgagttcatgggctggaaattcgatgttaatagcctgtgttggataattttgtagttgtgtctaactatatttcgcctacgatttgcaagaaaaatgcacaatgaacgaacaaacatgtgcttgcaaaattttggcaaccttacaaataggtgccaaagttttggagctagcatgattttgggcaagtttgccagacatacctatgactttctatggtagtctgtataaatgcctgcagttgatcaaacttcacacaaccaagagtgaacatgtttggtagtctgtgccttgaggaaagaaattcagttccagtttaactggacagcacaagataatcaactttgttttcagtggtttgcgagtggataggtcgtgcgtgatcaggatcaaatgatcaaatctcacttttatatcacagcaaatttgcaaccagtggcatcacctcatgcatatgcctccagaca

SEQ ID NO: 107342 - DNA, 1149 bp, Oryza sativa
aatctaccatgagcaagtcaatgcgaaagctttccattctggttgaattcgttttctctgatctcctttatccatgaatgatgcagttttagactcttctaactattaattgtcttctctgcagaacatggcaataatgatacacctcagttgaacccacatgattacttgactgttcatgttcacacacccataactcaggtttcgtttgaagccgtaggaatttcaagaaacactggtgagacattttcatctttcaataagaaatacatagcatagtgactgactactatactgctgttgccggaaattgtcactatgatatatagacatttcctgtgtatggatgttaacttgttttagaaatgcactattttgtagggttatcattccatcataaataatggcgcccatggtagttgaggtttttcttatatacatatactctttgaatgaaaataacagaaattactatcaggcaaggcagtaatcctaggctctttgtattatttatgtttgttttcctcatgctgcctacgacacatcttttctaaagtgtgttggttgctgatatttggtctgcaaccgttggctgatacaagaacatgttactgattccccatgcataaattagtattgcgagatacatatgattagaagtgttctcccagcaatttacgtctgctatatttatctaatgtgctaagctcatattcttttcacttttgatgatagacatagaaccttggagtggacggatcttttcagaaaagagaggaaaattattaaagctagctgcaaaaactatgtcaatggaaagttctgagtttttgcagagaaggttgacattacatattgaagaactcctttactttatattttcatgttgtccgataatggttggcctgatgacataaatttctcagatcagaattttttgctgacatcctgcaaaggctaggcgccaacagcatgataaaaaaggtatcctttgctgaacctatgtaatgcactatcacccactcaaaaatgtttgtctattatttacaagttccatgatttgatttgattttttttttttgctgtaatgtagcaccgtaaggagtccatgagaatgatgaaggtctgtggccatactcctactggcac

SEQ ID NO: 107343 - DNA, 2351 bp, Oryza sativa
cctgccgaaagcgctgcctctgcctagcttagctgcatgcgttttttttggtgttgcttggagtagccacgacaaggacaaaaccaaccatgtttcctactttgtagctaggcagctatttctcctggagggccagatcgctacaatttgcaaaatgattccttttaatcacactcaaaaactcaatcaaccaagtatatatgtgatagtagttacaaatttttcttacggtaggatggaccggggtaccacactttttagtacgaacagagtattgcatctctcggtatttctctaatctagtgttgatgtataaatatatactacacaaatttagtaagaaatttagtacgtgtagcagtgctcctacaaaataaataaataatacaattaagatgaggtgcctcctccttaaggccttaaaatcacttttatttaagggtatgaattttgaaacttaaataactctaatttttaaggtttgcactttgaaactaaatatggtaaggttaattagatccatatcactacaaatgtgttgtttccggtaaataggtgtcaaacggtgtggcatgtactacagggttgtaatgggtcctttcacaatcctactcaggctgtgttcgtgaggtggacctccctgcatgaaaaacgtggtggtttattaatgtatcattaattaagtattagataagaataacttgaaaatgaattaatataattttttaaaataactttcgtatatttttttttaaaaaatacaccgtttagtaggttgaaaagtgtgcacgtggaaaacgagagaggtgagttgaaaaaaaaaaaaaagaactcaatctcaatatatttttgagtaaagaaaatatatagaaattcagtccactccacttcaaatctaaccttcaaatttcgtagaaaataatattaggcccattatcacccctaactgcaacagtaggtccaataggtacttcaacttacccttttttttaacttggccgatttaccaaacaaaattaaaatgagaacatgcttgttaaatcctattgttgagctgagtgtccatgtgttggaagagaagtacaatatggcatatgtagacgtgctagtacatcgacttgacaaaggttatgggtgatttttttttagtaaaagaaaggtgattatttttttccctaaaacatgaagtgtgaatatgtggaaactttagcatgaatatacttgcttgagtatgtgattaatatgagccacatacaagaattggtggattgagtcccaggttgattatgacttatttctaactttcacaaaataaaatttcctaaaaatatagctatgttgtgatgattgttcgatctatgcgtggccttttaggttgaaccaatatatatcttcctttcaagagatgtaagtggtatgcaatatttctatctatctaagaatgtatgcaatatttttgtacacttaagattttagattttagaacaatacagtgcatttacatccatgcaaaacacatacccctccataaaaaaaaaccaatcctaatctggacaaacatgttgggatgaatgtgttttttttaacagagtagtatactagcatgacatgaattgtacgcatttattgctatacaacagttacagctgacaggtagacctcacacatcataaacccacatgccagctgctgttagcttgttactgctatgcactgtgcagtaatggaaaaggatatggatccatactacagtaggatactacacaatactgctatataggtggtgtttagatttaggggtgtaaagttttggcatgtcacattgggtattatatagggtgtttggtaagggtgggcagaaaaggaccgaaccgaaaagaccgagaccgagaaattcggtcatcaagtcgatcctaggcagtgaaagaccgaattttgttcggtgaatttagttagtctcctcggttaaccgaatagatcgaaaagatcgatttatcaaaaaagtgtaaatgcaacttacaatccactatattaaataggattaaactataatttttacatccctacttcttctaggcatgcaacctaataacagtcttaactcataagtgcttataatttttttttgcgatttttgtgttaaaaattttcattatttctttgcatgtatgaaaatattgttgaatttcggtcaggaccgagaccgaaaccgagaccgaatttttcggtcctgacatttttgcgttgaaattcggtcttcacttttcaaagaccgaagaccgagaccgaaattttcagtcagaccgaatgcccacccctagtgttcgggcactaataaaaaactaattaaa

SEQ ID NO: 107344 - DNA, 1247 bp, Oryza sativa
aacaccggccaagaaaaataagaaagaaaaagctgactcttcaaatgatgtgctggatgccattccagagcaaaataaaagtaacatcatgaactattctagtccctcaaacttcaggtctgggtctatgaagctgggtgacgtagttacagcaaaggtctaccagatacgagcctatggattagtacttgagttgagtgatggagttcgtggaatgcataaatttgcggtaatttcatacctaaactctctagtgagcaagttaatttgcttcgggatttgcaatattaatatcacattgcttgtcctttttgtccttctattatatgaaaaagaactgctatatgactatcgcatacatataacatctttgatagttaggaaagaaattatgtttccatatttgcagtattgaacatgacaatgcaatatcagatcggatggatccattgccctcaataacaaaaacttagctaaacataacaatgtagtatcattatttatgtattttaatttcattgcactgacattgaaacctttgcaggaaaatggacacaaggattttgaggtcggagaagaactacttgtgaaatgctcaagtttcaatgcaaagggaattccggtcttctcattgctagattagtagccattttgatggggctaatgtcttctctataggcctacagaaatagacgcttgtaaatgtgtagcagctaattcatcgacttgaggaacatgagaaataatactgcggctccctcgacttttgtcagagtgctaccaaaattgtgtggctgtcgttagtagttttgccctgcaactcacaaacgcccaaacattacgcatcacttggtatctgaatctcttttgcagcagttgtacacttgtatttttgccacgctgtttcttattcatcgttgaaactaaccgtaacagtagcattcatatttctctccactcgtaatcccatataattcatttcattctttaatacagttacttctaccatgagaatctctgagcagcagcttcttgggagttgggatatcttcatttcattcattgttgtgtggtgcgaagtgtgaattgtacatacagaagtacagaactggacgcaaaattgtggccttttctgccaccaggtcccacaacgacgaggcctgtggctccgaggccgcctctgataatcgccaagaaatgaaccaaaaaaacgaaccaaagatgaggtgatagactgactagcactg

SEQ ID NO: 107345 - DNA, 613 bp, Oryza sativa
aaaaatcatatatatcaaattcattgtctactactagctcccaatcaatgtatgcaacagaatcatacttcccatcatagaatggtaacttagatgcaacttgttcaaaattatagtcatgtacctcatatgcatcacatggagaagtcgtcatatctcgtcgaaggtgtagaagtcgatgttctcgtattcccttacacaatcctaccatggttagtagcaaacaagaaacacacaaaaatatgcacgctcctatcaactactaggtagtggcagctcaaatatcacacacactcaagcttttaaccaagctcttacaagttcttactaaagcaagcggaatggtgatgtacaccgacttaaccaagcaccccaatggaggttggatgtatcgatgccttggcaaacacttgctgtacggctgcaatcagatctgtggagctctgggtaggcttaaatatgtagcaaagggatagcaaatgctctaatgagagaatgcaaagttgaataatggttccaagtcaagtaccgtgctggtcctaggctagaacgtactagagacgcgagcctagacactaacgataccacaaaatagcactaggaacaactcatg

SEQ ID NO: 107346 - DNA, 591 bp, Oryza sativa
aatatatagtgatgagggcttttaatttcttcctgtgctctgtaaaaaaaaatgtgattatctctgacctgatcatgatcatcgtcgtcatatactcatatatctctactcgaactcgtggtatgtatggttgttgattcgatcagctgtggtgaactgattgacccgttacaaagattgcaaactggatatgtatctgcggttagagaatgggtggtataatttgagatcttgatgggtgttgcttaagggctccttattttccccctttggaatgaatgatttattgagaacattggagtaagaaaaaaaaaagaacttggaaattagatgtcacggtttgttgtatcgtaatattacgagtctatcggaaatttatagaaaacggcgtttggtaataccattggaaaaacatgtatatcatgtggaatttacacgagacaatgtatatttgagtttatgcaaaattcaaatataatagcctagtactccctccgttttttaatagatgacaccgttgattttttctcacatgtttgactattcgttttattcaaaaaatttatgcaaatgtataagatataaatcaca

SEQ ID NO: 107347 - DNA, 997 bp, Oryza sativa
aaacgttggacacggaaacttagggtttgtattttttttttttttgggacggagggagtacgttctatttagtacatgaggcactgttctgtggaggggggttaggaatggtggatagtaatatgattatttaaaagcagctttttataaagtttctttttttttagaaacgtaacatttaaacatttgttcagaaagcatgcctatgcctatgaaggctgtgtttagtttatactaaaattgaaagtttggtttaaattagaacgatatgacgaaaaagttggaaatttgtgtgtgtaggaaagttttgatgtgatggaaaagttgaaaatttgaagaaaactttggagcaaaacacggcggaaaatgaaaagcgagagagaagttgggaaaataggagaaaaaacttccgtatggaaagcttttgtaaagactgtattctttatatagttcattaaacgtgcatgtgaaaaaacttccgtacggaaaacttttgtaaaaactgtattgtttatatagttcattaaacgtgcacgtgaaaaaggagaaaaaataaagttaaatgaagtagaaaagaacacacaacaaagtaatttacagaacagttcaccagaggttggtgactgcagttatttaggaatcactaggccctcttaccttgaaagcattttaatctgaaattagaaaacaaaaacttgaaataattaaaaaccattttcaaaatttccttatgctggtatttattggattttattttttcttttcctattgtaccattgccaaaaactaattaaataatttcaaaggtaatttaaaaaggaatcaacttcaaattctaaatttgaaataagaaaatgaataattttgatattgggaatatatataccatctttgactctttatgtaattatttatatatattaataattagcaagtcctaattgtcgtgtatacttttttttaaagataatatcagccgatataatttaacaattat

SEQ ID NO: 107348 - DNA, 1519 bp, Oryza sativa
  unsure (1)..(1519): unsure at all n locations
tttcataacaatataaattagtatattgcttgattgatgatagtttagttgagccaataatgaaatattgaccccaattttgttcaccagagcgggagaacaagatagtacgagtctgtttggtagagctctaactcttaaagttagagctgttgtggagcagcctagcctaaacctagttccacctctctagttcattttgtgataacactgtggagttgaaactgtttggttggactctagagtgccaaatagaccctacagtattgagattgataatcagttaccaaaacccctagggaacagcccacccttcggccactacaatggccatacttccttccaaatactaaaatacagttttcttcgtgaacttagcataacttaattcgttaagctatttatggtgaaacctacttagccggatttaactccgtatttggctataattgatgtcagggttataaacagtggcaaaatatgcacactacttaaaaaagaggcacatacaagttggcactataggtgccggaacagcaaaaaccgtcacatatagtgcttttcccccttcaaaagatgaaaaaaaaaaccggcacctttaatacactataggtgacggttctataaaagaacaaccatcaatactttaggtgcccatttttttttaaaaaaacaactatatttaatatattataggtgtcggttaattaaataccgataccctatcaaacgagccgagccaagctgagagatggccagttttttttatcgcatggggagggaggataaaacgctgagtgggtggtgagggggcgtccttatccactcgcccccactcctctcacgctcacaccctctctctttnggctctctctccttctccaccgcggtctcttggcggtggcatgcaatggcgtccggtggcgggacggagccagcggcatagcgaacggcggcggaaggaaagccggtaacggcgggcaacaccctcccctccgccagatctagcgggaggggaggcagcggcagcggtggcgccccacgggcagcagcggcgatgggctcccttccgccagatccgacgggaggggaggctatggcagcgatggcagcggcctcccataggcgacagcgggaggcggcggcgggctcccatgggcgatggtggcgggttcccctccgccagatccagcggactcccatgtgttgttgttggttgttgattgtatgatgctgatgtgtagttgtccttttttgatagattttttttttggttcctttgatgcatcggctcggctcaatgtgagctgagctgcatttttttttgcaaattgtatatctcaaaggtgccggtttcaaaactgacacctttgagtgttctaatcagtgctggctccgacaccaatgaccttttctgtagtagtggtaccggttctacatggtgcccaatctctttgtatgtgtggtaggacacacccgcgcgtcgatggatgccgttagtgggatatctcagtattga

SEQ ID NO: 107349 - DNA, 597 bp, Oryza sativa
tcatgcaaattaaaaccaatcaagcaatcatataaaacagagtttaacatgattatctccctacttctgcaaaattgtgacctatgctgtcctaaactccaattttgatctttcttcgtgtcattcctcttcctggactggccatagcaagacttattgccctttctgcgcccgagtgaagcgattgctggcagagctggcagcaagttacaaggctgttgaattggatgtggaaagtgagtggattatttttttttctgttattttctttcttctggttatttttattgtacatactaacatatgctaaatttcgtcttctttgctctccaatctatatacaacatattactccgccgtgctgcatctattttagatatcattggatttattgtagttgagtttagagcaaaactggttgcaataatgagtttaatcaaattgaaatgctgaaaatggctgtaaacttcactcttttgaaagaaaccggccggttatttaaagagaagaaaaaaaagagcaatgcatttgcaaaattctgacaaatagtgcataaaagagaactaaacaaccgaacagagaagaaactacagggac

SEQ ID NO: 107350 - DNA, 754 bp, Oryza sativa
attaggggcggcgggcgtggtggggccgtggccgtgcgatacgggagccgtcacgcgcgcgagctgggggccagcgaacgaacgccagggagacgcgctactgtagtagtactgtggaaacgacgacgcaagaggcggagggaggtggtgccgtggtggtgccgtgggagtgggagcgccacgcccacgtacgtgcggcggcgtccacggtggccgcgtccccgccctccgttgcggatcacgacgaaagccgcgccagcccaccgcggacgtgccaaggcggagaaaaatccagagggaaacgcggctctcacgttttcacgtagtacagaccttgatgggcagcatggcgatacggtggtggctgggctgatgagtaaaagattttgagctaccggacgagacgagtggccggtagagagcagcagctggatggggggtgttttttttttccccgtgttggcaacttgggatgcccattgccactacgccgatccggagagcgactggtcgtggacttgtggtggcggctcgtggcgccggcctagcgctttttctgtagctttgcttttcttgtttgccactggcgatgtacgtggtggcctccgggctccggcagcaaatcggcgatgctgcaaaatgggtttagcgttaacagccctgtcgtttgtttactgatctgttaccagcgctgtaattcagtaattcagcagaatggtaaacacaaccaagatttttgattgcagctctgaac

SEQ ID NO: 107351 - DNA, 1042 bp, Oryza sativa
ggtaatatttaaacatatttgttattttctacttgtattgacccatttagagttatatactgtatcgtttaccacattatatatcgaatcatattgtattgcattcgaattttttgtggctaggcctaccctgggttcaaatcctgggtccgccactgtctactaacacatatcatggaggttacatggaaaagggagggcacactaaattaactagggaaaaataatcgagctcctgagatcaaccaggaaaggagaaaaaggagaaagagtaagttactaagtgccaagaagatctcctagggattgggcaacaccgcaacccaaagcttctcttattgcacgatgcgatcaaccaccatctccgtcgtggaaataatcccctctaagacatgagcattttttctagccacaggtgccaaggaggacgagggagttgaacccctttcttgtgtgatcctacagttgctggcaagaagactcccaccaaactggaagcagagcctgttgacagggtgatagcctcttgacagggtgatagggaggctaacctggcccggttgaacagcaacttgtgctaaacttgtggtgcgaagacacactgcaccaagatatggtcacctagatatctattgattatctctatacaaacaaatcattagtgtttattattccgatgatcagacgggctagaacaatcagcaaaagataggatatgtgcattcttctggtgcatatatatgctttcgggcctgtaagatcactagcactctatataccatgtgcatttaaacttatatactctgcggcaaaattaattatactactctactttaggggtgtttgccttatcaatatatattaaagcagaaaagtagtgagaatatagggagatgagcttctttttcatatggacaaactgaatggaagaactttcttttcctagagacaactgaatagaagaaacttcaagtgcaccggttgcactctccactaataagaatctaatcattaaaaaagaacaaaaacgacaatatgcact

SEQ ID NO: 107352 - DNA, 1421 bp, Oryza sativa
gtaatgtatttagcccaaattaatagaaagatttgctatggatcaggttggtggatactatagatggtagtgcttctattctctcctcaaaactgaattgcacaaaagccacagatattaagcaatgctagtgggcacaccatcaaaagcctactttccacaatgtaggtaggtgtgcagatgggaaacacacaaggcgtaccacaaagtgaggacacaccgttttccaactaaagccaaactattttgcagaagcgtggaattggcaaaagactaaacttcaatttgtatagcgtaagcttgtaccaatagacctgtattaatttgtatcatcatttttttaataaaaaaaatagaaaatttacctaatggttttagaaggaaaccatcttcatctgtccaaattagaccatactcccccagctcatggatcttctcaacacatatatctgtaaattgagttcataacgatcaaaatcccatagaaccatgaattctacaaaatccaagaaagatatacctttcatttgcttttcaagaagttcacgtggaatttctttcttaattccgtaatgctgaggattctggtaattcaattcgtcaaagtcagtttatgcatttaagcgaaatggatttaaagatttaataatactaatttgcccatgccttctttatcctgatgtacaaatacgagcacttgagccactcaatagccaaagttatatcagacaccgtcagctgaacaatctctgcatttagatgctcaccggcacatggaagtaacctggtcatagcatctatactcagcgagaagtttgaaatggtatgcagtccatgtcaaagtcaactaggtgaaattattagttttcagttgaacataaaacacttactgagactccaccatctcacatccatttagaaggttctcatatagatgcacctacaagatataacaggttagcacaaaagacctatagagccaattttgcccaataatggtatcaaaatatctcagagttaacaagagtggaaaatatagatcctttactgtctctcttcttgtcatgattataattgttccagtatcatcaaatggtggacgcccagcccttccacacatctgtagatcacccaaataaggggaggggcattgttagaagcaagaggaaaccatatagtataattttataattgaatcacaaaatgctctgaactacaatgctttaaatgcatgttagttttaattaaaaaaatatgatcttacacattacactataaataattgaactagtatgtggcatgaaatttgcacgtccaatttcaagtgttttgcagatataagatcaaatgatgtgttttcgtcaaagaaaaggatcaaacgatatgatgttgtggcaataagtatgtcagaatcaactttg

SEQ ID NO: 107353 - DNA, 507 bp, Oryza sativa
cgtttttactcccaaactggacgctaaatcggagaggaaaaaaaatgtgtagattcatgtagcctcatatgcttccctgaccctgcaactgtactgcgaattgccgtagagttgccgagttgggcagggagatcgatggaatggtgctcctggccataaaaaaaacaggtccagcaattgattgccttcgatcccaatgctagttaattttatctctccggtggcctccctacgtgacaaaacgatgttgcaataattgacatgctcatgacagaatgatcttgcaataactgccgtgcgtgcaccttgcctcagtgaaggcgcattgaagttcttattttggagttggtacgtggtataaatgtataataaaatccaatgaacatgctgcttttgttttatgactatgaacatgttgttagaaatgtcaaaaatggtcaattgaatgctcccaagaagatagcaaacagggtttacaattcctacatgctctttcgtttcgggcac

SEQ ID NO: 107354 - DNA, 748 bp, Oryza sativa
ttaggcttttctacgtagtcctgataaaaatgttgttggtttcatcactggtactatatcacacatttattgagactaatggatcatgtcttttaagaaaaaaaatcaccttaatttggaaacacatgtacttaagaacatactccattcgttctctaatacaagggattttaacattttgcttacactgtttgactattcatcttctttaaaaaaattttaggattattatttatttattttgatttactttattatccaaaatactttaagcacaacttttcattttttttatatttgcacaaattttttgaataagacgagtgatcaaacagtgtaatacataccaaaatcccttatattataggacggagagagtagtagtctagttaatgtttcacaaaaagaatgacatagcagttaataaaaagagaatgacatagcagctactcccttaatctatttttgatatgcatatttccaaatctgaaaaatttatttttgatagacatatttcaatccaacaacctattctcttaatgactttttcggatttgatgcgtgactctccatttttccacacaagattggctacatggcatcgagaaatgtaaatattaatgaatcgcttgtttacgagaaataactagtagcatgtttaaatggatgataaatagaattacttatctttgatttatgtgtcaagataaatatgacattcgaaaggggtaccgagctcgaattcgcc

SEQ ID NO: 107355 - DNA, 606 bp, Oryza sativa
gtttgatccactgtgcgcgcgcgcggggcatgcgccgctatagctagccgcatagccgcgcctgccggagaagggggcccggggcggggggcatctgttgcgcgggcagcaggtggcgtcgtgtgttggaccgtggcgtggcgcggcgtgcgcaacgacaaatgttaagggacggtgcctaactggatggaaacggataggtggcagaggtgttcgcgggtcgtgtgactcgtgagcgccgagccgccgaggcgtggggtggggtgggcttgtgggcttgtggccgtgtggtggttgtctggttgatcttcttgtgggaagaatggcgcgcggttacgttttgctcgtctgtttattccctttgcttaaagtaaggacaaattagttctgtttgtaaatagcacttgtagtacaaagtttttattatattgatactgttgttgtagaaaaggctaatgcacgaacgccttggctttacttttttttttctccctcgagcgaatgctgtgctttcctttctagcgtatgcaccgtcgccgaacttttatacaccgacagtttcttacaattactctcatgccactaattatgtcgtgttgtgtaatt

SEQ ID NO: 107356 - DNA, 653 bp, Oryza sativa
atcaaatgaggtggtggcctagacagaggggattttctacaggatttatatattatgaaagtactgacatttgaaacaaagaattgattcccacaaatttttctagagtaaatttgaagaaaaaaaattatgagatctcatctcatgttttcttcctttggtttcctgtgttttttttgtgtgtcaatcaaacggaagtttcaaaacttcatgaattttaaaatcccataggaatctagtgaacatgacattttattactatggttttttcattaatgcgtgaggagggaaataagaatcatcagttcttctcatttccgttcatcgatcaccaagttaataccaatctcacttcagtgccagtgtggaaattaatttactgtggtccttgtagctaaaacaagtaatctgtaattgcatactgtttgttggtggtcagttcaacttcaaaattctaccccactgttttatgaatttcacatggcatgctactttactgatggaatgcttctgcattgtaataaatggaaggcgggatcaacagtgtcaaaagactggaaggtgtatctttttgtaagttttggaaattaggtgttcgttgaaggcttggagtactgcattggttttactgaagtcgggaaacaggttatcat

SEQ ID NO: 107357 - DNA, 559 bp, Oryza sativa
tgtgtaggcttgtagctatagctagctagcaatttagtaatcgttaagctatagctagtagaaagcgaggcctttatcctgtagcggagggaagctaccccagcagcagccggcgccggcggcgcagtcgatcatcatgtcgtgcaccacgtcgtcgaggttccacaggctgccccacgtggcggcgccgccgtcgagctcctcgcttgagccctcgctcgtcgaggcggcagcgccagcgctggccgccacggcgccgcactcgccgccgccgctgccgaggaggtcgtcgtaggaatagggcgacatgtctcccgggtggtagtacagcaggtcgtccatgtccggcgccatctcctgcattatctggagctcgccgtcgtgggtcagcgaggtggcggctggtggcgcgacctccgcaaggttgtcgtccaccaccgcgctggtggcgtcgtcgtcttgaccgagctgctgctgctggccggtttgcatcagctggctctgctagtgcatctcgcggcgctgcttcaggaaccgagccctcgcgcgctcgatgttc

SEQ ID NO: 107358 - DNA, 581 bp, Oryza sativa
ttgatcgatcagtttgttatttgttcatatccttctttgattttatctcttagcttctcctggcgtcaaatatctaatttgtaattcgctttgtttctctgctgctgggccacagtccggtgataagcgcctcgccagcgctcgcgcgaagtaactaactagatcaagtttgttatagagataaaatcaattggtttgttggttatctcttaattcatctggttttatctcttccgcatattaacttctgaaatcttggcgcgtaggcagctaccgtcttcggccatgggccgagcctatgattaatcactcggatatgcataggttgcttaatcacccaggcatgcacacacatacgaccgtctactgtagtacatgcatgcatgcacgtgattgcctcaccagccaatcttcacacggctagttattggttaattatacatgcacatatactaatccaagtatatatattcccagctgcctgtgcatgcatgtatttgcgtgtatatacatggccgagcattgcgtagaaatgataagctagccaacttacaaactgcttgtttgctttgtccatcatg

SEQ ID NO: 107359 - DNA, 636 bp, Oryza sativa
gcattgattggtgtgtcctgcatcgcctttttctttttctttctttctgaagactctgcatcagacatcagttctgtggaggtgaaaacagccaagaagaggcgagcatttggcttgttgtactgtaccaatgtaccgtttcatgtgctcttcgctggcgctgtgatgaaccaattgatgatcagctctaccgccttcaagttacatggagtttggtagtatacgttggtattccatggcgtgacagtgcctgtgcttttacaggagtatctcacattcagtcattcagacatattctcacccaaatgagaagctatgggagatgggaatgtgctttttacctagagaacatatttactccctccgtattaaatataaacatttctaacattcaaaatttatactgcaatataatcatttatgaggtactaattttaatacacgaaaatccatacattttcagccattcacgtacttgaggagatcatactataaaagagaatcttttttccttaacctcaatatatggtatttttcacgaacgcgcaaaatgattgcatgtcatatattagaataaaagagttatagttacatgatgcaatcagtcagaccggcttatgcaaagggaaggggaaa

SEQ ID NO: 107360 - DNA, 509 bp, Oryza sativa
aaattacatgaaatatcctaattaataaatacaattgcctatccgagagctttatctccatcatggcaatcctcgtgaaacacgttgatcgattctagaaacatctttgaaaccattatcatcggaatcggctacatcacctctatcggctgtgtcggatgttatctgtccgatccatctcagtcgatgcagactccagccgatgccttcgtagccaatgcatgctctgttcttcgaatccatctctctaccgaatccgcctcgatttcaatatcgaatctggttcatatattaccaaatttggtcgtcaacagaatgcttccgatcaaaaatatccattgtcctattaaaatttaaaatgaaaattttaatttattacatttgttttatttttaaaatttatgttaaatttttctacactaattatttagtctcattagtttcataaaatgcatatactgtgcactcaaacaaaattttcaatcttttttcaagtttatattcaaaac

SEQ ID NO: 107361 - DNA, 709 bp, Oryza sativa
accactagaacttccttatctatatatttcttttgcagatttggagaagagatgaggccagtgaagttgacaaccaaggattttggtatggttcttgtttctcatcatattgcaaatatttggccaaagcgtaagaattaggacatttgatttacttattatgtcaaagtgagaagaaactgtgtcatgaatacctccatcctacacctgcaacttcctcacagaatcagtcatgaaatgatgttcgaatagatcattatttttgttttactccacaaaatcatgaactcttgaaaatgccactttgattacttagcatgtcctgacagccttacaacacttaaaccagcaatttatatgtttgacctaatctatatctgtttcactgtgctatttaggttatgctccagcaagaaatgacttcctgtttgagagggtatgcattttcttactatctgagaatgttccttctttaaaatgagaagggacaattagggcgtgtgctaagtcagatgtcttcttcatctccttgagctgtactactgtactgataatttgtgcataatcactgaatcgaatctgatatatttattttctttatttctttctacttgtagagactccaaagtttcattttcggtaagttacatctacctatctgtcaattgtactttaagttaagttagcagaatttcaggattcaaaataa

SEQ ID NO: 107362 - DNA, 1642 bp, Oryza sativa
cttgcccctactgagtttaggacaaatcaacgtcgtgcacagtccctagcatatccctctcgtgcacactacttatttcttagttatgtatggtaaacaatttcaaacaaagttctttaattttgttttcgaaaaacaaaggtgatatctgttcatatgcttggcagaacaatatatattcctctatcccattcaccacttgcatgcatattagtcctggactcctagctatagaatccttcagtttagttgtgggccaaaaacaccggcgccaattagctagtcgcctatcagtgtgcacaagctgcaacaggatgtgagcggaacatatatggtcccatttatcaacttatcttgttctattattcgcaagtccaaactcaagtcactttccaaagcatgtgcaccttttttaactatcactactagaaaaaccattttcccaggcgggggaaaatggccttcccaggcagatgcccgctccacctggaccccaacacctgcgaagatcaacacggtcgggaggtccgcctgggaagattattttcccaggcggactagagctaaaggcgtccgcctgcgaagataggaccagtgcgtctaagaaaatttgacagagccgcctatttaattaggtacaagaatttgaaaaaaaaattttacaataataatttgtgataaataatgttccaattaattaattaatttatgcataaaaaatattagtaactagaaaaacatttgatactgacaaatataaatatattgtataagtgaaaagtgtcgtcaagatgttacaatatttataacattgtcacttcgaatacactatctagttgcattatcgcatcgtgttgttccactccggaagattcttgtattcttcgcttgtatccaggatactctctaggtcgaagaaccgtcctttgacatgaaaacactcacggtggatgaagtaacagagatcgcgctgcacatttgtaatagttgtatcgtcaatgcttattcgatgttctattctaggaagctgcatgcatgaaagaagcacaatatatatattagtaggttatagatgtgcagttctccaatgcacttatacgttgagtcgagagacttacatcctctgcgttaaccctgtatctcccattaaccctgaggaattcacatgagtaatacccacagaggaccgagcctctaggttgcttgtgatacttgatgacatatcatagaaggaaaaagttaaattttctaattagtaaaataattggaatacataaactgtgtagactattaccggccaatatgtatgtactagcagcttctcccttgtttgaatccgctctccacccttcttgtagtagttgtatgcacagtatggattttttaccgtttcgtattaaggaggagatttaattgtaatgcattaataattagacatgcaatagtatcagaataacagattgttggaaattgtttgtatgtcttgtgattataatcaagggggtcaaggactgccacggagccgcgctttgggttgataatgaaacatatgtaatgggtgctacatggtaaggaattgatggtgtagctagtcacgaatgagataacacagatatgttaaaagaaacgaaaaagttcgaat

SEQ ID NO: 107363 - DNA, 504 bp, Oryza sativa
ataggagtagaggagcctaagttaaccacacagaagaaaggtatgccacaggatgctcacaggttttctgtccgcatgaaatttgtcagagtcagtggctttctccaaatatgaatagatctgttggacaggacaacctgaaaggattaaaatttaaaattatgtatgttctgcaaatagcacaaaccttagagatatacccgaaaaaactaaagatccacaaaagcaaaatgaagcgagaaataaaaaggaatagcaaaactgccaaaacatcttattatcttggaagagcgtaagaataatacaatgttgtgtaatccccccccccccccccccccaaatagagaaaaatggcctttgatagagcaatactgcaaagtattggcccaatggccctagctaatatttccagatgcatagcatatccaatttcccacacataacatagaactaactagatgtagaacacattcaagaagtgccaaatttctgtttcaaaaaaga

SEQ ID NO: 107364 - DNA, 569 bp, Oryza sativa
ttgccagaaaagaactgtcttatgaccaataactaataaatttcctaaattgctacaaaagctcctactaaaatggtggaatccaaagcctctagtgtataaactaagcaaagtaaagatgttgtttctatgtgcatgccttttaccttgagtacctggtaaaaagaggtgcattttaacacatcaaaatgaatttcacaaaaacaggaatgtacagtatttgccaacaattaatacgcaaaatctttcaaggcctatatcagtataattttgtgaaggatcagcatgcatatagaacaaacatgtatatctactacatgtgtttcccttgatctacatgtggcatcagccaatgatctctgcaagaattttaaaatcatgaaccaactaaatcacagttgcatgattatataagaaaaatgacatgtggaaaaaagcactgactcactgtgcatggaaaagatgctaatattgcgttggtagatcagcaccaaattgaggcaatagatttggcaatttgaaagagctatatcaacacttatatgtgttaacacatacttcttccaaaa

SEQ ID NO: 107365 - DNA, 768 bp, Oryza sativa
agctcggtaccctccacggccgcgccggcctccacaccaccggcctcgcctccacgctcctccacgcgccaccaccaccagagccacgcctcctatgctcccgctgccgcctgcatccccgctgccaccgcatccccgctgccacccgcctcccctcccgcacctagctccagatccggcaatggtcgacgcggatccggtgatgcccgaggtcgtagactccgccaccgctgccttcaccaccgcggcccacaccccgccgcctccgcctgccgccgccttcaccaccgtggcccacatcccaccgccagtctctgcctccacctaccgccggccaaccccgcgcccctgcgccgcctgtcgccaccacgaccacctgccgccgtcgcccgcgcgccctgcacgcctccggcctcgacgacagcgccgctccggccggcctccaccctcagattcgcccgcgccggatctagggtggccgccgccacgagccccgccgccaccatcctagcaagctgatggctttgccggccgtttgctcaggcggcggcgaggcagaggggaggggggaagaacggcggcggcggtggcttgggtcgccgcccgagtcgcccgagcgggaggcgacgcgggggccttagagcaaattaagctccaagagtatacattcaggtatttgaaaatcaggatttagaaaatacaagaacatgatgccacacctcagtgaataatatggaaagtaaatacacaaatttgtaaaataggatg

SEQ ID NO: 107366 - DNA, 3259 bp, Oryza sativa
atctacaacaaagcgataaaaataattttagaatatgattttatatttctgttcttagtggtataaaagctaagcctgaaaagataaataaaaaaactccgaaatcagctctaacataaatttctaaaatcaaattatggttacgacctaaatctgcaaccttattactacctccgtttcaggttataagactttctagtattgtccacattcacatatatatatatatatatatatatatatatatatatatatgggttacgctagaaagtcttataatataaaacgaggaagtagttcaatatgttatttgaaacgaacagcttggcttcaatacgaccgagagtcttgaaagaactactactattaagttctaaactcgtaatgctcgctacaagtacaatacaaaacctggcagaagtggtccgtatatgtacgtacaaatgctggtggttagcacgattaatggcgacggttcacctgctggcaggctaaccacaccgtcgtgtgatatgtgatgaagagtcttaactgtagttctcatcgatctgttgagtgttgactggtgaagtggtgattagggatgaaaacggtcggaaatagtcggaaatagtcggaaacggtattattattttattaactttttaaagacaaatagaaacagtcgtaaaattttcatatttatgaattcatcaacttcaatgccacgctgacagaaattaaaaaaactaaattttgaaaatagtaaccatcggtaaaaatattattattatattaattttacggaaacgatatcggtatggtcagaaaatttccataccgttttcattggtgattgcgtcaaaaaaaaagagtgttgacttgtggtggtggtggtgcttgaccccaatcagcttccttttcgggtctgttcactttaatgccattttcaatcttactaaattttggtaaagttgtcaacaaaaaatggctacgggccagtttggtttgcgacctaaattggccttaccaatttttggcaatgccaaattttggtaagttttggcatgacaaattttgggaaggtaaagttgtgtttggattgaagccaaaatagcctaagttaattattgaaatggcctattttcttaggcatgccaaaatttggcttcaaaccaaatagacactaaacactattaaaattgccaaatattggtaagccaaatttaggcctcaaaccaaaccagccctacatttagtttgctgccaaattttggtaactctataagaaatcatgtcaaaattttagtaagttgccaaaattttggcagctattccaaaattttggtaataccaaaatttggtaaggttttttttggcattaaagtgaacccttcttttttacaaaaaggctgcattgtcacaaaggccacgaatcagaaggcccggtctccgttgtgcggtctcccggcccaatatgcatgcggcgtaccaaacggatactactttactactctgaattttctctgaattttctgaagaaataagggtctcaaacgctcaaatggacgcagaggctgaggctctatttatggcgtcagccaacctgcaattgcgatcttttggtggtggcatactatgatcattcggtattttgatgactgatggatatgtgctaagacgtggagaaaagcaagataagataaagaaagcaagcaatgctagctgccacacacacacaaacagagcaaacagacagagagagcaaaacagaccaaacaaacagagagatcgaaagtgattagtgggtgtccggctgctcttcccctcagcctgcgctgcatgctgcagatgcgtcgtcgcgtcagcaggatggagatcgtcttcgtttgcttctgcaggagccgagcggaaatccctttctcctcctgctgctgctggtagcccgacctcatcaatcatcacaactcacaagcatcagagcaagccaggatggaattgtgaattttttgaggttttggaggttcagcttgagcacaatccaatcagctgctgatcgatgcgtcgtcattctctacgggtggcactccagctaccagtcctgactttgcactgagtacctaccaagtaccaactgtttgatgtcagggctctgctccacgctcatcagctcatgcagtatgggcctcttcttcacaccaggctgctatccgcacaacataactaatcaatggcttaattgatcatcattggtgtttaaaggagaagattactcggattagctcacttgctatcaagcccgagaatattgattattggactttgagcaagcaggttactctgtcatgtaccagatgtcgctccgctttgtaagctattaacaacactggacggctcaccagacatgcatgattatcggtttagatggtaagtatactttatgctaataattatatgctcttgtccagataagatatgtctccagtaccaaacgggatttttgctaacgacaataagaagctaattaaatcagggcatcaggcataatttaggcttgaacttgggcagctatgtatggctgtgaaaataatcattttcattctctgatgaacaggtgtaatactcttcttacggtagtgattttcaggagacggtatgtacggataccgttaggctgtagacatcaacgatatctcgagacgactggcggcatctcgatcgatttgtgatgaggagaaaacaagctttcccatactgatccaacggaacagatgaacaaacacactttgccatcatctcgtttgattaatttctgatccattttcccctcataaataagccagcgcgacaattcgctgcatcagaactttccatcatctcgtctgattaatttctgatcgatttttccctcataaacaagccagcgcgacaattcgctgcatcagaacatagttaggtatggtgtatgtagcagtactatatagctttttatcacaacttgtaggagtaggactccaaggattggaagctttatccaacttggtacttattaaacacaacaactttatccaaagccgaatcgaggtcttagtacgctcgtattacagtaccatctcaaatcgagttttttttttgaacgaaatcctcatcgagatttatttgtttttgttctgcggaggaccacctatcatcatgtcaatcataagatgcacttgcaccaactatgatgacattacgcttcaactaatcctagctttatcaccccggctctcctctgttt

SEQ ID NO: 107367 - DNA, 695 bp, Oryza sativa
taatcgatatcgtgaggcaaaggggttcatacaagtatacactacaggttcagtcgatatgatcattatgtatgtccggtgggttaatacgttctgctaggggccgctgttgacgtgtggaccgaaaaggagttttcgggttacagccgaatatacatgaacctacagggtcgcacgcttaatgggccggaataaggcgattggatggagatccaatataagcttaattcggatagggatccgaataggagtcctacgggccttggaggcccgagtgatggatcctatatattcgtgaggggtgcgaccggcggagatattgcatcacgtgagaaaccctagccgtcacttccctccccacgcaaaaccctagccgcgcgcgggtgctagcatatctgcgcgtggcgttctgtccctgtacgtgtagataccggtagaggcgccgctggtttgcggtgctgattagcgtgggagtacggcgaggagaacgcgtgaggaagagaaggtcaagccggtgcgatcgactaccttctctacatcgacgcgcgctacttcgcgagagttccttcgacttctcagagtcttcttccgctgcgcagcgcgtagagtggaaacgatctatgatctaatacttgcatgggtcctggtttacgcgataaaaaattctgatatatgctatcgtagactacgcgtat

SEQ ID NO: 107368 - DNA, 1241 bp, Oryza sativa
aaaaaataggtatattttcgctgatggtccaattaagaggcctgcctgcaagttttcacacccagccggttcatacttcctttatgatttactcccccgtccatcacctctcctcccgaatctcctctctgtactcctcccctcccctttcctctccctacctcatttggctcctctcagctctaccgatgatgggagcgtgcaagcaagcgccaaccggtggtggcactgtcctcaggagcggcaggaaggggcgacaatgactagggcgatagtgacggaggcagcggcctcaaggcagcggattaggcggcaccacccttggccgcgggagaggtggatccatcaccaccaggcagccccgctatgggatccgcctctgccgacaacacgatgggcggtgacaacaactgtgcggctacggtaactacgatgatagtgaaagcctcaaggggagcggatccactggtcccaatctcgggagcgacgctggtgaaggaaaggcaaggggtggcggtggaggtgcaggatcgaccgcccggccctgcgacgggtggatctatacagggtggtgaaggagtgctgaggagaggcggcaataacttccggtgcaacgacaatgacattggactgcgctggcgacaacgacagtgggaatgggagcacgggtttctgggtttttgattttctggactttttttttttgcagatggatggcattatgcaaaaaatctgttttcgtacacggttcagctacctgtttgggaaaataccgattttcacagacacctcggggcatgtgggcctcatagtcgtttacaaatttatgttttgaccgcttgtaaagatggtttatgtatgagagaacatgacttgtaaaaccatagatgagactatagcacaaagtcacttcctctataaaattttgcatttcaacccttaactatttgaccattttagtccctttattaactaaaaatgttcaaattttacactacaaaccttatggcactaagtactatcatacatgtaccattttcttacccatgccccactggccattgtcaaaagcatcacattttcgtcaccctcatctatctccctcacacaattactctgctcaccgcacattggacaccgatcccaaatcgcctacacactaacaccatcaccatccccatttcttcaaagcacaagcaacattgtgtcccttattagtgatatgctctagaagcaatcat

SEQ ID NO: 107369 - DNA, 1201 bp, Oryza sativa
atcaaaatataacatagtacaactaactttagatcacatacacgtatttatcacatactactttctttctagccaaatctggagtatattgtttgtatggatggaatttttatcctgtatatatatactgacaataaataatatatttgtcaagtgtccatcatatattaaatcgatcaattaggcattatctacatctatacctaagtttatatcactaacttaatacataatatatgacatatttattcatgtctcaggcttccttcctttaatactcacaaaaaaggtatattggggtaaagggattttttccgatccttttcatacccaatttttttagtatatgttcaatatgtgtagcttaacctcggaaagtgatccgctgtgcatattttgtgaatcaaatagctaaattaacagagctttaatgtaataattgggtacagctacattaccatataaatgagctgcgatatatagtatccatgtttccaaataattagcttccatgtttccaaatacgaaggaccagtatttagtattacacatacctagtttgcataaaaaaaagtcaatttctccatatactttgtttccatttgtcaccattatataaccatttattcaaacctcaccatgcatgcaatcacgcaagtttccatacttacaagatattatttccaatttcatgggtatttaatgttttcatttttgaaatgtacacacacttatggattcaaaccacaccgagcaatcacgtaattttccatttacttattatccatatacttagtttccaaaaacgaaggatcagtatattgcacgtaactttccatttacttagtttccatatacttactttccaaacacgaaggattagtatttagtattacacatacctagttcgcagaaaaaaaaagtcaatttatccatatacttagtttccatttttcaccattatattaccatttattcaaacctcaccgttcaatcacgtaagtttccgtacttacaagatattgtttccaattttatgggaatttaatgtttccatttttgaaatgtacacgcaattatggaatgtttccatttttgaaatgtacgtgcaatgaactaagtttccttattttagatgtattatttccaattacacggacatttaatgtttccatttttgaaatgtgcatgcaattatgga

SEQ ID NO: 107370 - DNA, 632 bp, Oryza sativa
aacacagacatgccaaatgcagagatgattgaagcatacccagttccgtatgggatgttaaaccaccaagtgggagctctccacccatagggtacggcaacgatgccggttctcatcatggttttgtaatgcacaaatgtcgctccccttgtacacaccgtccacgatatggaatttccggcgcacctgaaataccccattggccatggtaccatgagtagaggatgctaccaccactagagccaaaatgattgttgataacaacaaaggagctgccatctcttcagcaaagtgcgtactatcccttccctttttgtattttatggagttttaaatggtaattgttggttcctcatctggtcctcatctctggcaatgggctattctatgagcttcaatatgaatgggtaggggcatgctagcaaaagatgtggggaaccgtgaacaggaaatagctaaaagtggaagcagtcaccaattattgccgggagagagtacgaggaaactggaaactacatgggtttttgcggttgagaaaaatgcacgtgtgtttttttcagataatggatataaatctggccactacactggtgaagaaaccgtctttagtcccggtttgtaacccatgtagt

SEQ ID NO: 107371 - DNA, 776 bp, Oryza sativa
gtgtactcggtctaccgcggtcctttaggttgacatgtggggtctgcatgtccacaagcgcagccttcctatcttttccacgttagcgcttacacatgttttatagttgcaaaacataattataataatccgcaaatctccatgtaacagcattaaacttcggatgaccatgtcttggtcatacgagctccgaattgacccgttcaactctcttaatgtttgttataacctaaagaaccgtgtgctttctttttatgtattgttattgcttctttataggcttgtagctttgcttgtgtgcttcgcatagcttctgtcgttccggaggttcctgaagcgtggtttgcagtcgttgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcttatttacctttgttatgacattattattgctattgttattattaccttgttcaccctagaataaataaaaccccaattagtgggtactctattcatggttccactagtatgaatttaggtaaatgcttcgctgattaattaggcaacattatgtggttttataactctagactttgggaatattcatctcacttggacattatggaatggttggattattgtggaattggatgcacacctccccctctattcaaaacccccaaaatgg

SEQ ID NO: 107372 - DNA, 3158 bp, Oryza sativa
caccactaccactggtgctctgatccatgtttggaacaagagactcctctcctgtactgctacctgagccatgcttgtcgatgtttggaaggtggagagcaacacctgagccatgcttgtcgatgtttggaaggtggagatcgtggctctccagtattcggttaatggtggatagatgcccccggacttcatccatcttttgtgaaagtggagctcatggttgtcctgtatgtagatgatggtggacaactaacccaggacttcatccatcttggcgaagaggggtaccatgccttcaattgttaacatcgagatggtggtggcgaaagagtgctctgataccaatatattatggatagaatttaggtggtgcatgaggttgcgaatgttgtacgagcgtccaataggaggcttagtccctagtgccctaggatgctgaggcaccagccgtgagtgaggacaaggaatcatcatgctgtgaacaacgtgcaaggaaggagatagtttctgcttattccttctttattgtccaatagtacatcaaattataacctaattaataggaaattaccaactagggatatgacacactaaaaggaaacttgatggtgcacccggcgtgttcttggactgctgcttgcgacggcggtaagtaattataacccatgccacatggttgaggccttaacccgtgcattgaggccccaatcacgtacacaatggccgcccactatttgtaggtcggttcaaggggccagcgaatgaccttttcttaaaccaactctgaaaattcacaccagagttgaacccatgagctagtaggtgctaccatgcataaaagtgtaaatactaggctgcatacccattcacaacgacggttgcccatattttcttggaggcatgctttaatggggatctaacatgtgatcaaccgtgcacggacgtgctccccccatcccaacgcgcggcttcgccccccttctcatatggttttcaagaaagaatttaatatatgtttagaaaagaaaaaaaatactaacaaaagaagaaaaaatctgctcagacatattcatgtgtataaactttatacacataaaatctatgtgtataaacattcaatgaagctaaattcggtatgagatatttgaatccatttgtcagacatttaaaatttggtgtataaactttatgtgtatagactttgggtgtataaactttgattgtataaactttagctgtacaaacatttcaaataaggaaagcatgtggagcaagaaaagaaggggtgcccagaaagaaagggcgacctccacacgctgatacatgagcattggcacgccgaattcgggcttccttgcctttggtcgccaccaaataacaaagagaaaaccaatgtatgtctagagtttattaaaagggattgtttagattccttgggtggcaatcctatagttctaataagtccactcttaattaatcaaaatagagtctctttcatatggataaaaggtcaaacaacaaattccaaacctaaatatgacaagcattttcaatttctaaaaatttacaaaattatatgtagaagtattcaataacttgcaaaatcaaaaaaaaagcaaggataattcagtattttgaaacatacgcacaatgacctacaaataaaaatattcttatttcctttataacaacagacaatttaatttcgtttatctgaaacatttttccttcaatggaaaaagacggaagttcatgatatagtagtttccgtcctagtttttattgtggacaatcttgatttgcatcttagcatttagcgttcaagtcaagtaaacagtaccagtgcctagcaacacgaacataaataaagaaccgaagatacacttccatgactataagtggcacttaatttatttaaggagaataacatcatgaacttgaaaagatggacatataagaggattaatagcatgcaacaataataataatgatgcacatatggattataaaatagttagaccgattaaaaacataaaatagatatagtgaattgaatagagtaaaactgctgaatgatcacgcataaaacaacttcatgacacaattaccttaaagatggtaatagcccaaagtcttatcagcggtactagaacccttcaaacttaaagaacaaatcaagttcgaaacatattacctctagaatgaaaaaattacctctagaatgctcaatataaaatctgaaagcccgaaaacctgaattccgacaaacaagcaaaactatgtttacttattattctggtcataacttttaaaccactcaaattatatatattaatttacaatgcactatgttggcgaatggcctcacaagtccatgtaggaggcatcctatcatggaggagaggggaggtggaagcagtggcttgtagtagtgtcagggtacactcactgaggcacattcctttggagaataaaacgatgctccacaccgcagaggaaacggcatggggagagctcagtgagggcaagcatctccaggtgtttgtctcgttgttggatcggtacctcagacacgcagctgctcacgttgacaccatatctgcaccattgctgggcaagtttttgcatctgcattgatataaggcttatcggccgatctctttgccatatatgtgccacagctgtcaagcgtgacacaccactgcaagcttatcgtctgatatgtgccatcaacatcgtccttcagccgagcagccctcggcgccacagagctcatcagcccactgcacaaactccatggagggctgctcacgatccgtcatccgtgttaccacaagcccttcaatcgtgggaggggacggtgaaagtggggaggtggtggtgattggtgaagagtgatgactcaaagctttaaagtaaatgaggatggcagcattcacagtgaatggaagtagttggaggcggaagtggcgatggtgatttgggagtagaggaggacaacgacggtccagacgtgtgagggtagatgagtatgcagggttatggttaggctatgatagtttaaaagaaaatttcttaccatataaaacaggaaccatgagatgctgagcagcggtacaagatttggagcacagcaaactggtttgacaaacttggga

SEQ ID NO: 107373 - DNA, 503 bp, Oryza sativa
cgtacggttgagggggaaagtgggaaggaaaaaggaaacaaggggagactgggactttcccgaaaaggaaaagcaatgcagtgccattttaggaaaagaacggaaacggatattgttcgtcatgcaaaacgaaaccgcagaccgagaggggtgtgaattgggcacaattcacgagcaaaagcaaaggaagaaattattagcttgacacttttacttagcaacactgcctccattgttctaatatttactctttaggtcctgttagtgattttcagagcaaagagaatttgaaaaaaaaatttccctgacaattccgattactaaatgcattgttaattgggtttttctcctgattaaccaaagcaaattcttgaagccatttattagtgatttggaacctaagggaaggtaaaactcagggtgtgacaaacctacccccttaaacagaataacaacatcgagattcggaagaactggcgaagagatggggatcctctagagtc

SEQ ID NO: 107374 - DNA, 572 bp, Oryza sativa
gagagcttatctcatcttgcgcaaaaagtgactctacatgagcaaagatttgccgaagctaagaagaactttaaaaagatcaaccatgtgtatccttacatgtatggttctgatgatgaagatgatgattccaaagtggcagcagccgaatgggtcagaagcaagaaggtggtacaatgccaatggatcaagaattctaggaaagaagaaaaatatgactttgatatcaccaaggctgacaaaattttcgatttgttacttcgggagaagcagattcaactacctgctggtcatataattccattagctaaagagctaggaaaaaggaggtattgcaaatggcacaattctggttctcattctactaatgattgcaaagttttcagacagcaaatccaggtggccattaaaggaggaaaaatcaaattcgatgattccaagaagccgatgaaagtgatggtaatcctttccctgtcaatatggtgcatacatttgggaggatagccaatgcagggaggaaccaaaattttcagatgaattcagctagaattatcaacaaataccagagaaag

SEQ ID NO: 107375 - DNA, 603 bp, Oryza sativa
cttcgttggcaggttgggtgcgataacttcgcatttgtcgagaatgttctcgataatggagtgtactcgaccataacctaatcgagtgctcagttgttcctgaaaaatattttctagaaggcaagatatatagcagataatatcgagtatgtactcaaaaaactgcatggatcttctagtattatcaggatataatgagtagattaaatatcaggcattatgtaaaccgtaaacaaacatgattcatacagaagagaacaaagtgaggccccagcgttagaccgtagtcagtttaacgtcggaaacactcacgcgatagatattgtataaaaaacatgctctaggtaaacatagtaaattgtagatctgacaatgctgtatgatctgaataggtacgataaattcatatagaatattgcgtacctttgtagatatatgccggatatatctacgaaattagtagatcaatttaattaattaatctactaattaccttggttgtcatgccgtgcgtccttagtagagatttcatgcatgcggtagattaggacgtggattaatatatcaccaggatcatgcttactgtgtacgggttggacaccg

SEQ ID NO: 107376 - DNA, 2806 bp, Oryza sativa
tcaaatgattttacaaagaaatccaagtcctcaaatgattcactcagtctctccaagtgtatcaatatgaattcctcacctttttgcccttttagattcctactctaaggtttgatatgtggagctcagtagggatcaaacatggcatacttgcattcacgtttattactaagtcaaaaacttagactaaaatagatgactaaacatacttaagatcaagatcgtgcaaagtgtgtgtgtgatatatggtggaaatgaaatgtgaagaaaaataaagaaaacgcttctcctttgtgcttactttcttctcccaaaaatccttctttttattaataaggagagggcatggctacattattatcttttttttcttttttttccaatatcatgctcatacttgagagagcataactttattattttcataaccatgcctttccctctttcctttttttttttcaaaaatgattttctttttaggagaagaaagcacataaaatcatggagaattcatttttagtggtagtatggaaatggaatggataattgctagctcccagtgtaggagtttagcatgtgcatatatgtgggtgtatgatcttgatcatagagcatgagaagtatctacacagttcacaagaatttgacaaagttcaatagaattgcaagtaaccaaaacatatatggtttaatcaacatggaatatttttggctctggtaggaatttatatcaaatgaggaacttcaatataggttaaacttcaatgtgggtgtattttgggtggatactgcccaaaaattttgttaaactttcattcatattttcatcacatatatgttagccttgtcaaacatctatcaaattgaagtccattttgcaaactgaaatcaaatttgacaaaaaaaaatctaacaaacctaggtcaaatttcacgaaaatatgataaatttaagtcaaacttgtcacaaatcggtgaaacctaaaataagtgcacaaatttatcattgttctttctcaatatttcaccatacgtaactatgccaaactaactaaaagcttggtaaaatgagtaagggcagaagggacattttatactccagttaacacatttacgtacccttaacgtaatagggtcagactgtgtcttcaattttgaaaaaaagatcaaatgagtaaagttgacagaagagggtcaaattagtagttagcttagtctagagcgtggtcaacgagaggaccacaaagctaagaaactaaatccaatccagcccacttgcttcccctttcctcctaccttgtggcccatgtgtaaactagggaaaaagcccatgtgattatttgcatttatgttggctgaaaacaggggcgaagccaaggggggagggaggaggcctggcctcccccaacgacagaatgaatactaattaatgaatctcccttcacctgtacactactagtgctagtgtgctacatacagcactgttatacgtacgattgtttttgtatgacgtttatacgatgaaacgtttctctccttactcctaacgttttttagcgatgaaacggatccctcccctgttgagtccatatccaaagcccaagctctaatgcgctggtctgctctctcgttggcatgcttgcatagccaaccaaagcaatcttctttctatctaattatatattaagcaattttcgtcctaattatatcttatatggtaattgtacttagcgctcctttattatgtggcaggtgaagcaaattactcatacatatatgttccttgcaccttggacagggatagcatcaaccatagttgaaagtagattctaatggccaaaattagaattggatgcagaaaaagttcatatatatatgaaccaatgtcaaacaaggtttgcatatgtttagatacagagagagttcctagagacaaacttaaagccaaagtatagtgctgctcagcacattaattgatgtcacatggtgatgaagcagaacttgtttcaaacattccactcttttagtcatgaggtagaaggcccaaaatatcttctattccctttagattagacagtaaatttagttagattaaatactacctggtagattattctaatataatctcaaagtatagatataatctcatgtcagatgctgcaaaaggttaattgggctttcgggcccataagcgatcctgccgcgtgtgcgtgcgccgcgcgctcgcgttaggttcccctgccgtccgcgccgttacgtttgatcgtacaaaaattggaagataaaaatcgtatgcgtagcattttccgtgctacatatcagtaataatcaagtttaagtccttaggtgactaatatttaagctgtataatttattatggtgtagtgttcaatcataaattaaacctcaattcccgtagtgtaatttaccaatccatttcaatttttaaatttctataatattaactaatatttgcaagatagggagtttgttgcttcttttgacaagatctaggtttatttttattatttatcagatagacttttagcttggatgatattatctctgcttataatcatactgcttagtcctcatatggctaaattaaaatttagagtaaatttcactttggacctgttttattgaccaaagtttcaccatgaactatgtctaactctaccttttcagttaacaccaggtattatgattaccttcttttgcaatttggacccgggttttaagacttcggccacttgatccgagcctagtgaactaagttcagggaagagaaatattcgatggaaact

SEQ ID NO: 107377 - DNA, 1515 bp, Oryza sativa
agttttaaggttgcaattttgtcagaattttatcttttttgttattctctatgtagaatgaatttggagatgcgactttgcacgtaaatgtaatcctattgaaagtatatgtatctgttttcctagaattttttgtgataatttttagttggtgtacacggtgtgcacacgtgagggcctgtgtgcataggatacgctccctatatatatatagaggagttggattttttgcacgcgagttcacatgtacccacaatctacaccctatatgcagcttgcacgaatcttagagcgagtatattaggtgctaataaaatgtaccatgcatgatgtttacgttatactattttttttacaagtgtaaaataccttgtttatgtaatttttgtatttcttgtaggcaaaacttgtttatgtagtttaccttgtttatataaattaccttgtttatgtagtttttgatggtaggatatatatcattttggaagtatcatttttgcaagatgacaatttagtgatatagtagatatattgttttctcattttgactaaatatcatgttataaacaaaataacggttagagaaatacaatacactagatatataaatgtcatatatgattgttattgaaaaagttatttggtaaaaaatacaacatacatgttatacatattgtgaactaacctaatcctaatcttttctccctatagtaagcattcatttggttaaggttaggtacattttgcagcacgaatcttaaaacacatcaacggtgtagattgtaggtacatatgaacccgagtgcaaatatgcattttcatatatatatatatatatgtatatgtatatgtatatgtatatgtatatgtatgtatgacgcccggatgggactccatggagtatgggctccaaacttgggagctgttggatggttgctaatcggtttgatcatttgattgcaagagcttaatgggtatagacccgtttagagtacaggatttactagttaatggattccatatatttgaatagattaaaacaggaattaatgcatttatatgcatgcatgcatgcagtgtggatgagagaatttccataattgcatgcacatttcaaaaatggaaacattaaatgtccgtgtaattggaaataatacatctaaaataaggaaacttagttcattgcacgtacatttcaaaaatggaaacattccataattgcgtgtacatttcaaaaatggaaacattaaattcccataaaattggaaacaatatcttgtaagtacggaaacttacgtgattgaacggtgaggtttgaataaatggtaatataatggtgaaaaatggaaactaagtatatggataaattgactttttttttctgcgaactaggtatgtgtaatactaaatactaatccttcgtgtttggaaagtaagtatatggaaactaagtaaatggaagttacgtgcaatatactgatccttcgtttttggaactaagtatatggataataa

SEQ ID NO: 107378 - DNA, 541 bp, Oryza sativa
cgatgttgatttttttatgggacatttaaccttttatctttattaaaaaaatttacgtaattataatttattttgttgggagttagtttatgacttaaagtattttaagcatgatttatatcttatacatttgcataaaacttttgaataagacgaatgatcaaacatgtgtttttaaaagttaacggggtcatttattaaaaaaaaggaggtatgagtagaattgaagtggtagtttttattctgaacaatcctgaatttaggtttctatcctaaacaattataaagcatttaccgataaaaccgaaaagtcccctattttcatgtgcggctcctcaaaaggaccatacggaaaaatcaattttcacatgcgagcctcttaaatggaccgtgggcctattttcgcaggtggttaagagcaaggctaataatacagccgacatgttggctataagggtctttatagtctttctcagcctacccatataatagtagatctttacaattaatatatggcataactggctctctcacggagttt

SEQ ID NO: 107379 - DNA, 574 bp, Oryza sativa
tatatgacctagtaatgagttgtagtggatccttatctttcttgaaacaaggataacaacgaatcattaaagctttctgaacaaattgcggataacaacgaatcatcaaagctttctgaacaaattgcaatggaagctggaagataagaaacatatgaccagtacaatataaaatgtaaatgtgtagtcttttgaatcccccattgtcaagccaaaactagataattcttcccttattggcttgacagttcattttggcaaactgtagtgttgggatatgttattatgtaacataagaaaatagcaaacataaactcagaaaaagagtgggatgcttgctccatatgtgactattaaatatacactagtacactatatattttgattatgaaggcatcaggtagaggtgtctgtttcatataaacttacaagggtctacgtgccaagtgaaagccctcacaaaatggccaactcaatgaaattgatgtccttacacatccaaatgaaattgatgtccttacacatccaaatgaaattgatgtccttatacatccattttgataacatgatatct

SEQ ID NO: 107380 - DNA, 530 bp, Oryza sativa
tatgaattgggaggtttcaaatctgcgatataaagccaaattaataggggggaaaatatgacagaattggagagatgaaagtagggaaatgatttttgcaatcaatttggaggagagacgtctggggaggcggatcaacctcggtggcagtgctagtgctagctagggagaggggaactgaattggcgggttggaggtggaagacgacgacgcagcgacttcgtggactggctgagccgtgcccacctaggccgagcaaggtatacccgggagaaggaggggactttgctcatgagccaacggaggaggacaggaagcggactttggctataatcggcccaaagagagcacatacttgtctttaggttttttattttcataaactctgaaatttgttttgctgcatattttaggatgctctgagaaaatcaaggaaaaactgaggtgacattttagagcatggagaatttaagaaacatactctaagccacattcaaacttttcttgcacatgttcttgaacttttgtca

SEQ ID NO: 107381 - DNA, 807 bp, Oryza sativa
actttaggtgcataaatttactaaaataggaaagtaatgtggtgcctaaaaaggaaactatgtggaggagggggggatgatcactaggggcgatcgattgcccgttagcctttttggatgtttcatgcttacgtaagttttgtatgtaattattgctagtggatgatgaggtggcatgcttgcatgttgaactttagaattagtgggctataactttacagtaagataggatttcatgttggacacaagcctagggactagggcacaaaccatgggggccggcgcgcatcaatgcacccttccggctgtgagaactatagtgggtgccatcctccatgttgggcacaagcctaggggaagcggcggggactagggtttggaggaggcttctagtcagtgtatggatgttaggtccgaaagctagtgagagaaggcatcaatcaaatggcaaaattctttttttcattttgtatggtgccttgcagaaatggaaaggcatgtgtgataaaaccaacaggttattcccatcgcgtctttctttcaaggcatgtgctttatttaggccatgatcttgtaagcgatggcatggattgcatgcaagatggcacttgagattgttgaagcttgccttgttagccctaaacaagactactatgccaataaatgtgtaatgccacttagatttgtagttggttgaaagggtcaattcgacctagagggggtgaatagacaattaaaatttttaagtaaaaacgaaagcaatacttttcggaagtgaggggatcctctagagtcgacctgcaggca

SEQ ID NO: 107382 - DNA, 711 bp, Oryza sativa
aaaataaccattttaccctttggatgaacataaaaatttacgaattacattattggaaatgtaaaagtttgtcgcatgagactattatagttatgagtttgatgtgtgacacattatttatgacaaaatatttttagataatgaaataaaaaatacgtatttattttatttttaaaagtcataaaaatgaggagcatacatacaaagataggactgcgaatgctcaccatattttttttatgaatgctcccgataaaaaaaatctattgttctattaaattttaaataaaaatttttatttattacatttgttttattttcaaaatttatgttaaaattttccgcactaattatttagtcccattttctacataaaatgcacatattctgcactcaagcaaaattttcaatcgttttcaagcttatattcaaacctaaatcatcaagggcattaaagacatttgccaccaacttaacggtgaaatgaaggaaaatgtgacggcaagggcatggaagggatcaagttaaatatcaggggtataaaagggattgagtgatttttcaggggtatacaggaaatttactcctataaatcaaatacaatgtgtataatttatatcaattgttcatcactatgagcaattgtgtagctcgacatacatgtacaagattgtaccaaatatgatatgatgattagagtgggaataattt

SEQ ID NO: 107383 - DNA, 1363 bp, Oryza sativa
taaaaaaaatgttttcatatttttcccgcttctgactccgtctgtttactcactccataaataagagtaaaaatttgttctaaaagattcttggtggtagagtgatctactagtcctgaatgaatataatctcttctcatcgttacgtattaataaacgataagtagtttttaatcattttcaaaatatatttagattagctaaaacacttatagttatttagagatggatgaagtaactttcgaagaatggctgctgccggtcgaaaaaaaatcggccggtcctttctatccagacgtctctctcaactctacgcattctgcacatgtactgattagtgattgaatatcatgcactttctcactccaaagaaagcacgtgatgcacgaagagagtatccaaccaaatccgactagattacgcccctacaggaggaagaacaagcaaaagatgtagacaatctaccaacttatgatgtgtatagatgacatgtgccagcaatttagccaagatagaccaaagccacttttggaaaggtgagtaggctgagatgaagggcatgttttaagaaggtaaattttgctacaggacactgcaatttcgtggttttagccgtaggacaccgcccgaacttacttttgtgggaagacacactataaacgtggtaatttgtcaatggacaccgcgccgattaatagagagaaatcacgtgaatgtcaaaaatgcccttgggcccacatgtcagctctcctgtctctctctatcccctccttccaacgtctgatgcgcagagcggagcaacagcgatggcgggatggcgcgggcacgttctggcaccggccctcgccttcacgcctccgctgccaccgaccatgtccccaccatcatcctcaacaccgcggagtccaccaagcggcaggtcaacgggatctcctcctctctctctatgcgtctcagccatggtggagaaggcaaactcgacgtctccgtcgcctgctgtttgccgtggtagccgcagcagcaagtgtacgatagcggcggccttccgtcgccgacaagcccgctcgaccgtgcggcacttcacacggtgccgtcgccacgcagtggcgggtggcgccaccgtgacgcgggcggggtcgggctcgacatcctgacggcgctcgaggcgtaggaggaggaggaggcgcaaaagcccgcggtgttggcgtcgtccttcgccgccacgaccacccaacaccgcatatcagacgctggaaggaggggatagagagagaggagagataggagagctgacatgtgggcctaagggcatttttgatacttcacacgttttctctctcctctccaaccggaaattattgtt

SEQ ID NO: 107384 - DNA, 827 bp, Oryza sativa
cagctaatagaaatctttccgcggatgcttaaagaaacatactagaaataggaatcggagtaaaaaggagaaacgtacttaggaatcagagtaaaaaaagagttcgagatcaatacgactaaataaacggcctgtacatatatgtgaaaccaaccaatctgaaaaggaaaagtttatttctaaccgggatatttaaattcgttttgtctatatgaagtatttgaactttttctcatattaaaattaatgtattgatccacagcttgcgttccttaaaaacgaactcatgtccatgtaaaaattagaacaatactgcctccttaattaatacggagaaaaaaaagaagagtctaagtagaaatacaatataaaaataactgaaattcggaattaaaaatatacaatattgaaagaggagtctagataggaacctaatacatgattaattaaaattcggaataaaaataaaataaattttgaaaatagaaagagtaaaaaataaaagttcgagtagaaatacaatttaaaaataactgaaatttggaattaaaaataaagaatattgaaagaagagtccatacaagaatccaatacaaaattaattaaaattcggaataaaaaattgaaattaaaaaaagaaaagaaaataagagttcaagtaggaatataatttaacattaacttaaattcggaatttaaatataagcattatttcatgactacatataagaacccaatagtagattaattaaaattcggaataaagaataatataaatccaaaattaggaaaattaaaaatagagttaaagtaggaatatagttttg

SEQ ID NO: 107385 - DNA, 620 bp, Oryza sativa
taaaagcctggatttacctaaaattccgtgattctttttgcaccaaatagcccaaaccccaaaagcgatcaaaagaatagcaatggtagcagctacaggtgggacaactagtacaatcagagaccttttggtctcaactgttactcagacaaaaaaaaaaagacatagagagagatcagttcatgctcagaattactcccttcgctgacttttctagttaaaacttctttagattaaatcaaatttatataaaaaattaaaagagattgcgacatcaattaggttcattaaatataatattaaaatattttgataatatgtttatttgtattgaaaatattgttatatttttctataaactaaattaaacttaaaaaagtttgaataggaaaaagaaaaggtgagagtgacttatattcgagagagtatcatatgtcggcatttcttttacggtgacatcaggatcgttactttgttaaaaaaaagaactgttactttgacatttctttcgctaatcttttatctggggtcattttcattcaaaatataggctcggattgaaacccattttcattattgttttagaacataatctttcaagataaaattgaaataaagca

SEQ ID NO: 107386 - DNA, 666 bp, Oryza sativa
atgcatgcatatatcaataccatttgcatcagtaatctggtccataacatttttgtctgctttacatttgttgtctacttttcttgtccagctctgactgcaagattgactgctgaggctgagcacccaagagttgttgttggtgagatcagtgatcctcatgtgccaagtggttcacaccaacaacagagctcttacatggacaaactgcagcagctgcttacacagaggcaaccatcacaaacccaacaaaatcagccacaataatatgtggaacttttagggtgatttctcattagagacttttgaaaggcttattgattttttttttgctaaatgttgagtaatacatgtgtggagactttcaatgtacaactagaagataccccgtgcgttgctgcaggattacagaaggtttattcagaaaaagaagtatagtttataaactatattcagttattcaccagcaagaagtgtgttaccttcagtattttaggttcagaattaggcttgattggaaaacggaaatctaacatagcctacatttcatagtagaaaacgatcatgccaataaggaccaggccagtattcccatgtgtggaatttgttcttggtcaacacaaacaaaaaactctacactggaagacaaggacagtggcaaggtat

SEQ ID NO: 107387 - DNA, 643 bp, Oryza sativa
  unsure (1)..(643): unsure at all n locations
atcatcatattctacaaaattctcacgttccataacttccggaaagtttacaagataacccacatagccgcctccagaaaaacccttttactccaagattcttgccactaattatcatggcattttgtaaagagtccaggtatcgctgacaaaatgaaccgggaaaaacaggaaagggaaaaaaagaaccaagcaacgttttctaagcactactctacaattgaattagcaagggtcactattacttacacaatgtacaacagatctgacctgttccacctgtacactcaaaacaagacttaaacctaagcctaagaactccagaaatctagtttactcaaaataccaaggctattctaaccacgatcaaaatgtatgctaatgcatatctaactttaatatatctgcactagtctggaatactcctagaaattggaggaaaagttgcaggtttagatcactaggctgcctctcaaattcagaatgtggctgaccaaccatgagataaaaggtggcttgtcagcaccaagcatttcagtgcccttctaagcctannnnnnnnnnnnnnnnnnnnaatctatcagggtcagggctaaagagcgaataatcttgtatctccagatttgctaaatgccaattgacg

SEQ ID NO: 107388 - DNA, 1193 bp, Oryza sativa
cactgagatagcacaaagacggacatatcaacctggcagttcaatacaatctaacatgagtatgtaataataagaaataaaaaggttccattgttttagttgggttgatgaagtgtacatgaccatgttacaaaaaaaaaaaggatgggtggccaaagttacaaacacagtactggaaaaaccatctttcgtgggttggccaaaaaaccgtgactaaaaatcatttttcatcccggttcaaaagcccaggggtactttttgatagatcattattagtcccagttcaataaatggcaggcggtgtcagacccctctactatctttaggtccagttggtgttaccaactgggactaaagatctaattttaatcccggttgttaaacaaccgggaaaaaaagccttgagccgcgcgcgcatgcaagtctggttctctctctccatccttatttccttctcctctcccatcccccatccttatctccttctctcctcctcccctcctccccttcttctctcactccatctcctcctcccctctccttcccttcctcccctcccctctggcaggcggcgtgatgggaggccagccagtggcagcccagcgaaggccgggtgcggggcggtggcctcgccctcccctccgccagatctggccagaggagaggcggtggaatgggtggctggccggcggtgggatgggaggctggccggtggccgggtggcacatgacgatgtggattttgatttgtttgagtttttcttgattttttttgatgatttgtggatgttgttgatttgtgaatgtatatgtgaatgtgtttgtgaatgtttatgtgaataaatttccgatgatgtgctgtgaatgaatttgtggtgttgtgaatgaatttgtgatgatatgtgtgaatgaatttgtgatatctgtgctgtgaatctaagatcatgaaaggaggaaaaaaaagaaaaaaaaccgaaggaggaaaaaaaagaaaaaaaccatagtcccgggactaaagatggttgttcccaaccgggactaaagatgcatctttactcccgggtatttcaaccgggattaaagatagcgatctttagttccggaatcttagtcccgctttgcaacccgggattaaagggggttgcaaaccggggttaaagagggtttccgcagcagtgacatgactagtatata

SEQ ID NO: 107389 - DNA, 591 bp, Oryza sativa
actaaaagtccatgaaactttctataaacgctctcaagccgccacgtggcgctctaataaaatagagaaaatcctagaaattctaagaaaaaagcaaaacatctatcccttaatttttacttaaattggtaggtccaatattatacaccgttagataaaattgatcttaaaacaaactaaataccatggtcccacctatcctcttcccacacattggcaggtgtagtatatacgtacgtacatacgtacgcctccttcccccccctttttttttcctttttttcttttttttcttattttttccatttatatatataatggatatatttttaaataattaatcataattttacaaacaaataatctaccatcatataacttaaaccggtgtacttttttactttgtactactattttcaaataatgcactattttaaaataaattttacacaattatatcatgtatactaaaagtccatgaaactttctataaacgctctcaagccgccacgtggcgctctaataaaatagagaaaatcctagaaattctaagaaaaaagcaaaacatctatcccttaatttttacttaaa

SEQ ID NO: 107390 - DNA, 669 bp, Oryza sativa
actccatgcatacgttcaaatatttgatgtgacgaaattttcggaagtttgaagggggacataaacacggcctatataagttgggatgtgtgtttttgatgtatgggtccatgaggacgagtccctcctgtttggacctatatctctgactttagtgagaagctgcttccaagtacaacccatgagctccttcagttaaaagaaaaatcagacacttcccatttatgaacactttcctagctcaatgtttttgtcctctcgatttattaacttgaaaatatttcagctttgaaccaaattacctttaccaagccagcactacatcccacgaaacaacagcaacgaggttgaaacgtaaatagttgtagagctcaaggcatatctagtggagacgaaactaattttaccacatcatacgtgtgctagatgcctagatctttatttctataaatagaattatctttttttctgaatgagtaaagattgattgattttagtgaacacttctgcttacatggcttcttaaaatcacacacacacactagcatttcgatgccattagcaggtatactggtgctatacgggaccgccccatttttttttgcatacgatgaccatttataactacaaataaaaagcatatgccccattccttagctcatgagcatt

SEQ ID NO: 107391 - DNA, 940 bp, Oryza sativa
cagtggaagttgcggtgtaaaagattgctacatactggttcgagaaccagtgagcgagtagaatcatctctcgaacaccaatggaggttgcggtgcgagagcttgctacgcactggttcgaggaccagcgaacgtgtagagttatctctcgaacaccaatggaagttgcggtgcgagagattgctacatactggttcgaggacaagcgagcgagtagaatcatctctcgaacaccaatggaggttgcggtgcgagatattgctacatactggttcgagaaccagcgagcgagtagaattatctctcgaacaccaatggaagtttgcggtgcgagagattgctacgtactggttcgagaaccagcgagcgagtagagttatctctcgaacaccaatggaagtttgcggtgcgagaggttgctatgtactggttcgagaaccagcgaacgtgtggagttatctctcgaacaccaatggaggttgcggtgcgagagattgctacgcactggttcgaggaccagcgaggtagtagaattatctctcgaacaccaatggaagttgcggtgcgagagattgctacatattggttcaagaaccagcgagcgagtagaattatctctcgaacaccaatggaggttgcggtgcgagagattgctacacactggttcgaggaccagcgaacgtgtagagatatctctcgaacaccaatggaagttgcggtgcgagagattgctacgtactggttcgaggaccagcgagcgagtagaattatctctcgaacaccaatggaagtgttagagttggtttattatgtgtgtatctcatgtggccaacatgactcacacacccaacttgtagcatatccggatgttcgttcgcaatcatgtcgggtgatcaagccgacaacgttcacgaggaattatccattaacaaccttttct

SEQ ID NO: 107392 - DNA, 654 bp, Oryza sativa
atttggtagactctgtatgagattgtacatgaaatatgatatctcgcactttgattatatggatgaatatatgttaagtattataaaaataatggatatatatgttaaaaatattatgaaaaataatgtgaaggaagatgattggatgttgatttgtagaatccaatgaattatagatgatgtgtggctaatgggcgggtaatcgcccagcgatcgcccccatcccccgatacgctcctctcccccttcctcctccccttcttctcttcctactacaccataaatttttttaaaaaaataagaaaataaagttagaaaaatttatgtatggaaatacatatatataaaatatttgaattcaagttcaaatttgaaacgggtatgtaaacttttgacttataaactttggatctataaactaatatttgaattcaaattcaaatttgaatcaggtatgcaaacttttgacttataaattttgggtctttaaactttaggtgtataaattttagatgtatagaaatactatatataaaaatatttgaatttaaatttaaatttgaatcgggtatataaacttttgacttataaactttgggtctctaaacttcggggatataaactttagatgtatagaaatactatatgtaaaaa

SEQ ID NO: 107393 - DNA, 631 bp, Oryza sativa
gtttatatttttagcacgtgtgctagaaaggtggcctagtgttgtactttctctggtttcaaatatttgtcaaagaaaaggataaacataaaagtataccaccatattatattagcaatgtgtgttgtaccgttaaccatataattttcattaacaataaattagttgtttaaaagttattactgattaaaattgaaatagtgatggtgaacagtgacaagtaactgaggacagagtgagtattaactgcaaataagtaataatactagaaaagggcttgcccaccattctacaccaaagtagagcccaaacaattctaaagcgtagatgcctttctctattattatcaagtttacaccaggcttgtttaccagataaggcactccatcagtgcatgactaattaggtgttaactatttcaaactcaaaaagaatggatttgttttatttcctaatgtaactttcatatataaagttttttttttaaaataaatgcaccgtttactagtttgaaaacatgtgtctgcaatccgcaataatcgaaggccctgcgagacgatctcgatcaacaagagggcactcaaccatatcctacttttgtcttgttctctccatatatctcttgctatcg

SEQ ID NO: 107394 - DNA, 1081 bp, Oryza sativa
  unsure (1)..(1081): unsure at all n locations
ttgtgaaccaaaaatttccatttttaaacctaggtgaaattgatttaactcttgcatgaataaaattggagggaaaattaaaactttttcatttataacctagaacaaaaatgtaaacttatgtgtaagcatacatactcgcataaaacatgttttgacttgagtccttcatgtgcatttggattttcgatttgcatttcataataggtctcatcaatattaactaagatctagataaacaactaaaccattagggcctagtgctagctagaggaagttaaaatagaaaccatacaccttaaaatatatcaacatggctaatgtcaagcctcactaaactaatttggctattcatctgaaagcatgtcatgaatatggaagttagtaaataaattaacttatatagaaaatattctatcttaattacctttatgagcatcctcttaatttaatgctaaagtaaacttatggataaataggtaagaagcttatgacatgtgtaaggtaaactgtaattctaacatatcaacatcaccttaggtccaaatataacttctataaatgtttacatacatttgcatacaagagataagtcttgctaattatctaaaataatttgtgcaagataaaatcatggaaaaattcatgtaggttctactcaacaaatacatatcactgtaattttggtacaatttaataactaaatttgatacctcgaataaatcagtcaaaccagtcaaatattagattaattataattctcaattggctaaaaccacaccttgtctaaaagtacatttacctgcgtggaagtgtataaggaaaataatttattcaaatactaggttaattatcatgaataaatatattttttttcagaatttatcttctctgtttaggtctcctaaaaattcaaactagtatccaaagggcccaatttcttctaatttctgtgagtaatctatccataatttttaagtacaaccaaaaaaaatgaaaactaggtacattcatataactncagtaaaatccacatgagcttttctgcactacaaattaatatatgaattaacaaagatgg

SEQ ID NO: 107395 - DNA, 546 bp, Oryza sativa
tttttcatgtaaatatgagcccaagtgataagtaaaacttttttaagcatggttaagcaatatagtgaccaagtggccatgtaactcatattcctagtagttttagaatatgattcctaaggttaggaatgagggagatggatatatgtggggttaaggtatatatgcaaataataggagtttgtctaactagtttaacaagattttaatgtattagtgtacaatcgacatgcaagatttgcaaacattttcaataacctccaaaacataggttcaaagtgatcaaagagagggaggtgggacttgccttgaaactggaaaaagtcagcacctaaatcacttcttcaccgtttaagcaatcatctatacaatgtacacgttatgcaattaaaaacactgaaatatgcgaaaaatccaaaatgctctaaaatgcatgatttgtgcacagtggataggtactggtctaaaatgaatttatgtgaaagaatttctattttatctcatttcatttgagagttatgaattttagaagtttcgtcggtatag

SEQ ID NO: 107396 - DNA, 760 bp, Oryza sativa
ctacgtagtgttatcgtgggtaagtacacacccggacttactgagacttgccacttggtagagaggctcaaatgttattgcctcacatcaaagaaaattaagttaaaggagcttaatttggttgatgtttctatagtcactaggaattccccacgctttgatgtttctataatcactaggaattgcccacgatgtgctggggaaattcctaagttaaaattatattagttattaacaacaaataaaactgatttgtcaaactatgttcatagagaaatacatttggtagactctgtatgagattgtagatgaaatatgatatctcgcactttgattatatggatgaatatatgttaagtattataaaaataatggatatatatgttaaaaatattatgaaaaataatgtgaaggaagatgattggatgttgatttgtagaatccaatgaattatagatgatgtgtggctaatgggcgggtaatcgcccagcgatcgcccccatcccccgatacgctcctctcccccttcctcctccccttcttctcttcctactacaccataaatttttttaaaaaaataagaaaataaagttagaaaaatttatgtatggaaatacatatatataaaatatttgaattcaagttcaaatttgaaacgggtatgtaaacttttgacttataaactttggatctataaactaatatttgaattcaaattcaaatttgaatcaagtatgcaaacttttgacttataaatttt

SEQ ID NO: 107397 - DNA, 526 bp, Oryza sativa
aaattctttcacataaattcattttagaccagtacctatccactgtgcacaaatcatgcattttagagcattttggatttttcgcatatttcagtgtttttaattgcataacgtgtacattgtatagatgattgcttaaacggtgaagaagtgatttaggtgctgactttttccagtttcaaggcaagtcccacctccctctctttgatcactttgaacctatgttttggaggttattgaaaatgtttgcaaatcttgcatgtcgattgtacactaatacattaaaatcttgttaaacttgttagacaaactcctattatttgcattatcaccttaaccccacatatatccatctccctcattcctaaccttaggaatcatatcctaatactacttggaatatgagttacattgacactagttcactatattgcttagccatgcttagaatagttttacttatcacttgggctcatattaacatgaaaaatgattttattaagttctggacagatatgaataaatg

SEQ ID NO: 107398 - DNA, 707 bp, Oryza sativa
cggcagatgtcgaatgaagcaaaagcaaaaccagcagctaggagagcaggcatggctgtgcgcaacttccgttgctagcgcagctgcgccaactagcaacccccttcaatgttttctacaggatgactaaaaataatatctgaatccacgctagttgtaaagaaatggaaattgttataacattgttaaagatagaaacactttggctatgtttggataatgggtttgggatatgatttcccactcctcaaagagtaagtttcaattctagccatccattcttctcactccatttcattctatccctccattcatttctatttcccaatcccacctctcctaacccattatccaaacatatcctttcaccattggtcatctactttgggcatgcgtaatcaaactttgccttacttgtccatgcaattccttgtaaacaagatagtggaatagcttgcacttgaaaactagtaaactattttccattatgaatttcgattgtttttagttaatacagatcacgtcccattcctttcccctctaccactcatttctctccaccaccttatccatatcctctccaccatccttctctctctcatgcatccttctctctctcacgcgaagctcaaaggaggagtggctggggtaggggcagcggcggcggtggctctaacgagctgcggcatcggtggcggctccgagga

SEQ ID NO: 107399 - DNA, 531 bp, Oryza sativa
ttttgcacagtcggccctgagttgcgctccatgcacttttgtctatggggtcggcttgtacgcaagtccctcggctgctggaaccgtgaaggtcggcatcaccctaactatgagggtgcagctcgttggttcctgcgatagattaatcaatttttttagaatattatatatcatatggattcggtaagtctttcatgtattgagtaagttcatggttaccgttatatggtcagcggcgctgtcgaccgatgttggattttccgccaactcagttgatgcgcaactgctgcgtttttgggtgggacttcctaactcttcgtgcgcagaagcaacggcggcctgggggttctattgctcttctcggatctcttgcctaatcttggccctcatcgactcgagcttttcatcgaattcagatgtcagctcagctcttatcgacgcccagatcttggcttcaaggcgtgcatctttctccgccttgttggaagtccgctttttgtactgccacgcgtagtctggaaatccatactt

SEQ ID NO: 107400 - DNA, 559 bp, Oryza sativa
accggttttgtcaaggtcaaagtcgtcttaaccatatgcattcatatatcagaaaacaaataatatatggcatttttctcgaaccaatatggggggttttttctgtcacattcctttagccattgagcctcaccaaattgatcttgagcaagccttgtttattgggaaaatgctctactcaagcccgaccggtgcggggggaggccgatcagatgcttcccccgggcaccctacccccacgtgcgcatttgctaaactcacatatttttccctttccttttacacaaaagatgtttcatctagtatatttacaacattatttataaatctaatgttgcagggaattaaaatattcttttgcaacaaaaaacccatatattttggaaactctctattaagggaatttggtttattttttggtccaaccaaaatgtttcacctagtgtacttacaatgtttcactatatatagatctaatgttgcaatgaacgaaacatttcattggaataaaaaacccacatatttggaaaccccctattaagggaatttgggttatttt

SEQ ID NO: 107401 - DNA, 637 bp, Oryza sativa
atagtggcggatgtttcggcggggaaaacgaaacgactctaggactgcggctatcgttaggggatcgggagggactaacggacccgggcctacacagaactttcagcccaacttcattattggcgaggttggacgcgatccttacggatttaagcatatatttttgccttggtaaaaattgctcacaacagaatatcccaatgccgctaaaaatctttttgatgcagctagataattctttggaattactacaatgcgaaataaaaaggagcccgacagaaaagtgtaatactaatttttttggccttcttaggctacaaagctggttgggttttattgtgatggctcatttcagaaggctattctgtcagcatgctatatgcttattttgctaatgacataagtcatagctgaggctattttgacttgccatttgacattctttatacaacagatgatgaaccctttaagagtggtttactcggaatcttatcatatatgctggcctatagatctttacagtatttttcactcgggtctttctctgacttttcaggcattttaaactaaagcagttggccggatattttatcaggtgccacatatgcttaactatataagcaccttggagagtcag

SEQ ID NO: 107402 - DNA, 558 bp, Oryza sativa
aacacaattatccctaaaactttctaaatacaatttttttataaaaatacgaacatttgaatatcgatactgtgcagttcccatcgataaaaaaaagttaaaaaaaaacttgtattcttaggaatttgggtaaaaatagcccaactagtagggaggcccaaaggtgggtatataagggcgcgcatgcagtcgtgggcctcccaagcatgtagctcgtagccccatccgttgaaaaaaaaataaaaggaaaaagtaaccaaggtcccttaacttgtcgttgagttacaaaatcatccttgaactgcaaaaccggatacaacgtgtcccccaacttacaaaaccagtgcaaactaggtccctcaacagttttgactacggttttaattgacatggcagctgactcatgagcgtgggacccacatgggtcccacatgtgtagacccccgattttgaaaatcggaaatcctctgtgtttatccgtaccaatccctggatcagtagttggtacacacatacatagttggatcacaacatatcacgaatgaattcaggctaaaa

SEQ ID NO: 107403 - DNA, 679 bp, Oryza sativa
gtatcagttgagtttgatttattaagtcatgcttagaatatcaatctctagcctgccttctggttgccgattagggtagtatcggagtttcagctgatcttatctgatttaattatatttgctttatatgtttcattgacatgttaaatctgccctttatgtcaggatattattgcatctaagtatattaagcttatgtttggtatattctgtttgtttcaacatcttaacatagtgttgtattggagtattagccgatacatactagatctatccgatcggctatgctataaacatatatagttctgttattaatatatatttcaatctaagtgatttatactgtctcgacatggcgaccgatctatcccaatcactcaatttaagtatagatataaaattatatattgttgatatctacagccgatcgagtaggtttagtactttattatctatttataaccgccgatcgatttacatatgacatcggctcaaagataaatgatatgtcatcggcacttagccgatcgtctatcatttataggtttaaccgcggtttctttgtctctatttcttgttgattgcaggatcaaatcaactggcacgctaacacacccgaaggcgagctttggacctgcactagagttaagcagatctcccaggcctcatgttttacatc

SEQ ID NO: 107404 - DNA, 682 bp, Oryza sativa
  unsure (1)..(682): unsure at all n locations
taaccacgtacgttggtcctcgccgccacagcaaccacggcngccacngaagctcctagctgactggcaaccgcttcaactgccacctccctcagccacatcgggcgccgccgccacctctgtcggcatcaccgccgctgtgctgcttgccagatccaggcgagtcttgccatgtcgccccatccaggagtacggaggaggaagccacgccgccagccaaccatagggcgccacacctccagccaatacagagcatcgtagtgatggctaggatttgaaaaactgcaactgaatctgaagaaccaaaggagaaggggaggaaaagaaggggagaaggagatgatggagaggaaacaaggagggcgggggtggcgccgctgccggctccaccgccggtgacagcctcgccggtggcagcagggtcggccggtgggagatccttggtggcgaagttttttggtctcccgggttgctccgtgggagcgacacggaagttggttcgactccttccgtcggtcacaacaattggtaggatcttagagaatctcacatgatcctacaaatacaatgatgcccttccatttcacagtatttctccttattataaccactttacctctttcaaactgtttaattactgagagtatggaaactctgaaataacatcttgaattctgtaatg

SEQ ID NO: 107405 - DNA, 668 bp, Oryza sativa
aatgtagtagttgaaccccacaaaagaaaagcaatttttttttcatattgtttctaactaacagtaaaagtgatagatcacattctcatggttatgaaaaatctggtgacttcactgcaaattctgtgcaaagtgcaaacacatgtttagatatctggagaacctatctcatgaacatatttggaaaagcacaatacaacttaagtttaaatatgttgaaaaattgaacagggagtcatttgaataacttgtgggggagaaactgggttgggaaccctgcaagctctttgttaacatatcacagacaaacaatagaaaagtatcattccaggtgtagtgggcaaagtggtccataccactacgagcatttgtcttgtgacataggctgtttctttagttcatttccattactgggtaaccaaaaaagtaacctgtagaaatttttctcatatgttcgtttagcagccattctttgaaaaaaaaaaggatattgttttgaaagaaggcagtatgactaagatgtcctggtatcataaccttccatgcttgtacattcctaccgttctggaaggtatattgaaaagtgaaacagcaatagtatacttggtgtggagaaacttcccaccacaagcaatgggcttctatagtcctataccaagatccatgca

SEQ ID NO: 107406 - DNA, 679 bp, Oryza sativa
  unsure (1)..(679): unsure at all n locations
tttggcaatttagaaaaaatattanctggcatatgatgaacatcaagagtatctcgacaattccagatttgcatcaaagtggacatgcatgaatggagggatggcaatataagtgaaaaaaaaaacagtagttttttttaaaataaattcagtcacaacccatcaatagactatcagtagcacagtgccgtgtaaaaataaagaattgcaaatatgtacaaatatgttcaagtgcatagcagggaaatgttgggctagttgtttatgcgcaatcaacacaatctattatagataggtgttcaggagtaaagaaaaactctcatattgtctgcaatatatatatatatatatatatatatatatatatatatatatatatatatatatctttgacttgtaagcaatactggtttagctgccaactggacctggaaaacgtaatcaaactttggagataattagacaaaaaagaatcaaatagcatgcaagcgtataacagtacctaagaagcattttgtcgaacatttgctgctcacgcaagagtgtgatgcaacatctcgcaccaaaggttattaccttgtgtctgttgcttgttaccaggattgggaagaaatcgtggttaagccgtttcaacaaacacccttgcaagcacagttaatcagtttgtctagcaatcaag

SEQ ID NO: 107407 - DNA, 629 bp, Oryza sativa
aaacccccaaaatcagtttcaaatttatggttgataattcaaattttggatgataagcataaacataagtgaaaagattatgccgatcatctttaactcacatcatgcattttcagccagtggacaatgcacacaaaaaccgccttacgaataactagaacagcatttatgagttaagaccgattgactcaaacaacaaagattcagtaagaagagcaaggagcatgtcatgtttgttaaactcattggcattctccataacatgattaagctcataacacccaagcatcaaacagcagaatcaatttacacaaggactagtcaagcacagcagttcacttcaaccctacatattctagcaagttagtgcgaccactaaccgaagtaaataacaaaataaaaaaaatgaagcaacagtagtacccaaccatcccaacccagttctaacccctaaaccgcccatggtaacatacatttcagaaataaaaaagaggaaaaatttatatgccttcatgtttgctcaagaaacgcaaccatcccaacccaactctaacagtccaaccctttcgtccatagaaacacgcactgcaaaaagggaaaaaacaacatatgccctcatgtttgctcaa

SEQ ID NO: 107408 - DNA, 665 bp, Oryza sativa
tatttactaataattggatatggatcacaattcacaagagcaagcaagcatgctgcactatagtgctactaattgtccaatggctgaaccggcttggatctggaggcgaatttgttgaccagttctagccactttcattgactaagctaagctcacacactccattgatctccttctttgcaagttgcaagtatgcaatgctaaaagccacaaattgattgtacaccatgatcagccaccactacaacagtggatccaaccatggagattttagtggatggctcaccacacatcccactatatgtgttcagggataaactttggtctccgaattcttgaacatttttctcacggatagtaggtttaggccctgtttagttcatataacaaaaattttctcgctgtcacatcatacatgtatggagtattaaaagtagaaaaaaacaattacacagattgcatgtaaattccgagatgaatcttttaaacctaaatgcgtcataatttgacaatgtggtgctacagtaaacatttactaatgacggattaattaggcttaataaattcgtctaacagtttcgtggcgaaatctataatttgttttgttattagactacgtttaatacttcaaatgtgtgtctgtatatccgatgtggcaactaaat

SEQ ID NO: 107409 - DNA, 1853 bp, Oryza sativa
  unsure (1)..(1853): unsure at all n locations
agtaaaaattgcaatataaataccaagtaactacaatgtaattgatacgcaagtataatgcaactgagatgtaagtacagcgtgtaattggtatgtaggtacaacggaactaggatgtaattactttgtaatgaatattaatataattttggctatggagacatggagtcagcacaactactgtgctcttttttttttaaacttaaacatccaataatataaaacgacagagttcatatgaataaatcccagtacattgccaaaaggataaagagaaagcataagaccatccgtttcgaaagaacggaaaactgcactaaggccacaatcttcatatagaaaccacacagcagagaaggtgcacatcgacagggagctgcagtgatgaaactgcactaaggcaatccgcgacgattgcgaccttgggcctccttcagcgtgcacaacgcttgacaatccggtaatccccatccggttgcctccacgaaacgacacaaaacggaggtctgctactgagccgtagattttggagtaagcatccccgggctcagcaagagatgtccacggagtccgtcgtcaaatctgaggagcgagagctcaacccgaacaacaaaccctgcatggaacaagccgataggaaacacataggaagaaagagcctaaatccaaatcccaatatccactaaagaactcgaatggtggcaaacgaattgctgtcttcgtggattgacgtacgtggatggggaagtgaanatctgcaaagcatgattgatagaaccatggcattggaagcacatgttcaggcaccagagaaaccgccgccacaacgctgacggggtgtcgcccgcaccacgagcggcgagctccgggcgacaacagaacagccagcaagggacacaggaagccgccgcagccgacgcaagaagcagggcggcggcctcccagctgaagacggcgacgcagccgacgccaccacaagaagccagctccatccatcaaatcgcccactgatcttcggatctcgcacttccaccgccaccaaccaacacctccgccgaccactccggcacctgtcacgccccgaactagtaccggtcggtactagcccgtgacgctccaaattaacctgttaatcgataccagtcccaggaaacagtgctggtatcacaggaagatagattatcacagcaacagaggtctctttattatagagtagaggtacagtcatgttgggctgcggacagatcccgagctcacaactgcattacaaaagggaagcggaagccaagacttggaccaaacatacaggcgcgacttgggaactaggccgaaaccctaaaactcatcgtagccggcttgctcctggaagaactcctcatcagtaggatccgcctcatcttcttcagcaactgggggggattatttatatagagcaagggtgagtacgggagtactcagcaagccatgggaaataagtgtttaatgcaggcttcaaggaaggctgttgtttttgcaattgattttatttgaactcgtttctgaaaacaactaagtgagtgcttctcaaacgacacggatgagacagtgcgtctcgtccggtcggagtatgtgcaatgtatcagtctttagaattgatcaagattggcacccagccagcgactttcaaacggccacccgggccaaccactttcaaacggccacccgggcctagctgatcccatcagctgcagattttccaaacatcgatcccctttccacaacagcaatttcacaagacaatagtcaaacaaagctacgctaggaatcacctcacatccgcccatgaccgtgggcacggctgttctaacagtttg

SEQ ID NO: 107410 - DNA, 585 bp, Oryza sativa
ctttttccggcgaaccctacctaatccgtcgccgattccatccgttcccgagtcgatctctccctcttctggctataaatagcatcccctcggcctcctcttccgtttgcctcaagtcccaagccgagccgtcgcttgtagcgccgccgccgccttgccctagccgccgccgacgccggtgaccctccagccgcgtcgcgccgcctcctcggtcgaccccaacctgcgccgtcgcctccctcggcttcgcaagggtgagagctaccccggccacccgttcccttgcgccgaatctcgccggaatcgctctccccgcgctcgccttctctctccacctccggccgccgctccagcagccccgcgccgtcgctgtggtcgtcgccttcggtcgccgctgccgccattgggttcgcgaggaggagaagaagaccgacctccacttccccgtcgtcgaagaccctgggaagcccgtcgtcaccgtgaagccgatccgttccatcttcagccgcgccgttcgtcgccgtccatcgccgccttcattcaccgtcaccaccctcgggatcgcaggagcgaggtgaagaccgt

SEQ ID NO: 107411 - DNA, 1069 bp, Oryza sativa
tgttaggcgaaggatggatcagtcctagtatcggctctttcgaaagaaattgcacaaagcgactattttctgcattttattgatgcggcattagttggctattaggaagaaggcttttgtgttctcttatttttcatacacacgcttctcaaactattaaatgatttgatttaaaaaatataaaaaaattacttaaaatcatattaatttatttttcaagttttttaactaataattaataaattacgcgttaatttatcgttatgttttgcgtgttgggggagttagtttccaacttactataatggcaagtgatataaggttttaagcacaaactcactataatggcaagtgatataaggttttaagcacaaactccaaagtgtcatgtatacttaaatgatgatgtggaggagaggagagaagagaagagaaaagagagagagaaggagccacctctaccttgacatgataaaattttagagcttgccactagctgcactattgaccttgctctcatataaggggcaacctttacacaaactttaagaaacaagagaaaaagaaaagaaaggggttgattaggacattcctaacccaaaacactatacatagttttcacaaactccacatcatcaagaaactaatactagacactactcttccaatgcaaacaccactattccatacttagatttaatgctacttatctcacatgatgtcttaaatgttgtgtaaagaccatgatttttttctcttttcttatttattcacttgtcatatcatttttcattctaggtggcagcttatctaatgctatggataccatcctagtcattgggttgagaatggtgttagtggtaagtgtattgggactagtgtattaaatgcaatgcatttatataagttagttttaattttatggataaatgacgtggataaaattaaaggcggccatcacctttattataaaacttgccctcaagaacacagtctaatgggtcatcgtggagaggagtctagctgagtcagccacgtacgaaaagctttttcatcttccacgaagaaa

SEQ ID NO: 107412 - DNA, 717 bp, Oryza sativa
ctttaagaaacaagaggaaaagaaaggggttgattaggacattcctaacccaaaacactatacatagttttcacaaactccacatcatcaagaaactaatactagacactactcttccaatgcaaacatcactattccatacttagatttaatgctacttatctcacatgatgtcttaaatgttgtgtaaaaaccatgatttttttctcttttcttatttattcacttgtcatatcatttttcatcctaggtggcagcttatttaatgctatggatactatcctagtcattgggttgagaatggtgttagtggtaagtgtattgggactagtgtattaaatacaatgcatttatataagttagttttaattttatggataaatgacgtggataaaattaaaggcggccatcacctttattataaaacttgccctcaagaacacagtctaatgggtcatcgtggagaggagtctagctgagtcagccacgtacgaaaagctttttcatcttccacgaagaaaccacatagtggagagaggagtcaagctgggtccagcgaaagactaaaagctttcacctttaaccctttggccttccatctccttccccagaaaagtttttagaaataatattattttaataaaaacttgtaaaaaagagatcgattggctgaaatcacaagtgagattaaatgaatcatagagaagttagtgctct

SEQ ID NO: 107413 - DNA, 721 bp, Oryza sativa
  unsure (1)..(721): unsure at all n locations
tggatcttatagattttagaaagcagtgtaaacgccgctaccatacttctttacggctggcccactgcacccttcttttttgtcatttggatttaaataattgaagctattcattgttatggccaggtttcctctttttactttccagaagtcttgtcaaccgcttcaaccntactctttcatagcttgcatgtcacccttcctcttaatatcattaggattataaaaatagaacctaatcgtcattgaggcttggttttatagtttttagattaaatgttctatcaaccaaagctacttctttatggtttgccgctacccgctctatcatcatttgcaatcgttgtcttttagattgacccctatttcagtatttcttcttttcaatgtctagtttttgttatttctaaactgcatttttataagaattctcattttctctcatttcagatcttattttttattttcaattttaattaatattgtattatgttctttgtacactgttctttcaatattccctattttgttattttgaatttcggttatttctaaattgtattctgaatttaactcttattttgtttctaatttatttttatatttcatgttttatgctgcatcttacttatttcagtgtgtgttgtaaatgaaccttaacttattttatgttttactctcttctttcaatattcttaattttctattccaaattttagtt

SEQ ID NO: 107414 - DNA, 655 bp, Oryza sativa
tggcagatcctagaaccatctcaattttgaaagaaaaaaacaactccacctggcacatgttgtaataacactatatcgcaaaccccaatctcgaatccatctctggtggatggtgacagcaccttgcttccctgctaaattcatctatagaaacaccggatgctgtagatgtatcctggtttacttctgccacatggcttagcctgatcatgttggggtccaccatctgcccaacgatggtgatcaccagtgtgcaagcgtttggagttgtaggagtgtgaagatggggggaggtcgctgtgggctgatgttgtttgcggttcagggacgacacaatttatttgcataagattttggtgggaagtaaaaagggagctaatttgctccaggctttgtttcacccggatctgctttgatcgatagtgtagaaaacgtgattgaacagcccagatcagttcatttcataattggacaccaaagaacgcttgcccatgatacatcaccaggctaagttgtagttgttacttcgatcttataggatttgcatatgattatgctcacctgcatcgtctcatcaggtttagttacacatactacgacaagagccatggtgctatacataaatcgatagaagccttggaccacatgggcatgg

SEQ ID NO: 107415 - DNA, 747 bp, Oryza sativa
acgaagacacgggagatttgcttagctctagtgtaggtcctacattttgatgaggtgcggccgtgccagctagtttgatcctgcaactgacaagatggataaatgacaagatggataaattgatggtcaaagagtctatcaaccaataagctgatgtagcaatactagctgatgtcggtagggtttgaaaaattggctatatatccgatgtagattctaatacttagataaaaaaaatggaagaacatgagcaaacaatccaatcagctgatgataatatgatgaagtagatgtccaatgaaccaatcatcagaaaaatgtagactgaatggttaaaataaacatcggctggaagtcagatgtaaagataacttatatgttagcactccgataaaacaatatacatgagttactagggtggattagatctattaatcaacagtaaaaactaataggtcggaccaaaccgatacaacattaagttacatcaacgaataaacctaataatatcgataaatcatgtataaagtgatgggctaagatagaagatcggacctaactgagacagtcccaactaaaccgatgagcttctaaacacaatgcacttaaagatagaattgaaatatcagatacgcaaatataccaattgaatcagagcaatccaagagatcgaagcgatgcatcctaaaagaacactagtgtagcgataaatttgccagggccaacggaacttagggcttacccctt

SEQ ID NO: 107416 - DNA, 561 bp, Oryza sativa
tcggccattgtacatcggcaaatcacaaccgattacaccatgaaaaacaactaagggcgatataacaatattggccattgtatatcggcaaaccacagccgattacaccatgaaaaacaactaagggcgacataacaatatcggccattgtacatcggcaaaccacaaccgattacaccatgaaaaacaactaagggcgatataacaatattggccattgtacatcggcaaaccacaaccgattacaccatgaaaaacaactaagggcgacataacaatgtcggccattgtacatcggcaaaccacaaccgattacaccatgaaaaacaactaaggacgatacaacagtatcggccatcttaaggtgatgtaaacacatcggctgtcatgcatcggcaatagtagccgatcatgcgttaacccaaacacttgggtaatatttcttcaaatatttgccattgagcgctcgctcataaacttcaccgtcatgtccttgcaacatatatgctcccttagacacaaccttatgaatttggaacggtccttcccaattcggcgacc

SEQ ID NO: 107417 - DNA, 588 bp, Oryza sativa
cccctcgttttaggttataagacgttttgactttagtcaaagtcaaactgctttaactttgctcaagtttgtggagaaaagtagtaacattttcaacccaagacaaatttattatgaaaatacattcaattattgatttgatgaaactaatttagtattataaatattactatatttgtttataaatttagtcaaatttaaaatagtttgaatttgaccaaagtcaaaatgtcttttaactgaaacggagggagtagctagctgtgctcatagggtgaagggagttagttcttctgatgtttcagcactgacagtgttgtgtagagaacggcaattttgttgctgttagccttatttgttttgtggtgggatagcacggtgcaccggctacagctaagaaaggatggaagtttgggctattttctggcgttgttcggcccccaactgtttcatttctagatcgagaaatagaatgaaaaaccatcgaatacccactgcaacatttcaaatataactaatcaaacatcatagtacatgcactgaaacatcaaaaaattcaagatgaaaacctagatctacctcttcctc

SEQ ID NO: 107418 - DNA, 1210 bp, Oryza sativa
atgacaaataaatctgcattgcgtttccagccttggtcagatgattgttcctctccttgaacctcctcaatattccaatccattagtttggggatgagattgcggtcagttgtccatgcagacaatctgaaaatcgacaggttttgtatatgatgctcttcataaagctcttcaaccatacaactaccgtctagtaattctttcatggcctgcttgttccataattctggtggtattccttcgagtgcaagtatgactctttggcgcagtgggtttgggacactatgaaggttcatcttgaaaggttcatcttgaaaggctcaaaatgcagctgagttgtttggaatgtgtaggatttctgggcaaacgccttttgagatctctcatattgcttgtctgagtccatgaatagcacaatgtacattttgtgcctgaacggcagtaaggcaaaatcatcaatctggcagtcacacacgaagcctatcatagctgatattttcgttgtgtttggatgcccagctcaaagaacggtgacaaccacagcgtcttggtaaatgacatcggcaaatagctgtgaaatttctccgcggcttgaaaattttgtcgctaacagtggacggctactgccataggacaatggtcgtggttgtctctggctagggtggttatcttgatgggcctccatagtgttctaggaaagaaatagaagacctgttggttaacgcgtgcccattgcagagatcaaaaaaatgtttagtttgtttgctctaatactttcctatattgttctattacagatgtttggatctgacccacttctgtatagggagaggagggataggaatgaacatatggagattactgaagataataagctgcagttgttacctggggagggaggctgaagagcttgtgaaagctgttcttgctgacgggaaggcgaagagcagcagatatgtggtggggaggtgcaagtagcggcgaagaggagaagataagtgtggtagagatagaaataataggatgtgctgtatggcatctcgctgcaaatatgtcatgtctcttcaaaggcagcatgtacgggcaagcgatggtgtggatggagtgtgtaaagaatgcgtaggctgttgtttcagtatggagttggttgatgggtgaatttccctagcattcaataccatatatatatatatatatatatatgtatgtc

SEQ ID NO: 107419 - DNA, 536 bp, Oryza sativa
tatagggcgaattcgagctcggtacccgattttattttggatggggataaaattattgtgtttgttttagcaaaaccaatcaatgaaaaaagtacgaaaatgctcattatcaagcgaccaacacaaggcgaaccgaccactcatttcctcatcctctctctctcttcttcttctctcttcgctctctctctctctcgcgcgcgcgcatccgtatttggcactcgcatctggtggcgccaccgcccttcttcctatccttcctctgcgtcattgccaaatcaccgcatctggcgccgccacccgtcgtagccacttctggcactgccacccgtcgtcctctcctctctccgtgctgctgccccatcgcctggaacttgggagctcgggagctgtggaacacgacgaccgagcttcattgtgatatcccagcccagggcttaataggattaatagaatactcatatcaacaagttgcaacttcttttctggaagccgatctctaaagaactctgaggttaagcatgcttggcctagag

SEQ ID NO: 107420 - DNA, 733 bp, Oryza sativa
ttcctactgcatgtttgtatatcagtaccagcaaactgaagtactgttgtacaaacaaaaacatatatttgccgtagtgagaattgcttgagttgtaacaattccatgtactctctattattaaaagagctctgcatagccaagttgtacacacgcacatgctctgaatcatgtagatctagatggttaagtgccaaactgagctgaacaatccatttataatcactgtgcgttccgcacacagctgcgtttctgctgagagacaacttatcagatccaccattatcatgtatgagaagctgagtacttcatcctggtattcagttcagctggcacgacttacactgccgccccaaagagcttaatttgttcgtggtttaacattttgctttttatccgtgtgaaggctccctacaagtgcagaatacagagcatcatctggggtcaatccatctcccagcatattgtcgtacaactggaatgcctcctctgatcttcctttcttggccaggccggatatcagagcagtatatgccaccaagttgggtttagaccccctctgtttatcttttaaacaggctcaatgccacatccacctttccattgacacagtgcccatggactaacgctgcataagagtatatgtctgggacaagccctttcttttcatctcattttgaacctctcagcctcccgtagctccccttttgatgtaccattcatcataacattg

SEQ ID NO: 107421 - DNA, 802 bp, Oryza sativa
cgccggcgactcggagtcggacgccatcggcgggggagcgaggtgaagaggggagaagacgagcgagtccaaatgggctcgacctgcttggtgtccaatgttgcagatgcttttatgggcttaaaatctcggcccaataatatattgactgaaatgtcagcccattatccccaaggcccataaagagcaggagccaccggcccacctacaaacacatacatgcaagaggaattgggcgggcctttttacatacaaatgtgcttcgttgctatatgggcgggccgtgtatggtggagcttgaagaaaactgaaaatgtaaaatgtaatattcggtgcaaatttctcaatatattacgttacattatcagccgatgtaaactggagaacaatatgtacctctaatatttccaaattgatcagcttatatgatttttacagcattagctaattaccatattaaatagcctccgtccatatattcattcatcacgtacttcctctgtcaaaaaaaaaatcgatctgttgagttggttgagttcttttttagatggaaggtgtacgtggcagacggaacgacgaagggaatgacatggggcatggtggttgagtcgagagaagttcacgagcggcttgggaaccgaaaaggcgagacagggtacgacgcggttgtggcccatgggcgccgggggcgtagtacgtactcgtatcttgcccatacgggccacgggccggccggccctgtcgcgtcgacgagacaccaacgcaggagcacaacaacaacacacgcatgtgtgcacagtgc

SEQ ID NO: 107422 - DNA, 1139 bp, Oryza sativa
agttaaacgaaatactatcaagagtaccactggtaaatgctaatttaaacaactccattcataattaagaaaaacaaacaagtccatgtccactctcatagtctcatgcccttgctgatttgtccactacccttccattatgctttccccaaaataatcaaatcaaggagcgtatcacagaacaacgcaagaatcattgcattacatgtggacaactctggccctttgtttaatttgcagagtaatcatctcataaacaaaagcctgtgagccaacaggacgccagcttaactagcctggccaaagactcttcttggcgccaaatgtgcctccacttgcctcacaattcgaagtggtaggtaacatcacatcactgctcaaattcaaaatatctggtttattttgtttgtgtaatgaattagatacctacaaattcattaaaaaaatcatgcattttacaaggttttcataaattctacttttcagaagggcccatcatttagaaaataataaacaaccaaacaagttaattaacaaaagaagatattaagggtactaaaatactcatctcattacatgatgcactaagagcattttaaaatgggaagagaaaaaaaagtctggtcaagaagaggtttgaccatctaattaacagtactccactctagctagcaaccacacgagaggagaggcttctattgagaagcctccccgtcaactacagctcgatcggtcccgtgtccggcgccggcgatcgtcgccggcggcggcattacatgacgctacacgagctcgggttctcctcgttgaacatgttgctgtaagactcctgcggcggcgacgaccgcatgcccggcgggccgtacaggtactccggcggcggcggcggcggcatcatcatgggcgggtacggcgagtagccgtacgacatctgcggcggcggcggcatgggcgtcggctgcatggacattaccggcgtgggcgcgtagtacgaggacacgctcgcgctcgggtgcgccacattgtagctcatcaccggctgcggcgagtagtacgggaacccgccgtgagggcgctccggcgacgacagcgttggcgccggagcgggcatcgacggcgcgggtgcggccggtggcgcc

SEQ ID NO: 107423 - DNA, 727 bp, Oryza sativa
tcatgccctataatatatccctctttactgtcattaaagaaattactgttaatattaggccttattgtgtttaaagaatttaatacagggccttgctattcacttagtgactgtgcttttgatgctaattacataattaatttgtagctcggggacttctcgaggtgagccaagattgatgccgtccatcttaaaggatcttgaccgtcgaacctacctctatagtctgatcatgcctatcatgaacaagtaagtttatatcttcttatggaaatattgtgatgtggttatgacaacttcattattgtgtaatatctggatccagttgtatgcctaatctcctttctgcaattttctaaccttcttattcttgcaaaagtaatgagataagtagttaattattgcattaaccaaattttgtttttgtttgcctcaaacagatgatatcatttgtgaagctctgttgacactgaccctaaaattgacagatcctgagaggccgttgtttgcatgcttcctgtttgacattttttttggattattcacattagtaacacaacctgggtccagtacttcagttgcaagacgcaaagtattggacaataggtaccgcatatgccactgcttgcagctcaaaaacttaaaaataaagtcatatattggttgctgcttagcaagtatcaagcaatgccagatatacatttgttactcatacacatcaagaaac

SEQ ID NO: 107424 - DNA, 744 bp, Oryza sativa
ctgtaaatcgacaagttttattctcctatattagccgttatacatatatatagcagcatgatgtttttcatatctcatttctcttcttaaatattttaattcaggtgctgtaaaaaaattgccatgcatccttagttgatgtagaggccgaatcttcactttgtttaaaaagaaaagatgaatacatgttgccacaaaaatcctagggaacctatatatattaccacgaggtacacgctgttgaaatgtccccgtagaaattgttgtcatgcatgtgaagaaagcacaattatcatggttggcatgaaagtgaaaccggtcgatatagaaggatgagaagaatagattcattttttttttgaagaaaaagcggcaagagaattgccgattatattaggaggtagaataaagtcttacagcatagttcttagaaagattaatacatcttgggaagaaaagataggtagaaaagtagagctagtaataaattagcgcggtttgaaaacaaaatcccgatctctaatgtcttccattatagcaggtatagtctgcgggatgtctggtgattggttcctgaagatttttgcatttctcattaaccaaatacgccaccatggtgttaattagaaggagaagaatagattcattcacgggtaaaaccccatcagtcgacgtcgtcgcgcgctgtactacgtggtaatcgatttcatcggcgcatctgatctcaacaccactctacataca

SEQ ID NO: 107425 - DNA, 1186 bp, Oryza sativa
tcatgtatataaaaagatggaattctgatggctaccggttaatatattagaggaaatgctagaacaaatccagttcatttccttccaggttttgaattcatcgatctgttggttcatcggtgagcagagcaatggataaattggagcagtcagtgcacatgcctttggttgatcagttcaagaacagattaactcgagccgcctcgtgatatgcttgaggcaggcatccacgagcttgccacctaggaaggatctgaggaaacaactaaacagccatcccaattttgacaagccaaactttactcaatcactcgttgatttctgctgtcaatagacaggtgctcagctgacagataacagtgtcagatgcgttgaatcgtccctgcaacattcaccttgtttaagaacaacaaactcgaccaagaacaggtcatgcgactgcatgtttcgccgcaacgtttcattaaaaaatttcaaattgatgcatatggaaatagagtactaggccataacaatagaaattttcttatgcttatctgaaacttgggaggaaagctcacatcaagtgatgtgatgacctcggcagaaaactcacaggattaccatcatgtacggctataaactactcctaagtacagtacacccatccatcagcagccataagcatgcattgatcagctgaatggaaaaactattcagttctaatttggaagcttgtgtgcacttttttctttgttgacgatggggcacgaattctgcatcttgcctgctacagctgacgaggcaccttgttatttaattcccttgattaatagtgcagttaagttgctgttactgtcatcatcttcagttccaaaaccaaaaagggcaccacctctatgaacttatcctgctgctttggtcatctgaaggggcgttaattggaatgtgcgtatacatttatgcacgcttttcaggctcggcgacctacctgtcactgtccttgctttcagttcaccgggccttttttttaaaaaaaattcgccgggccttgctttcagttcaggttattaactggttaaacaagcagaggtgtgagatgagcacagctgattctttaattgggaattgatcacaagcttgagctcaattattattagtattctagaatggttggcctgttggtttcagtgcttgctacatgata

SEQ ID NO: 107426 - DNA, 531 bp, Oryza sativa
tttccatggtagaaatcattcaggttttgatagaagctttgagaaagagtgatgagtgatgacagattgacagccgcaacaaaaaggagcgtcgtttgtaggagctgggggatctagatggcgcacgggtgcacgacgcaagaatatctttgttttcatttttgcttcttcttttttgggctgagtcaaacggtggcataaatgtggcacgtctctgtctaactgcttcctaaaacttgctagtgctacaagtacgtgcttttcttgtaccttcactactctcagttagatgggtcaaatcatgacccaatagtacaccgaagatccctcaacttgtcattcagttataaaatcgcctccaaccacaaaactagatatcgagcttccctcaacttacaaaaccgttcactttaggtcctttggcggattgaccctggttttgtccgatgtggcggttaagtgagcatggccgtatcagcctcctctatctttcccctcttctctccctttatcatctctctcactttcttt

SEQ ID NO: 107427 - DNA, 729 bp, Oryza sativa
catcaacataataattattttaaaaataaatttattttgggataaataggaaaatgaacaatacagatagctaggagagatgcacctaatagtgtagtagtaaggggtgtttggttttttcaatctccaatacgcttaaaattttttctcaaaatatattttgaggctcataattttttcttaaaaaatatttggaggtacgtctttccttctaaatctcttcttttttcttcttttttttcttttcttcttaaaatattttgaggctcataattttttcttaaaaaatatttgaaggcacgtctttccttctaaatctcttcttttttcaatgatgcggaggctcgtaatttcttcttaaaaaatatttggaggtacgtctttaatttcctagctttttttttttttttttacggagagagtagtactagtactacgcgcgtcctccctctggggttgcaacgcgaccgcgaaatctttggttggttccaacgagaaaatgggtcgattttctgtgggatttcgacggcggcggccggcgaggcgatatgcaggatgctcaagccgcggtcaaacagcgggagactttactcgcgtcggcacttggcagtagtggcaggcaggcagccgcagctagattccgctagcctcgccgtcgccgtcgccgcggctcgtctcgtgccacaatacatgcagcacagtgcacgcgcacgcacacactggcattgg

SEQ ID NO: 107428 - DNA, 587 bp, Oryza sativa
tagtaatgttaccatacatacagaaccgcgcatttttatacaacttctcacttgatacttaagaaatcggagtggccagcgttagaaagtgttgagcacaaattgttagagtactgatgacacttacagaatttcaagccttcctgtcccagaagcaaggaagaggtgttcgtggaagaaatcgtatcgacttagtgatacatttaaccccactgatggtcctcgtgccgcaatcaattcgaacaaaaacgccaggtatgaattgatgtactgttgataacacaaacatgtcacttgaacaatgcccaacctttgtaagtaaaaagaatttcaagtgcagcaaacagctagggcaaaaatctggaccttgttagcgaaaccgcctccatatggtgttcttgtgaggtggcatttgttcctcttcgccctctgaacatcaggcacctaacgaaattcccccggtagaattgtgtatggaaattaatttcaggattgtacgtaacacattcagaactatgcagagttagaaattttacaatttcttcgagatagatatagctacgagctacgaagaacgagataaacga

SEQ ID NO: 107429 - DNA, 792 bp, Oryza sativa
cttggcaaaatggcatacctagaaaaggattagaatttaggacttgttgcaacttgcaagaggcaattgttttttttttcagtttttttagtttcatcgtgctgagaagtgagaagaactagttgataattctgcgggaacagaggaacctgtaggctgtacacagcggttttggtattcggcaagttgaactcttcctgggaatgccaacctattttctcttatttatcctttagatatatgtatcctaccttgttctcgctgtacttcttttatttatagtgtcaaacaattacagcttcgcatggaagagaagctttactgcagagaaagcaacaatttgacttcttagcacaattctttcgaagcattttctctgtcgccccttgtatggttaagattggattttaaaatggcgataatgttttgtttgctttcaaacatcaataccaacaaattaagttgatcggtcgggtatttggaaaatctgcatatactactgtcgtgtggacggcagatttataacataacttcaaattgaacactactagagatagcccattgactgccccattataatagtgcaagtcattgtcaaggtggtaattgtttgtcaatgacaaccacgtaatttttcaagtgccaagatactataggccgtagtaaccatggaaaaggggatgtcaccatcacaaagttcactcttaattttgtattattagcaggggcttattcatctgtccttttgaataaccttcgattattttagatagtgtcgactgtctactataa

SEQ ID NO: 107430 - DNA, 644 bp, Oryza sativa
aaatggcattatgcatcctgcaagcttctggcattgccattaatttaccccagcgagtgcatcagctctggcaggttttgtcgtcgcaatcgcaaagatgagatgcacaagagccatgacatgagtagtagtggtagtggtactgctagtcgtaacacactttgaacacgagtagatctcgcttcaattcatacatttgctgttggtccagcagcctgagcttggagcagagcattcagtcattcacctgcgtttctccggaagaaagaaccatacactagagaacaaaatctacacacacccaggagagatgagatgagatggccattcaagatgcacagctctgctgcctggaacctccaattttccttcagtgctaaaataagctctttttcatccaatataaaacctaaaaagatcataatatcatcatttcatcgaatcccaatataattatttcttactttatatactctcggtacatttattccatattttcacatcaacataataattattttaaaaataaatttattttgggataaataggaaaatgaacaatacagatagctaggagagatgcacctaatagtgtagtagtaaggggtgtttggttttttcaatctccaatacgcttaaaattt

SEQ ID NO: 107431 - DNA, 743 bp, Oryza sativa
aaggtgaagttttatacgtaaaacgaggtggtattaacgtgtgattgattaagttttaattattacaaacttgaaaaatagattaatatgatattttagagctactttcatatagaaaattttcgtacaaaatacactatttagcattttgaaaagtgtaccataaaaatcttaatcttcgtccaacttttattggagaaaaaaaaccataccttagatagggttggtatcaggttccatgaccatcaaattgatatcgtattcgccgtgtgtctgtccactacataaacagtatattcataaactaggttgtgtttagatccaaagtttggatccaaacttcagttcttttccatcacatcaacctgtcatatacacacaacttttcagtcacatcatctccaattttaaccaaaatctaaactttgcgctgaactaagccaatgtaagttcatcaaactctatccctgttcgtcatcagaatatttctcctggtggtgggcccatccggccgggagctaagctaacttgaccgggacatcactgcgagagtgaaaagatagatgctgcgctttattccagccttctcttagcgatagtggtttcggacaaacatgcacgtaatacctctattcagattctttttctttttcttttttttaaaaaagagctcttgttctatgtgacagatggatacaacgacgacaaacgggatactatattgagcgtttgatgagaacatg

SEQ ID NO: 107432 - DNA, 746 bp, Oryza sativa
tcgcctggattggattggatcggagttggacaggtaagaagtaggccatagcctccactgcaaaagggaagagaatctgattcttccgtccaagaactagtatccatctccatgctacttttgtccaaatgtccatcaattcatccctgattgcatctgatctaccacgacagaaaaaggtcaacgtctatctggatacagagctagctaaccaagagccacatcggttcacctaataagctaaatcaaaagctaaaatttgaatttctgaacttgatttgattttggagttcattttaagatatttttagcattatttctttttagcgttggcttttaagtcggtacgaacaaatatataaaaaattttcctataaattatttattattccttaataagccgggcttattagggaatatgggtaaccgatgaggcccaatattccagctagctatttgtagttttggagcgtccgaaatctcaaaaaactttactcaatatcaccatcaaagatggcatgccactaaacagaggcaccgcttagcaaccactaactaatgcattatcgctagacaaggtctgttgtctcaacctctttactcgttgacctcaatcaaatctgcgtgttgtgtgcggcagaggatcgaagtgtatcaagaaaccaaaacaagaattccgtttgagggataaataacccgtgaatcatgggccatggccggccaaaatagtacagatcagaaaccgt

SEQ ID NO: 107433 - DNA, 607 bp, Oryza sativa
tataacttctatgcactaaatatacttataatttgacaaccgttggtcaaaataaaaaaaaaagtgaccttttcaaaatattatacttcctccaccccacggagggagtacactctatagttttctagggaggaagtatgaaagacacgctgcaatcaatgaaagaacagctgtacaataataatataagtaagaacgtttttattgacccagttggtaaactgcagaacatttcttatcttatggaatctaaataagattataaaaattgaagatgtttttatcagtattttggtaggtcattcgtatttgagtcggtttttaagttcgttcacttttaaaaatacagatctgtgtttgagtcggtttttaagttcgttcgcttttggatacaaaagacatcttataagaaatctctttaaaaaatctcgcatgctaacttgggacgcttttggaaatacaaaaggagtcgtataagaaatcattttaaaaaaactcgcatgctaacttgagacgagagtcagactcctaattacaactcatgattttctaaaaatatatatatacaagcgaattcccacaatgattttcacccaagataaaccgt

SEQ ID NO: 107434 - DNA, 542 bp, Oryza sativa
agggcgaattcgagctcggtacccctacttacagcctcgccacttcaggaaaaaacataaatttaagagtaaaatgcaccagcggtccttaaacttgtcaggaggtttcacttaggtccacgaacttgcaaagtgcacatcgaggtctctaaacttagtttattgtatcatcccggccaaagccgcgtttgaccgtggtcttgcctacgtggcacgccacgtggacgatgacatggaatttttctcttctccctttttttttggacccgctgtggcctcaaaacctcctctcctctgccgctcgtctcctcctcgctgactcggccgccgccaccgccgcctctccgcgccgcgccgtgccaccgtagctgctgacgataagctggccatagcggcgacggcggatccgcgggcgaagccgcccgccgcgacgtcgacgcaccacctcgagccgtgggggcagccgccgccgccaactcccttcgatggtgggatcgaggagctttgggtgaagctcatgggtcacctacgagacgccgcca

SEQ ID NO: 107435 - DNA, 1141 bp, Oryza sativa
aatcgtattggtttcaccgatgatgaacttagtaggatcaaggttgccgactgggccgagaaagtaatggttcttgtgagataggctcggaactgcgatcagattggaaagatgctacgaatccaaaagaacagggaagaagaaaacaaaagataaggaaagggaaaactaatctgatgcgaaaaaagaggatctagccgatgagaacttacctccacgtattcggctgatgatgtggcagacgggctagtggaggtcgacatcgctacaggcgaaaagttggccggacaagaaatcgcctgggaatcgccttgcgcaccgaggggatcgctggagaaagagaggacgaagtttggcttaagcggtgaaaacagaagtcacggtgtgaagattctcggggatgacggttagtatttaaagcactgtgtagatttctctcggaaaacggcaagtgcggatttctctcagagtcgacatgtagcaaatccgaaacattttccaatattccggacttggggggcatgtgttaacgaccaaatttggtaatctaagtattggagttggagttgagaccgaggtggaatttaagatggaatcgctcggggaacagagtagaatcggctgaagtccgaaacggcagcgactaggatcggcagagttcgagtcggacagggttagccgattgagccgaatccaacaatatgacacggcatacgttgtcgggttaggttgacgtgcttcatgatgattgccacgcgtggatggagtcctgagaaggcaattgtatctattaattaggatattttatgtaatttccttagagatatgtttaggcaaatgtctgccgcaaagacttatagtatcttagagtttgttagagataagagtcatgcccgatatggacatattttgtaatctcgggtataaatagaccccgagccccatgtaataaaactaacacacgttcaaatcaatctcggtgcatagccacccttttacttttgttttgtttcgacgagttcttgctttggggttgagctgcatcggtttcaatcttcaacaagaggtaaaacttattgtggcggcttgcattctcgggatagtgcctccatctttatgatactctaatcttgttatgtga

SEQ ID NO: 107436 - DNA, 1156 bp, Oryza sativa
gtcacagatggccgattgacaaatttcataaccatcagatttagccaagtctgcaatagccaccatggtccacctgttccaactactaagccgacagctattttggccgatgctttatttaacacttggtataggtagccgagaagaattttgcctaagggaaattgtttctttgattctagggcttcggctacaaattgccagttggttgtaggaccacaactggatccacagaaaaggaacttttctagccacatcagcaagaaagccacatgttcccgaggagtgacaggccctttgcccatgtatgccgctacatagccctacatagccagaccaaccacctatgcttttggtcctgaaatcaaattggttcttggtgttcatactcatagggttagctgatgaagttacgtctaatccggtaatcatggtgatgtcaatcaaagttggagtcatcggcccttggttgaacaggaaagcgttgatggtattggactagaaataggtggcggcggccattaaaggttcatctttagctgaattggctatggtaagggcaagcacttggccgattccgatttcgtcccagtgaactttcttgctagccgacatgcgcttgtaccatatagtccagctcttctcgggtgaagttttctcgagagatggccaagatttgaaggtattcttccagtgtcctagatctgggttggctaatctgaaaggaatcgtattggtttcaccgatgatgaacttagtaggatcaaggttgccgactgggccgagaaagtaatggttcttgtgagataggctcggaactgcgatcagattggaaagatgctacgaatccaaaagaacagggaagaagaaaacaaaagataaggaaagggaaaactaatctgatgcgaaaaaagaggatctagccgatgagaacttacctccacgtattcggctgatgatgtggcagacgggctagtggaggtcgacatcgctacaggcgaaaagttggccggacaagaaatcgcctgggaatcgccttgcgcaccgaggggatcgctggagaaagagaggacgaagtttggcttaagcggtgaaaacagaagtcacggtgtgaagattctcggggatgacggttagtatttaaagcactgtgtag

SEQ ID NO: 107437 - DNA, 661 bp, Oryza sativa
tgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgtttgttatagcccttttgttcttgattactttattccttgataccttgggttataataatttgactagttgagctttatttatattggttcaactagatattagatataattgcttagccctgcttagaaaccttagcacacttatgggataactaatgattcactattatttcatgatggcttattgatagttcacgatggacaatcgtgattggttaattaattaatgtgccaactaaaacctgataatggtgggttgtgagcacatggttttgatggtcgtgctcatgacaattaagggtaccggttcacgagtttcgggtgtgaaacatttatcgtgccaaccacaagccaacatgggcaacggctttatcttttggatagcatgggtcattgcggggcaccagactgagaagtggccgagataagcccacggggtcgcttgggagtccatg

SEQ ID NO: 107438 - DNA, 533 bp, Oryza sativa
ttttcaatcacctagagtcatagacacaaaaataagattatcatacacagaaatggactccttatgccaataatgacattgcgatattattgggccagtaaagacattgcgatgaaaatactcaacaggtaaaccagattcctattgggcttaatatgccaatatgttgaaacatttctaatattcagttatattttcaatgtatatgctaacatgatacattatataagaggtgtttttcttgagttcaggcaagacacaaaaaacaactgtgcatatctagtattcagatatcagtatatgctaacatgatacattactcagatatcagtatctaattcgtatataaaatgcaatcatttttttatatatggttgaattgataaataaatagaaaatgcacccaagttcacaaatcaactagatgggtacccttcgtgttgccgtgggagaattgtgataaaatagtcgatatgagttataaaattttcttttttacttattataccattttctttcatttgcttatatat

SEQ ID NO: 107439 - DNA, 1680 bp, Oryza sativa
gaagagatcgagctccaaacgggaggaatcgaatcgggaagaaatcgaactcggttttagggataaaagcaaaacgaactcgattcggacccaatcctcaacgattctctttgattattgggggaaaagaaagaggagaacgagaggaacaaaacccctcaaaatcccaaaggaattgggctcggatttgggcggaatcggagcgggaagcggcggctagggttcgggctcgcgcggcggcggccggaggtcggggacggacttgacaggtgggccccacctgtcggcctccgtgagagaggggcgggcggcggcggcttgggccggcgtgggccgcgcgcggggagagagaaaaaagggagagttgggccgaaaacggcccaacggcctaagagggggatttttgaactttttcgaataaaacaatttgtgaaatgttgtttcaattattaaaaatacttcccttactcaaataattcccagaaaattctagaacatagaggagcaagcatagtatttaataaaattttatctagctcatttttatgttgaaaattttcctagaaaattagggtttagcttgtaggcttttaaaataatttctaaaaattccaattaaaccacaatttatatatttaagatttttagggtgtgacatacacgaagccaaagaacttgctaaaaagacagagcatgaactaagggaccggattacccaactccaggattcaaactttgaactgagtggctcatcaaaaggtaacctcaagatctgccccattaatttgtgttgttataatcgtatcctcaactatctggaatcaaaacagtgcaagctgccaagatagctcaactggagaaacgaattcaggccttagaaagtgtcacgtcctgataaattcatcccaaaataaaaatcatcttctaaaaggaataatagaattaattaaaattcgaaaagaaattggcaaacactaaaatacgtacaagaaaaattcaaatatggcccggagaatttttgttaaattctccttggtctaaaaggagccctcaaattttagtggaattttcagagcacaaataataattgaaaagaaataaacaaagttgaaaaggtttataaaaagaaaatcctaaaagaagtcttttccccctcctcctcccttcttgggccggctcggcccattccctccctctctctctctctttccccccggcccatcggctcctcccccgtgcgcgcgccgctgacaggcgggcccgcccgccgctctcgctgacgggtggggcccacctgtcatcgccttcctcccgccgcgcccgccgcccgcccgtgccctagcgccgccgccgccgctgaatccgccgcatcccgctttccccgcgcgccttaatgaggggggaattactccccgcgtttccctctcccgattcccccccttttccctctctctctccctcggattcgtccggattcatcccgcgaagttcgccggcgtcttcaatggcggccgaaatccccgcggccggtttccttcctcctcggccgcttctctcccttccgacgctataaaatcgttgcccgagctccgctcttccgtttccgccgctcgccgctcgctctcgccgtcgatttcgtgcccgcgccgtgctccgctctcttcgccatcgccgccgagc

SEQ ID NO: 107440 - DNA, 605 bp, Oryza sativa
tgaaggcttgtcgtataaacatcatcttttgacaaaaaaggatgatatgtttatgtcaatctcgatgtgccattttctcccaacaagatactctacatccaactttagggcgagaaccaaatctcaacgtataaatgcggaccaaaagctcagatcttgattgatagcgactgaaatggactcactaattactttataagtagtgattaatgaagcacatccctgtcatgattaactaacgacaaagcaacggtgtaccagctaactatcattaacacaggaagaacatagtcccccattttggcattttcactaccagacattgcaaaaacctctcttgcaaattatgtatatgttgcgaaatgtgcaaattaagtccaaattataatgatggagattgatcgaataatgtgattatagatgtacaagaaatgcaatttcatatttgctatactgtctactgcacaattgtgcagggaattcgactagttgcaagtagtacagtcaagatcatgagaaaggtgaaagttacattgatgaggcaatgagtaccaaggcaagaggagatacagatgtggtagctgttttgttcaggagcaaaattt

SEQ ID NO: 107441 - DNA, 681 bp, Oryza sativa
  unsure (1)..(681): unsure at all n locations
tagttcatcagctcgaagacgatgaaaccctcacatcgccctttgtagccctctcatcaaaccggcgctggagcccagtcagaccggtcgtagaccaccggtcagaccggtcgtagaccaccggtcagaccggccagacgcgccggtcagaccggcctgaagcctcggtcggaccgctgtctagtcggcggtcagaccggcctgattgcccggtcagaccggctacatggccgtggtcagaccggccgactgcgatgagctggtaccggcttcagattttttgtttggagactcttcaactccatctccagaaaggtaggcacatcatgggatcctattttgatagtaatcacctncgaagtcctttcctccaccttggtgcgctttccttcccttttttttcattaacccgatttttaccataaaattggctttttgtttggtgaaagataagcgctcatggattggccttcggggtccgccccacccttgggtgaattgcattggaggcatatggttgtacattggcggcgttgccccccatgacatgaagtgaggataagaataaccccgcggccggcttgggataaaaccccatgacatgttctggggatgaaaagtttgaggtgaacgcaaccggcttagtggatgaccaaaatcgcccctaagaaggagatctgg

SEQ ID NO: 107442 - DNA, 1190 bp, Oryza sativa
ggctggacgatagatacgcgtcgtctgcaagcagctcatcaattaagtatttttaaagaacacgtcaacatcttaaagttagtttggtgtggtgagggaaagtgggccggcatggggatggtgtggtgagcacctcctcaagctcctatgtcgtcacgggttccatcccttgtttatcaacctcctgcggcgaggcagccgctcggagttacgaggatggtggacaggtagacgagctcgaagtagcttgccggcaacccccacattgctccacttggttgggaaaagaaagagttgaaagaaagataggggaaaagaagagtgggtacttacatgtgggtcctacagtagccctatgctaactccacaagtctgaccacggtcaatttgtcacgtcagcataaaccatgttccaaatcaccgaatcgatttgcactggtttttgaagttggagaatgcaacgtatccacttttacagtttaggatacgattcgactgaggccaatagttgagaaaggtgaaataaacttattcctactctataggggtaacacaagtgggctataaagtgggcattgtgaaatggaaggagtaccgagctgaatcattagcccaatttaaattcttctcctcctcacaaattcctttctctccctccgtcctaaaataaatgcagttttagcactattcatattcaacgtttgaccgttcgttttatttgaaaaaagattatgattagtatttttattgttattagatgatacaacatgaataatactttatgtgtgactaattttttttaatatttttcatatttttttttaaataagacggatggtcaaagcgctaaacatggatattttatgactgcacttattttgagacggaggtagtaacatatttgtcgttgaattgccaacggatggtccagatttatcataagtgggctgcttgctaagaagattgcttgtctggttgggccgttctctatttgctcggtagcgacaacgcagcccactaaactccaaagaacagagtactctcatttcaaaaggaaaaaaaaaaaaacaaacaaacaaaaaaaaagaagggattgtctatacataaatcttgcaaattctggaccacccgattactttaagatttgtgcaaagaaaccaaccctaaaaacctcctctcctctcctttct

SEQ ID NO: 107443 - DNA, 898 bp, Oryza sativa
  unsure (1)..(898): unsure at all n locations
agatggactgattgacagatcgacatgtagcncatcacggttgataccgactcggataaggagaagccgatgtagccgatttcggcaaaggaatcttacagtcattgctggattagatttaaatgttgcaaaagtactgccaggcatggattgcgtccgaagaaggcaactatatctattaattatgatattttagtagtttccttatagatattttcggtaaaagtccgccttagggacttgttcgtcttttagagttgtaatagaagtggagtcatgtccgatgtggatatatattgtattttgggtataaatatatgcccgagaccttgtaaataaatagggttaattagatccatgtcattataactttcacgcttttgaaaaatatcattgatatttaactatttagaaccatgccattattatttcacatatatctattatatgccactacttacctattcaacacaatttataaacttttaggaccaaattgccatgtcttcttcatccccttccccctctttcctttcatcttctctctgcatctccttatcccttcaaacaacaggaggttgcccagctgcttctcttcttgtgggaggcgatggacttgtagaggaaggtgaggaggtcgatcagggcacacattggatggcagtaggaaggacgcgagctcggcaacagcgtcagagagcttcttcccgatggactcgtagatcttcgacgtcatcctttgcgagcaaaaccgagtctgcgcccagagccgttgccgccgcattagcctactctgtgacgcnacacgcatgtgcagagcctncccagcaccattgcggcggcaagtatgcgggcacgatgcgacctgctgacatgtgcgcgagttgacgctgacggt

SEQ ID NO: 107444 - DNA, 612 bp, Oryza sativa
tgtctttttttttttgacggagggactataatcgtagttgatcgagtatgttccaagcaatggaaatctcaccccattttttcttttactagccgttccttcattttgcagtagggttacagtagttacctagtaattaaggagtactagttctaccttgataaactagattcttttactgacatggagtgttttaccgactcaaagcgatgattccttttactgtgctttgccgtttaccttgctaattaacttgctaaatttgtggctaactcgtggtaattaagttacgttgtatgattcttgcagatggtgttagacaacaccacatgtaagtagtacaatatgctgtgttcacgtgatcgtttggttaagcaagctacagcgagagcaattaaaggtcacattagatatttaggttgtttttagttcagtgtaaagtttgtattttggttgaaattagagatgatgtgactgaaaagttgtatgtatatgacaggttgatgtgatgaaaaaggactgaagtttggatccaaacttttaatctaaactttggaataggccgagagcctggaacaatgacaccgaccatagcgaatggagggaacatgg

SEQ ID NO: 107445 - DNA, 655 bp, Oryza sativa
aataaaaggggaaactattactgttgagttttggagttcaaatatccatggtggtttatcatactaaggactatttccactgtttgttttaggattttttttcaagctaattaaacacccaaattagaattcagcatgatagcacttaatcagggttaagcaccagatgaatcccctaaagatctctattgagcgtaaatcaatgaacaagcagaaaacctctatgcagcagtatatctcaacagcagtaataccctgttataacatgaagatatgcatgttttcatgggagtaatatgcatatatccacatacagatagtttttctatttacgatgatcaacaatgatctctgttgtccagtgtgtgctcttgacattcaatcctttccctgaaatatggaaatgcatgaaattggccagctgctattgttggatttgcatccttatggtttccttttttatgttatttcatgtagcacctggtaaagacctttgtaatggtggcattcctgggtctggactacaaaacaaaatgcacaatgctcaaggttttctactcactccttttgctagttatgatgggcctaatgaatttctggaagtttctagttgctgcatattgagctaacattgttcatttatcttttaattttt

SEQ ID NO: 107446 - DNA, 526 bp, Oryza sativa
cagcatgtggatgatacaggatgacacaaacaaaatgagacgcttacacaagcacagtggcgcaaggttggagtgtttaacccacggcaagggcatggccgggaaagcggcgagaggcctcaccttttcgtcgaggacgaggcggacgcgcgccacggccttgctctgccgccgcatgcggtacaggcgccgccccagcacggcgatgccgagcagcgcgacggcgacgggcaacgaccacacgctcctcgccgcccgcagcgcccacgcccggagcacgcccatcggcaggtgccaccaccgcaccacccccgccccagcccctccgcccttcgtcaccgcgccctcgcccgcctccacctccgccgctgccgcctccaccggcagcggctcggtggcctcggcctcctcccgcctctccccgtcgtccgacgagtccgaccacagcgccgcgcggtcagggccggggaagacgaggtcgtcggggtcgggctccacccagctcgcgttgccggacgccaccccc

SEQ ID NO: 107447 - DNA, 649 bp, Oryza sativa
ttggtggctcggccttcgggtcggaatggaaaaaataagatcggaagaggggagagagagagtgtgggtgggggtggtcgctgtggggcccagagtggggcccggagggcagggagagcggttggttatggttcggtggcgctttgagcgggttacgtgtctccaactaaatttggggcgaattcgttctctgttcgatcggattcaaaaatcacgctctacttaaattaattaacgagagctatctggctgcatgtgctcaccaacggtggttcgtggaaattttaaaatcgtgattcaattagtggaatatgaatttgtagtactaggaaagaatatatcacatctcgtgatagattaatttattctgaaatggatctaatactccctccgtttcaaaatgtttgacgccgttgactttttagcacatgtttgaccgttcgtcttattcaaaaaatttaaatagttattaattttttttttcctatcatttgattcattgttaaatatatttttacgtaggcatataatttacatactatttaattttttttcctatcatttgattcattgttaaatatatttttatgtaggcatataattttacatatttcacaaaattttttaataagacgaacagtcaaacatg

SEQ ID NO: 107448 - DNA, 572 bp, Oryza sativa
ccggctgagaacgacggatgcagtgaatttgaacgggtggatggatcttatctctggaagcagcagtcagcagttttgtccgggaccgtggctgtgcacaggagtacaggaggaaaagcgtcgatggcaggatggattagattagacgagatgagctagtatggctagcttctttttttgaaaaccatggctagcttcactactcctggataaatccattgcgctatttgctttgctgctcagttctacaggagttaggtccagtcagatgaaaattactccaacaaatttcatcggatttaaataaatttaactaagaaaaaaaagtcaaacgacttataatataaaatagagggagtaaatcttcggaataaaatctgctaatatgacttgatttatatgtgctaatgtgcaatatacttacccctccgtcctataatatagccatctaggaccggacgagacatttcgttcattcatcggattataaaatatctaatctagtcttaggttgttatattatgagacgagattataaaatgtctaatcaggctagattggtatattatggg

SEQ ID NO: 107449 - DNA, 1032 bp, Oryza sativa
atctagcactagtaagttgacatggcacatggttttgaaagaaaatgtttgtgttattaaaattgtctaagatttttcttctaaatgtatgggcatagttatcatctgaggttaaaaacacctaatcagtctcgtttattgtgtcaaggcctaacaatattacctcagatatggatttcctgttggtggaggtttacatctctaaatgcacacataaaacattgaaaacaatatagtgtgcgcctagcaaaaatctcttccacaagaaaaaactattgttaacataccgacagcttttccgcttgcccacccatccaacttggagcttgaacgtgggggccaacaaaactttcttgcccccattccaccccttttctgcccaccgaaaacgtccccccgctctccctgacacctcgggcccacacccgctgcgtacgtggcatgtgcgggtgcggaggagggggcggtggtccccggtcgcctctccccgagccggtccaaaccgaaacctctcccactgactagtggggcccatctcccagcacgccaacccctggcccactttacagcgagcgtgatgacgcggggtgggtttggtgagaaaaaagcacgcgctgccccgttcccacgggtagcggggcgggataccatgacggcgtgacgtgatcccgtcacggctccgtccatgtgacgtcagagagagagagagaggggggtaaaggggtaggttttgtcggaatattcatcgtctccgggtgtgtttagtctacgctaaaattgaaagtttggttgaaattgaaacgatgtgacggaaaagtcagaagtttatgtgtgtagaaaagttttaatgtgacgaaaaagttagaagttttgaagaagtttggaactaaactcggtctccttggtccatgagaaatcggcgagattcagaaacaggacagattcagaagcaaaggaattggtatgtgaaagtgtagttgcttgatggcttgtattgacgagtcgcagggacaaaggcagagttggtcacgt

SEQ ID NO: 107450 - DNA, 1119 bp, Oryza sativa
atgatttcacctcctgacagttgcaacgcacttagcgcccttttagccaaggaaatggaccacaccaacgttaaatggtggtcaaatgcatccacccatttttttgcctctttcttgtgcaaaacttccctttttcttaagacagtggaagcattttgtgcaagtttcctaagttgctgagaaaggagtccattgctaggaatgtgtgatgcgtgaagaagaaatggatcttcagttggattcctggagatggagaaggagaaggaccctcctccaatccacctcaatgccctacctgatttatgggtgcatgtggaccatctgatgcaatatgctctgcctcaatcagaaagtccatcaagccatccaagtgcagaagctagtcaagtttgcttatctacctaactctgtattaaggtgtatttgcaatattccatatgaataagcagaacattgcaaaaaaaagatttaagggttttttttaaaaaaaataaggcaagattttgccttgtgaaatttcagattttagtgcaacttcgacagataacctgccacaaatcaagtacaagcacatagaaattttgtttcaagaacaacagaacaaaggcactgtttagttcccacacaaaaaaaattacaccctacacatcgaacgtttaaacacatgtacgaagtattaaatataggctaaaaaaataactaattgcacagattgcgattaatttgcgagatgaatcttttaagtctaattgatacatgatttgacaatgtggtgttacagtaaacatttgctaatgacgaattaattaggtttaataaattcgtctcgcggtttactgacggattctataattagttttttattagtgtccgaacaccctatacgacaccctatataatacccgatgtgacacgtaaaaaatttactcccctgatctaagcaccccctttgtggactcatgcaagatggactgcagtcagtgcaaaacctgcaaaatctacactgaaaataaaatgtgctatgtgctcaagtgcactcaaatgggtactactactacttgtttgtcaggtactgtcattttgaggccctctttgtttaggcttataagccgacttata

SEQ ID NO: 107451 - DNA, 1135 bp, Oryza sativa
cccaccgttttcctcctcaggaggtgggtcccacctcgctcgcttttttgtgctcatgcgtcgtgtcagcgcgtgagccgccgtgtacggaccgaggtttgtgtgctcggctgtggctggctggtgggcccggagaatcactagttctggccctactctgctagcgtcaggattcaaaaattgagcgcatacgagggctcgtttagtcggtgaaatgatgggttgtcacattggacgtttgatcggatgtgggaagagatttttggacatgaatgaaaaaactaatttcatagctcgtctgaaaatcgcgagacgaatcttttgagcctaattaaaccgtcattagtacatgtgagttactataacacttatggctaatcatggactaattaaactcaaaagattcgtctcgcgatttacatgcaaactgtgcaattagtttttctttttatctatatttaatgctccatacatatgtccaaagattcgatgtgatgtttttgcgaaaagtttttgggaactaaacagagcctgatattacaggagcaaagagcaagtttaacagtatagccaattactagctccaaatcatctatagtcaatttaatagccaattcatacaatagttactataatattaatacctaatcccacttgtcatacacacattgcatcttgaagtctgtgctgcagctggttgtaaatctgtagcccgctgttcttctctatcctattttatcttcttaaaatatgtttatagctgacttataatctgctattttatctgctctaatgtagctatttctagcacagtaacttagttccaaaataaagctatttcttcacctacctcctcttctcaaccaattacaatcattattcttcatctcctttctcttttcaaccaatcacatacttccttcaatcattctctcctactttctcaatacacgtgccaaccttaaaaatgactatatattaggacggataaagtagtatagtagtcctagttgattattaatatatttttctgcaacaaaagaatttcgataggttcatttaggtagaaaatcaaccgtagaaacattctcatgcttgtgaaaattatgagcatcttttccatagaatgtataca

SEQ ID NO: 107452 - DNA, 830 bp, Oryza sativa
catgaaaaaatcattacaagttcatggttttttactcgttgtgattaattgttacccctgcatctatatatcctatttaatcctgtagttatttcctggtaggtgtccaaaatagatagcggctgtaaagtttcagagagccttgcagtgtgagcaagctgcctgaaatgggccaagatggcatgctctgtatctttgcagcgaaatggcaagtgtgaatctattctagctaggaatggagagagatcagaacatttgtggtgttagtttttttttattttggatttgtggtgctagctgaatatgcatgtctgcatacagcacccctctgtttgtgtctgtctacatatatatatacatgaccaatgtgcaaacgtacaaatattagagttcgttaattaccagctgcctgaatcttaatctccatccatatttgcatcaatgtcagttcaaaaattcagcagcagaccatagctatcatatcaaccatagaatgatagtaatcaataggtcatcaaatatacatcatgtatatatgcaggtcgttggatggcaatcatcagtatcattgaggaactaaacaaggctagcttgagctgcgactttttctgtagcgtctgaattcgtgcatcactctgttgtgtgtgtgttattcagaaaaagcttagccttgattagtgcatagtagaaacatcgtgtacgcatcttaatctgtgctatttatatgatcgacagcttttacgactttacagttcagtttgggatgtccatatataataagtgaagaaagttacttcgttgattaagttcagtttgagatggttatgaag

SEQ ID NO: 107453 - DNA, 611 bp, Oryza sativa
  unsure (1)..(611): unsure at all n locations
ttcttacgcaaatcatgcccattgcaaactcaatctactagattaaatccgaccgtcgaaggaatcgntacgcctccactcgcgccgtcgccacgcgcgatgggagcgctacaacgcccggacgacgagatcgaagaactcccgattgaattaaatcgcaagaaataaatctcaatttcaaattactaaacagcccttttcatagttttaacaaataccaaatctaccttttcacatactgctagtatatacttgtggtagaatgtactgtaaaagtcctctatatataattaccaaagcattattgctcacacctacactaataacagatcacgacctaaaaagagtcttaaaaacacataaccggtgacaattagaccctttagttacctaacaatgtttccctgtgcatcctactccaaatgataggtttatatatcagggaaatttgtatgagcacgacaacataacgacaaacacaatccacggtgtgaactaaacaaagactaagggttttcaaacacgcaagaaatgtgtactacaaaaggtgcacttaatagtaataatgcatttctgcttctgccctgcttgcatctgcattacgctgatca

SEQ ID NO: 107454 - DNA, 935 bp, Oryza sativa
atctatatatatctcgccgatgtgttggaagcatatgcatctctgggtagcacgcacagtgcggcatgctgccgacggcgagcacgtcacgtggcacctgccggcctccgccgcagaggtggcggcggcggaatcctcctcggccctgctgtgtcggcgcgggcggtgctacccattacctcttgccggctgtgtccattttttttctctctcaatacgtcatcgacaatatcggtagggacacaactatatgtgttacgggtgcatgctaaaaaacccgattcagaaatttttttaatgattcgtctatatttaccatatatatactatatatcattcaattcaaatttaaatacatatattaatctaaactcaatcagtaaaacaagtttaaacttgatcaataaaacaaacgagtggcatatccttctatttcgttttagctcctgagtgtcgactagggtgaatttctttgacctattgagtattgacagtcaggggatgttctgccgacattcacgtaaattatttggaggccacatctcatcttcatctttattgttcaggtacaacggctcctcctgtacgtagccaacttcctcttctcagttctcactcaccaacgagagaaaaaagaaaagaaaaaagcaaaaaaaaaaaagatgggttgcttcccatgtgatgtgcgtattctgaacgattcgtctgcaactgcatcgtcagctcgggtcgatcgatggatggatgtacggttcatatctgacgtgtgatggattcgagcatcactgacgaatcctctcaccggggtcaaccacagatcgccgtgtcggagcggggcccacctggcagccacagcacagtgaggggatggatgagcagaacgccgtgagagttcagagaaacatccatggagcccccacatgacgctcacatgg

SEQ ID NO: 107455 - DNA, 762 bp, Oryza sativa
cagtcgcttcattgatggtagcgccaagttcttcaagcactttacttagttcaccatctggagtaatctgaggaaaagctctgtttagggccacctccaagtgatcaaggatgccatccatcgtttggcaatatttcttaactagctctgttttcgaggcattgcttgaagacagcacccggaaatttgaaatactatcgagtagtgacaatgacactgaatccatcacctacataaacaaatcaaaaattaagttcacttcgggtgcggagacaaaggaacggggaagctcaaacaggctcagagtgactaaacaaacaagcaggtgcattccactgtcattcgaagttatgcgtaagaaaaatagctgagtaataacaagcaggttagcatgcacgtttcagtgaaaatgagctgctagctaactcaagcatgactaaccatgccttgttatttatctactatatatgtgaactaagatagacataaattccgtgcttatacctggaacggaaagcaacaaatttaggcgtgatagcatcgaaacatctcgtcagtgtcgtaaaacaattggtgatcatcagaaattcagaactacttagtccaaactgtatacaaacaagctcaccgaacacgcatttttgccccaatacaagcaccgaagcactatccccacactatcacaaaccctaaccgcacagaaatctcgaaaaccccatgccgtacttgcccaccaccacaaacaaacgccatcaccacgtc

SEQ ID NO: 107456 - DNA, 772 bp, Oryza sativa
tatagtcctttcccccctcttcgtgcttcgggggaaggttttggggggggggggatttgctatttgttactcttgtctttccctcatacattggttgttattttgaacttagttgctagtattagagtgaaccaatggaggtcacattattttttatgtgctgagatctgcgcccttgtctccaggtgcaacagcacgagtagctgatgttttcaatgttgatatggctaaatcacaaggtttgtattactaaatcagtcatgatttttttgcggtagttgacacttttctgaatatttctacctatattcactatggttacttcattatttgttttttacaagttttatctaagcttttgtttgagcttttttctctcctcatgtttcattgtatctgatattattttgaactccagttgttagcagtagatggaacagcctcagcccagcctgctctctttttaaattctaagtcgctgcctatccttcttatttctaagtgcaaaaatgcaagtagctgaacctttgaaagtgctatagagaaataaccggaaggttttgtttcatgtcagtgtgattggtgctttgttttgatcatgtctctaccttatctaatatttccaaatgatcatgttttgccccttttctcctcaaatatcttttctttggaacagattaatcttgattcttgagatagatgtaactaatgatgttttaccttctttaatttctttgttcaagatgcatcagggcaagtaactgattacttg

SEQ ID NO: 107457 - DNA, 605 bp, Oryza sativa
acatggatatcaaatttgacatgaattttacttaataattgttgtaacctacttttaaagcggagttgtccgtaggctcatacggtcatacccacattggtaagtgcgcagctctagtctagccaagaaaattaagcgatcagttaaaaatgatatgttggagccagtgcttcgtgtttgattcacactccaagccttcgctaatcatatatgctaatgcaactcatatcctgaattgtattaggttttttgcaaattgtaatgcacacgaccatgttactagtttctttgccttaatttttctaacaaactgttgggtcagaggtctagatgataagactgaaggggggcaatatatgcaaaactacaaatagctttcagttattgaatatctggaatggagatgatgccaaacacaaaattttagagaggctccatcgttagttagctgccttaatccatcaggattttctctcacccctgctgcttctatcttgtctattctccgtcctgtactctttgggggcaatacacttcacttgtccagcccagcacctgtcttgtcattttccttctctttaattaattaaggccgacatggaacc

SEQ ID NO: 107458 - DNA, 1194 bp, Oryza sativa
caccatccatttaggtcccgttgttttcttataaagacatattttactttagtatttatctgatttaaaaatgactaaaatcaattaatcacgtactaatgattttttttccggtttacatgttcctacttaatgtttatgttctacacacaattgtatttatctcgaaaaataaaaatgcccaattgtattacttaaaaagaattgcactaccttcttcttgtaaaaatatacaacgttttgattatccgttatatttaaaatcttaacgtacaaatacaagaatatatgcatgtttaaaatattttaatgataaaataggtcacaacaaaataagtgatgcatatatagttttaataggatagatggttaaacattcgataacttcatatatttaaaattagagggagtacagttttactacctttacactcacagttatatattatattcatgtaaaaaaaacagttttattttttatttcttttccttgataagtatagatgtatttctcatgatgtgtgttcgctgctataatttagactcaccatttaccgtggctttcgggttcgggttgtcgtagatggtgaacattggagtactcaatttcaacacgagtattgaaagaaatgtgcgagcaggaggaggatgatgaaatgtgaaatgcagctagatttttagaggcctgcatgtcgaacctgcgttggtggcggctacgagcagagcgttcgttgatagagaaccgcattcactgtcgatttctcttgcaggtcaaaaaccacatttaagatattttcgttttttacatggatctgatttctctggtcactccgtgacagaatgttcagtgagagcgagatactggaactactcaatcattggcaaaagaaaacgaacaaatcctcctgcggttttaatattctggccaaaattactggctgttgtcaacccattttcgagtgatcctgaaacagatgagtttggcacttcgaaaggcaagagtctgtccacgtcggtcttttagctctttctgtaacctcaccacgaatacgaaactatatcagttctgctgctttctgcagaaaaggtgcttagtttatggttgattagtgattactcaacttagctgagaaaaaaaaaacagctgataaaaagagaatcttcttttaccctcttttgcaaagccgatttttt

SEQ ID NO: 107459 - DNA, 531 bp, Oryza sativa
catagtactgctagctcacaaaagtactttgcagcttatttctgacagattatatgctaaacaccttccttttagttatgtctatgctacataaaaactactgagcaattaatcctcccaagttttttgtccaagatactgaagcccattcactactaataaatgaaaggttaagcatccagcagccgatttttttttctaggaaaaagaaaggggcattggcaattccacaaaggcaggacatgatttaggatacttggtcaaaccaaatgaatgaggtaaccaaacatgggcaggcagcataatgggtattgcaatgtcgtgctaattcagatagcagctaagtatggttgaaatactgggggaaaaaaacaaaaggcgctcaccacaaatgaactgttcggcagaatcaaggaagctttcctccttccccacacagtgtggatgataacccttgaggcagttcctgaaaagcataacaaggcacaattagctagctacactgtcaccaatcgattggaaatgatcccg

SEQ ID NO: 107460 - DNA, 583 bp, Oryza sativa
gtattacaaggcctttttctcataattcggccttcatcatcctcagaatcatcgagaaaatcatcctctgaagcagcatttgccgcaagatgtatttccagcaagttaagaatcatatttgacttcacttttcttttcctgaacaaagaatgaagcttatcatcacaaatgacagattttcttttcctgtccttgaatagattcttctgctggatgtactccttaacaactccagtaagtataaattcatcaagaggtttagttgtatccttgccaatacatgacaggaattcaattagctcttttgaaccccaaccgacatatgttttcttgtttgacttctttctcttcagtgacatttttgcttcacttggttggacctttacatcaaccgggaatggttgttcagcgccatcattaacactcaatgaattcttatctgccctgtaatcttcatctgggggtttctctgaatcccttccttgtttacagcttaagcttgttctaagacaaatattggcttgctgcaaatcaatcaatgccaagccttcattgtctttaatagtttcccagtagtctttca

SEQ ID NO: 107461 - DNA, 594 bp, Oryza sativa
ttgccaaagtgaaattataagataaggatagtccaaaaggaaattttagtaataaaaaatggtaactgctttattttgacagtcctgctttaacatttggctggtatactgttacgtgacacgttatttgagctcatttcattgctaccctgctcaaaacaacaccacagaaaggaagtggacgacacttagcctgagttctttgggtcactttcccaactcaccaatctaactatcttgtttttttcgcatgttttcaaactactaaatgatatctttttttgcaaaaaaaaatatatacaaaagttgttttttaaaaaaaacatattaatatattttcagagaaaattaggtaatacttgattaatcattccataatgagttaccaaagaacatagccttatatatgattggtcttgaactcttgctatacatgattggtctgttgcaaaattcacaatattgacacatatataccttccatgaattaatctacaggagaagcagagctcaaacaaaatttccaggcctcgaagacgatgtctagccaaacgagaaggtccaaattaacagccgaccaataaccggtcgacc

SEQ ID NO: 107462 - DNA, 1278 bp, Oryza sativa
  unsure (1)..(1278): unsure at all n locations
gctatgttgacatgtagctaacttgctatgcatgcatctagggatgatttatctacaataatcgctgacaatctgtctgatcggcttgagagatggattcccacatgtttaatcacgaggtaactactggttccttttttttttataggagtagaaaagcttaaaatcactcccttcaataacaagtgacgcttttatattgatacggtttctaaaatgcaacttgatttgcatacaactaactaggtgagccgcgcaattgcgcagctagcatccatacaaaattattttttttacatatgattttgcttaaaattagttaaatagctatataattgtcttaggactttgaaaaaccgaaccttatcatctgcattttctaattttatagtttttgaaagtcacactaggcgctacctcgtacttatttgttacccttttatttatttgctcgatctactacggtttctattcatcctccttgcaacttttaaaattggatcttataaattctagagtttattgctcgatctcctacggtttctattcatcctccgtcaaacgccgtcactcgactcccntaagccgtccatcgcctactctttttattttcattgggatttttaaaatcgaacataattatcatctgtgtacattttaactttctagaagtcccggcaaaccatccgtagctttgttattgtactcctctatgacccatccgttgccttctctcttaattattagtgagattttaaaaatcgaacatgattatcattttggtttaatttttactttccaaaagtcttgccaaacaccgtgattgtgctgcttaacagcttgcctgtcatcccttctcttaatcatcactgggattctatttgattttttttaaatttaaccactataattttgacatgctatcatctaacaattattttttagtaatatttaaattcaataatatgataaatagatactacttgaacactttggaagtcatatcaaaatccaatttggggatgtattttatttttaattttatttttaataaatatttttaataagtagatggactctgcttctaatattctttatttttaattctgaattttagtaatttctaaattgcattcctacctgaactctttcgaattcgtagaattcatattgaaatcaaaatttgggatttattttattcataattctaaaatttaattaatcctatgttgtgttctaaatgcactctcttccaatattttttaatttagaatttta

SEQ ID NO: 107463 - DNA, 538 bp, Oryza sativa
atctaaaaagcttcggatataccactcctatagtaacaaaatccaatagggactcctctgtcctgagtcctcccgactccttagggcatgtacaatacaagcccttcttcatgtctattagactcgtcatgagcgtcggagacgaaagctttccttacttccaggaccaccatgagtcaaagtaatttgcttgaaatttattcaacaaaatatatacaaatttcacatagtgaatttgatattttatcttgactgatacctcctccctttcatctgcggtagtctttagtgtacaacacatgcttttaagaccttagtgtttttaggaagcaagttgataattacaattgtttatacttgtaacaacaaggcttgattttagcattgaaagtatctttccagaaataaaaacctattgaacaaaaagtggtcacacataggcaaaactgtcaaacatggagcaagtatctcaagacagtgatctcattgaaactgtccttatttcttttttcgtaagcgcacaggtccacttttatct

SEQ ID NO: 107464 - DNA, 912 bp, Oryza sativa
atcattagatctacacatgtaacttacgcagaataacatgaacagatcaaatatgcgcaacatattaacacgtaccgaggtgacgaaaagaccggctgcttggtcgaaacttttcgcaggctctgggcaagcctgtgtatcatcgtcgtcgtgatgctcatcatctttccacttcggcgcgtcctccttctcctccacaagaatgaagacctttttggtagttgatgccaaaagggggagaaaaatgtcattaggtgtgctttttgtcttgtgggttgggactagtggtagtgaggttagtcacctcatatctaataggttaaggaggtttgggctatattatgtatgggtatgggctattactctatattgtatgttccttttcattttgttgatctctatgtcatttggacccttcgtagtcttgtaatagcctatatttatttgtgagcccttttagaatgatttgtgacttatgtgatttgaatggttaagagatgtgaacttgtgcgatgatagatggtgtatgtgatattgatatatttgtgaccatcttatgctcatgaatgaatatttcttgaagttcacattgagatattgctcttgtgtttgtgatatgttgaaatgtgaaattgaaatgtgcattggctccatatttgctatttgtgattgttatgcatatgtttagggggagcttttgcttgtcaatgcaatatatgtccatgtgctctatgtttgattatatatatatttgtggtgtttgtcatcaattaccaaaaagagggagattgaagcatctaggcccccggtgttaattttggtaattaatgacaagcgctaattgtggactaaccattgtctttgagctatatattttaagttaggtccacgtcatatgtgtgcatggatgat

SEQ ID NO: 107465 - DNA, 655 bp, Oryza sativa
tggctagtctaaaggggatcctattggtttcggcattaatgaactcagttggatccaaattgtcgatcggaccaagaaagtactgattgggatgaactaaacttgggattgcgatctgatgagaaaggttctatagaagaaaagaggaaaaaggcagattgagcgaagaaagaactaatctactgcaagaacaagggatctagccgatggggacttacctcggggaattcagccgatggtgcagcaaaaggaccagcggaagttgacatcgtcgcgggtgaggtcgccactgcagggaagtcgcctccggatcgccaaaggggttcgagggagttgccggagagagagaagacaggtgtgatgtaagcggtgaaacgaaaagtaacggtgtgaaatttctcgggggtgacagttagtacttatagcggggccataacggtcaaaaaacggaaagccctagattttcttggagataagatttgggcaaatccgcaacattaccaaatatcgcggacttggggggcatatgttaacgatcaaatttggtaaatcaagcattggagatagagataaaaccgaagcaaaatcaaaagaaattgaatgtttcggaaacagagtgcacatcgactaaagtccgaatcagctacgatctaca

SEQ ID NO: 107466 - DNA, 699 bp, Oryza sativa
  unsure (1)..(699): unsure at all n locations
gcgaattcgagctcggtaccccacgtccatatataagcctagctacgtacctagctatatgcacgcctacctaattcgttataattgtgtagtaattccacatttatttatcctgtgaactatgtaataattgattatatttttttaagtaaatgtcaaataattgattttcattttccaaaaagaaaaatatggattatgactatgaactccaacatgcctatccaccactacctgcatgtgtttcgacagtcaggatttatgcacgcctgccggaacaggatttatgcactacgtacacagtagagtgactcatgagctgttaatttgctccaattaacaagcaaattgctagcaaaattagctaaattcgtgccgaagagttgtgttgtacttaattgttactggtgtatcacgggacatgcatgaaacgccagaagttacactatagcaaacagcactcccgatgttagtttccttcaagaaatgaaacattatatcgatcgatccatccatcgaaaattcgaaatgatggatatgcaaagtgtggcattttgtgtggttggtactgaacctctgcttcttcctcttccctcattcacaggcatagggtttcgatttcaactcatttatggggtaccaagcaaaaaaaaaatcgtgcgtttaggaagcanggaacagaaaagaacaaattataaa

SEQ ID NO: 107467 - DNA, 508 bp, Oryza sativa
ttaccatgcaaccacatgttttcatggtaaggacctagcttagtacactgcttagctttggcaccggcggcccaggtggctagatgataggtttttggtttgtaccatgggaactttcacctgtgtggtgtagggaggaccgcccatgggggaagccggtgttagggcgaggtaggggaaacgctttgttacactttggtgtttagcggcaccgaactgtatcttgtgggtaaagttgtacaacctctgcagagtgtcaatctattcgaatagccgcgtcctcggttatggacatgctcggtgacttcacatgaggggtagatttgtgaaagttttaattttgggaaagagttgtgtgcaggaattaatgaatatagatgtgttgtcctgtgtggacaaagaaccttttggtcttgtgtggacacagtatcctttttgggttggttggttggttaaaaatgttgtgattgcaaatgttgcttaaattaaatttatatctatagtgagt

SEQ ID NO: 107468 - DNA, 1015 bp, Oryza sativa
tactatagggcgaattcgagctcggtaccctccaatgtataaatattataatatttaggaattactagtactaattgttagtagctagcaatagctatacatatatgtatcctccatgtcattgtaaataatgttagtgcctgtttgggttagtgccctcgtaaaattttagtagtgcaaaatcttagatatgttatggcactactaaaattattattgacttggggcaaaggttgaccttaatccaaatatgtaccgtgctatattaaagttatcaaatgattcgtaggactaaatttggtatccaaccaagctatttcgcagtacataccaactagttaattagcactagctactatgagaggcttgtatacaacccgtctatttaaaaaatatataatgcatagtaaaatgttcttaataagtctatatatgcgtgtgtatattaattaatcgtaaccattagattaagctctgggcatagagtccagcaagaaatatatatgtaccaacccatgcaattaagctaaccatataattaaccttgtaagccacctgctatataaggttcagaaatttgttgtgatattttttgggtaccggtaatttataccccccataaaatcgatttttttttaaaaaaaaggaacacatgcatttgctgcttcttcttttcgatctggaacctgccgtcgatcgatcgatgaagcatcatatctcatgatatccagtcacgaatataaaggttgccacacctgactggttcctttcattcgcatgtatagcaaagtacaagctggtgatgatgctggtctgattagtggaccgaccgacctggaatgaatatatacgacctctcagattttccttcaaaaagacaaacgtgtcgctctagtacttagagatgatattcttgagatgcatgctcctctcattgtctgattgttagcttatttcgaaactccttttcaagtttatatttttattttccgtgggtggccaaacaactgttttt

SEQ ID NO: 107469 - DNA, 760 bp, Oryza sativa
tgtagaagttagaaataatacttctgctcatacacaccaatcctttgctctactggagactcaagtgcaatattgaatccatcaagagcataacaaaatcaaataatagagaggattgtaacagattaccccatcaagttggtgaaataaaggagcaattaggataaccaatagatcagctaatggaacacataatgaacagaaattccttagacctttgttgtcgaagtgacaactgcatacgtcgaaggatgtggttgctcaagggttcttggaaacaacgaagtgtactaatttaaggatttttcttttgaatgcccctttacatggccctaggggtctatttatagttctattacagatccccctattagggtttaggttttacaggggaatttacatggttgccctcatgagagggacacttgtatgggcatacaatgtaattgaaatatatgggcctccaatgggccggttggcgaatgttggcccactggccaatgggatagagcggctgggatggccccttgggcctcctggagctgggcttgataccgcgaagtcatcctccttcggcaagcacccttcaccatttagccttcgcctaggacgcatttggacttgcagggtcccaacgcgactcttcacccttcgccgcctttgcccccatagtcttcgccatggggcttcgccccgacgaaccttgacgccttgagtctgaatcctcgctggttgcatggtttcggcaggtctggtcgaa

SEQ ID NO: 107470 - DNA, 652 bp, Oryza sativa
tggaataaagtatggctcatacagatcaataattcatctttccatcagtggcgacctcacccgcgacgatgtcaacttccgctggtccttttgctgcaccatcggctgaattccccgaggtaagtccccatcggctagatcccttgttcttgcagtagattagttctttcttcgctcaatctgcctttttcctcttttcttctatagaacctttctcatcagatcgcaatcccaagtttagttcatcccaatcagtactttcttggtccgatcgacaatttggatccaactgagttcattaatgccgaaaccaataggatcccctttagactagccagttgtgcaaccgggaccccgaatcaggtactaaagatgggcatatagtcccggttgaaataatcgagactaaagatgaatcttcgtaatacgaaccaacactaaagatcagagtgccacgtggctgacgctctcatctttagtatttttttttgttttatttttaattattttttttgctacttatattaatttcaaaccaaactcaacgacaaaatcatccccattcacaaaacatcacaaaatcatcgacaaattcatagatcgaatgaacatactcaaattgacataacaaattcattagctcgaattcgcc

SEQ ID NO: 107471 - DNA, 734 bp, Oryza sativa
aagtggaactagggcagcaaaaactgtgatcatcagaagctattgctgggaccacctccaagcatctcctccctgtcgatgaagcgctcaagaagctccttgttcttggtaacgatgcattcatcatccttgccaaaccaatcgtagcgattctttgcaatgtaatcgtagattgcatcccgcagtggggcggggatgatcagcagggagctcaaagctgagtagggaagaggcaggtacgatgcaactttcaaagcagctgcaaccaaaacatggaagatttagtaccctgattaccacaggaaataagggtgggcaaatatgacatgattaaacagcaaaaagtacataaagaattgctgtttattttttttccctaaatgagtatcattaaaaggatccttcagttagtactttcgatcttccagttagtgctgctatatggacagtacaaccatatctataatctatgtattctgccagattaattggtgtctcagggaatgattgagctacattatgaaaggaactgtggcctctagaaatttgtacttttttgcaggagcacagcaatggctatcattgcaataacttggttgaacaaatgcatgatccaaaaaaaaaatactagagtgtaaagcatgttgctctcatgcattactggtaaataagggggcacacctatctatcacaaacctagcaaatgggtaccgagctcgaattcgccctatagt

SEQ ID NO: 107472 - DNA, 511 bp, Oryza sativa
catgcaaagagggatcctttgatggcctgatcaactgtaaaattgtttataaacatggttagtaatatagaaatgacacagatagattccatgagttggtacactagtggagcttgacagtgccgtggtgaaaaattacagaattttctgaacatttctaaaaatcaactcatagggattatatgttctacatctgaaaaaatcaaaataaaaatccaagatgtgaaaagataaatgctacatgagatagtgcttcaactcttttcagcactgatgttcttgtacttctaaaaaatcaaatcaactgtattcaatcttacaaattttacagatagtaataacattagaaaaaataatcttcttccaaaacatatcgaatgtgaccatacccattcagaagctcacgggtgtgaagctggtccatgaattgatatcatagtgtatgatcatttctgatgtggtaaaagcccccatttaacctacacactagacagacaatgatccatggatg

SEQ ID NO: 107473 - DNA, 638 bp, Oryza sativa
ttgtctttgaactagtttagtaaagtggttacaaatcattgtttcaagcaaaacgataaccggtaagacccgtgtgaagtactgcaagacaatggacaatatggctatgttgtttcatgtatgttcatagtagcattttatatgctgaagtaatatatggtcaatattatttcattgcaattgtgaagtgtaataataaatttcttatgtagattcaaattatcagtggctgaattctgacacttgaatcccacttcaagatctaaggaagtagcgaaggaatttgcgaagatgatataggaatagatatattgcacaattatctagcagagcttgctgctgaaaatgtgtacttttttctttttaaaagatatgcctatgaatttctttgttacaagatgtaaacaataattctgtaaatttccttattgaaattcaatatattatgcggtagcgctattcagcgcacttgcgcacggaacattgtttcgagcaccgcatgtcaagcccagtgtccgcaaaaaccgtgttcggttgcccacgttcgtgccatgtagattagatctatttgaatccgggtagttgttaaagatacgcctctgcgtgtaaatcaattagtgtcggatatagggacacct

SEQ ID NO: 107474 - DNA, 726 bp, Oryza sativa
cttggaatcgcgactagattggacaagtgctacagatgtaaacaaggatagagaagaagaaaacaaggtgaggcaaggaagaaacaatctattgcgaaaaaagaggatctagccagtgagcacgtacctctgcgtactcggccgatggcgcggcagacgggctggcggaagtcgacatcgccgcgagcggaagcttggccaggagaagatcgccttgaaatcgccgtgtgcaccgaggggatcgccggagaaagagaagacgaggtttgcttaagcggtgaaaacggaagtgacggtgtgaaatttctcgggggtagcggttaatatttaaagcactgtgtaacggtcggaaaacggcaagtgcgagtttctctcggagacggatatggcaaatccgaaacattaccaaatattccggacttggggggcatgtgttaacgaccaaatttggtaatctaagtatcggagataaagattagattgaagcggaatccaagatcaagattgtttcagaaacagagcaagaatcggctggagtccaaatcggctacgaccaggatcggcagagttcgagtcagacagggttagccgattgagccgatcccgacaatacaactctacgtcatcggatagaattaatgtgcttcgcatggattgccacacttggactgagtcctggataggcaattgtatctattaaataggatattttatgtaatttcctta

SEQ ID NO: 107475 - DNA, 867 bp, Oryza sativa
ccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacacatccatcagtgggatgatcaacggagaatttgttatagggagtagagtggtggactgattacgtagatggccgagatttatttgtagggagggatgacttggattgatttgggtattaggaggtttggtctaaccatgaggtgtgcaacatggtgccgtggagcgagcacataataggcgtggtgatgataaagcactggatggtggacggatagctagaggggcttcaggagtcggtttg

SEQ ID NO: 107476 - DNA, 1160 bp, Oryza sativa
ccatagcaaattcgactaaggatgagcccttgatagccgctgcaacatatttttggtcgaatgcccttaatgctttcctcttcaaccaagggccaatgacaccaactttgctaaatatcacaatgattactggcttggatgtgacttcatcggctaataccatgagcttgaacaccaaaaatacctttgaattcaagaccaagagtattggaggctggttagggtatattgtagcatatatgggcaaaggacatgtcactccccgagagcatgtagcctttctgctgatgtggctggagaaatttctcttttgtggatcaagctgcggccctacaactaactggcaatttctagccgaagccctagaaataaagagacaattccccttgggcaaaatcctcctcggctatctgtaccaaatgttgaacaatgcatcaaccaagatagctgtcggctcagtggttggagcaagtggtccatggtggctgctacaaacttggctgaaattagtagccatgaaaagctgtaatttggcatcttgggcagaagcttgagtcccagaatagaagtcgatacagatgatgatggggtagagcgaacccaccgtaggtgcatgtcttatggagaatatgcattcacaccagttaatgcaggagcaaagctatctactgaatttcagaaggactggttcttcagcttctacgatggatttcaaaaagatgcccgagtctggttcccttatactgactcgatggattttgagctgccatcggactttagattttaggaaatcaattctgagaaatatgatcaatctagggaaatttttactactgccgtcagcccatgcatccttctagtcgtcatccagcaggaaacattcaaacctcatacgaattttatcacccaatgagttctgctaggcaatttggaatgggacaaatgccgatcggcttgtactttgtagacaaaatccagtgccgaggtgatataacttcagccttaatgatggatcggctgcttaacatcccaggacctccactaggcagcatcgaaaatatagagctggcaaggttcaggagcaaggcatttgacagatggtggggtgaatggaagctgcatctgttccaccaattggcttccatgtacatgacagacct

SEQ ID NO: 107477 - DNA, 562 bp, Oryza sativa
ctgtttgcaagcgctaccgtggctgaactcaaccgggctgcgatgacagagcctgcaaaatctcccaaggctatggcagtgaagcggtttggcagggcgctgacctatccatgtaaaagaaatagaagagggcatggcactggcaattatacaggacacgggaggtggacggtaaaaagtggaggagccatatgtgctggaaaaatggatctagctcatcatggtgattcaatttttgtcattgatggaaaaaaatgatttaggagaggaaggaattagtgagtagattggaagaagaagaaaagaaacggctaatcatcctcagtggtatctgtggaggaggaaggtaaactagctgggagatgagaggtcaccggaaatttgggaaacggattcagatcatcaaggtagtttcattttttggcattaaacagtaagattgatgagggagatgatagatctgtgatgggaattggaggatacgttgctgctttcatggagaaaaaaatcagcgtctcagcatacgtgaataaaaagaaaaagggccagcactagtaggaat

SEQ ID NO: 107478 - DNA, 505 bp, Oryza sativa
cccatccctacctcttctgttcttaaaaaatattatctatctccacttagtgaaatactggaactagtaatctcgctgctacgaaaatagatatttatactccctccgtttctaaatatttgacgttgttgatttttttaaatatgtttaaccgttcatcttattcaaaaaaatttaagtaattattaattatttttctatcatttgattcattattaaatatacttttatatatacatatagttttacatatttcaccaaagtttttaaataagacgaacggttaaatatgtgctaaaaaaatcaacggtattaaatatttagaaacggagggagtaacttataatcacacctaaactgcacagtcggctaaaaagggtgagtggtgccacgtgcttggccttatgacacatatcgactacccaggatagccaagctagatcgatatggtgcccatatattattaattgtatttgtggtcttgataaacaattaaatatacaat

SEQ ID NO: 107479 - DNA, 650 bp, Oryza sativa
atagtcgtagcagtagccatcactccggattggaaagtgtagtactagtaaatcagcttttacctttctagccatctcgagaacaaaactgacgaaatcatggaataatcgaagtggtggaaattaagaacatatatccttttttaaaaaaaaaacaaaaggcaaatgtgtatcgctggcatcaaattacagcgtaaatttttattctctacgtgttagactatatttttgtggataaccattgaaattggttgttaaatagaacacaaatgctggagaagggtctggaaaaacactaggctttttagggagaaaatggtttcaatctgttcaaaacattacttaattgcttagctggtcaatgctacgatgctacgatggcattcccaattcacagttgtgagagttagtagccttttttctctaaaggaaaaggatgtagtcagtagccttttaggtgagcgtttgactcgatctaaaaagcttcggatataccactcctatagtaacaaaatccaatagggactcctctgtcctgagtcctcccgactccttagggcatgtacaatacaagccataagtaacagtggtcttaagataccacgtaggatagaaccacataaaggtcacacaacccacagtggtaatca

SEQ ID NO: 107480 - DNA, 531 bp, Oryza sativa
ctatacaagtgtgctccagtttcacaacaagaaatggagataaaagaagagaaagcagcttgttcatttcttcagttagaccaaaatttacagtgaggactgactgcatttgctgtctgaatctggcgacaacatgatacactacggtgaaaacgatgctcttaataggaaagcgtgtatttctttttggaattgatccaatgttgttccctttttttttccagagatgggaacactgcagctgggtgactgaagctcatggtggcattagtgctaagcttaaacacttgcattcaatttgtagtttagctcttagctggctagttctatttattctaaaaaaacaactgaattgtaaccattttgattactttgtgaccctttcatgtatgcatttgtgaacgtacagcatacatgtgtgttttccctgtgctaaacaatgtttttttttactgcgtcctatggatttgatctgggagaatgcatattggttcattgctacttgggaacgtacagctgctggcttatttt

SEQ ID NO: 107481 - DNA, 634 bp, Oryza sativa
tataccaaataggcccttagtttaagagaagtgatctcatcatctcatcaggattgttggtggctatcttctaggattcttccaaatgtcaactcatggtttatgttggatgacttttgcttcgagaggaaagagtggttaatacaaagagtgccctccatacgcaaaatttgtaaatctatagattaaattggttcctctcaaataaatatcgttttaacgaatcaaaaatcaagataaaaaaaggttgaattggccagccaggctaaaaactggataaaccaaaatactaaaaaaaaaaccaaaaaaacctgacatgatccacaaccttaccttcccccctctccgactctccccttcctcgtctccatctcgacaccacccctcccgcctcccatggagtcctccctcctcctcaagcccttcgtcctcctcccctccgccccgcgccgccgccaccatcaccacctctccctccccacgccgccgcatcggcgcctcccctcctcctcgtcctcgtcccgccacgcatcgcccgcgtcctactcgttcgccgtgacccgcgccgcgcgcgagctgttcgacggcagcgcggacaggccccccgggggggtcggccgcgggggcgcgcgcc

SEQ ID NO: 107482 - DNA, 543 bp, Oryza sativa
agtacaccgttagatgctatatattttctccatttcatattataagccgctttcacttttttatagtcatttttttaagtttgattaaatttatggaacaaaattatcaacatttagataataaattagtttcattaaaactaacatttaatatgttttgataatatgtttattttgtgttaataatgttgctatatatttttttaaaactttatcaaacttaaaaatgtttgattacaaaagaagtcgaagcaacttataatatgaaataatgaaacagagggattattatgccgaacttttcaatttttatcacgttatgttacagagcatgtaattttttctgcggtgtgtggaatcaatactaactctctgtttcagaggacagtcatatggagggtggttcagaatttgcttcccgggaagacaaaggaccagagttctggagaatctaccccttctgggatcatgtggtcctttgccgctggttccaatttgtcaacatctgcaagctttaatgctgaaaaggaatcaaggaagaat

SEQ ID NO: 107483 - DNA, 1408 bp, Oryza sativa
  unsure (1)..(1408): unsure at all n locations
gtagccgatggatctacaaccgatggcttggttcttttcttctttccggtatccattgggataggctctctcatctgtccttgaagcaaacttgttgtcttggggggcatggaagccgatgacaggaggagccagtccaccaccattaggaagaaggcctgcagcataattgatctccaaaccactttcactatgatgaggaggtgaagattctgtggtctgcaatcaaagaaataaattggataaattttatatcagcagatagttaaggaaattgataaaagtagaaattcttacttgagggataacatcagggaatatgttagtgagatacatggaaaccgattgatgaaataaatgtttcttccattcaacccaccatcggtcaaatgttgtgctcctgagcaaagctagctcaatattatcaatacttccaaggggaggtccttggatgcttagcagccgatccatcattaatgccaatgtaatttcccctctatgctggatcttgtcggcaaaatacaaaccaattggcagctgtcccaatccaagttgtctggcagcactcatggggtgatagaattcgtaagaaacttggatgtttctaccctgatgtatgccaactgagagtatgcaagggctgatagcagtagtgaaacttctctagacttatcaaacttctcagaattaatgtcatcaaatctgaagtcgaggnnaagttcaaagctatcagaatcggcatatgcaaaccaaactattgaatccctggggaacccattgtagaagcttgcaaaccaatctctgaaaggatcggctgacagtttggatccagcattagttgatgctgcctctccaaaagacatgcatcggcatgtggttatttcttccctatcttcatcggtgattggttcgaatcttgggaaatctgcttctgtcagggctggtctatcgacaactttcatagtatgcaaattcaaccagatttgaagaagccaccaagggccacctatgtcgattgctgatccagaagcaattctagccgatgttgagttcagtgtttggtataaataacctaatagatattttcctaatggaaatccttttttttctactagggactcggctatgtgttgccagtttacagttgggccacagcttggaccacagaacaagtacttttctagccacatcagaaggaatgctgtgtgttctcttggagtaacagctccattccccatgtttgatgagacaaaccctgaccaaccacctatgctcctggttttgaagtcaaacttgtttttggtattcaagccgactggattaaccgatgaagtgatgtctaaaccagttatcatggttatgtctagcaaagttggggtcattggtccctgtttaaacagaaagccat

SEQ ID NO: 107484 - DNA, 647 bp, Oryza sativa
taacatggaaactccatcagctattgaaatcggttgttttgcctcctcttgagtggttggttttatcctacatgcactactggagaaaagggtcttcactcacggttcgtaaccccctgttgtcccagttgtgcaaccgggaccccgaatcaggtactaaagatgggcatatagtcccggttgaaataatcgagactaaagatgaatcttcgtaatacgaaccaacactaaagatcagagtgccacgtggctgacgctctcatctttagtatttttttttgttttatttttaattattttttttgctacttatattaatttcaaaccaaactcaacgacaaaatcatccccattcacaaaacatcacaaaatcatcgacaaattcatagatcgaatgaacatactcaaattgacataacaaattcattagacccacggtatgaacaaattcacataaaaaaacaaatacacattaatcaagtcattgtcgcgccggccgccgcccggtgctgctcctcgtccggcgtcgtgttagccgccgccgccgcccgacgcgcgcaggccgcccttgcccggtgctgcgctggccgccgccaccgcccaacgctgctcctctctgttgcgaaaaaaaatggagagatgagata

SEQ ID NO: 107485 - DNA, 646 bp, Oryza sativa
gggacttctagaaagtaaaaaatgaacccgaatgataattatgttcgatttttaaaatttcaatgacaataaagagaaaagacagtggacgggccgtagaggagtataatggcggcgtttgatgagacttttaggaattataaaaacgaaacccaatgagacaataaactctaaaaactataagatccaatttttaaaaggttccaaggagaataaatgataatagtagatcgagcaagcaaataaaaaaggatatgacataagtaagggtagtaactggtgtgacttttcaaaaactatttaattagaaattcggggatgagaagatttgttctttcaaagtcttaagacaataagatagctatttaaataattttaagtaaaatcatacgaaaaaatatatgattttgtttgggtgctagtcgcgcaattacgcgggccacccagctagtttcagtagaaagaaagaaaacacatccaacaagtttcagaagttaaaaaaaaagaattaaaaaagatgtgatgggacaaacccccaacttccactaataaaagtatcaactgaaataacgttttcaaaatcacatagattctagcataaaatttcgtaggtactacaccatccaaactggaataaaagctccgt

SEQ ID NO: 107486 - DNA, 642 bp, Oryza sativa
gctagtatggtttatcgttaggaattaataagttttttggatttgtttgaatgtacagaccaaaaattcattgtttagtactttcagcagagcaaacctttttttttctgagtttctccttcaggcacccaaaagaaatagagctaatctttttcgttactgctcagatattgaatccgtactcaaatgaattagagaaacataagcagctcatccaccaccaaagttatcagaaacttggtccgacgactaactacaacccacatgtcacaacatttcccttagcaatttcaagtttccagatagaattactggactagtgctcgaattaagaccgacagacacatatatgatgtgtggggggaaaacgtcgcagcttcaaaaactaatctaaggatatccttataaaagtgctccactagtaacttgtattgtgcaacagtacattgaacgcaactaaagagtcgaaactgaaacaaatcagtgtgcgatacaaattaagttatgaaatagtaaaagcagtaacatattccccatgattaggacagaatcagtgtgcagctgaaattgaaacagaagataggaagtttgatgcaacagcttctcgactaaaccattaacccaagtaaaagatcgcccata

SEQ ID NO: 107487 - DNA, 1143 bp, Oryza sativa
atgcttctgcttgattgatgtcacatcagttaacttcatctcatgaaccccactgtagaagtaactgtgaaattgtttctccaaatcggccaaactattgataaaattgtatggcaaattagagaaccatgtgaaagccgatccagacaaagacaaaggaaacaacctaaccctcagagcatcattagccgatgcctcaccacattgagccaaaaatcggctgacatgttcataagtcgacacattatcttgtcctgagaacttggagaaatctgggaccttgtatcgatgtggcagtggaattcaagtccagtacgataatatcatgcaagtctaggttgcacaggcaaaaatgtacgataatatcatagccacactacgtggagctggtgcagctgaaggcacacatgccactgtctccgacgtgcaagcaactggcccatccacgacaagcggtgcaaactaggccgtgacggcagctaccgattccatcgaggcatgcaggtcaccaaggaggctgcaacgctcactgctgccacttaccgcatgtagccctcgaaggaggtaatccctttactgcaccataattttatacgcaactatcacaaagctctctgatgacacagcaaatgcattaccacgtgcattatcacattgtttaattaccttacatgcatttgttttttcagcacatgcatctatgtttatcttgtcaacattgcaattagtgggggtactctatatttataattattcctacatttattacatactaccagggacaccgaaagacaggcgacaccactaaggcggtcccccaggacagctacagcatcaccacctacaacaaagtcacttgttaccagccccaagagcactgatgaacacaaggataggagtacgtcgccaccaaaagctatgagaaggtcaccaaggtcctcgccggctagcaatgtgcacccatcatccccacagcaggcggacacgcaacaatcggggttggcattggaaaagggcacgcttgaatggcaaagccgacctgccatcagcgcaatgcaaggcatgcagaccgacggaggaacactgccataggaccaaggcggatgctcgattgatgcgactgcaggcattatacatgcaagt

SEQ ID NO: 107488 - DNA, 647 bp, Oryza sativa
tatgtttatttgggttggaaaatcaggacttgacaacaatttcttctgttccttttactggtcattttactgggctgaatatataagatggaatgcttagtggttattggtatttaacctgaaatggatgccttgagatgatcacagatggcggtcttgtaggttatccattgccctgtgatatgcatagatgtcaccgtgaaaggaatggagcaattcttagattaattatatggagtcttagcttcagtcatacatggtagatgcattcctgtcttaaatacattagaattggcatatagagcatcaacaggcatcaaagaggcctatgaaagttctttcaattcaagtacgaataaatagtatattataaagactaaaacttatttggaaccagcacagaatactattgtttgtaactttcctttggaataaagtatggctcatacagatcaataattcatctttccatcagtggcgcttgtcctttggaaagaattgctgataattcgatggaacgtattgatcttaagacaatcaggggtcataatattgtttctaactttatgtcaattgagaaaatgaatgcatcgggcagcacaagtgctgatatataatagatatgtgcatacacatgcttttacaca

SEQ ID NO: 107489 - DNA, 650 bp, Oryza sativa
tcatatatttatgaagcttagttatctataatgttctacacgtgttctaacattagtgaattactagtacaacatagaaatagatatcactgattgataacaattcgagcaacttaccatgtcttctaagtattaaaaaacatttttgcaaaatttaatgcatacatgtaagctttttatctgttgcgcactatttctataccttattattctacattgttatctattaaacctaaaaagaagtaatgacacatttcaccgggttaaattactaattgtttaacatatcagaacaaagtaaagtaaccaagcaagttagttctaacaatcacttagcaaaactatgagaagttgattaattaactaaaggaaaatagggtgtttgcacgtgtaatgctaacaatagcataactgttttgctttcataaaacaacgcatgtttttattacctgctaattgcatgagctgtagtgaattggtcaatctaccggtgtcagtgaactttcatcgatggtgtcattggctaaaaacaaatagcatcgtgtaggatttgcaaaagggcgtcggtgtcagctgacactggtaggaacaccgtagatccgcccctggtctcgactctccagcaatcagatgtgtctcgatcttgcatc

SEQ ID NO: 107490 - DNA, 843 bp, Oryza sativa
ctctttcctgaagttttgatggatggcgcagttagtattatattggcattgctctgggattattgaagcacaacaattagctggtaataggttttttttttccatctttgcaagaggaggcaactttcggggatggtgggacctctgaccagtgaccacatgtttggagcaaggcagtagtcgtttctttcgtgtttagtttccgatatgctaaccggacaggttttataacaagtgatatcagccgaaggtttcagcattaaatcaatcaacaatgtggaggaggaaatacgaattaatgtttttttgtgatgttaatacgaaggcttcggctaaggttgcttttgctgcggctgcatctgcgatcaaattaatgtttttttaaaatgatatttttcatgatgttcttcagtgtgtttcttaattagtcccgttcaattatttaataaacttgccaatgggaaactaaaattggggctacttgatggattacgcagggagtgcaacaattccctgtaaccaaaagaataaagtgggcacagtacagttcaagaacaggttcttctccacgaaaataattcggcaaggtaaggatacataggatgcaacagcaaagtttgttgtagtaaatttgtaagtttgttgtagcaccacaaatgatattttagttgtttagagattaattgcaatcctttttatgtttaggcttatcacctagagttgaaaaatctgggattgcaagaggcattgcaagggagaacttttgaaaaggaattgtgagtataaagaagagctcacaacaggtacagagttcttgcgttgcattaacatatgattttttta

SEQ ID NO: 107491 - DNA, 2125 bp, Oryza sativa
aagatctttagtcccggttggtgctaccaaccgggactaaagatcccgggggggcctgacaggtcctgacagcattcgaaccgggactaaagatgatatttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgaaaccaaataacatttacaaaaaataattttttggaatctaaaccctatactttacttcaaaaccagaaaaaaaacaacctgtacaatattcccccacaaaagtgtgaaccgttttctactgtctcattgcttatgcactacctgtttctggcaactgccaagtgtaatgttggatacttcactacttcagcgaggaatatacttttttttcgccttctctgttatccttatcagtcgtaggtaaaatttaaatttgaaaaattaattttttagagctgatcattgtaagagggtttgtttatttttcaacatatattggcttctgaatatgaataatacatgtataaaagttttactcataaatttttttattacttcatccattactaagccatggatcaaccaattagagacgatgatcttctttttattccttgtcttcgtcctatgtcttctttgtgtgagagaggggagaaggaatttgaaagtgctagcattatattgttccttcccaacaaattatatattctccctcagctcagtctctcctctctcctctctagattaattagcagtcccagtggcactacataaccagtactatatatacaataaccttgtgaacaggtttgcatatactccctccgtttctaaatatttgataccgttgactttttagcacatgtttgacattcgtcttattcaaaaacttttgtgatatatgtaaaactatatgtatgcatataagtatatttaacaatgaatcaaatgataggaaaagaattaataattacttaaattttttgaataagacgaacggtcaaacatatttaaaaaaatcaacggcgtcaaatatttagaaacggagcgagtatatacttgcatgcataaagacaaattacagttcataggtaggatcgagccaagcttctcctttcccatattctctccccctgcacaccccattcgtgcgagtatcatcagctcatttctatattcttctatgtccccccatcatccattcacttgtatataaaaacaattttattgatattaattaattatcaattagtatatatatatatatatatatatatatatatatatatattgccgtcatgcattgcatatactagctatatattactttgtatgcatgctgagtacgcatgcatctgaatatacccactaattaattaaataataaattactaatcaaactagccgctaagctagccatttagtttgaccatatagtttagttaactaggttgttattagctaggaaccattcgtgcaagcatggatatatgggtcatatatatgagaagatcgatctactagctagctagccaggccagccagtgaccggccggtcaatagtcattagtcgcaagcaaagggttttgtgggggccatcagcgatcaacgaacttttttgcagctcgatcggcacctttcatggaatgatgtctgaaaagttctgtagtccatatatataagaatatttttgataaaaattcactataagttactggggcagtttttgtttcagaatacccatcgagctggtgcatgcatgcacacaaacaattagggttaatttgatatatactccatccgttttacaatataaatccttctaacatttctcacattcatattgatgttaatggatctagacatatatatccatctagattcattaccatcaatataaatgtggaaaatgctacaacgacttacactgtgaaacggaggaagtacataaagttataaatgtgccaaactagaaagtgatattactattcataatatctactgagtgccactagagttttataaaattggaatcataacatcgccgt

SEQ ID NO: 107492 - DNA, 656 bp, Oryza sativa
ctatttatggagtttatggaatataagacagaaatgtccacgggaagggaccacatacaatatccggttccatagtgtagtggttagcactccagactttgaatctggcaacctgggttcaaatcccggtgggaccttcttttttttaggtatttcccataatcctcaaatcatgttttcaagttatccgattagtcatccttatcgctaccataacctcaatcaggaacttcgaagcaattagttcgatcagaaaacttattgtccgactaatcacgactagtccatcaaattagtcatggacgactagtctgttagggctaaaaattatgtgttgggctttacgcccagcccaggaaagcctgtagccctcatctaaccctaaccagccatctagatccaatcataagagagggaggggggaaagatggacttattgcaactaggacagataaatgatttaactttaagaccttgtcaagtgtgaactgtcaactgtgagagtctgattatccttagtttatactatactatactagtatactatggtaattactacttataaacatctatacattatcctgggtacccctagcctatagtcaccgactaatctacgactagtcacgactaacagcgattagtcgactagtcag

SEQ ID NO: 107493 - DNA, 843 bp, Oryza sativa
tagtattggggtttcagccaatctttctgatttagctacattattccctacatgtttgctttatatgctaaatctgccctttatattaagatcctattgcgctaaagtatattaggcttattgtttggtatattttgcttgtcttaatatcttaatatagggtagtatcggagtattagccgatacatgttagatctatttgatcggctatgctatgagtgtacatataatcttcatcttgaagtacttttaagcataagtgatttatacaatctcgactgactgttcgatctatcccaatcacttggtttaaatatatttcgagaaagatattatatatcattgatatctatagccgatcgagtagatttaactttattttgctttatccttcatagccaatctaacaccaataacatcggctcaatgattaatgatatgtcaacggcccttagccaatcggctatcgtttatagatttaaccttatttttcttgttttcttttcttgttgattgcaggatcaaatcaactggcacgtctttgaacccgaaagtaagatttaggacctgcactagagttaagtagatatcccaggcaagtgtgtgttttttgcatcaacagttcatcatcggtcaccgttgtcgttttgtgccttgtctcgttgtggtgaggattcctccctcgctgcccctcctcggcctctcggtgttgccaccgtacacgtcgtgccactgtcaaccccggtaccagtgtaatggtgttggcagtcgttcgtgcagttttcgtgtgcacgtgtggtgaccgttctcgtgtgcccgctcgatagctgcgtggtgtccatg

SEQ ID NO: 107494 - DNA, 906 bp, Oryza sativa
tgactgtcgacttcctacgacagcccgtcatgaccatacacgcgggactaaatacggaggagtacccaacccaggaaattaacttatgactatatacacgcgcgaaggaatacccgtattgagctatcaccatcagcgacccacctctcatccgcagcatatagccccaaataatgatatcccataatctagaccccacgtctaaactaccagatactactctaatatcatcgtcataacatagagtaattgcataagcaagcattatacccgcaccaaagcatctcacagataagctagtagtataaccagtataacatgaacataatgtaaagtaggcattcgtatactcgggaagtatttcaataccataaatgtataaagaagagtattctaaataaagtacaaagcttacaaaagagaagagaagagctactagagccatacccaaactcttccgaaggcttcccgactcccgatttctactctattcctattccactagcttaagaacaccaaactaacttgagagaatatgagagagctattgcttgaggtgtgtgagtgaagtgagaaggtgaggggtttatatagcctcccaataacggttgtgatggttggaatggtcggaaataccctccaaccatcattgggagctaatccacactgtccagccgcaaccctgcatccttcggcgctaggggggttcggccgaaccccctggtttggccgaaccaggggccgacccaacctggcacaaattcggtaggtggcctcctccgttgttcttcttcgcagacttgtgaattttgacccaattcatcatgtcaattttgagttcttgacccattcatacataagtgtgggtcttggcatcgaccgattgatttatcatctaagttgatg

SEQ ID NO: 107495 - DNA, 544 bp, Oryza sativa
actccagggtgaaatgctataatgtaatatccatccgcttgcggattccttttgtaaaccatatatataccaggaccatttctagcatcattactgggaatttatttttctagtaatgtcgttaagaaataccaacaagctataggcccaggtcgcacagccgactgccgtcttcggcctccatatagtcctgtggccgtatggcagagccgatcttccccatcaaatctagccaaatcttttttgatctctcaaaatttgttgagggcttttgatccactcgatctcctctttccctttttcccgaaattggaacgaatccgcaaaattcgggatagaaatggctggacggccatcatcagcaactgagattaaatctagttaattaaaactaaattgaaaggggaaatcatgagacaaatgaagagggaggaatggggaatcaatttttgcaatcaaacggaggagaaaacgcatggggagatagatcgaagtggcaacagtgctaggttttggtctgacggcggcatgcaatgcataggat

SEQ ID NO: 107496 - DNA, 1120 bp, Oryza sativa
gtaataaaagcagcatttaaataaatcatattttgaatgagtaaaaacagtatgtaattaagcagtattaaatcatcactgtccaacgctaaatccacgttgcaacaggcccaaccaaaaccacttgaactacaccagttctttaaggcaaattattatagtgagactgatcactgtgagctggttgaccgcccaataaccgcgggcacagctattcgaatagttttaactttgatcagaggtgtacaactttacccgcaagacaagattccacacatgttaccatgccccgaagtaccgccacgattctgcaaagggggaaatcgtggcaaaacctgtcatataactctccataaccgaacataccctcaggtttcaccccctccttgtgccaagtcgggcagtcccttcttgtgcctaggtaaatccagctacaacagagaccaatatccaggtcccaactgcaccaacgcctctacccttgccatggtatgtcagctaggttaagttatactctagatttagcctagagtccatgctggcgtgtggtaagtacgagtatatcttccaaggattcctgagaaccggtccttaattatcatggacataacttcaaaaatcatgcatgtacacgcaacccaccattaaagcatattttagtttaattaaaccataaccatggtggtacatcataatataataaaggaataaaattataatgaatcccattgtgagctaattgaactaagcatggctaagcattcctaaaccaatcatctagtcaattataacccaagttatcaatggcataagatattcaacaggttgagtacaataggcatccatcccacatgacattctaaaacaatgcagtttaatgaaaagcaggggattttgtaaaataggtgcaacatgatctatgatgtatgtatgacttgccttgctcttgagctgactggacctcgcgagcacttcgaaataaactggatcaccagaactgacgggatctaaacgacaaacaaagcgcacaggaaatacaccttattaggcttctggaacagcaaatgaaaccaattctaatggattctatacattttaaccgattcgatgcaacttggat

SEQ ID NO: 107497 - DNA, 905 bp, Oryza sativa
cctgcaggcatgcaagcttgggggggttttgttgacggtcgttattgatcagtttcaaccgtcaatattactaaaacaggagagaactagtgatgcttgcaatgcataaatatgatagaataataatattccagataatgattcgccccaggcgaccggcgcgggagagccggatcgggcgctccccccgcccgcgccctccccgacgtgattacctggtgtgcccacccacttctccctcatatttttacacaaaagatgttcacctaatgtacttacaatgtttcactatgtatagatcaaatgttgcagtgaattaaaatattctattgcaacaaaaaacccacatattttagaaactctctattaagggaatttagtttattttttgttccataaaaaatgtttcatctaatgtacttacaatgtttcactatgtatagatctaatgttacagtgaacgaaacattccattgcaacaaaaaatccacatgttttggaaaccccctattaagggaattttgtttattttttgttccactgaaaaatgtttcacctagtgtactcacaatgtttatgtatagatctaatgttgcagtgaactgaaacaatctatcgctatttgctgaaacattttttttatataaggtgaaacaacactcgatttaaacgagtgaaacattttcgatctacttagtgaaacaattccgatatacctggtggaacatcgtgcaacatttaaaaataattcaataataagctattttttttcgtcggaatatatccatgtgtggtcttgttttcaagatttaattgcaacgaatttgatggtgcaatcggatcatgatttggataaataatttaagagaaaaatcagtttaaagcagtttttgcacgtaaatcgg

SEQ ID NO: 107498 - DNA, 740 bp, Oryza sativa
agcatctttctccctccttgtgacaagtgtccccggcggttatttcaggtagaaccgatcacaaccgccatggtatgtggataacttccagctgatgaagaactgggctgatcgggctggctactggttcggccgaaccaaccctggccgagcccaatcagccaaccatttggcatgtgtgtctcccagtggctcctcagcttagtggtatgaattatgggcttgtttgctcatgttaatcctgtattaccagcccaactatccaaaagtctgcttctcgatagcgtatgattgatcgttcatctattttttgtcgattctcctccatttatatgtgcttctcctgtatacatgttagtagcatagtatatagtggaagtagatgtgttatttggaatttatgcattgcaagcatagctagtcttcatatattgggtaacattgacggtcgaaacaggccgataacgaccatcaataccaatgacggttgtgacggttggacaggtcggtaatacccaccaaccgtcattggggagccatctcagccgtccagaagaaaccttgatcgaacggcgctgcgaggggttcggccaaaccatgggtcgggccggcctggcccaaaatcggtaagtggcctcctccgttgctctcctacgcagacttgtgaattttggcctaattggtcatgtcaattctgagttcttggcttattcatagtataagtctgattctcgacatcg

SEQ ID NO: 107499 - DNA, 765 bp, Oryza sativa
ttataaatgctctatatatatgctttattgacttgttattcctcaaatagctttaattgctcattgtgaaatagagaataaaaatatgaaaaaaatgaataccgaatccttggaaacaggtcttgacgataagaacgtattcgatgtgagcaaaataatgggtgtcgaatccttggaaacagtcttgacgacacggacgtacccggaataaaagagaaaaaaaatatgagcaaaaaggctcaagataagaaaagtccaaaaaattctcttggttattttgtgctcaaggttatttgagaaagagtgataaatgcaatatgaatttttgattgttgattcaagcttaattgtaaaatttttgtttcatggttatactttaatgcatgcttgttatattatagatgggtttatcttctttttattgcaacacatgacttgatatgctatatgtatgctaagctcttgaacattaatgagcataattcctatgcttgatgaaatcattgtcaaaagggggagaaataattgtaaaaatttttggagaagcaaggtgaatttttgaggagttgttgagaagagcatgtttttaattcaattgggaatttctttcttttaaaagggggacaagttttcttttggatttttgagcacgatgtgtacatttgtatgaagtgtgctttttaccactttcgtttttatttttccaaacaccaaaacattttttataagtttgccaatgtgttcatcaagggggagattgtgaaa

SEQ ID NO: 107500 - DNA, 832 bp, Oryza sativa
tcgtcaaagtcactctcctcatcatccgagtcgtcatcatcatcgtcgtcgtcatcgtcttcttgagcaaactcagtcgcagatgccgctgccagatccaagtcagcaaagacctgagtgttgtcaagccctatgataacatgctacacccatgaaccatcatccaaaacaagaattcagtatacaccgaagataaaaattcagaaccaagaacgaaaaccggggaaaaaaaagggcgtaatcgtcaccgcagtcttgtcgtctcccatgatgctctccaggagggcgtcgtcgttgtcgacctcgaagtaaatatctgatgagagcagattgccacacatcacagcatgcagcttcaagaacaaaattaacagtgtctccagcaaaagtcacagagaaggagctaagctaagctagctagctgcatcaaagcatcagctcaagcatccggttttctcgcatacctccgttctcatcggtgaggtaggggaactccggcaggatgatcctctcgtgcacgccctcgtcgatcagcgtcgagatcatcaccgtcgccttgctgttcacctgcattttgttccactgatttcttggtgaaagcttgaagaagagtgatggttggttgtcaccaggcaatggccgtccggccggttgcgttgtgtaacaaaaactctgctttcttctaatacattgacgcgcaatctttttgcgcgttcacgaaaatgaagagagtgatggaagaattttatgaaaaaattttcagataattttgtgttatgtgtagacctcgacgatggttcgtgcggactcggcgtcagtgaggtgggcgggc

SEQ ID NO: 107501 - DNA, 659 bp, Oryza sativa
tgtctatttttaaaaaaacttttatatatgtgttctcgttgacttaaaagccaatactgaaaaaaaaactgcgttgaaaatatcttaaaattaatatcaaaattaaatttgaaaatttaaattttgactttttctttggctgaataggtaatccgatgggagcctagatctcttgccaagataaaaggccggactactatgtatagcgtttttttattaagaacaagcctacgtataggtaatcgacagtacggtagcctgtggcagagatgcaaatggaccgacctgcgaagctacttatttattttttatatatattaaataaaaggtaatccgtggacttgtcgcgtcgtagaaaaacaagtgggtcaacccataaacctatttataaattaaattagtagttaacctacgggttactcactaatttaatctataagcggtttcgcaggttagtccgcttgcatcgctagctgtggctatgcctaggagttaacgttttcgtatcacgctagctgatcgagtcatggtagaagtggcgtaggagcatgcgcgcgtagaagcatcatcacacatacatacgaatacgggaactggcgaactgcgaccaccctgagtgggtagaggcctcttttggacttagagtatcaccaacaatt

SEQ ID NO: 107502 - DNA, 595 bp, Oryza sativa
gagctcggtacccctgatacttaattaatcatgcactaataactcactctactcactctattttacgtgtgcgggagaaaagttttcaaccgaagctaccagacacagccttagggtgtgttcgtaatatggggttgggactcatctcctcgcacggaaaacggagcaatccattagcacgtgattaactaagtattagctattttttaaaaaaaaggatcaatttgatttttttaaacaactttcgtatataaactttttataaaaaatacaccgtttagtagtttaaaaagcgtgcgcgcggaatacgagagaggagatgggaaccccctcgtccgaacgcagccttaaactagttattggaagctatttaatttgttaagtttatttatcaaaatatttcatttacttatataattaagtatataattcgttagtaatccctttaataatctatttcaaggtgaggccgttttgacactgtcctaggggtttagctttttggcttttgcttttctcttaaattcctgaagttagccaatgccagccgctagctaagctcccggagccaaaacgattgctcatgtcgatcgcc

SEQ ID NO: 107503 - DNA, 736 bp, Oryza sativa
aataccaattcaaaccggtccttaaagtttgcatgtgtcagctaacggtgccctgacgctagctgccacactctagcatgtgcagtgttctcacaaattcagtcacaaattcaatgcgtacagccaggctctggaattggataccccccacatatacgtacgtacatacacatacgcaatacagtacgtacgtgtacgacagatcagtgccgtccgtttaggtacaaatacatttgcatcatacgtacacagactgtatttaatttactcctctccggatcagatgttaggtatatgtagctagtagcaatacgtactcgtgtacgacccatatgtacgtacatcaacttgcatcgcaaaatggagatgggccagtaataatttgaagtacgcaccggtactaaagttgaaagaacaaattctgttcagtctggaaattaaaaatcaaaatcgatcttagatacgtatagtacgagataggaaaagtctctggatcgatcgaattgtccgataaaagctaggcaaaggtatcgattgatcgttggatccaacgaactggtttagtaacattctttcttttttcggatggtactcttaattaattcgaattttctgtgtctgaattattctgcttttgctacgacaaaaggatcgaataattgagaccgaaatcgatcgatcgatcgatcgaacgaacatggcgtgagacgcagatcgcactaggaagaggaggaga

SEQ ID NO: 107504 - DNA, 955 bp, Oryza sativa
tgtgtcatggtattactatgctgttatctcaatagcttctcagcttcatctctaatggtttgatcatccatatcactagataagcacatgcgtttcgattaggggaaaatggtgggcagtgagatgaatcaatagattctcaaaacaccactctactggccaaagaaagtgctcagtaaatcatgtacttaatccccctgtcttctggaataccactggtatctggtggcaaatgcaaccagccacattgaccttagtgatactactgctgacttgtagcacgtgtaagcaatgttcaaaggatcgtcgcccaacatgtcatggtaatagtagccagtgagcacagcgtgcacaggtgcacccagggcatgcatcattgctttgatctcctgacttcaatcataatcgtacggaatggctaaaatctacgagactatggcatgctaaaagaaagtgaacggaagttctgaatagattgaattcattggataaatctttaggagttctccaaatggtacctacgcatcatctagactacccaatcagctcctatcgcccgcatcaacttcaagactacgcaacaaataaaagaaaccagagatttctccattatactaactgatggtttaacgaagtactgcacttactaacattaagtgtgctaatagcatagcacgctagatatttatatttataataatcagctaaaccatctatccaaagatgatagatcgaacaacagccagaagcagaatcaaagtttcatttccattaaacaagtctgtattacagtacatcgcccaacaaaattactgtaataataatcagattagcatctctctctctctctcattttttttaggtgtccttcctacacaataatcctacttactaaacacaacacaaggaaggatacgaagaggagaataacaaaattaaagacgggggggggggg

SEQ ID NO: 107505 - DNA, 925 bp, Oryza sativa
atcatattagaacgtaccagcttgaattgaaacctaaaattttagaggctatgtacggtggttgcttagcacgttcctgcataattaaggctgggttcggcacctatacttctcaacttaccttccttgtttttcacgcacacgttcttaaactaccaaacgatatgtttttttaaaatattttataggaaagttgattttaaaaatcatattatttttttataaaaaaaatagccgagtcgctccattttacgtatgcgagagattagctcccaacatcttgtaaagaacactgcctaaatacatctcaatctcaaatggagcctagaccctagagctattgcacatgaccatggtgtctccttttcttacctagcatacaatgcaagtaatcgcatatgcacaactaaagccaacatcttttgcttcatctcttctccttcatcttcctccttcgtctaattctccattatataatttccttttagtaatccgtcctaaactgatcctaatctatctcctccagattaattaatggctatagctatatatacctacgcaactagctcaacatgatcaccaactagccaatcacatcacaagaacacaaagaacactaacaatggacatcacggtggccggcggcgccggcgacggcggcgagaggcggacgtgggtggtggaggtggagaggacgctgcacgacgcgcccgacgcggcggcggaggcgtcgcggtggcggccccactgcatctaccgcgtcccggcgtgcatcaaggacctcaagccgaaggcctaccagccgcaggtggtgtcgctcggcccctttcaccacggcgaccccgggctggcccccatggaggagcacaagcgccgcgccctgcgccacctcctccgccgcgcggcgcgcccgctggccaacttc

SEQ ID NO: 107506 - DNA, 621 bp, Oryza sativa
ggcttggatccatagcgacaatgccatcgacaacatggagagtagggacgaagaacccatgatttggggaaagtgatcgccggtgggtgggcgagaggttatatgaaattattttgcatctgtttagaataggtagctctagcaataattgtacattaaaataaaatgaggtctagtgtaaaaaaattgaaagagtatactattttatatatagagagagagtgtccttggctcatagctgagagaacctcttcttattactgtgtggtgttagaaccatgagtgcttcttcatgagttggtgcaattacgacgtacggtgtatattttagttggtgcaaaggttaggagttatatttcctctaatttcatatataccgtcattttgaacataatcgtaattaccgaggagttaaataactttgaactcaacgtttatcttacattggaaatcaaattaagcaacaataactacaggggtaaacttatctaatgcgcttgcaatctcttttaagagcaagtttaatagtagactataagcaaacaataaacttatgtaaatgagagaaaattcaaaaaatgagaagaattgtctctcaaataagagctattcacacacttt

SEQ ID NO: 107507 - DNA, 718 bp, Oryza sativa
actttcttaggcacctgctttggttgcagaagggagtgttcaagcacttgctcttgccgatgcacttttgaggtcaatctattgaattgtttgtggtacttttctttgagtttttaagttgcacgtttcaatgtttcaaatgatgctattctatagttcagttcactttattacctgttgtgatcctgatgagttttatcctcaacacagatgtgtagccttttctagtgatgattgggagattgcagattcaaccttgcaattttggtaataatgtctatgtctttgctttgtttcattttcatgaatcacaagctcttcttctgattaattacaagtattagtttttcggaaacatattattcccgtattattttctttatgtttgtgttgcgatgtattcctgcatcttgtctatgtggaaatttaggatggctgggttgctgatgagcatattccgtaaccttgtggtcgtgtggggggtttagaaggtctaggagtatcacaagatttttggtgttcgactggaatctacgtacaaactttctcaaaggacttgtgattaccatacttcaggaccggatttaataaaaacactgtaacctgatatgcctatggtccttctagctatgtctgactttgtttttcttgtcatggtcccctcattgcaatctcattgagagttaaaacacatgcttttacatatatttttggatca

SEQ ID NO: 107508 - DNA, 1016 bp, Oryza sativa
aaagaacctatcataataggcaactttctttattttaaacatcttacatttataaatattgtttgttaaagtagtatctcgaagaccatgtagaagtcctagaaaagcttatattttgaaacggagggattatacaataagctctctgagttctactactagtaaaaaaattattcaactattcagatgatagtataaataaatactacttcgtacctctgtttttaatatatggcaccattaattttttatatcatgttttattttaaaattttactccatctgtcccaaaaatataagcattttggactctgacacggtctccgagatgctaatttgaccaacaatatctagaaaagtaagaggttttaaataaaaagagttacatattgtgatagtttgttaataataaatctagtaacatcaattttacaggataaatcttttttattctttcgttattaatagtcaaagttaataatgtttgacttgtcactatgctaaaaatgtttatattttgggacggagggagtaagtaatatcttttcttttgttgtggcttgatttatcactaaaggaattttaagcaatactaatacttatatttttaaaattcgcacaaaactttgaataagacattaagacgaatgatcaaaattgtaccaaaagttaacatagtcatatattaaagggttaattagatctatgccattaaaattttactggttttgaaatatatcattgctatttgcgtatttgtaacgatgccattgatacttgtttgaaattttagtggtgccattaagatacgtatttgcatgtattggaagaaaataccctcatcttctacctctctcttctcttatcttccttcccggtgcttcttgctccaccggccgccgttgcagctgccactcgccgtcgcgccaccgcttgccgctgctgccgctgcttgccgccaggcggctccgccaagtacatcctccagttggagcacgactaccctgggacgacga

SEQ ID NO: 107509 - DNA, 613 bp, Oryza sativa
tgtaacaaaccttatccagaaagtagctgaaaaggcatccatgactttgcaggggaaaaacactaacttgacatgattgcatgcctgcaggtcgactctacaatccccaagcattatttttctttgcatatactttatcttctcaggggaataaatttctttaaattaaaaaaccaacaggcccaataggacattatcctttttgctgaaatgaatgagcagtatgcattcattgtttcccctttatgcaactggctaatttactaacattccatgacaaaaaaacaaatgctctaagaaaaaaggtgttcaattgataaagaaaaaaatatatacataaaggtggatagatatcctcacatgacatatatgacatcgcagcaagtgctgctcctcggtgcattgctgtagagcatatagctgccttttgaaatgacaactcaagcagggagccagatgcgacaatagcttcctgatgatatatgcaatcaacacagataactactatcagactcactatccatatcatgcagcagcaatgaaccaaaacaccttaacatataagacacaataaattcacctttgggcagcagcgaataaatgtggatgtaaa

SEQ ID NO: 107510 - DNA, 3217 bp, Oryza sativa
aacactgaccaattatgcgtattccaaactgattgtatttctagtactagagtatgaatgtctctttgactccatctcctctagagctacagcccagctaaataattttttgctcaacataaaatagaaacgaaatttggtgcagcgttctcacgtaatgaactagagatgtggagttgggtgtaggctgcttaacaaccccacttaagacccaactccttaaactaaatttaggagttatgactctaccaaacaggccttaaacatcttaattccgaccaaatttctgcattccaaacactccgaggatcggcattgttagcctgcttattcgagcaaatattgaattatagagggaaactatttatttgaattttgcggtgccctaatttttgataaactatttatatcttgcaattactaaactaaaatacctttgagattttgacgaaatcataacagacgccttactatgacagacaggtacattacatatcataaaaaaaaataacatcaaatattagtacgtacatcaagtttagaacatgaacttaaatggtgtaccgaagtaggtacagaattaaaggtcgttttggtttgatgccctgtggaaaattcagataataccaattcaaaccggtccttaaagtttgcatgtgtcagctaacggtgccctgacgctagctgccacactctagcatgtgcagtgttctcacaaattcagtcacaaattcaatgcgtacagccaggctctggaattggataccccccacatatacgtacgtacatacacatacgcaatacagtacgtacgtgtacgacagatcagtgccgtccgtttaggtacaaatacatttgcatcatacgtacacagactgtatttaatttactcctctccggatcagatgttaggtatatgtagctagtagcaatacgtactcgtgtacgacccatatgtacgtacatcaacttgcatcgcaaaatggagatgggccagtaataatttgaagtacgcaccggtactaaagttgaaagaacaaattctggtcagtctggaaattaaaaatcaaaatcgattttagatacgtatagtacgagataggaaaagtctctggatcgatcgaattgtccgataaaagctaggcaaaggtatcgattgatcgttggatccaacgaactggtttagtaacattctttcttttttcggatggtactcttaattaattcgaattttctgtgtctgaattattctgcttttgctacgacaaaaggatcgaataattgagaccgaaatcgatcgatcgatcgatcgaacgaacatggcgtgagacgcagatcgcactaggaagaggaggagaaaaaatgtgtggcaaatggagtgagtaattgagtggttttgctgcatgattaagcagaggaagaatggtttgatctctgaaggggacgcatgctcgaatggatgatcctttttctggctgctgcgcctttttttggctcctttatttgttcatagagtatttcttttgttcgtgcatgtatgatgatactactacatggatgtctgtgagctttgcttctttggttgttcatgactgcttttgcttgctcccttttgattcccaaggagagggcactaggagtttaataggagtacatcataaagtgtttctgatgataaaaagaaacccaactgaaataatttaaaaagattacaactatcaaaaaattttagaacacaagaattttacaggatcacagtacaattaaatccaaaaataacaaataaaaaatcctctaaatttccttttccaaagaaggcctgtataatttgcacgatgaattgatcgagatatataatcaaaggagcttttgcaaggccctaccaccgagcaactactacaccctacatttcgcaagttaagccatagttgaactatgatgagattactgagatgggcccagatcaaaatgtgtctccaggcccggagaagcaatcaagcaaatgcaaaaagcccaaattaatcatcatgtccctagctggaatataattaatcaatgccaattaatcttccccgtttgatccctcctattcagctcgattcgatcgattgggttcacgacctacccgtatacaatcatgtggggccgtgcttgcacgctctgtctcctcttctttttcgtgggccccacctgtacgtgagtgagtaactgtatgcgcgtgaagaaatcgagattttgtctcacaaaaaaaaaagggaaacggatttcgacatgcggacaatatggcgaaattggcccaccaaaagttcggcccgctaaaatggagcccagtttggcacctcagatatgggctgatttgaccttggggaactgggccgtacgcgatgtaacatgtctgcagtggcccatcaaagcccggcctgctatagtctcgtgatcagggctggtgatgtggcccattttctttctgagaaaagtgatgtgggttgggatccagtttctggtgggccagactgggccgtatgatggttgggctggttcagatgccgttgtgggctgcctcgttaaggaataagttcactttaaatccctcgtgttcaaagagtttaagttgaatcctcgaaccacaataccagacattacacatctctcaacttgtaaaaccgatgtacccgaatacaccggttttgtaagttgagagacatgttatatatggtattatggtttgggaacgaaatccaaactcggcgtcaagacgagggacccaaaatggacttaccccctcgttaaccatgggaggcgtgcaacgtggcgccatggctacggaagtaacggagctcgcttggccaaggtgacgatatgtcatcagagcctggcgtgcatcagacccgatgaagtcattgaaccgagcattgaggcactggttgaaccatggtttaaggttatgtacatttaatactcccttcatcccgtaaaaagtttatttttagctctttccatttgttccaaattaagttcttttttaagtaatcattgcgtcggagtttatgaaagtaaggaataattgtaaatgggagtagataaagtgggaaataattgtattgggatttaataaagtatgggtattttttgtctttttggttttggattggtatgtataggatgagtaaaaaataagcttgttttgggacaaaggaagtattttcttaataatgga

SEQ ID NO: 107511 - DNA, 1483 bp, Oryza sativa
gatccttggagcaaaccgagccggtgaggggagctggtttggttttttcgattgaaccaccggtccggtaagattattttatatctggtccttgccatatgtttaaatcctactttatatattgaagtgcctgaatgttccaagtagaaatagaattgtcgccggccggacatgtgtatatacgggttattggtctttgtaaacagttgcaagacttcaatgtaggactatgtggataaaaagtcaaaagacttgattgagaaatactccattttatattataagttgttttttatttttttttcctagttaaacttttttcactttggtcaagtttatagaaaaatataacaacatttccaacacaaaacaatcatattatgaaaatatattcaacatcactaattttgtattgttcatgttgctaaacttttctataaatttcatcaaacctacaaaagtttgactaataaaaaagtgaaggtgacttataatataaaatagagaagtactatatatctacaacaacaaagaaacccatttatgcatactagaaagataaatatatggtataattaattatatgagcgataatatgactttgtgtgacagtttctttgtaccaataaatatactaaatgagagttctaaccatatatagggacatatctatacgatactctctttggttttttatatagacatcgaacatatgtttgattacacatcgatcttattcaaaaaagtttatgtaaatatgaaaaatttaaatcatacttacaacatcattaacgagaaaataaatcacaacaaaataaatgataattacataatttgttaataagctaggttaatagtcaaacatatataaataaaaacaataacgtcttacatcaaaattcagaggaagtactacacacatatcaatactacttctcttgtggaaatgccattgccgtagacaatgaatcacgtgatccacgtgcctgcaggacgatgttccttcctttgggcacaaacctagcaatttttttttgttacatacaaattaattaattaaatgtgatactatacctcccctaaactctactccatcttttgcacacgatctcaattgattattgtagctagggtatgcaacattcccaacgatggagaaattgaaggccacagcccacaacattccacgagatcacactgcacatattcctggcttcatcagagcaagctatccaggccagcttagctgcatatgcatgagccggtgtaggccattgtcctatggtatctcgacctctttacgtaaagcctttcttcagaacttgtgatcgaccgtccgtcttgcagctgtaaagaggaaaaacagatcatcaacaaacacaatcagtttgaccataacgtacaccacccatttatcacagtaattcttcttaacattcaccagctttaccttgtttgtactacttcctccgtttcacaatgt

SEQ ID NO: 107512 - DNA, 1346 bp, Oryza sativa
taagttatgggcatgcagtcggtacatgggctaaagtggtccatctaagcttaactatcttttcgtgtggtttcaggatggatctgctatatgtcataaaatatttaagggctcaaattatatttttctacaatatatgttggtatagcaaattagaacaaaagaacatatcattaagttatcattcttgaatttcgttgtaatgcatgagtatttagctagcaagctgtacctgcataaggatatatatatatatatatatatatatatatatatatatatatatatatatatatatatatttgaaattgtggggagccaaagcccacttgagcactgaacacacttagcccactaggaataaaacaccatgcccccctattcccttgtccatgctgtttgatcagctctacgtactctctcggtaaaaaaaaagaaagaaagaaaaatcaattctaaatacaaatctaaatgtagtttatatttagattcatagctataagttagtttgtttatggaggatgtagatacttggaaatttcaatgtattaggactacaaaactttttacaatttaaaggaggaaattcccatcatatatatttttttattgtgtttagctcgttgtacctcatgattaaattagccttgtactcacatcaaaaggaaaaagggtatcaaataagaaaaaactaaagaaaaatcatattttgtaagaccagtactactctactaactcttcatgtacaattaatgggtttgagagttttgcacaaaatgctaccatcgtaattcacacttcacacaatgttccacctttcaagaactacggacgtactccctccgtcccacaaaaaaagaaaaaacctggtttccgtgtccaacgtttgaccgtccgtcttatttgaaaaaattatgaaaaaaataaaagacaagtcacgcataaaatattaatcatattttatcatctaacaacaatgaaaatacaaattataaaaaaatttcatataagacggacagttaaagttggacatgaaaacctatagtttgtctttttttggatggagggagtaatcctctattagtttctcatcaatactagtagtacgtactaccgctagtccgctactagctaaccgtgcctctggccttttaagcaatactccataagcaaggatcattaatacagaacatcacatatgtattgcctcatatgtaccggttcagaatttctagccatacaattggtcaaagttgagattctttagaaaaaaaactgatacatacaatggtgccactcatatatgtatttctaaggggatcctctagagtcgacgtgcaggcatg

SEQ ID NO: 107513 - DNA, 795 bp, Oryza sativa
ctatactcttcttccaatattatttattttatttctgaatttttattatttttaattgtatttctatgtggactctaaacacatctttcaatattctttaatttttaatttgaaattttagttacttctaaattgtattgctatattgactttaaactcttcttcccatgttttcttaatttcgaattttagttatttgtaaattgtatttttatacagattctaaattctacttttaattttattatgtttattccaaattttagttagttttaaatttctatatggactatgtactctacttctaatattccttattttttaattccgaatttcttatttttgttaattgtatttcgattctatactctacttctaatattgcttatttttaattgtaaatttgagttattttctaattgtatttctgtatcgactctatactctacttctaatattccttatttttaattccaaatttcatttatttcctaattgtatttccatatggattctagtcccctcttctaatattccttattttttaattccgaatttcagttatttcggtatttcctaattgtatttctatatggactctagtctcctcttctaatatttattattttttaatttcgaatttcatctatttctaatttgtatttctatatggactctattttttctttttctccgattaatatgagaatttctaggctatgagagtgaacgtggagactcctttttctattcttttaataatataatagattggctgaacagatttatggcaga

SEQ ID NO: 107514 - DNA, 663 bp, Oryza sativa
aggatccccaaagagaggagaggaaaagtcaaaaggataaggttggggtgaaaaaaatggtggatttttttaatgtaaaaatcaatttttattttacatgtggctctttaaaacgaatttaaaggcactaaatcaactcatatgaaaaagttgttaaaaataaagttgtataaattattgaaatatatcatttttattttggtcatttctccatccgagtttgattaaactatataaaatttgaatttaaaaatataagaaattcaaataatttttcgggtagtaaatgatttcaaatgaaaaaattgtcaacaacaaagttgtataacgcatcaatatctacaacttttgttttggtcatttttctatatgactttgttttaaccgtttgaatttaaattttaaaatatgacaacttcaaacaatattttgaaatactaaatgatttcaactgaaaaaagtttcaattccaaaagtcatcaacaaaaaagttgtataactcatcaagatctataacctttattttggtcatttcttcatccgacatagtgatagtaacattgtttataaaatttatatctatatcatttggttctataaactataaaagagatcggtaaactttgtaaacaatactactatcactttattggacgaagaaat

SEQ ID NO: 107515 - DNA, 1159 bp, Oryza sativa
acaaaattatcatccataccctatgtcctctaatataacgcacatatgcaggtgattttttaccaggaatttagtgagattaagcggatgtgctgtcggtttccgtctcttaaagtatgtgttaggggactattcgcgagagtgtgagtgtggtgttgcgtgtgtagtgatctaacgtgcaatcttaaaaataaagctcactaatgtattttgcctaattatcttactattttctcatgaacttttaagaagatttggatgggatttaggagctagactgcctagacttggctccgtcctgtttatagacatttggatttgaacactaataatggtgtcactagtctatcatatcaattatgtctcctcgctttttttttccctttcaattataagttagtatatacacgcctaagggtctgtttggaaaatggttaagaggggtgggattgggatagggacagagataaggatatgagtgaagggttagaatgaaacaatatatatgaagaatggatggctaggattaaaaagttgcctttcagaaggtgggataatatttccctatccattatcaaacagagtctaaaatctcatgctatattcggctataaatatttgatgtttaaaataagatttatttataaacttttgaattctaacaagcaataattctgaagtaatgagtttcttttttaaaaaacagtatacatatatttgcctcgaaactactacattatatcgtagacttattatttttataaacatattctagtacgaggactagagtttttaaagtttgacgtattaaatttttgtgtatttatgagtagagagaaatacttaattacaaattactctccctccatacccaatctacgacaattcaaatattttcagctagtcaggtgcttaagaggagaattcatgcaattcaaaattttaaaactgaccaataagatggctaaaaggaattgttttcgcataacctttatctttgcaaaacaacctatagatgtttacattgaaacagagtaagtaagtaatgtatattacacatgttaacaatttgattttatctagataatggatagaattatgtcttctatatccatacatggatatatacaaccaggtaacgatttgatttttaatggat

SEQ ID NO: 107516 - DNA, 745 bp, Oryza sativa
ggtaggcaaatgatcataaaaaaaaggatgcatcatatagttttgtttaatcccttttgctcttattttagttttgatgattatatttccttttctttattacaagttctttgcatggtgctttcttcattctcaaataccagtactacatctgtcccaaaataaacgtaaccatgcatgagtttccgtgtccaactttgatcgctccgtcttatttgattttttaagattagttttattagtattatcattattattagattataaaacattaatagtactttatgcttgacttatattttttattttttttaaaattaaataagacgaacaattaaagttggatatggaaactcatggccacgcttattttaggatggagggagtaacatataagaaggttggacatatcctcctactggtacttaagggataagtccaattcaatcttaagttaattgctctctccggtttcattttaattgacgttttggacaataacacggtctacaagatatatctttgaccttattttactattataatatatataataaataaataaatttttactttattatagtgctttaaaatacaaatccacatatgttgtttttatttctttaaactaaatatttttaaagttattgatgttcaaagttataaaagtttgatcttaaccttatacaaaacgtcaattaatatatgcaaagctgaatgatgcgatcaatcatcaatccatcaa

SEQ ID NO: 107517 - DNA, 1473 bp, Oryza sativa
aagaaggttggacatatcctcctactggtacttaagggataagtccaattcaatcttaagttaattgctctctccggtttcattttaattgacgttttggacaataacacggtctacaagatatatctttgaccttattttactattataatatatataataaataaataaatttttactttattatagtgctttaaaatacaaatccacatatgttgtttttatttctttaaactaaatatttttaaagttattgatgttcaaagttataaaagtttgatcttaaccttatacaaaacgtcaattaatatatgcaaagctgaatgatgcgatcaatcatcaatccatcaatcaattaatggtcctagatctacacaaacatacatgtcgtgcatcatcattgccctgttcttttcacattgttttcccaaagacgaaatttggtgggcattttgatgcctgcctgcctagctaggtaggagtaattcatcatcatcatcgttgtcgttgccacgattgttcgtttctctccgccggtctttttatcttctttacctgactactctcttttagttttctccatccttttgacgttttcgtgtttgacgatcttgtcacgcttgtgtttgagacgtgtgaatccactcaattaaccaaatatatgcatctacatgcactgacaaaccacacacatacgatatgatagcaacctgcacattgcaaaggtggcgacatgtgcattattattactaattaatcgtcttcgtcgatcgtgtgcgtgaccacttaatttgcatcgcatgcagctagcaccgtctctttcgttgatgttacaatcaatcgatcgatttctaggctggctggattgatggatggctgctcatcttggtctaatttccaaagctagtgtgtgcgtgttgttcccgtcagaattaagcttcagttttctcgccttttgcaaatgtgtgcaagtgacatggagacgttgatgcctatgaatgtgattgcatgctttgcccatatgtggtttggcaggtgatgatgaggacagtggacgagtagtgtgctttggccatttggacaagtctggttaattatgggtggatatagatagatagatatcacatgtgatgggaataatgttgatactgttggctggcctgaacaactgggaacattatttcattggaggtgatgagtgttttacactttagtgcttggttaattagtatagtgatagatatatatgtagatcttgatatagaagagattccattaattcaagttaaattcacatgtagtggtcgtgtatatctgtagtactcatttcgtcccaaaatatatatgctatttctagtgttaaaagtttataaaaagattggctatttcttcacttatttttttcatgtcaacgagtcacaatcacatctcccgtatttactctaggggtaccgagctcgaattcgccctata

SEQ ID NO: 107518 - DNA, 1414 bp, Oryza sativa
aaaaaaaatcaacggcgtcaaacatttagggaaggcggcgacagcaactatcccctcctggatccacgctgatccggcggcggcgggagaaacaaagcggcggcgaagggtgggcggtgggtgcgctttttgcctttttttttattcagatttttgttttcgcatgcgaacgacatgcgtccccgcacgtgaaaagccgattttcacatgcgggtgcaccacctgcatggaaaatttagattttcacggacccttccggggcagacgggccggaggtccgcacaagaaaatcacttttggcccgtctggaaaaattactttttactggtgtttctaggtttagtaaaaatttcgtttgagcaagtttaataatagagctaactatgagtttatagtatatattagagttaacatatacaatagagaggctataaggttatctatattttcttcttttctctgaatctctcacctgtgcatttaatgtactaggtgaaaccccgcgcattgctacgggaatttagtatggtaataaaaaaataacgtataagatagctagataacatcagattaagtaattaatgtggtttatgataatttaaatttaaataatatgtagaatggtgatttaaacgtaaaaagtaaggtggtgtgactttatggaagaagaaaagtagagagatagtttggaccgtagattaatcatttaaagctaaaaacaattgatgtgatatgacttaattagaggaaaatggagaaagataatttggaccatagattaatcatttaagcactaagtgatgatgaactatataagtatataggatatcataaaacataataaagatatacattgaaacatgtgaattatgttggatgataatttaatatgtttgtatttgaaaagctcttaaattataaaaactataaagatataacatgtttgtatgatgtttaaatgtgatgattgttagtggatgatgatgtggcatcttgttaattagtggattagtggatgatgatgtgacatctttgcatgctaagcttaaggaattagtgggagataactttatagtaagatatgatgataatttaacatgtttgtatttgaaaagctcttaaattataaaaactataaagatataacatatttgcaagatgtttaaatgtgataattgttagtggataataatatggtatcttgttagtggatgatgatgtgacatctttgtatattaagcttaaggagttagtgggggataactttatagtaagataggaatcatcttaaagtgtgtgaatagctcttatttgagagacaattcttctcattttttgaattttctctcatttacataagtttattgtttgcttatagtctactattaaacttgctcttaaaagagattgcaag

SEQ ID NO: 107519 - DNA, 1812 bp, Oryza sativa
ccttcttgagcgtgtcgatgacggcgagcaccttggtgagtaccttccaccgctccgtggccacctcgagcgcgtgcacccgcttcttcttgctccgttgcctcacgctgcggctctgcgtcatcccccgggcgagagataactgtgcggggcagcagaatcggccctggccctggcgctggcccccgcagcggagcagctcggctaggcaatcccgcaaacacgtggtgcgcatggtgtcccgaacggccggaacaagcatacgcaggagtaagacgatggtacgaacgcaacgggagcaggaagcggcggaggacggcagctatcggcgcttctagccggcggcgagaggaggaggaggccaggaaggggcggcgggatggccggaaagaggagcggggaatcaagcggagcacgagcctctacaactgcaaggacagcaatggcgatgcttaaaattagcccatgtgtttggatagaagatctagcccgcagccttattaggcttgttagtttgggctaatccaagaaatattttcaaggaacaagttgtaatattatttaaattaattttgtagttattgctaatacattataaaaaaattaacaactaaaattcaaggctaatatcactttaaaagacaatatatcctatatttcgataaggtaaagtacggtctactatattttatagaggaaataaatgcaagtatatataccatgttattattgtatattttaataaaaaaatgtataaaaaggcatgtgaattataaaaatacgaatataaaaggtgatgaacatattttctgctaaaacaaaatttactatttacaaaagttgatgagaaatgttcaaataagtatgcaggttgaaattggaaacggtaattgaacatagttgatatcctatatttttataaaaggtaaaacaattagtagcaagaatgaacataacaaaaatcattttctcctaataattgtgcaaatttttacaacttagaatgtagtatgattttacataagtttcatggaaattcaactaatttatataaaatgttatgaaatttgcactacttaatagcacaaaataatatacacgggctataaattgacgcgctaattttctagtaattaatgtaaagaacccctaataaaaaatgcataattttctgatctaaaccatgccgacacggtaaaaagttaaaaaaaaaaacattagccttgagcccttgaagcagacacagagaaggcaagaatgaagcaatggtgatggagtgcgcactggaggccggagcagagccgtgccgtctactcaggactcgtcgagcaggagggagagggacccgactccggtgcgccgtcgccgccgtgaggggcggccgcgcgccgggcctactggcgcctgccgcagccgcagagtgagaggacgaggaggcgaggggcggcggagatgagacacaagcggagcggcggccgtccgggcgcggtggtgcgcctctcctctgtcgtcctaaccctagcgcctgtggtgggcttttttttttgtttgggccgggccaaaatccaggtggtccaaggactccccgcccctgtgatggaccgatggacgtacacaggggctatagcatccacgccgggtaatgacctggttgccgccttgccggcagcccggctagggtctgtttgagggagctttagattctgagaagcagctgctgggtagccagcttctgagaatctagaaaagctctgaaactcagcttcttcagtttctggcttcttagttaatttatttttcagaatctgtaac

SEQ ID NO: 107520 - DNA, 595 bp, Oryza sativa
tcacttatagatcattatcgcgagcagtcccatatgttagtttgtgataatggtcggtacgataaggattttttattagtaaatacatgcttaccaagctaagcccacatattagtacatgaaaagtaccaataaacaagttcacgagtaagcccgcttacaccccctacttttaaaaactattggccgagtccatttatatctctcgtccaaatatccatgtgaagagttttacagattagtacataaaaagtatcaatatacgagtttacgagtcagcccacttacactcctacttttaataaccattggccgagtccattcataactcccgtccaaatatccatctgaagagttttaaattgttatactgaatgtgtccatatactcgttctcctatattcattgaacgatcaaacaatttcatactaagtttgtccccatcatttggctagttgttgtaatccgaagttaacaactccctgcaagtgcacgcgggtcggcaacctatatatgccgacaatcaagaatgatacaacccaaccatgcgatggtgctggtgacgaaggctaataagcatgcatctccactaaat

SEQ ID NO: 107521 - DNA, 718 bp, Oryza sativa
acaggaacgaatttttcatgttaaatctgtaaatcatcggtggaaataagcagaatgcattctagagcaatttgtcatctcgaagctagtgttaagataaataaacaatatgccctctagtaaaatattctaaaacaatatattaaaaaatagagtacatgctgcaaggaatattattcgtccttaatgttgttatcaaaagatgaccaggtagatactccctccgtcccaatttaagtgcagccatgattttccgtgcccaactttgatcgtccgtcttatttgaaatttttttgaaaaaaaatttaaaacgtaagtcacgcgtaaagtactattcatgttttatcatctcataacaataaaaatactaattataaaaaaaatcaaataagacagacgatcaaggttggacacggaaactcatggttgcacttaaaataggacggatggagtagtagatttcttttctactgcatacagcaccaccaccaccaccaaataatacgtaaatgaatgtaactgggacctagtttcatcatatacacaagttgctagatttttcaagtttttggcaagaaatgagcagtacagacatacagtatgttcaaaattctgacactattttaaagtcgtcagtaaaattgctggccaatgtaagaatgggttatgttagcaggaaaacaaaacagagcattatcaggtattatcacttaatata

SEQ ID NO: 107522 - DNA, 1617 bp, Oryza sativa
tgatatatgatgccattagtgtactactaaaatacaaacattcagatgcaaataaacactggcattgctgaaaagccacagagatatgggagaaccattaagcttttgtcaacaaagttaaaggttcattcaaggacttatcatggacacagctaatacaaaggttcataatggttctctagatgatatcatggtgataaagataataaaatatcagcaaacattccgggctcctttaaaatgcaagaattttacaggaatttcacaggaattagttccacccatgaaattcctctgtttcaacgaaagcccaaggctgaactagggagagagtacatacaagcttctccactgctgtgtagctggaacaaagtaaccttgctagtgaacttttccttaactctttgtcaagaacagaacataaagcatgtgtaattgcagtaatgatctcttcctcatcctctattcgcagattccccgcatccatgccctataagattgcatataattgccaaagaaagaatcaacttataagttaagtgttaaaggtagagggtgatgtggtaggccatgttcgcataaattaaatcattcaatgttagcatgaagctgtcagcacatataactaccagccaaagaaatcatcactacaaagcttttgccatcctagagcatacaataatcaaaattatttctctctagatagtaaaattttcttatctttcttcagtcatattgcaattgcatcaagaatgtgtgcctgaaaaccaaactatcctgagtgattcttttagcagccttcggttaatagtttgatagggtagtgaacatattttgcccttgaagaagatgaataaggcaatccaagatatcagaaatagcactttcaacccgattcagactacaaggaaacatgccattcaaatcaatccaaaatcattttcagcattctttccaaaacctggagtgatacatctagaatatactccctccgtattttaatgtatgacgctgttgactttttaaccaacgtttgaccattcgtcttattcaaattttttatgtaaatacaaaaatacttatgtcatgcttaaagaacatttgatgataaatcaagtcacaataaaataaatgataattacataaattttttgaataagacaaaaggtcaaacgtttgttaaaaagtcaacggcatcatacattaaaatatggagggagtactagcttactccctccgtccctaaaataagttgatttctagagtttgaaatttgtcacaatataatttgatttctagcctcttacctacccttggtccacaaatcgagaagttttatcccttcaataccccttagctacctacccacccaccaatactgctttcctattaaagagggtcactttagtcattatccctcactactatttttttcttaagatgctaggaattaatttattttgggacaggagtaagtgcttagcatactcaacattcaattgaattatcatttttgaaaaacaatattaaataagattagtagcatcgaccccgaacaaaaaatgtcatgtaaaaaataaaagctacttgaagtacaagtccatttacctcactgat

SEQ ID NO: 107523 - DNA, 751 bp, Oryza sativa
attagagggaaatcaacgacgggttactattattttgcgaggtgaaggaatatgtgtgattggttgtgatagttttggccttggaaacgtgttttttcagttggataatcgtgttaacatttggaggagatatgggaggaatagtagaaaggtcacgggggtagcgtcgtgggttgaggttatggttgtcgacgcgagcatttggatggcgtgcccaaactactagtagctagtagctacccagcttctttgttctgtcatctccgaaacattgttgatctttggctgtgtttggccccgtttagttacccaaaagtttttctaaaaacatcacatcgaatctttagatacatacatggaacattaaatatagatttaaagaaaaactaattgcacagttaagggggaaatcgcgagacgaatcttttaatcctaattagtccataattagccataagtgctacagtaacctacatgtgctaatgatggattaattaggctcaaaagatttatctcgtggtttccaggcgagttatgaaattagttttttcattcgtgtccgaaaaccccttctgacatctggtcaaacatccgatgtgacacccaaaaattttcatttggcgaactaaacaggctagtaacttccaaagttagaagtttggtttgaaattggtatgatgtgactgaaaacttgtgtgtgtatgataggttgatgtgatagaaaaagttgaaagtttggatctaaacacaa

SEQ ID NO: 107524 - DNA, 678 bp, Oryza sativa
attcacatttctttctttccaacaggtgcataaatctgcaacaatattgcagcagttggcagcagtgtgcagcctctgtgagagaacaacgtggaaggccattatttcttgggattccctttgtcgatggctgcaatcagcggtactgcatttctacaataacccccttggtgtaattgcgaaaggaaccctatgtgtttttgtttatttttttgttcgtctaacatcaaagcattagaacacatgtcatgcataaggttagtagtactgtacatcaatcttgaaaatcacgatgaacatgacgtggatttgcaagaggatctgggtcaaatatcatttgaaaattacagatgatatttctgtttatttgatttacatgatacactaatttttagtcactagaaatcatcagttttcatctacatactagccattaatccatatatgtaggattgtaggcagacattgttgtcatgtcggactagtaacaagtactgttgacacctgaacattttgagctaccttctggtgttttgacgtgttatattcatttgaaaagtatttccgactaatgtattttctgcatgaagcttaactttgacgtgttgcaacaccatcatgggctaacgtttttccaatcttgtccaggtgaaatacatgccctcagagtacctaagg

SEQ ID NO: 107525 - DNA, 1325 bp, Oryza sativa
aattgaacacagtaaagaacagaggacattcgtatagcaacactcacagaatactaagaaaaaactaatcaattatttatataaacatcaattaaagctcaatttaaagatgaacaaataataaatagagtctgacagacatatttagacccataagcaggatcgtccgagtctaatttcaatttggaagacataccatccatattctcctagagctcaggtaaaaataccacaatattatcaacttgcagtgagaagcatatgccattttcaaattggttaaaaaaagagtgaaaatttaactttgcttttgtgttaaaaactcagattttaagttaattaatttgaagacaataatacaaagataaccagatttgatggaaattatagtagataaaaatgaaatcattctttgttccagaataattcatcaaagacactgctatacttcaatgaaactcaacacaagcttttcataggtcacaaaaacatgaaaggataaacagtacatcactccataaaagcacaaaatcataatgcggagtaaaattttaaaagtgcagtggtatagaactcacaggtggaaggaattcaatgtctttgcaccactttgcagtgtaatttcgtaagttcggtcaattaaatcttgcaaaaacaattcaaggggcctcgctgcacgtaaagaacaaattcagaatgtcaggcactcaggttgtatgctttatcatggcaataactagaactgtaacattatgcaaaacaaaccaaaaaaggtactccaaaacacatatattatcatacaagaaaatgtgtatcaattagttagtgaaacaaaaatgaaatgcaaaacgattatttttctaatgggcaacaaccgatgtcaaaatatgtgaccagtgacttggcataaaaaggcgagttgggttcttctccatgtggcagagcaaacttgtcgctagttcagcttactgaatgtaagacaaacttttggcagaatgctttcttgattgcatttttttgtaagtaccaacccctagagagaatggagcgataacacaactgtttacatactacatggctacatcaatacccaaaaagaagtagcacaggctgttgtcaaaacttacatactaaaacaggtacagctagtgcatttttgccaaggtcttcatcagcctgcatgttctttttgatccgtgcctgtcacaacaaaaagaacagaaaaaatgatttcacagtgttcaaaattgggttatatttgaaatatataatcctccagcatacacttgatataccgatatgtagggaacacaaggtaatcctaa

SEQ ID NO: 107526 - DNA, 710 bp, Oryza sativa
cccgttaaagagacattggacagtgatgatttgaggtagaatgctgctctgtgaatgcgggacttggttaggagggactagatctacacaatagcaggccaagagaagagaacacaacaaaactgatattcggattatcttcttttgttactccattgctccaacataaaatacatcataataccatatcatccttatatagatggaggatggcttgagttgaccactaagaagccatctgtccatctctaaacaaggaatcctgaagatgcgtaaccaaccatgataaactaccaaatttgagatttgcatgcaggatcctaattacaatataatctttaaaatgccaactgtcttgtcttggtatgtactgctgtaacaacagaaaccggtactagtcagatactcagagccaatggttaacatactcatttttttgcttctgcaataacatgtttatgattgttcaactgattcttttcgcacagctcaaacgcccaatcgtaatgcatgctgacatgttagctccccaagctaatgtactccctccgtcccaaaatatagctacataggagtgttttgaggaattctggattggagtgaaaggtctaaaagtccctcattaatagatggtgaggtgacgggaatcaagaatagtacgggtgggtgtggatctcgagggttgatgggatgatatggcctactgggaa

SEQ ID NO: 107527 - DNA, 725 bp, Oryza sativa
tatgatatgtaatgtacctgtctgtcatagtaaggcgtctgttatgatttcgtcaaaatctcaaaggtattttagtttagtaattgcaagatataaatagtttatcaaaaattagggcaccgcaaattcaaataaatagtttccctctataattcaatatttgctcgaataagcaggctaacaatgccgatcctcggagtgtttggaatgcagaaatttggtcggaattaagatgtttaaggcctgtttggtagagtcataactcctaaatttagtttaaggagttgggtcttaagtggggttgttaagcagcctacacccaactccacatctctagttcattacgtgagaacgctgcaccaaatttcgtttctattttatgttgagcaaaaaattatttagctgggctgtagctctagaggagatggagtcaaagagacattcatactctagtactagaaatacaatcagtttggaatacgcataattggtcagtgttgtgcccccatcaatattggtagggtctctctcactctttcaataccatcaatggttggcttccttgattcttctctcatctgcctcacaaatggaagaagaagaaaaagaacaagcaccagcagctggctgcaaaagagaaaagccagagaagcccctcacctccacactggatttttcacattttggtccttttaaaaaatttatttcctaaatagacccctaaa

SEQ ID NO: 107528 - DNA, 746 bp, Oryza sativa
ttgcgttttgctagtactactctattgtatacgtatattgattgattgattgttcaaatttgacctcgacttcttggagttatataacgttttttttctccattggacgtacggcttgcacatgttacagcgacatctgtatgggacaactactattcatatacatattgtactatactatgcatatacaatttaaaaaatgaattaatcaaaagaattgaaaatgaagtgatcgaaacggatcgactgatcgagatggctacgtacattgaaagctacgtgcatgtaaaacgacgtcgtcgtctttgtgaattgtgacgaaacggacggagatggagacatgcatacatttaagtcataatgtttattagcaaccaacaaacaaaacttttgtatacttgtttttaaccataattaatattaaaacggagtaatatctaatacatattggttcgcaagtctttatacgtatcgaatttagcagccgacactaacttatagcacgaatgatataagttatcggtgtcggtcctacaaccagttctaatatttaattagtctcccgtattagtcggaagataaagagaaaatgcttatatttaaccgatacatataggaacgtccttcattagagttctatgctagtttgaaaatcaaaatactacactacacgaaagtaaataaaaatcatcttaaaataagatatactaatattcaattccgtcagcatctgatgaatggaacgg

SEQ ID NO: 107529 - DNA, 696 bp, Oryza sativa
cattattaccaaaattgcaagggtgaatctgcaatctcccaatcatcactagaaaaggctacacatctgtgttgaggataaaactcatcaggatcacaacaggtaataaagtgaactgaactataaatagcatcatttgaaacattgaaacgtgcaacttaaaaactcaaagaaaagtaccacaaacaattcaatagattgacctcaaagtgcatcggcaagagcaagtgcttgaacactcccttctgcaccaaagcaggtgcctaagaaagttcaacggttatcagcttatattcaacagtctcacacttagaaaacaatgcaatgtgattatgcatataaggtgtgttctatttcacattggaatttctctcaggttcattctctgagccgttactaaaatgctgatttcaggaaatacatgacagttaattcagttatttcactaacttaactacagtagaggtctaatattcacttcaacttgatagtagaacaatgaatggaggaatattttgagtaacagaaatgcaacatagataggttgcaaatatgacactgcagtacaaccaccaggtgagacaacttactgcctgaccaacttcacacatcaaacaaacaagaccagccatagtcttctcgcttctgttggcaagagctggcagaagaagagcttctctaatatatgggtaccga

SEQ ID NO: 107530 - DNA, 539 bp, Oryza sativa
ctaggcatcagaataaagattagtaattgttgttctccatatcattagcagcaaggatgaaatcttgatacgaactgtcaagtagatagaataattagacagttggaattagttgtagcattcctaggaaagaaattaccttgtatgcaaaaattctgcatgctgtttttgggcatgattacacaattaacgcaaatcttatttacagacatcccagtagtattagcaaatgaatcggtattattattattctacaagtttcaaagagtcttgctagtgttgtgtataaattacagcaatgatccttagtttacgaatagcaggttctgatatttgaaccctgtttagagtaagaattttgcaggaagttcatagaaaccaactcagaaaaatactctcttaaaatctagatcagaacttagcatagagttatatcccctttccaataacaatagacaggccaaacgacgaggcacacttgaacagaatgcaaagccacaacttcatgggcaatttagaagccaaagataaatgggaaa

SEQ ID NO: 107531 - DNA, 739 bp, Oryza sativa
taatcacgattgaccatcgtgaactatcatgaaaccatcatgaaatattagtgagtcattagttatcccgaatgtgtgctaatgtttctaagcagggctaagcaattatatctaatatctagttgaaccaatataaataaagctcaactagtcaaattgtaataacccaaggtatcaaggaataaggtaatcaagtacaaaagggccataacaaagaataggtcaattccacccaatgacattcgaaaatagatgcaatagttgaatagaaacaatagctttaaataggatcaacatgctcaaagggttggttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaaagtgtaaatctcaattttagaaaaatttagagacttgaaccaactaaatcggagctaagatgaattagttatgaatttttaaagattaaatcggattaaaacacttatatcggttaaaattgaattatgacgcaataatgaattatttttgaaaaggaaaagaaggattattgcgtcagcgggctagggtttggtggaccgggcgcacgggcggcggttcacacgaacggacggccggggtaccgagccgaattcgccctatagtgagtc

SEQ ID NO: 107532 - DNA, 1436 bp, Oryza sativa
ccttatatggatacgtgaatctcctcactgtagtctgattttcctcccaacatcggggtttgtcgtctgcatacaaatatataccaacacttatggaatatgtgagattaagcacctatcactatgttggatgttttattatccgaactttatgcagatgttggcggtatagaatcggcatttaacagccgccaacaaaaccccccacacttagcccttggctcgtccctgagtaaaggttagtgtagaatgaatttctttaagatatgaatcaagcatataaatcattcacaaccatacctgtacctgtgaactttataagtggctatcttaccatcttgagtaattgataaatggaatgatcttgattccagtccttcttgcttctctgccagactcatgggatttttatgactctctcttgtctctcaaagatgtatattttctttggatcctcaccaaggcaaaatgtgctagaacttatccctattctaaggctaatatgtggagcttggtagagataaattgtgacgtacctgcatcatatatattgcaaatccaaaaagatagactcaagaagataatcaatcatattcctagatcaagggtctttatttatggtggaaaatgaaaaagtaaaatatttttgtggaatgatggagtaaagaaaatgattctccctttttcctatactttctctccaattggttctcttggcatggttatggaaggggcttggctatattttctttgctcaatgttttgagagcaaactttatttccttctctctttttttcacagccatgcctttccctccttttctcattttctttttgccgagaacttttctaggagaagaaagcatagttcaatgtaggagtttatttgaatggatattttttttgtggaaagccaacttccagtgtagaagcttagcttaattttatatgtggacatgaaggtggaattgaccccttgatcatgagagtatgaaagatatctaacacaagtcacacaaatttgacaaagctcaatataatgtcaagcagtcatatgcatactaaggtttatcaatgatatacctgcatatggccttggtatgtataaggtaaaatcaattggaggattgagcctttaaaaacaattttatttttgaaaacaaatccccaagagtcataacaaagttgcaaggattcctttcatcttaatcatctcacataaagcaatcacttagatgtataaggttccctaatcatggatggttgttcacaagcacaagttcagctgagaataatgaatatacacgatcaatcatatgaagaatttcattagttggaaattttatctttcacttatgcttcaaccagttgttttctgaattttcagctctagtactataccatggtgggggtaccgagcggaattcgccctatag

SEQ ID NO: 107533 - DNA, 509 bp, Oryza sativa
  unsure (1)..(509): unsure at all n locations
ctatagggcgaattcgagctcggtacccgctgacatttatcccctaacactgtgtgttcgcttgttgccgacgatcgaacacgtggtgtgtgcgaggacgaacagcaagcctaggatgatccgtgagccgaccgtcgacgcccgtcgacattgcacggtgtgccgctactcggctaccgcaatgtgagcaactcctccttcccctccttgctctccctcccatcgtcgcccttagttttgttgatcgcctcctccttgcgtggccgacacctagccggaccgcgcaccatccctctcccacgcgcctggccgcgccgccgcgtagcctagcctggctaccggctaccgccgcaccgtcgcctgcgccgacacgcccggccgctgccccgccgacgtcttggcctcacccaggacgccgccgagtggccgcgccatatgcgcggcatcgccgtatcacggccacctcgaaccgncatggccaccaccctcgcaccaacaaactgaacacc

SEQ ID NO: 107534 - DNA, 1015 bp, Oryza sativa
atgcaaggcgatctttcgggtcgatgccaaaggagacgaagaagccattgacatcagtgcagcgggcgccctgacctggtccatgtcgtcaccttcctctgggcaatcactgaagtgaagcttcgctaactagcgatggatcttccggctctggctccgccaaccatagcgcaggtacatgactcatgagctcatatgacttgtgattctcctcccaacatttatttttgttagtttggggattggaatctgttgcagatcgaggagcttgagcgagttgttgggattaggtttatctatagaggtgcagtggggacacgccgccgtcgtcagcgtcttgctgaaccatggcgctgatgtaggcggacgcagtgatgatgattcttgactgtattttagggaactaattgctccaattctgacaaattttaactatatttttggttccctgaaatgctaattgttccaatcctgacaaatacaatgtattaggcaggtagttttgatttgaaatctcttttggattttgtagcccaacaggattgccaatttcgtcttcacaccgttggtttcgtcacttttggggggatcattggaatgcatgaagttgctctttcagatagattttctgctaattatcttcgttctttttttctccagctccatgcttttttacttccttgtaccactaacttcattattcttgcaattttgtttactggcatttataccttaaccatcattctggatttacagtgctttctaaagaatctactgtgctgaacacatgaactaggccgatgctaacgttaatggcgctggattcaatggagcaactcctctgctgttagcatgtagtcataccggctccatcagatttgtcaattgcttggtggaatctggggcagatccaaacattcccgacgaagtgagcatatatattgcctgtttccctcaatacttatgttctttttgtcgcctcatgtgcacaaaattttgttccctacagtttcat

SEQ ID NO: 107535 - DNA, 618 bp, Oryza sativa
ctagattatattccgttagatggcataaaacagtaatagaactgctgagtattctttactcactcttgtgcataatttggtttttaggtaccaaatgatatcgatcagcatgggacgagagtaggacaaggactacacattttattacactattgaaatttggttttagatcatgattttgcttagcataagttttgcgtagaacttgtaatggtcaattaaagttttggttcacatttccttgtggaatttatggagttaggatggttagcaatgtgttgattaattcgttattgatttatcttatgacttcctgtcgtggatgtccctatttttaggtgaggctctgccgaaatttctaataattttaggagttagtggttttgagtgtattttggtgtggcactttaggtacgtggttacctgggatgttacagttgagaccaacatcgattcggagtcggcaccggcatcgctcgggccgccccacgccgtcaccgctcgggccgcccgacactgtcgtcggatggaccgccccgccagccgccgctgctcacccccagccttcggcctcaattgttctgccggttgggaaaaaaaagaaaggagagagataga

SEQ ID NO: 107536 - DNA, 919 bp, Oryza sativa
tgcaggtaatttgaggagaaaacacatccgtcatacgataaaatgcacatccgcgcattcaggacatgtttacatgtattggaggcccaataagttaatgaaaaccatttaggattgggccaaaacatagcacaggttattgggggcccattaagcaacctcccggccgaaggagaggccgagagcaatgtttttgggttcggccgaacccactagttcggcttaacccgttctagcgccgttgatcgccatttttgacgtggacggccctgattacttcctgatggcggttccggggtattttggacatttcgcataagctataactgtcatacttgcctataaaaggagtagctcactctcatttccaacacacaactttgagctaaattataagaggctctattgtatcttttgtacattagagattgatagagagtgagggaaagctctggaggagtgcccggaagtttggcgcccatccgacttctacctcgacgagtgtagcttcgtaggaggaattctggaggagtaccggagctatcggtacactccgctccgggttcggaaaacttcttctataaagtaagcattcgtgttcctttcttatgttatttaattactttgtccaagtaagatagatttccatctttgcaggttcattggttagtattcatgctaagtactctagtactaggactccggatagagaatgaagttcctgcgcaagtattagagtagtacttaataacttaggcgtggtgtctaggttagagattacctttgtttgttctgtatcacacggatttgtcagaggtagacgacaggtggtgacagccctgaatcccacgctagtaatcctccacgttcgggtacataatagagctatagccggtaccacgcaggcagaccagtaggg

SEQ ID NO: 107537 - DNA, 670 bp, Oryza sativa
cccctaatgattttggtgattaattacaatgcgattagagaggactaacatttttatttaagcaaatgtgaaggttgtcatgtcctcaatgagttagcgtaatgcatatcccgcggaatacattgatgtgatgtgatgcggcaaatgagcaaatgatattttgtacgttttcgtttccttgagttaataggaaagccgcactattaagaggaatgatgcattgacatacgaggagtgatcaaagtgctcaaaatctatttttaaaaggtgtttctcctcagtttggtgtgttctggattttttcggagtttttcgaaactcattttcggactttccaaaaacacacagaaccagattgtcgcttctggaaattttcggatatgtccgaaagtgattttcggactttccgaaaaagactgcgaaggcaaaagtggttctgtagacttgtccgaaactgattttcggattttctgaaaatcatcagtagagtcaatttttcttctgtatattttcggacttgtccgaaagttattttcggactttttcgagaacatccagaacgatgttgttggtactgaaaattttcggacttgtccgaaaagtttcggaatgtccgaaacatccttcgttgactttgctgttggtgctgagcttgaaatttccgacatgt

SEQ ID NO: 107538 - DNA, 933 bp, Oryza sativa
tgggtcaatacatacgtattggcaaaccctacccaaaccttgggaaacttaaaagtacttgcaagctgagatcaatgagggctatatttgtggttcattttcagcataaagcaaattttgattcgcaatagtaaatgatagtaggttgctatgaaatttgtaaaacaataagcatgtaagtagagcatcatagtagtaatataatagcatcataatcatcatagtaatatcattcttgtgccctccaaggcagcaagcaacatgtctcattctcagcccacaatgggcaaaatcaccatttcccaccttacccggtttcaccaaacaattgaaagccataaaactatactcatgacacttcaccaagttgctcatgaccgtgagcacggctaatcgattagttttagactctgcagagtttatacaactttacccacatgatatgaacactctagtttgtttcgtgctcgcgaagcactaccacactctacacattgaatgcggtctagaggtcatgacaaagccgttacattgcttaatgcctaaccttgcatgagcacggcaagtgtttatccacactaggagcaacccaagtgccgctaggtcgaggggccctcgccatccctagcgccgtggcagctaacacatccgttcccccatgaggcacttaaccgttatattggacacacttagacgcctaggcacagccacactaggtagctcctataaaccatcattccgactagttcatactactacggcctcccaatgcaaggtcagacattaaacaacttaataagctaaggccatcccattcctagcacatgtggttgcacggtatacttagatggtgacacaaagtttggtccttaattgactagggcgagcactccccctatcgatatgcaactaccaccatatgcacatcacttg

SEQ ID NO: 107539 - DNA, 582 bp, Oryza sativa
tgatccccaacttggtgttgtttttcggtgtgagccttcctcactgtgtttgttggtttttggtggtgagtcttgtggatttggagcatgggtgcaggcgttgttggttgggaggggccatggcatttatgagctactgttgtgagccggcaaaggtgggtgcaaaaccctgtggtgtcttgtaggcaatttgtcggacacgttctgtgcatgcatgttgcctgagggaggcagagcagacttctggtggttggctgagcaagggaacaggggtgggctgctaggtcggctgggggagataaaatagacttatgctgggttgttcgttgggctgggagagagaggagaatggcccaattgtaataggagcttttgtatttttggtagggtttgtattgggatgacagtggcatttgagcttgcaactgatctgtgcattggactgtactatggatcgtataatttggacatttaatttggctctgtgtaattggatggtagggtgaattgtatacttgtgaatgggactgtatgagtgaagcgttatctgaacaattgagttcggtttggatttcgtgatag

SEQ ID NO: 107540 - DNA, 644 bp, Oryza sativa
aaatcaaaactacctgcctaatacattgtatttgtcaggattggaacaattagcatttcagggaaccaaaaatatagttaaaatttgtcagaattggagcaattagttccctaaaatacagtcaagaatcatcatcactgcgtccgcctacatcagcgccatggttcagcaagacgctgacgacggcggcgtgtccccactgcacctctatagataaacctaatcccaacaactcgctcaagctcctcgatctgcaacagattccaatccacaaactaacaaaaataaatgttgggaggagaatcacaagtcatatgagctcatgagtcatgtacctgcgctatggttggcggagccagagccggaagatccatcgctagttagcgaagcttcacttcagtgattgcccagaggaaggtgacgacatggaccaggtcagggcgcccgctgcactgatgtcaatggcttcttcgtctcctttggcatcgacccgaaagatcgccttgcatggatggggagtggcaagactggaggttgaacgaccgcaaccaatcgaacgccatccccacaggaaactcatctgctccccatctcctgcatcaccaccccaacccaccattcgacaagaaaatcaatattcagga

SEQ ID NO: 107541 - DNA, 818 bp, Oryza sativa
caatgattcttcatatttttggtcgaagtggaagctcctatgttgctctcaatctttccactcttttgcaatacccccccggtcaaaccggcctctggtcccggtcagaccggccacaagccgtcggtcagaccgtccaggagggtcggtcagaccggccgttgtctggcggttagaccggctagctggctcggtcagaccgccgatgtcgacagcaacggcgtcggctttagtcttctccgcttgtatagttttcgccgcatctctagtaggtacatgaacaccttgatattcctcattgatagcaacgacctccggagctttggcttctttcctcacccacacatttttcacctttaatccaccagaccgattcttttgtgagaaacggtcttgtcctgaattagatgaatgattcggtactgacctaggtgattccttccactcttgataatatggcataggtggttgaggcatccatggcatataatacataaaaggataaccatatagtgacattaaatatggatactatggcatcacaactggaggtttgtatggagttggtatggttgatggctccgattgctttgatgtttgaccaaatctcttcctacgagatgatcttggtcttttcgaatcactagtttggttatcagatcgttgaccggctaatcctttctcgtacttagccataagcatctcaaaagtgagcttcggctttttagtcttttgggaactagatgactcatcctttgcaactttatgatcttcggccttcgcattgttgattctattcttgggccgaggatccccaa

SEQ ID NO: 107542 - DNA, 547 bp, Oryza sativa
gaagggagtccacggggtgatatatgaagaccccgaaatttttcggatatttccgaaaattttcagatatgtccgaaaggatacagaagagtggcgcacggttctgatgattttcggatatgtccgaaaaattttcggaaagtccgaaaaatcctgggattgcagcaattgaaagagcgacaggatagagattttcggaatgtccgaaaatttttcggaaagtccaaaaattcttggaaaacacagctttgcaatgagatttcgccgggaattttgatgaaactatttttcaaacattttaaaggaattttgacaaaaaacaatttttacaaggatttttgataggatatagaaaggaagggatggtcgagcactagaggctccatttgaacttgtgactagcacacaatcaatcacacaaaacaatagccacaagtcaaatggacgatctaagggatcaaaagagggggaattaccatgagacaagataattcaccctcgagagagggaatgtgtgaatctatttcaagttgtgctaggaccaaaa

SEQ ID NO: 107543 - DNA, 565 bp, Oryza sativa
tcaccacctttacacccacctcaaacgtactgtgggatacgcagcaattactggataacaattacctaaacaccacgtctaagcaattaatatctactttagtgtttataactcatcaaagcaatcactatattttagttaattatagtgaacaataatcctatatgctatttaggaactaaccaagagataattctcacaagataaatctaaattactcaagaagaatattatattgaattcagagtaataaacagaataaaagaaataggagaagattagcgacaactccggaattcttccaactcctactctactctcttcctattctagtatacaatatagtacaatagagcctcttataattcagctcaagcttggaagtgtgtgtgtgaagtgagggactgatgtctttatataggggtagatatgacggttggcgaaggggaaatgtccgaaatgccccgtaaccgccattagggaatgatctggagcgtccacgccaaacctgatgaggacataacttgctcagatataaccatgagtaccttatgtattaataaaa

SEQ ID NO: 107544 - DNA, 636 bp, Oryza sativa
ttgtctaaaacctatcaaatctacgttaatttggtcaaaaaaactcgtgaaacctaattcaaatctgtcaagcctatgacaaatacgtcgtatatttggttgaataaaaaaaatagatactgtgtcaaatgagcaagggtatagacggtctctttttccttgagttaacaccgttagcttgtcttaacggtatagggacatgtatagggacatatctgatcttcatttttttaaaaaaaaggggtcaaataaactaatggtatagggttatatctgatctttatttttttaaaaaaaaggggtcaaataagcaaactaaaaggagtagagtcaaattgctagttacatttcaaaacaaggttaaatgcgcaattgcccctatggattaacacatttgtttgctattcaataagaggagtttcatatgtccgctcacccctcccacgtacatctccccgctacgtaaaaaaaccggtgtacactctaaaagatccatcaaccatgaaatgacctgctaccaatttttgaaaggaacttaatgtcgcttagaggggggtaaaataggtgttcctaaaaattatcacaacttcatatcatattagagatatgagacctttcggtttaaataggaacttc

SEQ ID NO: 107545 - DNA, 781 bp, Oryza sativa
taaactcttccaacttcgaaaatccatatctttccaaccgtaactccgattgactccgttcaacttccataatctggaaacctctacggctcgggcgcccgatcatttggagaaaaatcgggcgctgacgtcagcgatttacgtgcagaaactactttaaactgatttttctcttaaattatttatccaaatcatgatccgattgcaccattaaattcgttgtaattaaatcttcaaaacaagaccacacatgaatatattccgatgaaatttttttatcttattattgaattatttttaaatgttgcacgatgttccaccaggtatatcagaattgtttcactaagtagatcgaaaatgtttcactcgtttaaatcgggtgttgtttcaccttatataataacaatgtttcagcaaatagcgaaagattgtttcagttcactgcaacatttgatctatacatagtgaaacattataagtacactaggtgaaatattttttggtggaacaaaaaataaaacaaattctcttaatagggggtttccaaaatatgtgggtttttttgttgcaatggaatatttcagttcactacaacatttgatctatacatagtgaaacatcgtgagtacactaggtgaaacattttttgtggaacaaaaaaataaaccaaatttccttaatagagggtttccaaaatatgtgattgatttgttgcaggtgggggtaggtattgtggtcgggtcagcgtcatcaacgcgcgcgcggggacgggggcgggggg

SEQ ID NO: 107546 - DNA, 1054 bp, Oryza sativa
catcttatgcaatttataaataacaaagcatttgcaacatataggattcaacatgatcgaaggaggaattgaagagggcttgccttgatttgttgtcacataatacttctctggtcctgctcacatcacgaatgaatccacaaatatgccatctattcaattttaaacgtaatccaaatgaacaccaaataaacaccaaaaataaattatgcgcaaacatgcatgatactggtgcagtagatagaacattattttagatgaatttaggtgaaagaattttaaattttcgataaagcatgtgagagatattaacagtcaaagttttatatgcggtcagcgacgtaactaatacttctctatttaaactggcattgcacattctagttttgcaaaatttgaccttacagcattaaggaaaatattattatagacctaacaaaatttggttcagtcgaaaatgatttaagatgaattagttatgcatttttgaagtttgcctatttttcagttttccaaattccccgtttgaactgtgcttttgcaactcgaaccctgagcttttatttttattacaaagaggtcctgtcttcttctccaaacgagcagagacagagcagagccatggctgagctcgatctcgagctcgcctgcgtcaaacggcggaccgaatgaggtcggggttaaaggagaaaatgcagataaggtctttgtgattccgtttctctattcatcccagccggcggtggacggagatggccgggaactcgtcggcagctgggctactcaaggactgcacatgcatgtggcaatgcgtttgcgatccgagcaaagagattaagagagacatgcaatagcaccctgtggctcacaggaagcttaccagggggtcggccaagggttgacgagctccggtgaggtcgggcagcggggtggcggtggagtagaccggcggcgacagtgacacagcgatggcgggatctacatcatgcatgccgaaatcattacatgcaacatgtacaacaccatcccaggttgctactactgcaagcaatcg

SEQ ID NO: 107547 - DNA, 2017 bp, Oryza sativa
actatagggcgaattcgagctcggtaccctgtttctctgcccacctttagatccgcagcggatggcctaataaatccattgatggggagaggtaaataccatacgactgccaaataggcaatcccaatttaattagtaattgtttgatcgttcgtcaggctccgtcggatgctagctgcctaaccttgcagctcttccacttatgtttttttctttcacgtttcccctaattcccattccgttgtttcacacatatttatattgctaatccaaaaccatctctcgggtggcctctattcatttatacatggccattgaacatatcaagccaacatatcaattatgtagttttacagaagtaatcaattactaatggtctatcatctattatagtgcttcctattactgatctatataacttggagtagttttgaagggacataaatcaattactcagttttattagccatgctaatcgatcaacaacttagtatttttaaactgggatcaacaacttaattccttcaccccttcatcagtttggccgacagcgccgggtgacccacctatttctactataagtgggttcgttgattggcccgcttgcgcccttacagccggccaaataacgagttagcaaaaataacaatattaatcattgatttgttgtgctgtggtattatgatcaaattacttatctatcctttaacttaaattttaagtcaagataccttttgtcataaaccgttaacttagaagcaacgaacatatcttatcaattccaagcacaataaaaagatctcatatatgacacctcttcaaggtgatgggaaacaatagcccacattgataagacccgtttagattcatcttcaaagctttgcatatactttctcataacagaaagtatcatagatatggtttgagttgtcagtgcatgattaagtggtttaaaccatattgtctatatacactcacaagcaagcacgcctttagtaagaataaacggaagggactacccattaattttttttcaaaaattggtcaaatgtaaatacagtgtaattacattgtagcttatatgtaactgcagtctaatttgttctaacatcctgaaaattaagtagtattttctaattatgcatcatgccgattcttatgttcttaataacctcctaaacttaggaaattaaaaattagaggtaacctcctaaaattaaccttcatagaatccgtctatattatttaaaatcttttgtggtttttattttaaaattgatcttgttaaaattgaggtattttctttgatttgatttttgaatcttaaaccttcttataacaaaattcctttattcaaattatttgaaatccttttatgaattatggtccaagaaaccctccaatattacccgtaaacctaaaccaaagcaattccaattttattggaattatttcttaaacccaacctttgatctagaccttactctaatacttctccatccaaacattttatgattccttcttctccatccaaacattttatgattccttctatagatattccaattatcaaattcctatctagtctccaatttaatttatatagctcaattccctcctaattctctcactggcacaagaatagtattattaaaaatattgtgagtaattgctcttgtgataggaaaatatatttgatccttccatcccaaatccaaaacctcatttagcccataattaattctctaataaatatcataccacatattttcctccctccgtattcctttcagattctcaaaaatatattcaaattaggaaccctactattcatattcataaatacccctccctcatttgagtgctttgatatttagtccactatattttatctctcaaaatattcaactcaaactggaaaatatctctttttagaaattaccttccaatataatttcctttcaaacattcccattcaaatacaaattctatctaaacaaaactctctcaaaaattt

SEQ ID NO: 107548 - DNA, 970 bp, Oryza sativa
ctattttagcaagaggaaaccacccgttcctttgtcacctcccgatcctatggaactcgggttcctgtgagaaactgtccgagttgacatccataatgagcaatgaatggctaagggaggtagagctttcatccgaagtaattcagataaatacggctccccgaatcattccatgccatctagaagggaacgatgtcggtattctctacagtccatctgtcggggccaacctcgtctctgagtcttttgcactcgcttatttaagcgataaggcagtgtccccgacaaacaaattcttcaagcatccgaacggaaatatcatcgaagggtttgggattgtgcaagatgtgcctgtctgctttgaagacatggaggcgatcttggatttccacgtctttgaaattcaagatttcgacattctaatcgggcttcccattgagcaacttcttattaacacaccccgattaggtagcctcaaaataacactgggagagaatgaattttcaattccattctcgcgggcaaggatcaccttgaccgatcctctcccagaaattgagtcagcggaagaggttaccgcagtccctcctcatgagtctcctgaagcccttctggaagatgaggtcccagacttcatcaaggaagaagcagatcccggtgagactctcgacctgccaatcatggaaccgccacctcgacctccgcttgagcttaaacctctacctccaagcctatgatatgccttcctacataatgatagagaggccctgtcacaccccgaagttctcctcccaagcctaaatttaatttataaatgaccctaagaaaataccggtgcaaatcaagagaaaaccctaagaaagtaatgcaaataataatcggatttgacatgtggaatttttcttgagttctacatgtcgaaattcattaacaggatttttagtggaattttcagagctctagaaataat

SEQ ID NO: 107549 - DNA, 794 bp, Oryza sativa
tttccttgctcgggaaggcatgtttcgtgtttcctttagtttctatcccgagttggacgtggagaagggcctgtagagggcaagaccaacccctatttaagggacaaggccggttcattgtaaaaccccagaatacaatatacttgaatcgttcttttactatgttttctattttaccctagttttagttcatctttgtcggtttgcgccgtaaaccgtccgccaccgctgcgagagtgcgacacctctttgtaggtttgtcctgaaaaccttccgttttgcccacgagatgggtagttatcctctagccggtagctggtttagttgtttttctacaaaacccatcttgatttggccctttggctagatcgaggtggttagcgactccatatcaccgcaaggcgtttaggtgttgtgatcgtgcttatcaacttgtcaaaaaaaaattgccaacacgatttttggcgactccgctgggtaatcgatctattcggctttattatagccgaatattttgatctactgttcgcgctgtgatcttgcttgatcacgctcgggtgtcgtcgtcggtttagttttatggccgaattgttttgattcggcggaatttgtgatcaatagcaatagcaatcggattgtttctatacaagccgatctgctacacacggtataaaaaaaaatcaggctattaaagccgatttattactgcacacggtcatccagaggtacacgtgtgaataaggagcaaggcagtaatactcgtacaccctagcagtacacggctatttttaatt

SEQ ID NO: 107550 - DNA, 547 bp, Oryza sativa
ccaaatcaagatgggttttgtagaaaaacactaaaccggctaccggctagaggataactacccgtctcgtgggcaaaacggaaggttttcaggacaaacctacaaagaggtgtcgcactctcgcagcgacggcagacggtttacggcgcaaaccgacaaagatggactaaaactggggtaaaatagaaaacatagtaaaagaacgattcaagtagattgtattctggggttttacaatgaaccggccttgtcccttaaataggggttggtcttgccctatacaggcccttctccacgtccaactcgggatagaaactaaagaaaacacgaaacatgccttcccgagcaaggaaacccgagacccgacgaaaatagactcggactcgaccctaccggtctgaccgcccacatacctgcggtcagaccggccctactagccggtcagaccgcccacatacctgtgatctgaccggccctgtgaaggaagcccgttactttctaaactttggtaatttttccctatttcgtccataggtgccaaatttgg

SEQ ID NO: 107551 - DNA, 523 bp, Oryza sativa
aaacattatcgatctacttagtgaaacaattctgatatacctggtggaacatcgtgcaacatttaaaaatgattcaatagtatgataaaaaaatttcatcggaatatattcatgtgtggtcttggtttgaagatttaattacaacgaatctaatggtgcaatcggatcatgatttggataaataatttaagagaaaaatcagtttacagtagtttctgcacgtaaatcgctgacgtcagcgcccgatttttttccaaatgatcgggcgcccgagccgtataggtttgcagattatggaagttgaacggagtcaatctgagttacaggtggaaagatatggattctcgaagttggaagagtttataaactgaaagggagctgctttcagagagggctgtgggttgcatacgagatgtgttgtggactgtagtggatgaggtggctaatgatgggctctgtagaagggtattatgtagacttatgtaagtgaatcaatctttcggggaaaaagcacaccgcaggt

SEQ ID NO: 107552 - DNA, 658 bp, Oryza sativa
ccatctattcaattttaaacgtaattcaaatgaacaccaaataaacaccaaaaataaattatgcgcaaacatgcatgatactggtgcagtagatagaacattattttagatgaatttaggtgaaagaattttaaattttcgataaagcatgtgagagatattaacagtcaaagttttatatgcggtcagcgacgtaactaatacttctctatttaaactggcattgcacattctagttttgcaaaatttgaccttacagcattaaggaaaatattattatagacctaacaaaatttggttcagtcgaaaatgatttaagatgaattagttatgcatttttgaagtttgcctatttttcagttttccaaattccccgtttgaactgtgcttttgcaactcgaaccctgagcttttatttttattacaaagaggtcctgtcttttttccaaacgagcagagacagagcagagccatggctgagctcgatctcgagctcgccttgcgtaaacggcggaccgaatgaggtccgggttaaaggagaaaatgcaaaataggtctttgtgattccgtttctctattcataccacccggcggtggacggagatggccggggaactcgtcggcaggttggctacttaaggactgcacatgcatgtgg

SEQ ID NO: 107553 - DNA, 687 bp, Oryza sativa
ctatagggcgaattcgactcggtacccgatcagcttaaaactgacaatttctactccaagggcagtgatacaagttactgggaagaatgcaagacagaatctgtcttgcaccttttcctagctaccgtttacacattcaacggtagaggtataccattgctttgctctctcttgcagagagaacgagaacaatttccaccgcacagtttcttgactcatgccactaatcttaaggcaccagcccacttgttcaaagtctaacatatgatggcagggattttctagatcaaagccagaaaaaggattttccctaaccatactaattagttcgggacgaatttcatatccagttgtataaatgggctccgatgaaggaaggggctcgtaaaattcgccctgaggagcagatagctcaaaaagaggttgctccaaggtcgacaagagtttgacaggaatacttctctaggatagcaagggtgaaggtcgaattaaaaatgaaaaaggatcaaggatgaacttggttcgaaaatgatcagcaaccgttccccggcaacggtgccagaaatgcttggtggtatctaatacggtcacaaataaaatccgcatgcgcacggatataccgatgtagcacttcccctactgagtatcgcagggtatcgaatacaaaggaacgtgtgtggtcagatc

SEQ ID NO: 107554 - DNA, 832 bp, Oryza sativa
ccaacaccacatttggatcattttgagtgtaaaggggaagcaagtctgtgttggcaggaatttgaagattatgaaggtcatcaaggtttagcaaagaacgaagacggaagccccagatctcagacaactgctgataagaaacagagtaccaggacccctgagtcatccagtatacggtggcgtaaaactgagcaatgatctcgttgcaccaattttgctgcaacgtcatgaaggagcggatatccatgagatcacaattggcaatcacagagttgatcaccagatcattatgtgcctgcagctcctcccaattgatccattgcatgggaacagtgggatgagctttggacttattacagactcataaaagtcttgttgaaagagagtccaaaaccgcggatccgtggcggtgcggcgaagggagcgcggatcctcatcccgacgaggagcaacaacctcagacttgcgccgccaatcatacacttggcgaatcaccgccggatccctctcgggggtatgaatgcggagaggcccaatggggacattgggttggtgcggcggcgtttgcggttgacgagaggagccctcaccatcaccaccaccatcatgagcatgagtagaccgtcgagccacccgcgcaacctgaggaaccgcatcctctccaccggaccaatcactgtccgaatcatcatgagaagatggagtgggagagcgatccctcgggcgcttggacttgtgggaggtttgcttgtggagaggcatcctcaaacaatagagatacaaggagtcagatatggaagccaaggagacaagaaacaagtgattgagagca

SEQ ID NO: 107555 - DNA, 741 bp, Oryza sativa
ccatcagttgataagttgaaagaaaggtgctttctcctatttcttttaggattgtgcgcgaatattctttggttatttatcgagggatcgtatatttatcgctcgcgggtattcaggttatctgactgttgcgtatatctggaagacattaggaacatatagcaaggcaagtcactacactctcttcgttgaacatattgatcctacatttataaatattttgttgacatataaattgcatgctatttataaagtgcgcacctatccttgattatgcccaccctagatattcattacctttatacatgttgtatgcctttgaatgcttgagtcatttatttatatgcggtcatttattgacattgcttagcactgccattgtagacatacgcacactcgatatttatgttagataaatatggatgtgggatcactcgatgtgagtgatcgatgatttgcaggtggaggcatgagcgccacttgccacacacagatattttgcgaaaaccatatcttaatgaaccaaaactatttcgactggggcggcatgagtaaaatatgggtggtttaggaaatggttggtcgccgaccctagtcagttaaggaccgagtcaggaagctatgcgggaaacaaaccaagtaagactgcacttcttacgtatgagcggacccgatggattaggaagctcttgcgggtaccgagctcgattcgccctatagtagtaggatgccaaccacggg

SEQ ID NO: 107556 - DNA, 631 bp, Oryza sativa
tgtgtatatataagcttgggcattgtcatttgcaggggccaagttgcgcggggttgtattgactgaatggcgctcttggcttacttcaccgttttcgtgttagcagcatctgttcctgccaccggccaacaaggtatgctttttcgttcttcctttttccgtcgattgcgcaattcagcccggccctctctagttttattgttgcacgcgtgtttcagtaagcaagacattcaaaattattttcggtgactactgtttctatcatctatggaggtgctctggaatctccgaaatataaaaccatgtcgattttgggtctggccatctctaagctaaatttgggtaaacttaagaaaacctctccaaaccatccgactaatcaaactcccctacaatctggccaaatgatgagcccaggggtggagctagagcaacatgcatggaagggaggggaggggggtgtgcaccgctatatattgtatagtatttttttttgttagcaaatggagtagtagaacactactaatttttggcatcaatattcaacataagcaaaaggtaggaaaagaatattcttaccgaaatggagaataccagtgacaatattttcagtaacttatatagtgcaata

SEQ ID NO: 107557 - DNA, 765 bp, Oryza sativa
attattagtctaatcaccttgtattaccatattgtaagcctgtttaataggtcaaccacgtgaggcccaatacgaaaaccgaatagtcctacaccagcaccggtacctatctccacgcgcatcgaccggttataaaaaagtggcgacagaactatagcaacaccgttttttatatccgagccgaactgcttttatctctcggcgtggcgttcgccgctcattgcgagtcgatctttttatctcttcccttgcccactctttttttctctcagttccttcgctcgccgtaaaaatcgccatgggccatggctgctgctctctctccctatcgcttgcttagcttgtgctaatagctcgaacttgattcagcgatggtggaggatcaggcagcggtgctcggtggcccggcatcgttcattccctcccttcctctttctttctcctcaccagcttttccttcagccacgttggcccagatctggcggccctaatcaagagtgatgcagctttactttcataaagtggtaaaaatgaactaaaggtatgataactaggggtgagtgcgagtggatattggctgctcttgggctacaagctaccccctgtagtgaaggaatactattcttgagactccagagagggtaccacttagtatctattatttttcattcagaatcactaaatcaattgaaatatataattgagactttaaaccagggacatgaagatcccagttatcatagtacccacctgtaagactgttat

SEQ ID NO: 107558 - DNA, 2029 bp, Oryza sativa
gcagatctcaggtgaaggtgtggtttcggaggcactgctccttccaatctctcgtgctcgcaagagatcagaagcgaggaagcgagaacagcataggcgcggaggaggaggaactaacaccgggaaagaagcaatcgatcagaacagatcggactcgcggcctccttatctatcaggagagagaggcaatcgtgaaaacgtggacgcgctgttgcggagagagtcgtgggaacgtcggttagtggctgcaaaagaatagcgacgtgacgcacacacgccgctagccagccacgcctcgccctcgccctcggccacgccccggcccggcccgcgcgcgcgtgcgtgtggcattccgacccccacctcaaccagtcaactgggagcctccaataactccctatttaggttgagatattcctcgcttaaatcctgaggtggtattattatccttaacatttattatgggcctttgagatttaataggataagttgggcctagcccaattattctaacaataatttcatttcacagcttgtctgtgaggatgttttgatttgagtaatatattttcccttcccaaaaaataatattggtcaaatatttaaagagttgaattttaataagatacatgtgcatcctagtgagggtgacgaagggagtagtatgcataatacacatcgctgaaaatcttgtcaagtttatttccaatgcaacaaatagtgtcatttggatttcccaataagaagtaaagatcaaattactgaatggcttcgcggaatccaaatgcgaattgatttcgggatgaccttcgaactagctgtctccagcaatttcacagccatttcatcacacaactaggatggttgttcttagcgtaaatatccctggtatctaagtacttgatagactatgttgattcaaatataaaccactttttgtcagtagtgtgatactctctccgtttcataatataaggcacaactatttttttgatgtttcataatataagacatacatgcatgcatacaattaattaggacctcttctccattaaattattgcttttttaaatcatccacccttaaaatttctaattctattggatgcatgcattacatttattagggggatccaaactaggagataataataattgtttcttgatctttgggttatgggtggttgtgtcttatattttggaatggagggagtaataaatatttgagaaagatctctacacctttctcttgtgattgcttgcagtattactaatatttgatcactcttcttcataagtgacaactattcaccacgggaggattactgaccaaggaaaccggtcttcaagccattttcggttaatttctaagagaaaagaattagagggatttattttacaactattatgatgtggaattattttaccttaagccccttcaaacggaatgaagccttacctggatctaccactcttccgtatagattcagatccaaagtctaacttcaacagcggaaaggcaaataatgtgaacagtgtagtcacttcaagaagagtttgtaattaaccatttaatctatccacatttgtaacgatcccatattcccatccacaataaacagacaagaagaccgattctgatatagtgcaatttatactatgctacctacatgttaatgtagcatatctctctgtttacccatctgaagtcggaggattaggttccctttcgcatcagctaaaaatccttagtctatatcttatttggcaatttgtcaagttggcagttttgaagttttcgaagtgttaattgtagtagttacaggtacagatctagtagtgccacttggatgcaccattttcctacacagatgtataaatcgaaaactaatttaatagtgctatttttctagaaaagtctattttacacaatcctaaactgattcagatctactcaaggagctggtctgaacagggtaacaagcagagtggatagaagtagttttaggaaagggttaatttgatgcatg

SEQ ID NO: 107559 - DNA, 641 bp, Oryza sativa
gtaccccacctaaggttgcacaatagtggaaacctgtccattgtgatcggagatcctgtgaatttggatggcgaaacaaactattgtgtgactgagagaagagacccttgaaaagggctcattttcatgatgtgctgcttcttttctttcctgcatggtaggatggctcatgccttaatgtgatccgagtggcttttccaagcagagctattgacttgcagaacatctcagaaggaacacacctatatgagttcgactgtagtcacagtctatgaggtttgggcgatctcaagatactcatgaaaggcctggagtttgacttatatgctccaaacagaggggatgcgaacggcagcccagtaccagtcaaggttctgagtgaaacctgatcacacaaaactgacaattcaaggcacagtccattgttcagttgtggtctgatgtagctcatttcctaggtggaagttcaactcaacagtctccaccaaaaccctggtatatcaaacagccacaacattgagaacatttcttatgagccttgaaatttggtggggattgttagaataattgggctaggcccaacttatcctattaaatctcaaaggcccataataagtgttaaggataataatactatctca

SEQ ID NO: 107560 - DNA, 891 bp, Oryza sativa
ctgacgggctgttcggctgcgacccgtcacaggtaactagtcacctgtaacgggttaggacttaaacccgtttgaggtgaggtaacctcacctgtgacgggttctatttttaacccgtcacaggtgactagttacctgtgatgggtcgtagctggatgcctcaccgatgacgacatcccgtatgacccgtcagaggtgacggtcatcagtgaccatttcgtttgcccgtcacaggtatcccgtcagagatgtgaggatctggtgtagtggatgcattggttaatggctagtattcctagtcaatttgcgtttctattaattggtaatcgtcttatatatcaaatttcacatatacaggtaccctgatgatcagtacgatcggttctggtccacagatgaagcccatcccttgtcgacaaacatttccacccaaactaccatccaacctagcaccgaatttgcggtgccctcgcctgttctccagaaagccattgtgccgagtggcaactccatgaaactagttttcttttccggccaagtagacgtccttcttcgtaaccacttcgtgatcctgcatttcgctgacttccagaacaacaagtcccgggaatttacagtttccatcgacaacggcgtgcatagcagcccatacagtacaccgtacctaaatggtttgtcagtcaccggcagctggtccagcgattctgaaggcaagtataacttcaccattgctgcaactgccatatcagctctgccccccatcctcaacgcttacgaggtctacggtcgtattgtccatgacaatccaacaacgttctcccaagattgtaagctcgctatatctgtcggtctcggttgaggtacactaaacaaacattatcaactctccct

SEQ ID NO: 107561 - DNA, 880 bp, Oryza sativa
attcttgatttttttaactttaagttttcattccaaattgagtacaacttcaagcttattaattcctgagtttggaattattgaattaattaaaacgataaattcaaactccaccatgacaacaaataggtagtgagtaattcctgattttcaaattattaattagattatgaaatgctatagtggacactgcaaaccaaactgaccacaatccattatgtaccaattattaattttagaaaaaaaatcatgaaaaatctataaatcagagtccaagccatgtacaactcaatacttattaattccaaattttattcattagattaagaaaagaactaaatcaagaatccaatattaagtaaaggtattactaattaattccatcttcgcaaattattaacctaagaatatgaaagtaacaaatgagatgatagctaagatgtattatatatatactttataatagctaatttgaattttgaaattataaatttgaaaaatcgttatgtccttagaacaatgtaataattgtttacatactattaaaatttatctctatagtaattgggcattgcgagtcagctgccacattaaaaaaaagataaagacatgattaagtgatcatatcatcgtgaccgtatattatatactgagaatttgtattgcagataccgtgacactttatattagttcccttttctttctaaaattttgaattaatgaacataaattgtatctatttgaacttagttaacactttcttagttaaatttttgaatgcaaaatttgtagttacaaatagtgactaacatggactatttttgcatcgtaatatgctataattttgacaatgtaatttccgaactaatttgtgcattaa

SEQ ID NO: 107562 - DNA, 539 bp, Oryza sativa
cctagctcgagccagcttgtttggctcgcgagctcaaccacccaaaatggcgactgtgggtctgcaatggtggaagctccaatccagggcattgtgccgtcgatgggtggcgaggaggcatcgtcgataatgcgtgcggccatggcaagcgatgccatgagaataccacatggacgcgcgggcgtgggatgcgacgagttgaggccgacaggtgacgggtgggcgggcgagctcgtgcaaccactgatatcccacaccaacgagaacatgcgctcacatcgctgccaatgtaagggcctgcactcgcttccgacgtccccgtcgagggagggtgacagggacgcttcctctgagctcaacttggcgagggcctgtgcgaccactgagctcctgcttgccgagttgccgtccacgctcccaccactccactcatccgatgccgctgcagcatcgccgtcctttgtgtgagaatggaggcactacacatttgacattttgacttatccaattccaatttgacgagtcacgagtttttcgtg

SEQ ID NO: 107563 - DNA, 764 bp, Oryza sativa
cccattcgaaaagaaaaggggaaaaagaaaaagaaaaaggaagaaaaggattttccctggaattaaaatattgcttgctcaatttgaattggttaaaattatctctagggctctgaaaattccaataaaaatcttgttagcgaatttcgatatgtagaactccagaaaaattccacatgccagtttcgattattatttgcattactttattagggttttctcttgatttgtaccggcattttcttagggtcatttataaattaaattttaggcttgggaggagaacttcagggtgtgacatgggccagactatgtggtccgttaagcatagtgcctgtttctattatgaatcagcagtgatattttcaatttataccactgttggttggtattttcaaatcatatcattgttggttcatatcgagaaccgacagtgataattgaagtatcattgctgtttattgttatgaacattagtgttggctcggaataccgtttctatgctataatgaggacatgttagtagaaagaaggaattgtaatggggttgatgaggtgggagaaatcagtaccattgagttgagacctaacatctggagagtgtagaattagaagagtaatagacctataattgggacatattgtatggaggctgccttaagaaattaaacaaagaagttaccacgttagcttctatactaacaggtggagattaaaaattttttatggcatttctctttgggcaataggtttcataagcattg

SEQ ID NO: 107564 - DNA, 703 bp, Oryza sativa
ctcccctcgcccatgccggatctagcggccggaccgccgccgcgcctccccacccgcccctgcaggatctggcggccgcgccgctgccgccgccctcgccggctccgcgccgccacgcctcccctcccgccctgccagatctggcggctgggccgccgccgccgcccccgctggctcggcgccgctgcgcctcccctcccgcccctgccggatttggcggccgggccgtcgccgccgccccagccgccacggcatagagaaagagaggagagatagagaagaagtcgaagagatagaggagaagtggagaagagggagccggccgaccttatgtcctcatgtgggcccccgctgggagaggagacatatatatatacagtggcagaagtcatctcaaacgggctgggacttaaagccgtttgaggtgagtaaacctcacctctgacgggctgttcggctgcgacccgtcacaggtaactagtcacctgtaacgggttaggacttaaacccgtttgaggtgaggtaacctcacctgtgacgggttctatttttaacccgtcacaggtgactagttacctgtgatgggtcgtagctggatgcctcaccgatgacgacatcccgtatgacccgtcagaggtgacggtcatcagtgaccatttcgtttgaccgtcacaggtatcccgtcagagatgtgaggatctgg

SEQ ID NO: 107565 - DNA, 568 bp, Oryza sativa
aatggttattaccaataccaggcttttatttctatatggagtaaaaaaataccctctggttactgcttacaaaaatagccaaaggcccccatgatttagtcccgcttggtcgaattttacagtcggagccataagaggttcgcttacgaaaaaagatgaacgaattatcataggtgagatgtaaagatgttagcatgcgaaaaggtacgagcgctcaaaaaatccacgcagctaagtctccatctattattttatcttcatcccttaggctgtgtttgatacttggggttgggaacccaactccaccgcacggaaaacggagcggtccattagcgtgtgattaattaagtattagttaattttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagccttagtctgctcactccctccctcaccctccactcccctcgcctaccctccccctgatcta

SEQ ID NO: 107566 - DNA, 1265 bp, Oryza sativa
cctaatcaatgatcctggaaatatctatctaaagataagtcatatcaaattcctctagatgcgtgagccatttggagacattagtatgggaataagaaaatatggatgcatgtttggctcccatattctgccctacagcttataagccactgtcaaaatttaaattttaaaactaacatgatttgaaagtagattttgcatgttttttcatcaaagtttattttttacattgacttttaaaacttttaaactgctgccaaaataatgctaattataaaagttttacacacaaattaatatttttattttgttaataagccgtacagtttataatcagcactagagttacctacagttggacggatacagtgttgatgtatgccttcaattgtgatatctacgaattttgaaagctaagcacatgtgttgaaggaattctgatatattatagaccatataatatatattattcttgctctactttcagattcagattgccccatatgtaataaagaaagattcctccatatgtgtctttcaaatttaaaactacaagagaaaagcctacttttggtcatgcaactgtagccttggtccgttttcatccctcaactacatatgaaaccgattactgctagtctcattctctcgaagatgtggcaccacatggatagtacatgcgatgcaataaacctccactagttcttactcctactccctccgtcccattttaagtgcaactatcagtttctacgctaaactttgatcgttcgtcttatttaaaattttttatttagtatttttgttgttatgagatgataaaacatgaatagtactttactcatgacttatgttcttttaattttttcaaataaaacggacgaatgggaaaaaggggtttttaaagggggaaaaaccccaaaaaccccgggggggggaaccatggctgcacttaaaatgggacggagggagtagttaggatgggtttatataattttaattgcaccagaatgcaactgctcatcatttaagtggtgttttccggtgattttaaatagcataaaactatccccattaatgtcagtccgaatctcagatgtggataatgaaaggcagtgaaaattttatgtatacttacaaatacttgagggcactaaacaatgtgaaattataggatatctggccttgcaactcgctggtggagagatcactgcataataattttcaagcaatacaacataaatgaaaggttccaaactatatac

SEQ ID NO: 107567 - DNA, 940 bp, Oryza sativa
cttgaagaagagttgaagtctcgggggcattatagccgatgacaggaggagatggaccacctccatttggaataaggcctagagcatactctatgtccctgccactattgctctggtgaggaaggaagaactcccttatctgcaagtcaggaaagaaaattaattacgttatgaatcggctaagcaattatttaaacggagttaattaaatgaaggcatacctaagggataacatctggaaagagatctgtcatgtacatagaagccgattgatggaatagatgcagtttccattcaccctaccatctgtcaaagtttttgctcctgaactttgccagccctatattttcaatgctgcccagaggaggtccttggagattgagcagccgatccatcatcaaggctgatgagatttcccctcggcacaggatcttatcggcaaagaataagctgattaggagttggcccattccaagttgtctagctaagctcattggatgatagaactcataagagacttggatgtttttcccctgatggatgccgacagaaagcatgcatgggctgattgcagctgagaaaacttccctggacttttggtatctttcatgattgatatcttcaaatctaaagtccgatgggagctcaaggtttgctgaatcttcataaggaaaccaaactcgaacatctttttgaaagccatcatagaaactgcagaaccagtccttgagcagttcagccgataattttgctccggcatcggttggtgtggatgcatattctccatatgacatgcatctgcgatgagtgcgctcttctccatcatcttctacaatcggctccagtcttgggaattcggcttctgtcaaagatggccgattgacaactttcatgaccatcagatttaacgaagtctgcaatagccaccatggtccacctg

SEQ ID NO: 107568 - DNA, 598 bp, Oryza sativa
tacaagagaaaagcctacttttggtcatgcaactgtagccttggtccgttttcatccctcaactacatatgaaaccgattactgctagtctcattctctcgaagatgtggcaccacatggatagtacatgcgatgcaataaacctccactagttcttactcctactccctccgtcccattttaagtgcaactatcagtttctacgctaaactttgatcgttcgtcttatttaaaattttttatttagtatttttgttgttatgagatgataaaacatgaatagtactttactcatgacttatgttcttttaattttttcaaataaaacggacgatggaagttagacacggaaaccatggctgcacttaaaatgggacggagggagtagttaggatgggtttatataattttaattgcaccagaatgcaactgctcatcatttagttggtgttttccggtgattttaaatagcataaaactatccccattaatgtcagtcaggaatttcagatgtggctaatgaaaggcagtgaaaattttatgtatacttacaaatacttgagggcactaaacaatgtgaaattataggatatttgcc

SEQ ID NO: 107569 - DNA, 1528 bp, Oryza sativa
cgacaggtagctcaaaaaaaggcaataacatggctaatgaatggtagtattttctgagaaggattggttccaatggaatcggtacaaatattattatgcaaaggattgttttctggaagtaaagaaactggtcaggacacatgcatgtaaatagacgcatcaagacacaatacttcttagaagtgttcgttgagggcaacacacaactcgacacaattaataggcgagaaaataatccaccaaaacagaactattagttctagaaaaagggcccaaacctgtataaagctctgtctttcaattgatctatctagcattaggtcaggtaactagcccccatcattgtcatggatagaaaacatagataagtccccatccaccatgtttcggtctaaaacttctccgctaataactagttgagccctcgcctcttcttcttgttcatccagcttaaagcgccatcgtctttgacatgaacagaagacaatcgcacagagacggagaagagctcctctcgcggttcttcgcttctccgttatcgtaccaagtgctgccggctgggcagaccataaaccttgccaaacagatttgccatgctgccctgtgcttcgcatcaaagacattaaacagggagccttagcttgaagtaagagcaaaatatatgaacacacgcaagaccattaatcgataatgttaagctctgatactattatagagtagggcgatgcatctttattggatcattttttttgtttctgagttttttttctactctttaatttggtgccagtgtacagtagaataatcttgtaccatgaaaattaaaatgaattcctagcagattaactgctacacaaaaaggtacgttggtaactgataacactaagttccatatcatcctatatatcggatgatcgaacaattcaatggactgtttatgctgacagtctcaaactaaatatgattacataaatggttcattgatgactctgagattctagtattggtttcattggagaaggggatcggtccgatcgattggataaatagagatcacgctctgttctcttccgaaactgaactaagatccatgatccaagcatccaatgtgctctatgtaccagatattctgatacttggtttggccagtttagggtgttgaatcattagtaaatcaatcaacagtggtatgcaactttaagctagatattctgatacttggtttggccagtttagggtgggggaatcattggtaaatcaatcaacaatggtatgcaacttaacctagaaatagaaatactccctccgttttttaatatatgaggccgttaattttttttaaacacgtttaactattcatcttattctctttgctgaaatagaaatactcctccaactccgccttcttgggagggcttggcctgagggatagagatgacatatgggcccagataattttttattattctctttgctggcgtcacatgtgctagatcaagtcaaagccgctaaaaatagtacttggggg

SEQ ID NO: 107570 - DNA, 1499 bp, Oryza sativa
ccccaagcatccaatgtgctctatgtaccagatattctgatacttggtttggccagtttagggtgttgaatcattagcaaatcaatcaacagtggtctgcaactttaagctagatattctgatacttggtttggccagtttagggtgttggaatcattggtaaatcaatcaacaatggtatgcaacttaacctagaaatagaaatactccctccgttttttaatatatgaggccgttaattttttttaaacacgtttaactattcatcttattctctttgctgaaatagaaatactccctccaactccgcctccttgggagggcttggcctgagggatagagatgacatatgggcccagataattttttattattctctttgctggcgtcacatgtgctagatcaagtcaaagccgctaaaaatagtacttggggggggtatttgtccggtacaaatagttgagggtacaaaacgtgtgttatttgagtttaagtggataattcggtcgactgcgatagttcaatagctttcggactttttccttttattgtcacttgatttatcgtcaaatgttttttaagcataacttaaaattttatatatttgcaaaataaaatttaaatagaacgaatgatgaaacatttataaaaaaatcaatggcgtcatatattaaaaaacagaggtagtactctataaccaaaacttgtacctcgcttgctttaattgataaccggctgcctgtagttagtaggaacgtatgcagagaagagaaagtcaagatagcagctcaggagtactctgaataaaacccgctcttcgcattggtaccgtctctattattgagataaaaatacaagtgatgtagatagccacattcttaaatgtagttactttgttttctttcatcgaccatctatagtatttctctccctgtaaacacaggtggaactgggtacccgtgacattgcatatctacactcctttataattctttataagtagagaaaatgtcaccccacctacttctgttttaattttacaacttactcccttacacattttaatattaaaaacaattaaatctaaatgaatagttatagaatcaaattagggtcgtattccatatgatgaaaagattggaacccatttcatagaaaaaatatttatagctattttagataactaggaaggtagcccgcgcacatgcatgggcatgtacgtaaaattttattacgaatgtccatgtgtggatggttttctatcaaaaatattctttcactttatcatacactaaaattgaacttacttaacatgctttgaacgctggttacttgcaacatataaattctgaaattaaattactttaaaccgtgttgtttctaattcatgagaaaattttgtgttgaaacaatagatgtgtttcctatgaatgtccaatttttttgttagattctgtaaaaaaaaaaaaatatattcattttattagtcctgctaaaat

SEQ ID NO: 107571 - DNA, 761 bp, Oryza sativa
tcaatgtaaaaaataaactttgatgaaaaaacatgcaaaatctactttcaaatcatgttagttttaaaatttaaattttgacagtggcttataagctgtagggcagaatatgggagccaaacatgcatccatattttcttattcccatactaatgtctccaaatggctcacgcatctagaggaatttgatatgacttatctttagatagatatttccaggatcattgattaggcaatgaaatgttgcaaaacatggagcatcatgatccaaacagatgcttgcaagacgaagtatatctgattgctgtgtaattttcatttttgccttaaacgaattcttttatgtgagattgccacttgcatgatggagtataccggtttactttaaaaaaaaaaattcgagtgaattatttcatgtccgattggcactaagccaacaatcttcacgcttttgccatttactagtaatcatgcacgtgcaatgcacgtttttacatataaaaacactcaaaaattattgcattttcatgttgtgttacccaaaacacacaaacatatttttaagaaccggtgattaaaaagggtcacacttggtgcggcgagggaatttgagactgggaactcatgatcccaacatattcaccctgataaaatttcactaaatattcttttgagctattttagagacaaaattattgtttgttctttgtatgcctctaccctgcaacaatcaatcgttaagatcatctgaaaattggatg

SEQ ID NO: 107572 - DNA, 543 bp, Oryza sativa
tttaaccatagataaaatcaatctgttttcagtaaaaaagattcaatacttagaatgccatatatgtgcatgtaaacttagtcgcatccactgtgaggtttcatacgcatcaagatatttgaccatttgttttgtcccattacataggttcagagcttgaccaaggtgaatcacaggaatcttgtttctttgattggttactgctgggagaaggatcatttagcacttgtctacgagtacatgtctagtggcaatcttagtgattatctgagaggtttgtccattgcaatctttaagtattgaatatttgggaaatctgagggaggatactgggcatatacattacgtagaccaactagtcattccttccttacaacttaaatactctgcatgaccgaaccagctcacagcgaagccaattaactcatgttgcataacagtttgcagaactatgacaagtagtactgcttacctggagagtgcatagttagacattttgagaaaaaaaaaagactggagagagcatagttagtctctacctaa

SEQ ID NO: 107573 - DNA, 690 bp, Oryza sativa
gtgtgtgtttttcgtatcagctagagtaaggaacaaagtagaaacagtgcacccgcatagccaatggcagcttgggggagctatggctcatggataggaaagattgacctttgttgtcgaaagacgcaacaattttccttaattaaaacactaaagtataatattgaatttcgaaactctgtcttacagcctaccccttcggaaattctttggtacttgattaattgctttgacgggaaaatggggaccccccattcccatttcattgacaccgccgcccgccggatctgcactccaaaacactactagaaaaacattttcatagtcggccaaaaaaaaaaaaaaaaaaaaaccccccaaatttttgggggggcccctttttggaaaacattttttgacatacggctagtcgtgactatcgacgatccttaaatcatagtatatgaccatcaatacctacatataatagaataaaatatggtattcaactgagtggtagggtttattactaatcatttccactagcgttggtatatatttggatgcatgcaacaaacaactaaagttgagagggaataaacaagaagaaagaggagaaccaaacacatatccaaactaaaggtagttttggacccaaaagcccaattaaacacctccaaatgggcccaaccaccatgcccatggactaag

SEQ ID NO: 107574 - DNA, 680 bp, Oryza sativa
  unsure (1)..(680): unsure at all n locations
atgccatgatgatgtgcatacaagatatggcttctcaaaggctaatgatgtccgccgtggtcttgcaattgaaggaaaaccatgatttggagnaagctcatggggatgggttctttggaaaatgtagtaagagataacacatcttcgatgtccatgtttagtccattggtaagatgaaaaaaaccattgatagctcgctttggaacatactgatggctctcttcttcaagtctaaaataaaacaactgatttctctctagacgatttcttctgtgttaagacacaatgatttatatacagtttgtcttcataaacaatgccggtaggatccttaataggtgtgggtattgcaaagcaatagtttgcttcagtgtaacagtaagctgtttgtgagctttctaactatagggtatcattgctcaaataatatgtaacaaagatatcgaaaatgtttacatgtttcgttatcatatccttttctgtgttgatttttacatactcattatgtattttttaaataatagtactgattatggtaattaatgctgattacgggggtggggattgcgcagcgcgagttgagcagctggcgcttgcgcgcccactaggaagccccaggtgaagagtgatcgctgccgcggcttttggcactaggctttggctgatgcaggccatggaca

SEQ ID NO: 107575 - DNA, 577 bp, Oryza sativa
  unsure (1)..(577): unsure at all n locations
tattaccaataccaggcttttatttctatatggagtaaaaaaataccctctggttactgcttacaaaaatagccaaaggcccccatgatttagtcccgcttggtcgaattttacagtcggagccataagaggttcgcttacgaaaaaagatgaacgaattatcataggtgagatgtaaagatgttagcatgcgaaaaggtacgagcgctcaaaaaatccacgcagctaagtctccatctattattttatcttcatcccttaggctgtgtttgatacttggggttgggaacccaactccaccgcacggaaaacggagcggtccattagcgtgtgattaattaagtattagttaattttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagccttagtntgctaacttccttccttacccttcactcccctcgcctacccttcccctgatctacctcaggggtggaag

SEQ ID NO: 107576 - DNA, 1215 bp, Oryza sativa
aactcatatatgtgcattttttatctattgttttcatataatggcggatgaaaacaaactttatattaactgtagagctcaatgagacctacaccttttttatgactttttgatttatggccgtttcgatatctgaacatatgttgtaaggtcttggatctatttgcgtaagtgaatatttaaaatttataaaaaatttcagatggagacgtaacctatatgaaagttgtagatctaaatgggatctacaattttttagttgacaaaattttcatctaagttcatatattgtgttaaatatgttcggatagcagtactctcaaaataatatcagttgtttttaagacatgtgtttgtaggttcgatagtaaggatgctttcgatggagagagatgtcttgcttgagtcatatgtatgaatataggtgccttgtgggaagtgaattgtgaccatataggtgcctaataaaataccaaatatttattcagatttttttagcaccttcaaaaaaaagccgggtacacccctatataaactggcacctatagtgtgacataggtgccttttcaagaatcagcaccaatgactatccaagtcattggtgccgaataatttgtgtggcactgaaatcggtacctactagaaaattggcgtggcgttttggcatgccggctgatagctggtttctctttgtaggttttactaaattttatttattttatataagattaattaaaaatgttatatttggcagggcctccaaaaacgttgtgagtagataaagagaggaattattgcattgggatttgataactgcttatatctacgggggtttttggggttttttttaaaaaattggggttccccaaaggcccccgggtgaatatttcgaagtatgggtgtgaatgttgggtgtttgggatgatatgtacatatattgggtagagcttggttcatcaagtactctctccatctcaaaatataaacatttctgaaggcttcgtgagaattaaaaaaatatgtgaaataaaatatgaaaaaaattaattgttgagaagataaagtaggtgaaaaattaaatgggagatggttgtgattggcttcatgggaattaagaaaatatgtgaaataaaatgtgaaaaaaaataatagttgagaagataaagtaggtgaaaaattaaatgggagatggggtaccgagctcgaattcgccct

SEQ ID NO: 107577 - DNA, 517 bp, Oryza sativa
atgaatcatattatatgtagataattaactttattggcactaaataatactccaatcaaggtgtgttttgttgtctattgttttggaaataatctcaatatttgaaaatctaattaagatcagttatagttttgctatttctcctagagtctcgatcatctgaattttgtagtttttaaggagttgagttttttgctactgtgccacaattttatcctagagtctcgatcatccaaattttgtagtttttagggcgttgtgttttttgctactgtggcacaatattttgctaggtgttgtttgtcagaaaaattggtatgatgataaaactgtaacggcatgtacaaataacaataaattgcagactgcacacagtagtcatatggatatatatatatacacacacacacacaaaaaaaagacatagggaaaattaattattactatcggtcacaaaatataataaattttagggtatgacacaaatatgaaggaagtaggtagaattaaattgggg

SEQ ID NO: 107578 - DNA, 696 bp, Oryza sativa
  unsure (1)..(696): unsure at all n locations
accctaatagtatcagagcttaacattatcgattaatggtcttgcgtgtgttcatatattttgctcttacttcaagctaaggctccctgtttaatgtctttgatgcgaagcacaaggcagcatggcaaatctgcttggcaaggtttatggtctgcccagccggcagcacttggtacgataacggagaagcgaagaaccgcgagaggagctcttctccgtctatgtgcgattgtcttctgttcatgtcaaagacgatggcgctttaagctggatgaacaagaagaagaggcgagggctcaactagttattagcggagtaaagaatttttttttttaaaaagtgaaaaaaacccccccccggggaaaaaaaaacatggtggatggggacttatctatgttatctatccatgacaatgatgggggctagttacctgacctaatgctagatagatcaattgaaagacagagctttatacaggtttgggccctttttctagaactaatagttctgttctggtggatattttctcccctattaattgtgtcgagttgtgtgttgcccctcaacgaacacttataagaagtattgtgtcttgatgcgtctatttacatgcatgtgtactgaccagtttctttacttncagaaaacaatcctttgcataataatatttggacccgatccattgggaccaatcct

SEQ ID NO: 107579 - DNA, 1392 bp, Oryza sativa
cctcaacgaacacttctaagaagtattgtgtcttgatgcgtctatttacatgcatgtgtcctgaccagtttctttacttccagaaaacaatcctttgcataataatatttgtaccgattccattggaaccaatccttctcagaaaatactaccattcattagccatgttattgcctttttttgagctacctgtcgacctgacagtaatggaaggaaaagcagttgctgtttcattatttcaaactcaatcgcatatatgcagctatatgggctatggttttaagtaggtgaatatctcattggtggacatactcttgcttcaatctttctttgtggtatagcatttgagaaacatcaattctaatgttggttaagtgtataattgaagaactagcataccttcaggtttcatgaaacattactgtttgcttacgaattttcatgtgccatacttgatatttggtgtcaagtttttctttctcaatttacaaaattcaaatagaccttgccatatgacaatttgaaatacttgaatatgaatcaaatttagatctcctttttgcccgcagcaacgcgtggggtgctgactagtttgtattgattaccttattctttttaaccagcttggacattttttattggttcaactagatgctttgtataattgcttagtcatgcttagaaacattagtatcattttatgcatgaataactaatgaatcacttatgattaatgatggttaattaatgatagctcatgatggttagtcgtgtttagttaattaatattcatattaaaacttgattaatgatgcgttgtgagctcatagttgtgttggttgtacaaatgataattaagaaccgacccgcaagctactagtgtgaagcatttatcgtactaaccacaagccagcatgagcgatgactggactatttttatagcatgattcattgtgaggtaccagactgagaagtgacagagataagcccatgggaatcgctggggagtcttttatgggttatggatagatgacaatccgggaatggttaactgctttgagttgtattatgtgaaagatcttgtcacgatttttcctttatagtaccatggtattatctcggggcatggcaacatgtgtggaaacatatcttgtgggtacattgctacacctctagctagagtaaaactattcgaatagtcatgcccaaagttatgggcaagcctagcaaatgcttttcgtgagtagtcccacactactcattagtgactaaattggtgatgataatttgttagctcttgttatggagtttatatctcttcagccgagtttgatagttcggagatggtttgggccttgtatgttgtatagtgttaatcaacattgttattta

SEQ ID NO: 107580 - DNA, 682 bp, Oryza sativa
atatttggtgtcaaggttttctttctcaaattacaaaaattcaaatagacccttgccatatgacaatttaaaatacttgaatatgaatcaaatttagatctcctttttgcccgcagcaacgcgtggggtgctgactagtttgtattgattaccttattctttttaaccagcttggacatttttattggttcaactagatgctttgtataatcgcttagtcatgcttagcaacattagtatcattttatgcatgaataactaatgaatcacttatgattaatgatggttaattaatgatagctcatgatggttagtcgtgtttagttaattaaatataaaaaaattttttttttcccccaaatttaaattttttaaaaaaaacactttgattaatgatgcgttgtgagctcatagttgtgttggttgtacaaatgataattaagaaccgacccgcaagctactagtgtgaagcatttatcgtactaaccacaagccagcatgagcgatgactggactatttttatagcatgattcattgtgaggtaccagactgagaagtgacagagataagcccatgggaatcgctggggagtcttttatgggttatggatagatgacaatccgggaatggtaaaaagctttgagttgtattatgtgaaagatcttgtcacgatttttcctt

SEQ ID NO: 107581 - DNA, 784 bp, Oryza sativa
atttgaattcaaaatcaaatttgaatcgggtatgtaaactttttgacttataaactttgggtctataaactttatgtgtataaactttatgtgtataaactttagatgtataggaatactatatataaaaatatttgaattcaaattcaaatttgaataggatataattcaaattgaaatttgaatcgaatatgtaaacttttgacttataaacttttgttctataaactttagctgtataaactttaaatgtatagaaatactatatataaaaaatatttgaattcaaattcaaaattgaatcagatataattcaaattcaaatttgaatcgggtatataaacttgacttataaactttgggtctataaactttagttctataaactttagatgtatagaaatactgtatataaaaaatatttggatttaaattcaaatttgaatcggatatataaacttttgatttataaactttgaatctctaaactttagatgtgtaaacttgaggtgtacaaactttaggtgtataataattttattaaaatagaaaagtaatgcggtgccaaaaaaaaggaaaccacgtcgaggagagggaggcgacccgatcgctaggggcgatcgcccattaggagtttcgatcaacagatgcactagtgaaaaaaaaaaggaagtggaagaagagacctgctggctggtcgactgcaagaacccctgattccagcacgagtagtacaacaacgagagccaagagccccatggagtcttgaattcctgataattaa

SEQ ID NO: 107582 - DNA, 588 bp, Oryza sativa
agggcgaattcgagctcggtacccatataagggtgctacatcccgcccatgcatgtcggtctcaatatgtacctaaaaccaaataaaacacatgagtataaaaatactcggcaagtgcaatatggaactagaaacacatatacacatcattggcaataaagcatgaacagaaggttttctttctttgataggaaacacattttcaaataccaagtcaaagaagatagtagttcccattccgggctggcatgaattgaaatagtatgttctataccggacaatagtgaatacatactaacatttgccggcaaagccgagtaagggtgatcagctcttgcccacaggaatttgaataaagaatcaaattgcactcccatgactacgcatggtagttgaataattgaaaccggaatcaaagaaccaaattaaaaccatattgcacattcatggcaaacagggaacttgaattatttacccagaaccagaatccgggatattgaaacatgaataacatcgtcaacatatgataaacaagaaaagcaaaattgtgtgaaccacaatatgaatataagcgggcacatgtcacat

SEQ ID NO: 107583 - DNA, 638 bp, Oryza sativa
atgtggtccgttaagcatagtgcctgtttctattatgaatcagcagtgatattttcaatttataccactgttggttggtattttcaaatcatatcattgttggttcatatcgagaaccgacagtgataattgaagtatcattgctgtttattgttatgaacattagtgttggctcggaataccgtttctatgctataatgaggacatgttagtagaaagaaggaattgtaatggggttgatgaggtgggagaaatcagtaccattgagttgagacctaacatctggagagtgtagaattagaagagtaatagacctataattgggacatattgtatggaggctgccttaagaaattaaacaaagaagttaccacgttagcttctatactaacaggtggagattaaaaattttttatggcatttctctttgggcaataggtttcataagcattgactgcggcctggaggcagacagcagctacctgggcgacctgaccggcctcacttacgtcccagacggcccgtacatcgacggcggcgagaatcagaaggtgaccaccgtataccgcaatcgctggtggggccctgacacacgtactctccacacggtcaggagcttcccatctgccaagggtcag

SEQ ID NO: 107584 - DNA, 608 bp, Oryza sativa
ctattttaaaaaacggaatctgtcggtcggagtttttttggaatttttcggaaacggaaacgaattcgaaaatattttctcggaaacggaatcggaaatgataaggccagtttccgtcggaactcggaataagtcggaaactttccagaaattttctaactaaaataccctggattcatttttaagcactgaatagtgaataccatggtgtttggctgttattctttaaaatatatttgttatgcaaatctgaagttatataagaatattttttttctgcattgggattaatcaacatcattactctcttaaacatagataatttattccatagattgtgttttgtgatgtactgttgagacttaaaaattggacttatatgattgtgttttatgatgaatcgttgaccgttgagacttgagaattggatttattggtttgaggggttttgtattctcataatttttcgttaccgtattcgcgttggttcgtttttgctccgttttcggtttcgataatattcgattccgttttcatatccggagtttccggttccgattccgattgcgaaaaaaaatgaaaacgaaaacgataatgatggttttcgt

SEQ ID NO: 107585 - DNA, 719 bp, Oryza sativa
  unsure (1)..(719): unsure at all n locations
gcgaattcgagctcggtaccccaaggaaagcttccgataccctacagaggccaaggtaggactgaagcggcaggctatccgcaagatggggaattgttggaaaaatttcaagacaacgctagtcacggagtacgtcctcaaccctgcccagccagaaccatttgtgaaatacccattcatcaccaaacccgtgtgggatgagttccatgccgccaaatcaacgaaagagtctcaggaaaaaagccagacctaccgtgatctgcaggcaaggaaccttcacctgcaccggcttggcaccggaggctacgcggggaaacaggcagaatgggacaaagggggaaggggggaatttttggtaaaaaaaagggagcccccttttttaacagcggaatctaacacccaaccagtgcttgctgatatcccggtctagcgggcaaggaactgggcaagggcaagggtgaagaagaatagtgacggaactctttcgttgtgaaatnccgaagatcaagcggtgtaccanaaaatcgnatgttgacacatagaataagtttaattatgcatgtatcttgttgttcgtctaacgcatcctaactgtactctaggtcgaactgaatgctgagagacaggcctcccaagaggtttgctcacaaaaacgcgaggatgacatnctcacgaaagcattgggaaacgaagaacaccgtggacgaacaaagggcatt

SEQ ID NO: 107586 - DNA, 660 bp, Oryza sativa
  unsure (1)..(660): unsure at all n locations
ggcgaatncgagctcggtaccccattttccatttaatttttcacctactttatcttctcaactattattttttttcacattttatttcacatattttcttaattcccatggagccaatcacaaccgtctcccatttaatttttcacctactttatcttcgtaacaatggatttttttcatatttgatttcacatatttttttaattctcacgaagccttcagaaatgtttatattttgagaaggagagagtacttgatgaaccaagctctacccaatatatgtacatatcatcccaaacacccaacattcacacccatactttgaaaaataaatttttttcaaaaccccccccgcgggggtgccccctttttggggggacataacaacgtagatataagcagttatcaaatcccaatgcaataaattgctctctttatctactcacaacgtttgtggaggccctgccgaatataacatttttaagtcatcttatataaaataaataaaattattaaaacctacaaagagaaccagttattacccggnctgcccacaggcacgccaattttttaatatgtaccgatttcagtgccacacagattattcggcaccaatgacttggatagtcattggggctgattcttgaaaaggcacctatg

SEQ ID NO: 107587 - DNA, 777 bp, Oryza sativa
ctgctgaacttcatggaatctctctcgttcatagctgggtcatcaacgtcacgtaacatatcttgcagcatatcagggtccacatcaaccatttcaccgcccaatggagatgggacaaacatgtcatgctcttcttcatctccttcttcatgaatgtctgtaccacttccgtctgcagctgcaccatcagtacccagatcttgctctccatgcatcacccaacatgtgtatctctccatgaatccccggcgtatcaagtgagcgtgtacttacttttcatcttcccacaaaatctcattcctgcaatcgctacatggacaacacatgtacttgtcgtttcttcttatcctattctcctctgcggctttcataaaacttaatatgccatctctatactccttgtactgacgcctcaagccagtcgtgtacatccaactccgatctatcgctgaacaatgaacaaaatattagttaacatctcataacataagtactactaaattaataggaaatatttagtagccttttacttacttttatgattttcctgtttttgtttgcaaaaaaaattacaaaaattcgcccccttcaacctcccaccaaaatagtgaacagtgggataaactacagtcaatggactgctggagtatatatagtgtgcaaagtatatctcaatcgggccaaaaaaatgtcatctctaacgggcgcacactaatctctaacgggcacaaatagaagcccgacacctataagagtcatcggtgacgggcattaagg

SEQ ID NO: 107588 - DNA, 971 bp, Oryza sativa
cccacttatattttcatcctggcttacagacatcaaagcatttaaaagatgcttcttaaagtgggtttatccaaaaaatgaagataaaaagaaatgaaaattgaatgaaatttgtctaatttaaaatttgtttttgttgggtttataacccattctaaatacaaatattcaaatattttagcaggactaataaaatgaatatatttaaaatttcaaacagaatctaacaaaaaaattggacattcataggaaacacatctattgtttcaacacaaaattttctcatgaattagaaacaacacggtttaaagtaatttaatttcagaatttatatgttgcaagtaaccagcgttcaaagcatgttaagtaagttcaattttagtgtatgataaagtgaaagaatatttttgatagaaaaccatccacacatggacattcgtaataaaattttacgtacatgcccatgcatgtgcgcgggctaccttcctagttatctaaaatagctataaatattttttctatgaaatgggttccaatcttttcatcatatggaatacgaccctaatttgattctataactattcatttagatttaattgtttttaatattaaaatgtgtaagggagtaagttgtaaaattaaaacagaagtaggtggggtgacattttctctacttataaagaattataaaggagtgtagatatgcaatgtcacgggtacccagttccacctgtgtttacagggagagaaatactatagatggtcgatgaaagaaaacaaagtaactacatttaagaatgtggctatctacatcacttgtatttttatctcaataatagagacggtaccaatgcgaagagcgggttttattcagagtactcctgagctgctatcttgactttctcttctctgcatacgttcctactaactacaggcagccggttatcaattaaagcaagcgaggtacaagt

SEQ ID NO: 107589 - DNA, 660 bp, Oryza sativa
cccgcttggtcgaattttacagtcggagccataagaggttcgcttacgaaaaaagatgaacgaattatcataggtgagatgtaaagatgttagcatgcgaaaaggtacgagcgctcaaaaaatccacgcagctaagtctccatctattattttatcttcatcccttaggctgtgtttgatacttggggttgggaacccaactccaccgcacggaaaacggagcggtccattagcgtgtgattaattaagtattagttaattttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagccttagtctgctcactccctccctcaccctccactcccctcgcctaccctccccctgatctacctcaggggtggaagccagtagtgaaagcggtagagggggcatcgacggcccttccctttcccagatctggccaaagaggagtaggacagcggaggcaacagctgcagcagaagtagaaggctgtggtagtagcagcagaagaagaatcaaaaagcagtggtggtggaggcggcaggagcaacacaaagcag

SEQ ID NO: 107590 - DNA, 592 bp, Oryza sativa
tccattctcggggtatatccttctcctgttcctgtttccactgttagcgctttactgctatgtgcgctatgttcctgttcctgatattcatgatgcctctagcatgttattgcgttattgtaatgttcctgttcttgacattcatgatgcgtatagtatgctactggttatattaagatcaccatacactgcttatgtcatgattattgctttaaagttttggattaaaatatgccgattcatgaccatatttccaacaattacaaccaccttccagccagaattcatttagaacctcagaccaggctttattggctaagctatgactaacctggttctgagcgtgatggatcttcctgacagagatttccctgtccccgtcaatgagcctccttatctccctgactaggtgcgcagaggccgacaggtctttttctcttgattgcagcatctgtgtcagcgttaaccaatctgtttccacttcaaaagggagcatagtccagtgaagcgctaatgcaattccttccacgcaggcaaggatctctgcctcaagcgccccattacagcgctccataaatctgcaggcagaaaa

SEQ ID NO: 107591 - DNA, 945 bp, Oryza sativa
ccatcccttgtcgacaaacatttccacccaaactaccatccaacctagcaccgaatttgcggtgccctcgcctgttctccagaaagccattgtgccgagtggcaactccatgaaactagttttcttttccggccaagtagacgtccttcttcgtaaccacttcgtgatcctgcatttcgctgacttccagaacaacaagtcccgggaatttacagtttccatcgacaacggcgtgcatagcagcccatacagtacaccgtacctaaatggtttgtcagtcaccggcagctggtccagcgattctgaaggcaagtataacttcaccattgctgcaactgccatatcagctctgccccccatcctcaacgcttacgaggtctacggtcgtattgtccatgacaatccaacaacgttctcccaagattgtaagctcgctatatctgtcggtctcggttgaggtacactaaacaaacattatcaactctccctcttgaactcctattttttttcctcgtatgctagttgatgcgatcatggctattaaatatgagtatggaataaagaagaactggatgggtgatccttgttttccacatgaatatgtttgggatggtgtgaaatgcagcgatgcaggtgataaaatcatggggataatatctctgtgagtatatttgaaaggtatgcatgtactagcattattaattgtatacatcaggctaaattttgttggattacttgaaattattatgcagtgatctttccaacagcgaattgcatgggtcgatatccaattctttcacaattgttactgccctcaagtacttgtaagtatatctgagatcccctctgccttcagttgttctgcatttaaaactcccaattgacatgactatgcatcatcttccattaaaaatgaaaaacaccgactaaatattatctagaggg

SEQ ID NO: 107592 - DNA, 1722 bp, Oryza sativa
ttgatatgacatgtaagtgcacagtaattttgataacaatgttgtataagttaatatctatttgttattttctttaaaatataaaattacagtcctatataactaaaattacatttgtaaattcaattgatatgacatgtaagtgcactgtaattttgataacaatgttgtgtgaataaatatctatttgttattttctttaatatatataattacaatcctatataactaaaattatatttgtaaattcagttgttatgacatgtaagtgtattgtaattttgataaaagtattgtgtaactaaatatgtatttttattttcttttgtagtctgttggatgtaaatttaagggtagaaaaaatatgggtgattttttcttagaaatcacccgacaaatagatagacaatcctgtaaagaaaaaaagaacagggatggggacactgatatcaaggaagatcgggagatatcaagttttccttttgagttacgccaagatgtttttctaaaatgaaaataacccattagcataaaatctggataattatatttgtaactaaaatttcttcacaaattacctctaggaaaaatctggttaatttcctgtcctataatccctggttctgtttaactttcagggctgagctaaaatatcgaataaatctcatcgacccaacctagtttggtgatattttgttattttaaacctttttaatttcaaaataaaccatgagaaacttattttcaaacaccggcatagcaagataatattgctacaccgataaaatataatgatgtggctaggatttttacctgacaatgttgccatgctagctgctcataatgtgataatgttgtcaagctacatcagtctaattagcatggtcaaaaggagatttgacaaaaaaagttttcagagtgtttactttcaaaataagaaaaatcatgtttgacagaggttttgactgtggtggaacccacttgtcataggggtaggctgtaagaacagagttttgaatttcaatatgctactttactgttttaaagaacaattgttgtgttatttttttccggggaaacccaaaaaaaccccccaaaaaaagggggggggggtcaatctttcctatctgagccatagctctccaatctgccattgtctatgtgggtccactgtttctcctctgttccttactctctagaaaaagtggaattatcatagatatgggtcaaaatcgctattaaataggtgaaagagagattattcttttacctagttttgatagtttttggcgaggtttactcattttcgtactgatgtatagtggagaccgtactgctgacaattgggccttgatgaggggggcattgactgactaggttgtttacctactctctcaagcaagttgtgcgcaaatcactatcaccttgttaagacttcaagactcttctctcctgtatgtccggcgttgacgggctttttgttatcctataaggtatcttcatcgatctccctatttttaactccctaaatctgaagaaagataatactttttttaaaggctccatatttctctgcatgcttcagatatcattttaattttgtgccatatatctcatccttctatatcttatcgatcttatactcccaagaaaaaaaagcaggggaagacaccatatgggagagcaatggagatagagatacacttttgactcatatttgag

SEQ ID NO: 107593 - DNA, 3726 bp, Oryza sativa
atatcaagttttccttttgagtacgccaagatgttttttctaaaatgaaaataacccattagcataaaatctggataattatatttgtaactaaaatttcttcacaaattacctctaggaaaaatctggttaatttcctgtcctataatccctggtcttgtttaactttcagggctgagctaaaatatcgaataaatctcatcgacccaacctagtttggtgatattttgttattttaaacctttttaatttcaaaataaaccatgagaaacttattttcaaacaccggcatagcaagataatattgctacacccgataaaatataatgatgtggctaggatttttacctgacaatgttgccatgctagctgctcataatgtgataatgttgtcaagctacatcagtctaattagcatggtcaaaaggagatttgacaaaaaaagttttcagagtgtttactttcaaaataagaaaaatcatgtttgacagaggttttgactgtggtggaacccacttgtcataggggtaggctgtaagaacagagttttgaatttcaatatgctactttactgttttaaagaacaattgttgtgtctttcgacaacaaggatcaatctttcctatctgagccatagctctccaatctgccattgtctatgtgggtccactgtttctcctctgttccttactctctagaaaaagtggaattatcatagatatgggtcaaaatcgctattaaataggtgaaagagagattattcttttacctagttttgatagtttttggcgaggtttactcattttcgtaccgagtagataaaaagggacagtaaattgtatttttttatcttatatttagagccaaggccgtccatggaggggggcgagcagtgcaaccgctgcccccaaatcgtggggaccaatggtgtgtagtcaatttatttgcagtatgcatcgggacaccaacgattatcaaactggtaaggttttaaattcggctatatagtttcataatttaatttatatgagttaaaccactgtaaataatattagttttgtaaatgatcaatccatgtcgtcaacaaactattggatagaatcgatattgatatcatcatcaaggacttcgtatctaaaaatatccgaaaaattttaagctaacaggttacaatgtttttatatattataatttatagacgcaatttcaatgttatcggcaatagcttgttgctgtgaaaactctggatcgaccctgtttagagctatggataaagattactccgccaacacctctgcctttacgaagtaatcattcatcattgccgtgtaaattaagatgtatcgtcgctgcacaaaaccatcaaatggagaggtcacgcatactcaacaaccaattacgcatatccatcaggcaagagctgaccgattacacacacccaagtaagcaagctacaacaaaagataaactcactcttatctaaaacatattttgatatcaatgagaattatatatatagtacttaaatctgggactttggtcttgtgttcacatgtaaactggacatcttagatgttaattaacaaagagcttgatgatcaagctaaggatggattacacaaagatgatgcctgattatgctatacttattttggagttcaccatgtaataacatctacttcaacctccaagagtgtgtgacccaactttacgttttactcactccgtctcactcacaaagacacgagtgaacttgacacagtcttgactaatatttaattaactttaaatttctcacatagtaatatactataatatttgtagcaacaaaatcatagtcatataaaagtaatttaaataacaatccaatgatattgttttcatcaaataaaacttaatttataataaaatatttattggtaaaatatttaaatagttgaattttagaatgtgtgtgcattttagtgagtgtgacggagggagtagtgtgcataatacacatggctgaaaatcttatcaagtttatttctgatgtaacaaatagtgtcatatggatttcccaataagaagtacagatcaaattacagaacggcttcgcagaatccaaacaaacacatgaatctaaatgcaaattgattttgggatgaccttggaactagctatctccagcaatttcatagccatttcatcccaactaggatggttgttcttagcataaatatccctagtatctgagtacttgatagactacgtcgatacaaatataaacccctttttgtcagtagcgtgacaataaatatttgacaaagatatgatcattcttcttcataagtgataactattcaccactggaaaccggccttcaagccattttcggttaattcataagagaaaagaattagagggatttattttacaagtattacaatgtgaaattaattttcctttaagccccttcaaaccaaacgaagacttacctcgatctacctctcttctgaaaggattcagatccaaacaataacttcaacagcggaaaagcaaataatgtgaagagtatcgtcacttcaggaagagtatgtaattaaccatttaatctatccgcatttgtagccatccacaataaacagacaagaccgattctgatatagtgcaatttatactatgcttcgtacaagttaatgtggcatctctctgtttccctgtctgtagtcggagaaaaaggaaagatcattatattaaaataatgatccagccttttttgagaaagcccaaaacagaggttcaaacgtaaaaacaaaactcagtacctaccctgaagtcggaggattaggttccctttcgcatcaacttaaaatcatatttggcaatttgtcaagttacagttttgaagtcttcgaagtgttaattgtactagtagttacacgtacagatctagtcatgccacttggatgcacaatgtgcctacattaatatttgtccgtactaaaacaggagagaaacacatatgcatgaacccaaaactaatttagtagtactattattcttgaaaagtctattttacacaatcctaaaccctttttttcaagggaacgagcaggagctctactatttcaattaaaggaggggagaaaaatacaacagtttcagatcaccccaaggaggtctgaacagggtaacagggtaacaagcagagtggttacagggagttttaggaaatggaaagcaactaacatcagcaaacggcgtaagatcacctacgttgtgttatactgggcctgttcccacgccttgcacattgagatgatggaatcagccacttgctgaatagggctgcacgaaaaactcgtgactcgtcaaattggaattggataagtcaaaatgtcaaatgtgtagtgcctccattctcacacaaaggacggcgatgctgcagcggcatcggatgagtggagtggtgggagcgtggacggcaactcgcaagcaggagctcagtggtcgcacaggccctcgccaagttgagctcagaggaagcgtccctgtcaccctccctcgacggggacgtcggaagcgagtgcaggcccttacattggcagcgatgtgagcgcatgttctcgttggtgtgggatatcagtggtgcacgagctcgcccgccaacccgtcacctgtcggcctcaactcgtcgcatcccacgcccgcgcgtccatgtggtattctcatggcatcgcttgc

SEQ ID NO: 107594 - DNA, 1135 bp, Oryza sativa
attggagcttccaccattgcagacccacagtcgccattttgggtggttgagctcgcgagccaaacaagctggctcgagctaggccacgagccaagctgagctagctcgttatcctaacgagctagaccgagccgagctgagctggctcgacatccacagctattgcgatccgtgtcgtaagcaccattgaagattctcacatttctttgaagccagataccccaagtagtatataatgttgtgccattgaaaatcctttttggcgctttgatcatctcattccggcacacttatcacctgtacagtaaattcccatcaaatagagatgttgccagcatatggagacccagtctcatccaaatcatgctccaaacctgtttcgcgaaaggtgcctcgctgtctctgtctcaagcccgcagagggagcaaattgggttgctttcccaaccctggatctatagtttgttggaggttaggattttcctttgcaccatgagccagccgaaaaatttgcatttattttccatctttgccttccaaatgtatatccgaacctatcatcctgtatgcttcctaggaattggacccgataagctgaattggctgagtaagcaccatttgatgtccacctccatgttaatttgtcttctctctccttgtgaaggtgcacctgctgaatgagctgccgcaggagaatgaattctctaacttgagtagtcgagttcatccttctcatctgccttagccagaaatgaccttggaattcccgtgctactgtcctgttttttcttttctggtcacgagttgatacagacatgggattagctccttgggtgacctaccatctatcatcggtccttcacaagctacctatccgtttcatcacaaggtaggatggaaccttaccatggtttgtcatatgcgtccaatcgaaccagagctaccttagttgcaatgatccgtcgaaacaatccaaatcagttatacctatgcccgctaaatttttttggcagcataccctttaccagttcactaagcaatgtccgtcgtgtgtctgttccgaacctgtctagaggaaacctcgatgaaatttgtccatattgttttcagtccacttctttaggtgggatactgtg

SEQ ID NO: 107595 - DNA, 508 bp, Oryza sativa
cgggcggcaaccaggcgagaaccaccactagcctcttcccttcctcctctccacctcgccgccacctaagtaatcaccggcgaagtcgagcgggtgcaaggatggcagcggcggggctcccgaactcctctcacgggtgtggcgcactggggtgctaccaagaccgaagggattaccccaagtggcggtcgtcggtggccagattaggtgttgttttggctggattcggtccccacacgaccggatctgatgccccagctagtggatccaaacggtggcaatgaggaggatgcacggtggtccaacaaggaggtgtggagaagctggggtcgcgcgatggccgaggtgatggagcagcatggaagcgtcgacggagtgcgtgcaagggtgcagcctaggcaacgacgcttgttgtgggagttaccgaccttccaatcgtcattacaaggctataaatagagaagagaagatcttcccacacacacttaagaagcatatcttaggctac

SEQ ID NO: 107596 - DNA, 671 bp, Oryza sativa
atcatgaatatcaggaacaggaacatagcgcacatagcagtaaagcgctaacagtgggaacaggaacaggagaatgatataccccgagaatggccctccgctggattatgaggcagaattgcctccgttgatgttgttgttcgcgccaccggctccagctcctggcggcggcgcaccacctccgccatttcctccagcagcggcggcggcaactccagacatggcgagcagtcgtgcgggaggcactcccaaaaaacctgatcatccgcctacccggtgcagatctcaggtgaaggtgtggtttcggaggcactgctccttccaatctctcgtgctcgcaagagatcagaagcgaggaagcgagaacagcataggcgcggaggaggaggaactaacaccgggaaagaagcaatcgatcagaacagatcggactcgcggcctccttatctatcaggagagagaggcaatcgtgaaaacgtggacgcgctgttgcggagagagtcgtgggaacgtcggttagtggctgcaaaagaatagcgacgtgacgcacacacgccggtagccagccacgcctcgccctcgccctcggccacgccccggcccggcccgcgcgcgcgtgcgtgtggcattccgacccccacctcaaccagtcaactgggagcctccaataa

SEQ ID NO: 107597 - DNA, 649 bp, Oryza sativa
gagattgcataagtgattatagtgtgtagaagagattcatactcagagtcaatataacccataatccagctgcaacggctgaaatatgagttccaaaatctgctatttttgctttaaaattttgacccaacaaaatgtggttcgccttcatatccccatgaattattggcaagttgcaacccttatggagataatccaagcctacaaataaggaaactattgttagaagaaaagatgagccctaacacttttgctttgttttttttggcctgctattatagaataccttgtgcagctttaagtgcaactcttacgcgtgtctttcaattcaaattttctcccataccaattttcccttttaatatattcacagacaaacagtttgaaaggaattctacgagcaactttaaatagcaattaagggagttgtaaaacactcgtctcttgtgtgtgtgcacacatcggcagggggagcaataacataaataatcaaaatagtttgggcctttaacaacaaaaagtagttaatgcggtgatcctcaaagatcatactagatatcactttgtttcataggggactagcaaagcacagatgttaattacacctattaaaaaagctgtgcatcacatatgcattcatgttttaaaa

SEQ ID NO: 107598 - DNA, 1278 bp, Oryza sativa
aatacaaagttattgtatcatgtgcatcttgagatgtatttgatttttcttcatttcgtacatttgggctgaggcatttcttttttttttgggtgatttttgacatctgtgacgggtgagaactaaaaccagtcacagctgtttcgtcacctttgacgggttgcaaagagtcatccgtcacatgtgtgagtcacctgtgacggctatattttttagcccgtcaaaggttttaattaccagtgacgggctttcacccgtcaaaagtgaggtgtagtcatcagtgaccacttgtctctgaccagaaccaaatccgtcaaaggtgagggttagagcccgtcacagataactggatccggcctagtgatcgcacgagctccatagttttgttttcttaaaaaaatcaataccatctaggtatttactaattcagactgcaattgttaaatcatccaaacatgacaattgagcttccgaggacaacacaatatgtattaatttaaacttcaaattattaaatcataaaaaactaattattactccacaccaacaagaaatctatagttgatattatattattactttttcatattttttaaatttggatttattaaatcaaaatggcatatataatgattcaaacgaagtgcaactacagtttcacaccaaaaaccgggactactttcaaattgaatctatttttgaatcagtgtgcatttaggatccttttttgtctgtatgaattaaaatcattttattttcttttgtaaaaatcagtatcgctgctggtcgtctcccaaacatagctggtaatgtggaaccgcgagtaatgcccagtttgtagtgcgttgtttagctaaattaataaaatcagaaaatagcttcaagtgatatattggttaacgtacaactgactaactgagctgcaaaatgtacaagatccaaggaaattaagaacatatataccttactaaattgtcatcgtcagggctagatcccacgttgctccgaacatagagggagagtgacacattgcccatgacagccgggtagggcaagataccgagaggcctcaactccaccgtggacacgaacggcgtgccctggccgatgttgatgaggcaaaccggcgcctagctcgcccatgccacgaacaccgcttcgtgaacattataaccatcatttccgtcggtggtgtctatactcacggtgtcccagtgtttcacaccaagggtaaggttgaaaattagcgatgggttgtccatgccgtcgtagttgcca

SEQ ID NO: 107599 - DNA, 535 bp, Oryza sativa
atactagggatatttatgctaagaacaaccatcctagttgggatgaaatggctatgaaattgctggagatagctagttccaaggtcatcccaaaatcaatttgcatttagattcatgtgtttgtttggattctgcgaagccgttctgtaatttgatctgtacttcttattgggaaatccatatgacactatttgttacatcagaaataaacttgataagattttcagccatgtgtattatgcacactactccctccgtcacactcactaaaatgcacacacattctaaaattcaactatttaaatatttaccaataaatattttattataaattaagttttatttgatgaaaacaatatcattggattgttatttaaattacttttatatgactatgattttgttgctacaaatattatagtatattactatgtgagaaatttaaagttaattaaatattagtcaaaactgtgtcaagttcactcgtgtctttgtgagtgagacggagtgagtaaaacgtaaagttgggtcacac

SEQ ID NO: 107600 - DNA, 591 bp, Oryza sativa
caagagaaaggtgtagagatctttctcaaatatttattactccctccattccaaaatataagacacaaccacccataacccaaagatcaagaaacaattattattatctcctagtttggatcaccctaataaatgtaatgcatgcatccaatagaattagaaattttaagggtggatgatttaaaaaagcaataatttaatggagaagaggtcctaattaattgtatgcatgcatgtatgtcttatattatgaaacatcaaaaaaatagttggccttatattatgaaacggagagagtatcacactactgacaaaaagtggtttatatttgaatcaacatagtctatcaagtacttagataccagggatatttacgctaagaacaaccatcctagttgtgtgatgaaatggctgtgaaattgctggagacagctagttcgaaggtcatcccgaaatcaattcgcatttggattccgcgaagccatttcagtaattgatctttacttcttaaggggaaaatcaaatgacactattttgttgcatgggaataaactgacaagatttcagcgagtgtattatgcatactactcc

SEQ ID NO: 107601 - DNA, 614 bp, Oryza sativa
aatgggatgtgaatggctgtgatttgttagatctgtgatttggatgcgatcggtgatttgtgatgcgatctgtgatttgtgaatgatgttgggagatatgtaatatgtgaactatctgtgatccatgctatctattatttgtgttttgtggtgtgacggtgattgtgattttttatcttttattttaatagtgatttggaaatattgaacatgagaaaagaaaaaaaagaaaaaaacatttagtcccggttgattacattaataggaactaaagatttagtcccggttggtgttacgaaccgggactaaagatgcatttttagttccggttatttcaatcgggactaaagatggacatttttagtcccggattcgtaatcccggttaaaaaaccaggactacagagggttatcaaccgggactataaaccctttctccaccagttatttatataaataaatttttccaactttgtttttttattttttaaaaaatttatggtgtagtaggaagagaagaaggggaggaggatggaggggggggagaggagtgtacaggggatggggatcgatcgcccattagccacagccgttgttgatcacaccggctatact

SEQ ID NO: 107602 - DNA, 720 bp, Oryza sativa
tcggagatcaaaatgatattttctcgaaagtgtataattaggaagctgtagataatatttatatctattttctgaccaaagggcgcgattttatctcaagtggtttagatgatacgaatttttgagtataactgttgtttttatgtcataatctggatagtaggtaaattgaaccatttttggtgggataaacagtggaatcagccaagacgcctatagacaaagttgtagaggtttttcttagctttccatattggtaaagtacaccctgattgggcaagtagaactccagttatgattgttttagtgcggatagtctgaatttctagacaattttttttttggggtttttagaaaaaaaaaaaggcccccctttggcccttttcaagcgcaaattagaccattttaatggcataataaaaatatgatttccacataagagttgtaggccttgttctgtagatttccaaaatgtatttgtttgcggtaatagccttttcatatttcaagatataaatgtttgaagcaacaatattgtttatagtgcaagcggcgttccttgttattgcgttttgatgggatagggcagtaggttcacctttttcattgttttatatgcatgttgaatgtgtttgctgaggttttgtttgtgattaggtggtggtttttcagatcgtgcatgataccaacccttcattgggtaccgagctcgaattcgcc

SEQ ID NO: 107603 - DNA, 1461 bp, Oryza sativa
cgcatcacaaatcacagatctaacaaatcacagccattcacatcacattaagaaggaaaaaaagaaaaaaaaggtaaaatatcccatgccggccaccgccggggcgggggccgcctgccaccgcctccgcgcctccgccgcctgccctccgcgcgggcagccgccgccgccgggccctccgcgcggggcagccgctgccggcagccctccgtacctccgccgcctgccgccgccaggacggccctccgcgccggccgccgccaagaagacaggggagaggggaaggggaggaggagaaggaggaagaggagaaggactgaggaggagaactagtggaggggcagaaaagctaaggataagactgaggagggacagacagatcgacgcgccaagagataaacatcgcgccggcttggggtgatttttagtcccggttggtataatcaatcgggactaaaaatctatctgtagtcctggttgtttataccaactgcgactaaaaataatagggacctgacacgacctgacaacttcttcaaccgggactaaaaatgatctttgtcctggttggtaacaccaaccgagactaaagatcaaaaaatacccctcagcttttaaaccgggactaaagatgttttttagtcccggtttttattggaactgggactattgtggaatttggccgaccgaccaataatggtttctccaccgccggggcggccctccgcgccggggcagccctccgcgccggccgccgccaagaagacaggggagaggggaaggggaggaggagaaggaggaagaggagaaggactgaggaggagaactagtggaggggaagaaaagctaaggataagactgagtagggacagacagatcgacgcgccaagagataaacatcgcgccggcttggggtgatttttagtcccggttggtataatcaatcgggactaaaaatctatctgtagtcccggttgtttataccaactgcgactaaaaataatagggagctgacacgacctgacaacttcttcaaccgggactaaaaatgatctttgtcccggttggtaacaccaaccgagactaaagatcaaaaaatacccctcagcttttaaaccgggactaaagatgctttttattcccggtttttattggaactgggactattgtggaatttggccgaccgaccaatgatggtttctccaccagtgaatactatatataaaaaatatttaaatttaaatttaaatttgaaacgggtatgtaaacttttgacttataaacttttggtctataaactaatatttgaattcaaaatcaaatttgaatcgggtatgtaaactttttgacttataaactttgggtctataaactttatgtgtataaactttatgtgtataaactttagatgtataggaatactatatataaaaatatttgaattcaaattcaaatttgaat

SEQ ID NO: 107604 - DNA, 1022 bp, Oryza sativa
aactttgggtctataaactttagttctataaactttagatgtatagaaatactgtatataaaaaatatttggatttaaattcaaatttgaatcggatatataaacttttgatttataaactctgaatctctaaactttagatgtgtaaacttgaggtgtacaaactttaggtgtataataattttattaaaatagaaaagtaatgcggtgccaaaaaaaaggaaaccacgtcgaggagagggaggcgacccgatcgctaggggcgatcgcccattaggagtttcgatcaacagatgcactagtgaaaaaaaaaaggaagtggaagaagagacctgctggctggtcgactgcaagaacccctgattccagcacgagtagtacaacaacgagagccaagagccccatggagtcttgaattcctgataattaacccaggagcgatctatcggagtttcgaccatgaccaataactagctatatctccactgcatacactaagtatgttgagacatgccgactggcgtacgtttacttgttacaagccacagcgtacatctcggtcactatatatattggctgcatccattattggttcaagccctgggccgggtatacttcactgtcgacctgtcgttggtgccctaagctgattggcttttgatttcttggagtttttgttaaagcattaattctccggactttggcagacttgactctttctttctacttcctccgttccacaatgtaagaattcctagcattattcaaattcatagagatactaatgaatctagacacatataaaaaagatatacatcaatcaaaaaacatatacatcaatcaacacataaatctaggtaagacaaaaggtcctacaatatgaaacggagggagtactgcatatggcaaatggtgttactctatgtcacaaagtcgagcaatgcatgtgagacaataattttttttaggtttttacacaggagggatgagattgttcgcgtggtcctaggataggaacgatg

SEQ ID NO: 107605 - DNA, 521 bp, Oryza sativa
ttaaaatttatctctatagtaattgggcattgcgagtcagctgccacattaaaaaaaagataaagacatgattaagtgatcatatcatcgtgaccgtatattatatactgagaatttgtattgcagataccgtgacactttatattagttcccttttctttctaaaattttgaattaatgaacataaattgtatctatttgaacttagttaacactttcttagttaaatttttgaatgcaaaatttgtagttacaaatagtgactaacatggactatttttgcatcgtaatatgctataattttgacaatgtaatttccgaactaatttgtgcattaaaaccctcatccaggaatcagccgaggtacacaaactgataatttaatgtacagattcatcaaaataactaaaacgataaatacttacataagaggcacttagttctcaccatgaagaaaactgcagcggaaaataaaatctagcgaagcttcagctcactcccacaggcagacaactgggatc

SEQ ID NO: 107606 - DNA, 518 bp, Oryza sativa
tgcatgcctgccgtcgactctagaggatccccggaggaggaggagaggataagagaggaaaggtggagtggagtggatttggtttttatatttagtttgcagtgatttttccaagtggacctcttaaggaggcgtctgtaaaaatctgattttcgcatgtggccacttaggaggctcgcctgaaaaggttagtccatttttacaggtggatctcttaagaggccgcatgcaaatgttattttgcatgcaacgctttgaactgaccccgtgggagggatttttgtaggcggaagcagttatggtccgtgtacaacctaaaaagggtctcatccagaaaaatcaattttgtagtggtggctgtactccgtatgagatatcctatctcacatgattagaattgggaagaaatccacgtaagtaaagtttttcttaccttgactttgcaatgtgttatgcaactacgcctaaccaaaatcaacaaaacatgtcttttagacttgtaggtttcatgactgcat

SEQ ID NO: 107607 - DNA, 631 bp, Oryza sativa
cccgcggcaaatgagaaaatgatattttgtacgttttcgtttccttgagttaataggaaagccgcactattaagaggaatgatgcattgacatacgaggagtgatcaaagtgctcaaaatctatttttaaaaggtgtttctcctcagtttggtgtgttctggattttttcggagttttccgaaactcaatttcggactttccgaaaacacacagaaccaaattgtcgcttctggaaattttcggatatgtccgaaagtgattttcggacttttcgaaaaaaactgcgaaggcaaaagtggttctgtatattttcggacttgtccgaaactgattttcggattttctgaaaatcatcagtagagtcaattttgcatctgtatattttcggacttgtccgaaagttattttcggacttttccgagaacatccagaacgatgttgttggtactagaaattttcggacttgtccgaaaagttttcggaatgtccgaaaaatccttcgttgactttgctgttggtgctgagctggaattttcggacatgtccgaaaatctttcggaatatccgaaaatctcaattattgtgcataacgggcagaatctgggctgtggctataaatagccccctccc

SEQ ID NO: 107608 - DNA, 675 bp, Oryza sativa
aggcgaattcgagctcggtacccatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtcccaaaaaaaaaatttttttttttttaacccccccccaaaaaaaaaattttttctagaaacttttatgattgtactctaactttgtcacaagtttattatccaactgctaatataattttgcacaaccttcttgaaattgctactttatttaaagaatacgaaaatgatgacgttctaactgaacctgtctttcacatgaacaaaaatatttgaaatattgcgaaaaatatacctatgttgtatgctcttgcttttgttttagatcctaggtgtaaattaaggggattgtctgctattttatcacttgttggagatactatagggggatccctctagagtcg

SEQ ID NO: 107609 - DNA, 698 bp, Oryza sativa
  unsure (1)..(698): unsure at all n locations
accctattatgcagagatctctccaacagcgagttgcaagggcagatatcctataatttcacattgtttagtgccctcaagtatttgtaagtatacataaaattttcactgcctttcattagccacatctgaaattcctgactgacattaatggggatagttttatgctatttaaaatcaccggaaaacaccaactaaatgatgagcagttgcattctggtgcaattaaaattatataaacccatcctaactactccctccgtaccattttaagtgcaaccatggcttccgtgtctaacttacatcgtgcgaaaataaatttttttggggaanaaaaaacccaaggagccaattttttttttttcaaagaacataagttatgagtaaagtactattcatgttttatcatctcataacaacaaaaatactaaataaaaaattttaaataagaccaacgatcaaagtttagcgtagaaactgatagctgcacttaaaatgggacggacggagtaggagtaagaactagtggaggtttattgcatcgcatgtactatccatgtggtgccacatcttcgagagaatgagactagcagtaatcggtttcatatgtagttgagggatgaaaacggaccaaggctacagttgcatgaccaaaagtaggcttttctcttgtagttttaaatttgaaagacacatat

SEQ ID NO: 107610 - DNA, 989 bp, Oryza sativa
tttgccttaaacgaattcttttatgtgagattgccacttgcatgatggagtataccggtttactttaaaaaaaaaaattcgagtgaattatttcatgtccgattggcactaagccaacaatcttcacgcttttgccatttactagtaatcatgcacgtgcaatgcacgtttttacatataaaaacactcaaaaattattgcattttcatgttgtgttacccaaaacacacaaacatatttttaagaaccggtgattaaaaagggtcacacttggtgcggcgagggaatttgagactgggaactcatgatcccaacatattcaccctgataaaatttcactaaatattcttttgagctattttagagacaaaattattgtttgttctttgtatgcctctaccctgcaacaatcaatcgttaagatcatctgaaaattggatgagttgaacaatctagctgtttgagcatacaactccaaggtagtataacagggaattggactaatcatattgaaaagctatgtgctctttagaaatatgaaatcgaacagaaaaaaatataatattgaccaatcagagatttttttaatttttttgaaccttttagtttttagctataaaaataaaccttcccaaaacttattttcaaataagttccttttttgccatgcgcaaatgcgggtggtgtgactattgtttcgccaagcgaggtgaggcgcagtgggtatgaaggttcagatttagaaataagtatcgagatggtttatttttaaatttaaaattttaaatgttcaaaaaataacaaaaattcccaatgaaaagcgtgtgactatacttccattgtctgttgcataataaccttttacctacctaagagggtggcactggagagcacaatcatgtatagttctcttaacaatcatgtatatgtactttcaaagtgcaagtcacaaaggcaatatgatacatccaccgctctagtgtatttat

SEQ ID NO: 107611 - DNA, 609 bp, Oryza sativa
  unsure (1)..(609): unsure at all n locations
ccctctcaactttagttgtttggtgcatgcatccaaatatataccaacgctagtggaaatgattagtaataaaccctaccactcagttgaataccatattttattctattatatgtaggtattgatggtcatatactatgatttaaggatcgtcgatagtcacgactagccgtatgtcaaaaaatgttcaagccatgttttggccgactatgaaaatgtttttctagtagtgttttggagtgcagatccggcgggcggcggtgtcaatgaaatgggaatggggggtccccatttccccgtcaaaagcaaaatttttaaaaaaatttcccaaaaaaaagggtttttttaacccccccccaaagaatttccgaaggggtaagctgtaagaacagagtttcgaaattcaatattatactttagtgttttaattaaggaaaattgttgcgtctttcgacaccaagangtagagtagtggtcctatccatgagccataactcccccaagctgccattgctatgcgggtgcactggttctactttgttccttactcttgctgatgcgaaaaacacacactggcctgggagatctacttagctccagtgcaggacc

SEQ ID NO: 107612 - DNA, 559 bp, Oryza sativa
  unsure (1)..(559): unsure at all n locations
acacttagttactcaaagctattttgtaaacacgatcctagagctacacaatattattaatcaaggccgtggacccacacgaacctgccttaacccaaggcctacgatgattcagaccgaactggcaactccgaccctgggtggttctctcccaaggcctttcccgggttttcccccccccagaaaggggccccccccaaaaaaaacccccccccccccggccaaccattcatattttagtgtaagcaaattttaagaattaaaccactaacttgggtacattgctaggcttgcccatatccgaaggcactgctattcgaatagatgtactctgatcagaggtgtacatctttacccacaagacacatncttactccgcattccatggccttggaacccgtcgtaaacatgtgacataacccttcacctatcctagccgtgaacaaaagtaccgacccaaccctgcctacggccggtatcccgggataggcaggccaggattgagcccctagcaacaagatctagaccgggtgcgccacacacataggggtgagaccac

SEQ ID NO: 107613 - DNA, 1116 bp, Oryza sativa
tagggcgaattcgagctcggtaccccataccaatttttctgacaaacaacacctagcaaaatattgtgccacagtagcaaaaaacacaacgccctaaaaactacaaaatttggatgatcgagactctaggataaaattgtggcacagtagcaaaaaactcaactccttaaaaactacaaaattcagatgatcgagactctaggagaaatagcaaaactataactgatcttaattagattttcaaatattgagattatttccaaaacaatagacaacaaaacacaccttgattggagtattatttagtgccaataaagttaattatctacatataatatgattcatttctggcatattaaccccacactttccttgtgtagtctgcaaatgttgttggctgggcatctttcataggacagattgatgaaacacaaacaagtcaggaaggtgcaaaatccctgaaattatgctctgaattgagtaagactattaaaataaattaatctacacatgtattggctgcattttgttttatcatgaccgttgatcatattacgaatttctgcaaataaaatataccttctggaacaccatagggtattcttgatttttttaactttaagttttcattccaaattgagtacaacttcaagcttattaattcctgagtttggaattattgaattaattaaaacgataaattcaaactccaccatgacaacaaataggtagtgagtaattcctgattttcaaattattaattagattatgaaatgctatagtggacactgcaaaccaaactgaccacaatccattatgtaccaattattaattttagaaaaaaaatcatgaaaaatctataaatcagagtccaagccatgtacaactcaatacttattaattccaaattttattcattagattaagaaaagaactaaatcaagaatccaatattaagtaaaggtattactaattaattccatcttcgcaaattattaacctaagaatatgaaagtaacaaatgagatgatagctaagatgtattatatatatactttataatagctaatttgaattttgaaattataaatttgaaaaatcgttatgtccttagaa

SEQ ID NO: 107614 - DNA, 507 bp, Oryza sativa
ctttttcttcttgagggaccagatcgatgtggtccttcagaatagtgaagttccgcctccctaggactccgcatatcgtagggaactttttgacagctttcgtcggagccgtcggatatccaacatcgtccatctctgttatggtgtagacttccttaggaatcttattctgggtcctaggattccggctcgatgtagtcccagtagtggccgtcgacatcggttcgccttgctgtgacatgtcctatgtcactgttgtacggggagaaagtactttttaaacacaaaattgcatctacacacattctcttatggtttgatatacctctatctcctacctacgttcgcctcatcgacgaaaccatagcatccatactcaatagggccggagcagccgggaactcgacctcgacatcagtataccactcgaacttgctatcaatgtcactaacataagatagtggcaacggtagcaagttctagtgggatatggatgtcgaggtcgag

SEQ ID NO: 107615 - DNA, 901 bp, Oryza sativa
ccccgatagcttcgctcggtaccccgtcccaggtgatcacttatcaggtctccatggcgctcctggttttgctcgcttactactacgaaaactctttttgcatgcaggcgagaagcatatttgcatacggttgtgcccatcgtatgggtaagaaggtctgcaaaaatcacgtttttcacatgcggccggcgtaaccgtattttcacatgtggtcgcttatactggctacatgcgaaaataaattcagcaataaaaaaaaaaccaaaacaccctcccccaaccctagctgccaccggagcgccgtatccccgccgcccgagccaggcgcacgtcgttgccggcgccagatccatcactcccgccgcccaccgtcgtcaccagccctggatctgttgcccccgccgcccaccgtcgtcgccggcgccggattgacagcccgccgtccacgccggcgcgggatcggctgctccaccacctgttgtcggcgccaacgctggatccgccagccccgccgtttgcgcaagggaggggcgcccttggcaccgaatccgcatgaggcggtgccgcccctgccgccgtggcggtgagggggggagggttgcctcgtcgtcgttgtcggcgttggcagtgagaaggggatggcggtggcgccgctgcccgcgttgccgcccactcgctggatccactgtcccaattgcgcgcccgccgtcgccgtagctgcagccgctccctagggtgacgaatctgaccttcccgagggaggcgccgcctgatccgccgcccttgctcccggctgccggcacccactctcatagagggagagggagaggacaaaataaaaagagagggagaggagaggtgagagagaggggggagagtgatataatagaaggggtgagag

SEQ ID NO: 107616 - DNA, 1256 bp, Oryza sativa
  unsure (1)..(1256): unsure at all n locations
aacgggtacatactccctccgtcccaaaatataatgccacatccacccaaaatcccttatattttgggatagagggagtataatatatcacgtgtgttgattttttattaactagcacctttaaatataataaattaaaggtggtggtttttttaaaaaaccgatatttattatattggtgccgatttttctctagaaccgacacctatttattcataaaggtgttggttgtcgattttagttggttcgacacctatagtgttgtatgctttgtgcgttttcgtggtagtgacactagcaaaagtttgcttattagacattgcactaaactagctgaactcttgtttaactattgtaactcttacgagtaacaattaaggatttaccactaaaatcacatatcatagacacatagaaactcatatgttatagactgtaagtgacaaatctatcacatcttaaaatgacaatattaaatgcccccgtactcttttcacatcttaaaatggcaatattaaatgcccccgtactcttttcacagatggattgagcagacgacaaggttaattactacctctatcccaaaatacgtgtcggtctggattgtttagcatgtactaaggttaagagataaagactataataccccttaatagataatgtatattttgatttgagatggtggttaggggtagaatggaaagaaatttgaattgaaagtggttgatgtgataaccattttggaacaacttttgaatgctagaaagactagtatggtggaacagaggaagtaattaagggccagtttggtttggtgccataccaaaatcttggtgtgctaaagttgcaaatttggatggccaaaacttttagattttactatctaagagatgttagattttactatctaagagatgtgttgttaaaatttggcaccaatccaannnnnnnnnnnnnnnnnnnnnnnnnnnntgaattggtaggcacaatttggaaccaaaccaaactagccttaacgctttcactcaattattaattggaactagcccgagatcgaacggacctcgattggctgaaccataatgcaattaaccagagatgagaggtatttctgaaaatattgatcaggtggcaagttaatcttccccattcccatggtgtttaagtaaacatatgtacttgatggttcattttatacacggaatgttgaaaaaaaaacagaactttagggatgtcccatactttggtattttgat

SEQ ID NO: 107617 - DNA, 1042 bp, Oryza sativa
cagcaacataagaatctctgagcatcttgctctgctctccatttgttttttatctgttcagatgcaaccagagtgcagaaggggtggcgcagaaggtctggaacttctccaaatgcaggggcatgtgtagttaccgtttatacaggtaagccatgtgaagaacatgcatgccatggtagattataattttaaggttagatacttagatttgatccttttaatttggtagaaagaagaattgggagatgctggcagagatactggatcatgctgtcaatacgttgggttacacttccgtccataaattgttgaacaagggttcatatgtggtggctgttgcagagatgttgacatcaacccctctagaggtgaagtccaaatgatattttcttcacaagtaacacaaccttctggattgtatatttatttttttagaacacgcaggagatctgtgtatcatttcattaagatagagggaaaatgattgcatatttaaaggcattgccaagtccaaagaaacaaatcataatatctagttggtggattatttgtcacttctactaaattaattatagatacatccaatttgttaaaagcagtgtatcctgtagatatatatttgtagtcaaaagatgcaacaagctctctttcgcatgttgtttattcataaagcccatagcatcgttgcaaacttgcattgccgcttgctttttttatcatatatagtctattaatctttctcttgggaagtatcaaaggtgtaaacttaaaattttacttattttattgtttgccccaaagaagaaatagaaccaattaatttataagctatgctaggcatgaaaacattacattgtgtagttcttttcgaaaaggagcatcatcttcttttagaatgatttaagacctgaccaattaaggagatacaaaaatagaaatcacatgtagattggttgctgtcacatttaatgatagaaataagttagataaatccagttcttttgaaagcacttcaatcctatagatgccaatagaaataata

SEQ ID NO: 107618 - DNA, 2783 bp, Oryza sativa
gagaaaccagtgaactcaagaggcaggtgggtccgggtgctcagtgtgttattatcattcgggaagcctcacgtaccttctggcgtgtggattacttgtttttcttttttccaataaaaaaataaacttgtttttcttttgagactaatctttataaacgagtaaatgggagatgaggtagcaaaatcaactacttccttcgtttcacaatgtaagccattctttatgttaataaatctagacacaatgtaagtcattctagcatttcttacattcatatttatgctaatgaatctagatatatgtcattctagcatttctcacattcatatttatgctaatgaatcttcgcataaatatgaatgtgagaaatgctaaaatgacttacattgtgaaatggacggagtataattttatttttcttaaaaaaaactctaaatagtttagggctcccttcgttcgaaatgtatagtaggtgaacgttcgccgactaataatctagcgaatcgctcagatagggaggattagaggaggcgggatggagtggtatgtgttctttcttttctaatttctcttttttatacgattttcctggtacgtatcaagcatatatattcttatctttccaatttttcagtttgcctttatttacgtgatcctcattgtacgtcaagatttcttttaccttctttttagatttcctagttttattaatagagatatttttatatgaattattcacgtgaaaactttctacatataaattttacatatataattaaaatttctacgcatatcctttatatatgtaaagtttctttatatagactttatatataaaaagtttatatgtagaaagtttgtgttataaaatgtatatgtagaaagttttaatgaaaataaattataaaatgaattctgcttataaattttatatagaatttatatatgcaattagcaaatttagttttataaatatcaatggaaataaaaaatatgctaatcagctctagatatttttgggaaaaatataatcttatcatcaaaacaaacctcagaataaacgctagtcatgctgagtatgcgtagatttggtttttaaccaaagatcgacgctaatcatcattagacgcgtaattaggcatataattagggggaagcctgccggttcggatgtaaagagggataagctgttgtaacgttcgtgagccacgaacgttcacgtactagacgcgtcccccatcgttttgcagaagttgttgcttttcagcacaacttgtgctaggctgatgcttatctataactatatctatactaatataaaaaggagttgccacttccaatcctacaggtgaaatcatcatccctaatccctaccgtccatccgcatcacatcacatcatctaccatgagtttgcaatgcaacaggtgaactcatgcatccacggatccaatcaccaacggagcaatctcctcctcaattctcgcaaatgtcgcccccatcatcatttcgtgattactcccccaattcatgctctctttcccgggattaaacatcacacattcggcgccgtcccttgcaccaccatgcgatggagagatcgcttcaggtatcattgattcgctgcaccttgatcgtcaccaggccactatctccaactctcctcgcaccgctgtcgcctgacgaccaacggacggacccttcgctatgcgcggttccgcaagattgctggggcacctccgctacacctccgacgtgcctcgcgataggctcttggtcgaattggcatgactacatcttgatggcaccagcaccgaagccgacgtccgctttctccggcaccaaccttgttgccggccgctggcttcagcagttctggccatctgcataatcagccaaccaacatgcttggttgtgtgtcgtccactgctttcgtgcgagcatagaggacaggttgttgctcggggcaccactccaccagttggacctgattggttcgatcagaccggttggagctgactggttcgatcagattaagggtatccaaagtcgaaacacatatgagaattcatatgctcccttctgattcatttgtttagtacttttgtgaatgagcatagatgagcatccatgaataaattacatatatattaagtagttcacaaagtaattatatatctaacctgagtctatgtaatatagcagttcatatgtgttacctccctttttttgtctaaagaaaaacattattgcttcagaaagagttgtaaagttttgggatacaattaactaacaagttacacatatctgacaggttatgtgttcaaactttttcccggatcggcattatagcagtttaaaaaaacattctcagaacatgatgggcagcggccttcgtttctctgggaccccaggtatccctcatcccctgcggcaatttgttcaatcgaatcattaagagtagcgatggtcaagcaaataggagtggcttttgactaggagaagaaaatgcctgactcaatggtgtggcaaatgctgcatcagacggtagttggcgggacctgtgctttagaatagcatgtgtggagctgatcagtatagtgggtatttaaagatgttctaattctttgactcttttggttcgatctcccttggttataacgaaacattcttttttttttacttttggcatagaaagctaatttgcacaaaaattatggctacgcccaaggatgtggttaaagttgaaaagtttgattttattggttattcctgagaacat

SEQ ID NO: 107619 - DNA, 1001 bp, Oryza sativa
cccctgtgctttagaatagcatgtgtggagctgatcagtatagtgggtatttagagatgttctaattctttgactcttttggttcgatctcccttggttataacgaaacattcttttttttttacttttggcatagaaagctaatttgcacaaaaattatggctacgcccaaggatgtggttaaagttgaaaagtttgattttattggttattcctgagaacatgaaagatttatattttatttctgtagcctaaaaaggtagatctgaatttctgatttaatgtggcactgcaatccaccatttgatactgctagccatgctaaaaaaaactaccataattgtctctacagttaatacaagcatatgcagatatgctggagatggagtaagcataatggaagaacaataggcctttatttgatggcttttagctttaagatgctcaatgaggagggtcaaggagattttgttcttttatttgccattgattggcctttggttgatatatctgatttcatgtactccacaggtacaacaaaaaggtaatatccatatatgcaggattatttctttactttaggttttttactattttactatgattagacaaggataaatggatatattttgtatgaacctattagataaactcagcttagtgtatgcagaggtacaagcatgaaccagttgattctgaataggaattactactactctttttttttacgaatttgagtgtgtaccttttcattagcatggcttaaatgcttccaactagcagtagttggtgaattgatagaattttggtgctttttggtgaaatatattctccaaagagataaaccttattttagataaagaagatattttattttgaagcataagatgtgctatatccccagcctctgccccaggggcacgcggcgcgaccaaaacacattccatgatgctctagaagtctagaactactacaacatacataattttatttttatatca

SEQ ID NO: 107620 - DNA, 642 bp, Oryza sativa
ctaaggataatttaaatcatatcaatcaagacaccatgcacacattctccaataatatatgtatcgattaaaatgccttagcattcacatattctttcatgctgcattaattgtattttgatgaaatccgtgtccatgcgattatacgacgatcaatttaagtaatttttaattccattatatgatgatcaatttgggaaggagggagtagtatagataaaaattaatagaaaaccaaataaccatttaataatattgaagttaaaaaattagtatggtaaaaattgtatttaatccaaataagccaagcaaaccagagacgcttctcttctcaccggaggttgcgcctggagactgcagagtacacatctggattttggacctactaggctactagtagtcacctactacagaacattcctgcactttattacaagttgcttatacctttcagagttgcaaaattaaaaaaatttcagaatacagccaatagttggacaggacttgcatgtctcttctgtacgcatcatctagtctggttggttagataagttagttagcaccagtgcatagttttgtacgacctaatactaatatggacatactatttgtcatggttctgaaatatttataccaattgcc

SEQ ID NO: 107621 - DNA, 708 bp, Oryza sativa
ttaagattgcattttttgcaataccgtagtcaatatggtagttttttctccattttattttgacctaaaactcaaaactcagtcatatgaatccaaactctcctatgatgcttttttgacttacatttcagtctaacttgtaatgattactgtaattcaaaactaagagatcaaggcatcgagctgtcttttgttcgtgtagatgaaggatgtttgatgatttgtattattttccaaggctgatggtttgtatttgtattagactgatgaagacatggctagctaaatgtgttctcatcctgaaccagaaagtttaatgtgttgtgatgatgattttgacaagcaagtaaaggcacatatagcttgatagatttcttgatcacttttgttgctccctatacctgtggtgatcagcctccatgaggaactccaagtatttagcttttaatgaacacaaaatgcatttttcgaaagtcttttaagtttctttgatacaactgattgtcactctacttaattctactggttatttgtgagtaacaattgatagtgcaatacatgagtaaatcaagtgtacacgtaaatcattcgcaacatatatttgcttccatatcataggcattgtctgatatgcgcttgagacataaattatcattagtaaacaagagttgtgcttgtgctttagcataggcatattacggtgttatg

SEQ ID NO: 107622 - DNA, 565 bp, Oryza sativa
tatagggcgaattcgagctcggtacccatgaaatttcatagtctagcatctaactaaacaaaatataaactatgaataaatttattattgagcagtggcattataacatatctgcccccttccctaaaaaagggaaaatatgacacgaagggcctataacagtgcatgcttacttctagtgattacacaaaagaattaaaccgcaagcaccaccattatttgccattgacactatttatatttgataaatagtaaacattctatagcataaaccaaaatccatactatgatagtggtgcacaatattatttattctaaaaggcgcaatgggactgcaaaatgattgagttgcgcacattttctcctataactattatgcctaaagggtagagggtatatcgataaccttaactcctggtggaaatgctactgggtgagcgatccgcctcgctcgcgcagagcgatcgattccccccccttcttccccttccttccttcacctgggtttcttttttggcaccgtattacttttctattttagtaaatttatgcacctaaaggttat

SEQ ID NO: 107623 - DNA, 676 bp, Oryza sativa
ctattatttgtgcacaatggactgtttggagttcacagatcaatgctgaaatgcaacctttttttactacgcatcttttatgataacttacttttacacaacatatcaggtccaaccacctaggtgtactaaaatgttgctctagctggggcattaaataaataaatattctgaaacaaaattaatgaatgtatgggggcttagatcacaacttgtagaaacacctaaaattttcaacaacaaacttaaaagtatcttagaagaaatagaacttggtatatttgattgtggaccgattacttagaagacaaatttaaaactggacttcatcaatatgtatgttaaataaattaagaggtacacgtatacttttaaaaagaaccatgtggtttggtatcttaaccaacttggttacataatactgatgtatattatgcttgcagaggaaagcagtgatccaagacctttacttgggcaggaacccaccaatgtttacagatattagggttgtcaggcaatcaactgatgatgaccatctggtgtgtaattatatgcctcagttgttcaattgctttaaaaatgttctctttctgggtatttactcaaaatcgaccataaaatttataagataagttaacatgccaggttttagagataggaatgaacttcctatctg

SEQ ID NO: 107624 - DNA, 695 bp, Oryza sativa
ttggggaaggtgaaatgtttctaatccctttcacaatatttctggcatttttatgcaagcagagaggactcttgtccctttggatgtatatatcatttactatctatgaattatctatttgtcactattgaatttactatttaagttttgaccactaatatattttaaattgtttgactaaaatgaatgagagtcttatcattaatttggtaaccaatggtagctagcagtattgtgtacttctaaatgtttacaaattacaattcgttgctagaaaaacaatcgtcaaaatttatgcagtgagttcaacagtgataagtacatgaaaaatggaaaaaatatgtttgagttctgacaatgtggacatatgctcatgatttttcttttgactttgaaacagtaggggaatcccctatggtatattttatattaaaggggcgtttatgtacaatgattcactatttaatatcttcttgaggggtgaaaaccatttaatactgcaatacttcttgaagtcttactactaaagaattttccttggtgtttagggcagctctgcttcaatcattgtgtactatgataaactatcaccagaaactattgttttttaattgccatctcatctcacttcatttatcttttacgttatcttgcagcaataccctagagcatatttgaccgattctggttctggc

SEQ ID NO: 107625 - DNA, 577 bp, Oryza sativa
attcgtactcacgcaatagttcagtggtgtaattcggacttttccctaataaaaatagatttatcgaggagtgagcgtaacttaactgattaggctactggaggtgaaacttgtctatccggattcaaattttagatttgacacggtgctcatatttatggctaattattcttttaagtgatgcatttgtgataacttcgttaatctcaagatatattcaaagatgatgtgtgtttataaaagcgagtgtgggtacatatatgagggcttcatttttctctactaatatcagcctcttctcttttctctttagattctaatatttgttcttctcttctttctttttaatatttgttattaatgttactgaatttttcctatgtaagtctccaatacccactttaaaatggggaatttaactatttgccacttttacatttgacaattaaccaaatacccttcttaagattgtacttaagaatttgccattagagagagaagcttttgtaactttttgccactttttgccctgtggagtgccacatgtgcatgccaacatggaccaacgtgaaaaatg

SEQ ID NO: 107626 - DNA, 1640 bp, Oryza sativa
  unsure (1)..(1640): unsure at all n locations
tgcctcgcactgtcgcacatagtgacatcgcatagagaaacacgaggctatgctgggtaaacgtgggggtgcaccaaaagtcaaggctgtcaggcagggagggagctacataagccaggcgcagcatggaccaaggtgatttccaggtgggccatagagcgttaggaccaatggcacacacgcacccaaccacatgcccacggtgaaccacacaaaggatccaaggcatcacaggatgaactataaacaccacctaattaaaccgacaaaccaaacgtgatatattcatcttattaatcacataggtaatatgttctgtgtagcaacacgaaagacacatgctaaattttggtggcagcatgccacagaattactgggcaaattcctatcgccagcagaaaatgatgtgatattttttgttacagaaaactaatctgctattgcctcttttttttctggaaaatgaatctccatatcgaatctaccatgtgctctgagaagcaacataccatagtttttttaatggctatctaatttgaccatgcaaaaatctgcataattcaaggtaagaacagagagaacagataagagctgcagttacaacaggctgtgtatgtggaggaatgatataattcaaggtccaaatattagcaggatctcaaggtctaaatattagcaggatccaggatcactaagtagaaataaacacactcgcagtttctgtttacagtggcgccataccagattctggataggaattttcctaccaatatatcacccctgtcctaagcacatatccagttatacatgcatgcttaataggaaactaatctggatagaatctttcctaccaatatcacctctgtcctaagcacatatccagttagacatgcttgcttaatagagaactaatctgcatattgagtgttatttttttgctgtagtaaataaatctgcatattgcatttaccatctgttctgagaagcgacatcattcataggcacaaatggatggggatctaggacagaagccctgatgtacttgtctagaacactaacttctttcaaaaaccagagtcagtattgtgattttttttatcaaacagtcaacatgcttgtatagaacactaagggtgtgtttggttcctggtcaagattggatgggatacggtggtccatattttgctggatatggcggtccagttttttgtttggttgtagggacaaaggtggatttggtgatccaattttttgtttggttggaggaagtatggtggatttgtaggtgtggtcacctctcacttgagatggtgaatataccccatcaaattaatacataatacacattccattataaatacacactccattataaatacacattccattataaatacacatagaaaaaagaaaaagaaaaaagaaaaaagaaaaaaaagcagtgccagatctgggctcgccgacgccgctagcagcctcctcccgccggcttcctcccgccggcggcccgcttctgccaccaccgaggctcgccttctcccgccgccgcctttctttctcgtcacccgcgccagctgccgagctcgtcacctttctcgcccgccgccacactcgtngccccgcgccagccgcaagctcgt

SEQ ID NO: 107627 - DNA, 1204 bp, Oryza sativa
agaaactgcaatgtttacagtccccaatgaaacatttgtatccttttattgatgatgagtattgatccgagttccaaatagtacaaacatccttctggtcatagagactcagatcttgtaggatggcatgttggtcctcaaactggttgtaggcttccactgacagacaggttaaagatgttgcctagttcatcctgttcagaaactagttccagtatgatattagactttgttatcaatgaaaagaatgtgcctgatgcccattccattgatctttccataacataagagggttcggtttgttagacagaccacttgcaaatctgcaatagccttgaaagattccattaacttcatattgtgtccccccacaagaaagattcatctcttaatctaaaaggtggtttacttctattaatatatatagttggctgtgtatatccgtttggatgtagaggctggtttaatccattatctaaaaaaaattaatatatatagttgccaaagcatgcaaatgcacccgaggaatatcaaaatgtcttgtgcaggtttttgatgagcagagtattatgcaggtctaacagtagaatctactcaaattgaaattctttatcttgttgaaaactggttgctttatttaactcaactccacttagggtggatcatttgtagtaattaactagttgaaaccctgcgctttgctatggaatacatggatgattttatgctatatataatataaattatggatatatatgttaaataatgtgaaaatgatgtgaggatgataattgacatgatttggtatgcttggagtaataaattgtatatatgtcatggttccatgagctttaaaataccatagataaatattgctagtgagtgatcatgtgtcatatttagatgttaagcttatagtactaagtagtgggtatagaaggtatagatgtatcattgggttttgtctctcagtgacacagcggtcagttacccaatctctaaaaaacaaacccttttcaccataggcgagcaacgatagcgagctatgtactacacattcgaaaatcgaaataacctcgtagtcttgaagtatccaaaggtgttacaaatttatcgtagaaaatgtgctctctttattagcatctactaaacaaaacgaaattctctctcttttttaaagtcaagtttcaatgtacgcctgaca

SEQ ID NO: 107628 - DNA, 661 bp, Oryza sativa
ccaaccacgttggtcgccatcagaggcatatgtgtaaagcctcatgcggagaaatctgaaagtttttgtggccttttggtgccgggtaaaaggagaacacatggagatctcaacgcaaaagaaaatcgtcatagcgtgttataagttaactgagaaaaaatgggtgttcaactcttaagagccagaaaatttgggattgttcaactttcaagagccagagaactgaagcaagcccgtctgattttgatgtacggtatggccataggggggaagaataatctcaaatagagaatacaggagcattattccgttttatattatgaaagtattctaggagaaattttactgtcgtaaataagtagataccaaaaatatttactgttaatttatatatagtacctcctgatacattaattataaggatattgagaggtataccaaaatttacatacaagcatgatatcttccagtattttctaaagaaccataaaaagtctcatattacaaagagaaattcaagttattgttaatcattatggatcagaaattaattaatttatacacatgctggtgtcacatcgtttttaaatagtacttataaaataaccaaactatatttttaggacagaaagtttgttatttttaattgaacacatgaata

SEQ ID NO: 107629 - DNA, 874 bp, Oryza sativa
tatcaagctgaaggcaaacacccaaacctgccgataaaatatgtcaccatatattagtgaaaagacaagacatcaaaatgcgataaaaacacattatgatgataatatgcgtgaaaaagataagcgtgtgtgtatcattttaacctactcgtttctattttttcatgccaataatgtgcaaaactgatttcttttctatattatttgtattaggaaattcatcaaacaatgtgcatgcattgttaagtaggcactccatacatgttacaattgctaatgatcagtactgttcaaatacagaatcattctgcaaacgcaacaacgttgaatgttgccagttctcggggcaaccaagcaatttcattcttacaaagagctcctggtatttattccaattgtttcacatggttatatgttgtactgcttgtaatatagtccctttcataaagaaaatatataatgaattgcagtttgggtcatcttctattaccaaagttttttttttgagaggaacgacggcaggagagctgccggaatttaattgaaaggagaaaacaaaacaaaaaacagtttcaatcccgtcaaagggacaaaagttccaggttccataggaaaatcagggaggcctaaatgccgtcttacgcaggtctagatcctgcttaacaagacaagcgacctcaacagctgtacaagaaatgttttgaaaaattctcctattcctttctagccaaacattccaccaagttgttaataaagctcctctaacaactttcttttgggactctgagccttgtcgattgatttgttcccaccatgaggaggtttcggccggctgtgagttgaggactaccaaattatgccatttacagactaa

SEQ ID NO: 107630 - DNA, 545 bp, Oryza sativa
atctagtggtgaactggtgaagtggtgatggcacttcggttgcgtgcaagtcagagtcaatcctatatcgacatgtcaacggactacaaatgggatttgaagggacgatataaagattttgaacgtggtattcatgtgttcaattaaaaataacaaactttctgtcctaaaaatatagtttggttattttataagtactatttaaaaacgatgtgacaccagcatgtgtataaattaattaatttctgatccataatgattaacaataacttgaatttctctttgtaatatgagactttttatggttctttagaaaatactggaagatatcatgcttgtatgtaaattttggtatacctctcaatatccttataattaatgtatcaggaggtactatatataaattaacaggtaatatttttggtatctacttatttacgacagtaaaatttctcctagaatactttcataatataaaacggaataatgctcctgtattctctatttgagaatattcttcccccctatggccataccgtacatca

SEQ ID NO: 107631 - DNA, 1296 bp, Oryza sativa
ttggtataaatatttcagacccatgccaaatagtatgtccatattagtattaggtcgtacaaaactatgcactggtgctaactaacttatctaaccaaccagactagatgatgcgtacagaagagacatgcaagtcctgtccaactattggctgtattctgaaatttttttaattttgcaactctgaaaggtataagcaacttgtaataaagtgcaggaatgttctgtagtaggtgactactagtagcctagtaggtccaaaatccagatgtgtactctgcagtctccaggcgcaacctccggtgagaagagaagcgtctctggtttgcttggcttatttggattaaatacaatttttaccatactaattttttaacttcaatattattaaatggttatttggttttctattaatttttatctatactactccctccttcccaaattgatcatcatataatggaattaaaaattacttaaattgatcgtcgtataatcgcatggacacggatttcatcaaaatacaattaatgcagcatgaaagaatatgtgaatgctaaggcattttaatcgatacatatattattggagaatgtgtgcatggtgtcttgattgatatgatttaaattatccttagtcttggtgcataaacatatatgatggtcaacttgggaaggtgagagtaattcataaattttagtgtaaaaacttgctaaggtttcgatactacagtactataattttagggtgggtaaaaattgacttcaaactagacaagtccacagttatagttaacccctggaatttaaacccaaggcttcttctttgtgcattgctagtaatctgatgaagccatatgtgcacatttcactcatttcaaatccattttctattacttttctgcatacatgtgattaattcatccctattgtaatactacttaattgttgttttagccattaatatccagttttctaccatgttaagaattgctatattcagtcagaaaaaaatgtaatgcttcattcagaaaaggttaaacatatttagacgaagcccttttatttggaagaagaaaataaaagagttggacatgaacccgcaatttttatggcttaattttcctaattgtgccgttaaattaaattcaaaaaccatgtcattaggcgaagaagaaacatatctttggtctttgctaagtttttttaaagaacgaatggtagaagtctatccgatatattaaaaagaaaatactccctccatctacttttaatagtcatatttttaattctgaaa

SEQ ID NO: 107632 - DNA, 1125 bp, Oryza sativa
catatgggtcccactgatatttttttaattctaatgccacataagtgccacgtgggactaagactaggtcaacaccaccacgttagcaaaaccaccctccaaaaccgctgggagagtcaaattgtactggtttcaataagccggggagtcatcctatccaattttctggttgaggggtacgaattaggttcggcctacttttttaagggagtcaaagtgaactttttcccagtggcaatgatgaaattgcaatagttgggcccgtaacctttttatagctgggcctttataacttttttaggccattagtaggaaggccgttcatggtccaccgatgccggagcttccgtgggaaaagtctattttattttccttaactgcagatcgagtttctcactttcctcaaccacaaaatcagttatagagcatcttttaaaactcaaaaccagtataaatgaaatccctcagcgtactacctttttgtccaatattatgtctacatagtgtgttgacttgatcttcgttcttggttaacacctacttcctccgttctacaatgtaagacttcatagcatttcttaaatttatatagatgttaataaatctagagacaaatgcaaagtatatatattgatcattggatgaatcggtgagtccaaaatgtcttacaatatgaaacgtagagtacttgtcatcataattgagggatgtgaagtggactttttctgcttcagtgtgcccaataacttgggcctttgagtccacgacgttgagagatcgacatttgtcagttgcaagtaagcaagttcgtcaagctgtttaatgatggaggcatgaattaagcataataacatatgatatgacaacggatcattaggcatgtgatgtccgtaagtgatttattccttttggtatttgctatttgcctatttgacaccagtgtgttttcttgttggtttgcactcaaaatttagaccgtccaatctggtatcaagatttgtgctgttatgttattgggcccgcaaccagcccatgtccggacccgttttcagggagaaaaccgacccgaacctgaggttcttctcgtaccatctactccctccgtcctaaaatataaaaagtttt

SEQ ID NO: 107633 - DNA, 554 bp, Oryza sativa
tacaaacgtacactaaactagtttggacaactggggtgtttataggtggaggtgatgatttactatgacaataattttaagtttacgaatggcatagaaaagtattaggcacaaaaaatgttcacaacttctgagaaggatgaaagttgacacttaagactatactcctatggattggaggtaaggaagagcgagacataatctataattgaaggtcatgagagcatgaacaaaattgaatgctgggtgaaaaaaaatgtaacatacccatcaattcattattctgtggactcactttcttctttgcgttcagcccccatctcctctggcggaagtcatcatcggcctaaagtcagtatcggcttcagagtcttggaattggaatcgaccgatgggagttatcaaatcgccagcagttgtgttcatggtggagtcagatcaattaaaggaaatttatcccaaagattgagttcaaggagaagagttcgagttcaaggagtatgcggcatggcaaggtatctattaattaggaataggttggtagttctttttat

SEQ ID NO: 107634 - DNA, 645 bp, Oryza sativa
ataccttgaaccggtatgaagtctttgtcgtccaaaacgagatcagaagagaaaaatgagcaaaagacatcatttttcttgactctcatacataccatatatttcgttttcttaacaaatgggtagtcaaacatatacaaagtagtagcctgtactttaaatattctaactaattggctggtctgaatcgacaagctatattgggggtgacaaaaagcacacaatttcaaaaagagaacatcatttgctcctacttttctgaacatcaagacagctggggtgccaccgtgccacgatatattgtattcagatcgacattgtggacactgcattcagatcgaccacgattgcaaatatcaacaaatataattcactgtattttgccctacttctgttgcaacatttcagatcacgtcgagacaaacgagcatgggaatggcagtgtatatgatccgtcaaagcttatcatcttgcatatttacattatcttaaaattgctaatccgcaatatggaggattttcaaagaaattttgtttactccttttgatttcaaatgtaagttgtttaaacttgtacacataaattaagaaaccagctcaaatgactaaggtacctttcatttttactacattgaaaaagatgat

SEQ ID NO: 107635 - DNA, 781 bp, Oryza sativa
gtggtcatacatacgtcacgtggagaaattttaatgtaagtcatattctttgacatttctaatcatgtgcttgtacttgttaataaaggttaatttgtcaactatactagtgaccagtcatggtcaaacgcatacgcgtattctagtactcaggtgtatcacgccctcggttaatttacactgcttggtttatctccattcttaaatcgcagataacgaaaaaaatgctgatttaatggattacagataaaagcgatgaactcttaatcagactattacaaaaacgaacggaaatgagttttttctttactttgaccaatataatatgatatttcctgcattagcgtttatattttataagtttggacatttaaacttcacaaataacacttcctaaaatgtctaattacgcagtgtaaggatgcatctaatcacaccttttacttgattgtaacttcagaaattatgtttgcttttatgttgcctaagacgcaagttaagattatttgaaccaacaggacggaaaaattgacagcacatacaagagaagataacactatactcttaaatgatttttctggatgagaccctctttaggttgcacacggatcgtaactggtcacgtctgcaaaaattaatttccatttttacatacggctccttaagaggatcgcatgtaaaaatcgatttttgcagactggcctcttgagagtccgcatgcaaaaataaacatatttttacaagcggaactcttaatgggctgcatgcgaaaatatatttt

SEQ ID NO: 107636 - DNA, 683 bp, Oryza sativa
taaccacacgtaaaattgattttgatcgtttggaaaaatacccttttagtagtaatgcacacaaacaccacccacagaaaatatataccccgaatccactggccccatcaacggatccagctcttgtacacttatgcagacccagctgcatcaatgacaatgacaaggtgtaggcgtgtagcgtttcacctgcatttccatttataacgtcctattcgtttgtcaaataaaatcccttgcccacaggtccgtacgtgcaagtcacacctgtacagacagctcgcctaggcttacctgcctgtctgtttattgtacatactccctctaaattaataaatttgtattgctaggtagtgtctaatcatctgtccagttttatacttacttcttccatccaaaaaaaacacaacctaatacttatatgaaacataatctacataattcgttgtattagattttgtcccattcaaatactaggttaggttttttttaaacggagagagtattaaatgatgtctaattaagtactccctccattccataatataaggcacaactactttttttgatgttccataatataagttatgtatgcatgcatataattaactatgacctcttctccattaaattattactttttaaaatcctccacctcaaatctctaattctactggatacat

SEQ ID NO: 107637 - DNA, 692 bp, Oryza sativa
aaacaaatcaagttcaaagatatgtagctatgtcctctcaaacggtccagaccttttatgcctgtcagcttgactttctttgccttctttatatcagaaataagctgatttctgtttcctttcataggggtggctccttctttcatgtcattctttaacccttctcttagttccttttcctgcgaaatgacatagtcgtgttggttattactagaaatacaagtgagtaattaacacagagtaataagcttgacagcattaaggacctttgcttttgcagcccgcagttttgctttggcatcgttccttctttcagctgcccttccattttgttcttcaatcaattttcttaactttctgttcaaaggttaagacacagttaacaattcaatataaactataataaattgaatcattccagtaaatgtggtaaagaagcacttacacggtagagagggcctcatcgcaaagtaaattaagtacatgcagcttacaaggactcagcttgttgtatcccaatgttcccttgtttacaaattcaagatgcaattcctttgacataaatgccaattcattgatatatgcacttaaatcatttaaccatgcatctccatttgttatgtagattgaattcctggaaacaaaataacccatttttatcgatttactaccaaaaatttgaacaaaatgaa

SEQ ID NO: 107638 - DNA, 704 bp, Oryza sativa
tacagtagttcatcagctctttttctgaaaagggtgaaacctacaaatatccatgaattccaaccttagcatctagtgcttggatatttgtatccctgatatttcttaatcgctttttcttcagagcaaaccagttactgatggtttcaagcagtttcggataggagcctaggagggtgacacctcgccatcatcaatcagagaagaaagctagctagttgctcatcctaaagtggactgcgatatatattatgctgcagcaatgtggctagctagctaccttcatcatccatctatccaattaatttcaacacagagagcactttttatctattaggtgtcaggacaatgaatcatgcacaacatattcaactccattcctattcgatgagttccgatgaaacagcatgatagattctcctccaaatgaggacagcgcaaaaataggacagctggaccaatccattcagtcagtggtctccaatgtccacgcagatgtgctaaaaatcagggaaattgcagtccatttctctgaacttttgaagtgatgatattataatttcacaactgaagctggcagtaacttaaccctacctgcagtgtgttggcagtttgcatgcaagatcaacctatctcctcacaaatatcagtacagcaatctccatgtagatgcatgacagaatgagaatctgagttcatgagct

SEQ ID NO: 107639 - DNA, 594 bp, Oryza sativa
tgatgcctgatcgagatggatggtccaggatggatcagtgatcagtagtgactagtacatgcattttattttttttggggggggctttaaacttggggacaggttgagctcactcgatcgatcgagacctgcgtgcttatatatattcagatacagatgcagcttttgacaaatatatacttcagtaaaattgatatgcagcgtttgtaaacgttgtgcgaaacacggcggtagaaatttggacacctttttgcaccaacttcttcaactgctcctcatttttttgcctgctatgatcgctttatatgcatgaaggattttaatttttttttagttctaaacgtcaactagagaaaatagagtatgctgctggacccctggacgcatgcatctcgtcgactatatttatagaagagaaaaaatatatatatgggactataataagaatcatcagactttatagtcagaaacaaaacgaatatgtatgtaatgtacttacgtatgtacaacacattggcacgcctagttcaacagctgcgtaggttaattgtatacgagttctagctgatcccgtcttaagtgatgaactactgc

SEQ ID NO: 107640 - DNA, 641 bp, Oryza sativa
tatccctgcacctggccttcatctgagcatatgtataacttatggttaagtgaacatgtatatgcttatgtggcattctaattacgtagaggagtagaattacgttgaggagtagacgttagtaagatcagccatgcatggtttgttgttttagccttcgttaacacaaactacgaatgttcctacatggaaattggcattttataaggttacgctataaaaaaaatactctttttttaaaattgacaatattgcacccacttcacagggtcgaataccactaatataatatattctttttttaaaaaaaacctgtattaaagtttgcacaaatcttaaagtaccatctgggcaaactggtactcctgcttcatatcataagttgtttagttttttcctagtcaaatttctttaggttttcccaagtttctagaataatatagtagcatttttaatataaaacacacatattatcggaaatatttaatttcaattttaatgaaactaacttagtgatgtgcattttgctaattttttttttgtaaacctaaataattttaaataggaagaaaaatcaaacgacttataatatgaaacggagggagcaccttgtatagcagtctataggccatccagactat

SEQ ID NO: 107641 - DNA, 640 bp, Oryza sativa
aatgcgctgatttgattcgagggatggcttgggagaagtgagggattgaggcggtggatcacaggaaggattttgatgaacttttcgaaggtggatttgagtggaatggtgaaccctagtttgccggcgcagctctgtactgtagcagggagtggggaaaatggcgagagttccggcggggaagacgaagcgtcgattggatcttgggatttattgttaagggtatcggaggtgcaaatgggcctaagcctgaacagtacctcagcccagtactttaaacagcgtggcccattgtgctccttagggacttaggcattttttttgctttggcaatttatgcgcacaatagtgttgcccaatgctgataaaatcctttttacgcggtcatataattctttggaattattgcaatgcaaattaaaaggtgcccgacagaaaggtgttatgccgtttttgtaagcttttttaggctacgaaagctgtcagggttaacttagaatgacttgtttttatcatagtcattttcttggtatgttatatgcctgttttcattatggtaaatagtcatagcctaggctattagacttattcattaccataatttttataatatttggtgggtaatctttagagtttttta

SEQ ID NO: 107642 - DNA, 706 bp, Oryza sativa
atagaattgtacatcatatttatacagggttacaatgtcttgatcaagaatgagacatgggtccatttaaatctttatctcttctatcttcttcatcatctcttctacaaatctttatatgttctaataaatctgccaggatgaaaaatataatctgaaatttaagtaataaatataaaatagtgatacttcagcaatcaaatttgaaggacggccattgatactagcttaggaaaaaaaaatgcatgcacatcaaccaacatattgcaattgtcagctacatcagcgtaaacaaactcttggtgtaagcactttctttttagatcaaacaccctacatgcagatacacaccattatttttaaatcaaacacatttgaagtccatgtttttgtactgatagttttccagcaatactctatttcaagtccatatttgaaagtaagttgagcatgcaattcaaattgaatcctggcaagaggaggaatgcaagagcacaattatgaattatcattatggacatgataaggaaaaaaaagtagtagtagtagtagtagttgttgttttaattaatcagtactactaggtcactttgtttggccagtgtattgtgcagggagtgagagagagaggagattgaaatatctgtgtgtgcgtgtctttgtatataggttgctgccaaagcttgtgttttttgaatgcacaatg

SEQ ID NO: 107643 - DNA, 648 bp, Oryza sativa
tgttcacaacttgttccaagaatgtgtatatatttaatttcataggtgtgaaaagggaaggcatttaatgtacaaatcttttttgtcaaatacatttaatgtgcaaatctggaagcataaatggtaagctgcttgtaacagatgtaaatgatttaaatccctcctaaaatttgtaactagtaaatccctcctaaactatctcttttcagttttggagtgtggaaaggcctagagccatggctatatattttacggtgaagtggttcaaccatcatctaacacgcttagaagtgtgagtactgcgaccaggcaatcttctatattatttctattgtatctataggattgaagtgctttcaaaagaactggatttatctaacttatttctatcattaaatgtgacagcaaccaatctacatgtgatttctatttttgtatctccttaattggtcaggtcttaaatcattctaaaagaagatgatgctccttttcgaaaagaactacacaatgtaatgttttcatgcctagcatagcttataaattaattggttctatttcttctttggggcaaacaataaaataagtaaaattttaagtttacacctttgatacttcccaagagaaagattaatagactatatatgataa

SEQ ID NO: 107644 - DNA, 583 bp, Oryza sativa
tttcctgtgaaatcatatacagattaaactatcataaataaaatttttcagtagttgttagtacttgttactcatcaagttcccacgtgtcttgatcgagggcacaacatgttcacagatagattagcatccgattattattaagaaggtagcccgcgtatacgcgcgggtattttgtttaatgttgtttgaaattttattattacaaacatttatgtgtgtatgatatttttgaaatattttttactctattttaaacgtatattcgttaataactgttgggcgtattatttgaacctctatatcctcaaatttatgagataaaatatgtcccaatattggagttagttcatatctatttatattgtgtgtgattcttttttaaaaaattttggagtttccaaactttatataacattttttgttttgtatggtatagatgactttaagtaacattttaattttattatatattaatgaaatatattttctattaataatataactaatgatactacttcatgtaatcaaagatagacttatattacttatattcccctttgtcacataaatggaaggagtt

SEQ ID NO: 107645 - DNA, 1016 bp, Oryza sativa
gattccgcatgttctgagattaacgggagctggaaatggaatcccgtgttgggatttgttgtggccggggtgagggcccgattttgggatgggtttgtggatggatggatggaggaggtgagtactacttccctccttgcgttgttctcctccgctgagctgcattggtgcgttcccgatcagagctagaatttcttgtctagttcttttttccactccctgtttggtaattggtgcgccatcaactgattttacttctcctcctccgtcgctgttgcacgataacttttacatttcatggaaaattgtagagtatttttgatggttttgattaaagcaagtagctggcaagccatcatctgtggatcatttttatccttaaattcccatcaattcatttatgatatgatgcatcgcatcaggacgcatcgcatcaagtatgacgtaggctgatgtttcagcttgataaaaaaaactggtcaacaatggagtctgtacctcaccttgattcagccaaagtggccaggtaggagtagatgccaaggaattttttcccccttcctgtgtgataattggtgatctgtggtctgctagcctacgtcagcaacagctttgcttgcaaatggtgaactcattgggatggtgggattggtgtggttaataaagtttttgtctatgatcacacagcttattctggattgcctgatgctgagtcgctgacactgaattcagggttcacagatcagtacatcttagtggaacagttgcacagcatggagtagttacgatggttgtttgtcgtgctttttacctttttctttattgggataacaaggccccctttttgaatgtgtggctttcctcagtcaaattttaacagcaaatatgaattgttttggtgcttaggagtagccgtgttcttctttttgaatacgccactgtggtgttcaaggaaaaaaaacgccatgctgctttctttaaagttaagattgtaaaccttttttttcaagaactca

SEQ ID NO: 107646 - DNA, 752 bp, Oryza sativa
tgctcctgctgacccaactccagtcggtatagccggtcaaacaggggcattttggtcattaagaacaaattttagtcacatgtggtcagcaatcgcggatcaggcgtagaacgtggcatgtttccagtatcgtgcgatttgtaatggcatctttacaatttgtcaaatagtaattgcatttttccaaaccttcaaattagtaatggcatgtgtctaattaacccttttaagtttctagctgtgtttagttacacgctaaaacatggaaagttagaaaaaattggaacgatgtgatggaaaagttagaagtttcaagaaaaaaagttgaaatctaaacagaccttaattgcctattcaagtattcaaccctccagcatgtggggcatcaccaatgtatatgataaaagcctggttttttctccaacaagagttggttaagcttctcgataaaagtggtacgtttttcaaattgctaaacggtgcgtttcgtgcgaaaactttctatatgaaagttgttctgaaatatcaaattaatctatttttcaagtttgtaataattaaagcccaattaatcacatgttattaccacctcgttttgcgtgaaacacttcatctttatcttcatcttcatcttcagaagattcaaacaccacctttcatataaataggacttataacaatctcgacaacatatatagatacaagatattattagaagaagagagaagtagagatagatactattatttatt

SEQ ID NO: 107647 - DNA, 593 bp, Oryza sativa
actgtgcagtcgcctgcaaatttgtaattcatcagttaatcccctagtcgttgattctgcattaagatctatgcacactactgggctggtggagaagactttctagatatggaccttacttacagatatattgaatatgctctaagttttaaccaaatttttaggaaaaaattagttacatttttatcccaagataaatatatttaattatagatataataaaactaatttgattttgtagatattactaaacatagttaatcttgaagtagtctaatttaaataaagttaaaacggagatgatggcggcggcgacgacgcgaagctcctcggcgatggtggtggctaagcaaagcttcaagactgattcaaaacgatcatctgggatacattattgaggaacccaagctgcaggtttgctctctcacattcccaaattccatttttctctttttcaagttctctgcaaaccctaatatttaatcccctctctctctctcaccggtactgcaggtggcatcaacagtggatatggaggcaactccgtacttgctcttggttacagtacccatcctggtgcacacacgcgcact

SEQ ID NO: 107648 - DNA, 1184 bp, Oryza sativa
gtctcttcaccatcagtccacccaggcggcgcgccaaccggcactccttaggctctagttttagaaagagtctacgcaccgggcgcccgatgggggtgggaaaaatcagacacccacgtcagcatgacatcatcagcatgcatgcaaaactaattaaaactatttttttctcttaaattatttatccaaatcatgatccaattgcacggtgcaccattaaattcattgcaattaaaattttaaaacaaaaccacacatgaatatattccgatgaaaaaaatagcttattattgaattatttttaaatattgcatgttgttccaccaagtatattgggattgtttcactaagtagatcgaaaatatttcaatcttttaaatcgggcactgtttcacctaatataaaaacattgtttcagcaaatagcgaagaatgtttcaattcactgcaacatttgatccatatatactgaaacattataagtacactaggtgaaacattttttgtggaacaaaaaataaaacgaattctcttaatagagggattctataatatgtggctgattcgttgcaaaagaatgtttccattcactgcaacattagatctatacatagtgaaacattgtagatctatacatagtaaaacattgtgagtgcactaggtgaaacatttttggtggaacaaaaaaaatgaaacaaattcccttaatagagggtttccaaaatatgtgggtgatttgttgcaacggaatatgtggtggagacacgtggcaagtgggcagggacacgtggtggggcccagggagaggcacgtgcgcgttgttaggggtggggagcgcccgattttgctcacccgccggtcgactgattcccagcattctcgcatattttattctaagagtgcaaaagctgtacatcatgtgttacatgcaggtttgttagggcgttcacaatgggatgaggtgtcgttcggcctcgaacgcacacgttggatgggggagagaaatcagcgccacttgacaggaagggcccaccaattcctagcgcgtgtgactagagttagccatccgttcttggcgccgaggctgcgtggggcatagatagcattgtgaatttagtcacttgcattgtgaatcaagtggcttttggtgttcttgagtccagccccaagcccaggcgcagcatt

SEQ ID NO: 107649 - DNA, 1270 bp, Oryza sativa
caaacacataattcatgaaagagttagccaatgcaaacttgatatctatcttatctgtactctgaaaatgtttagttgcacatctcaagctcaagaattgggtgcactgaaagagatataaaggaacctattattactgaaggcatgtattttttaagggatatattttttacatggtgttcaataacatactttgaccattaatttattccatgttatgctcccaatgaatatgaaattagcatcatatgaaaggacttcaaagtatgaatatcacgagcttgcaaataagcagagtggtagctaaagcgacaacccataaaaagatcaatgttgcagtgctgatcaatttattttcactccttgctgcgaatcatctaaaaacctggactactgtcatattacctgaagatgaattattgcgagctgaataacatggaaaattctggtatgcaatccaaaggtgtcaaacctgacatgaaaaaggaaaatgatcagatcaccagaggctcatcataccataccatcaatcttaagtcaaccaaactcatattatttgcaattgactgaaacctctgcatgaattcattattttcatctcttttccttatggctatcaagaaaccatcactacccattgcagtcccatttaaagtatttaacatttaagaaaacattcagtacagtaaaatggaagattgagatttgcatcttctgaataatagtgccaaatataaagcccttcctgctaccagttgtactaaaaaaaattgactgccaataaccaaaatgctaactactaaaaaaatcatccagtatgtgaagctcctaaatttttccttatgctactttgtaaaactatagtacagagtttctggcaagaaaattggttcccaggtcgtcaactcatgatggatcagcaagcaatatcactgcagtcttatatcttcaaactcccattttccagaaaaaaaaatatagtgtgttaggaactcatggagttgattttgtaagatgcagatgggcaacattcagccgtcatacagtaataaatcgaaagaaactaagatttatgttgttaaagaagataaccttggatgaatcctaattcaatcataacaaagccaagaatcataattcagtcttaatgaagccaagaatcctaattcccagtgtaccttggatatgagattgatgtcaatggaggtgcgagcaacagtcgacatagtagttgaccctagttccgaagcacgcactatattgccaaaaa

SEQ ID NO: 107650 - DNA, 1273 bp, Oryza sativa
aaattactataggatcgtctaaacagaatgtcagttgacatgaacaatttcacagattggtcttactttacaatatcgcaacaagaaccaatcgagtttttgaagggcaaattctgaagccaccagtctaaactatgaggtttggtgggggggtaaatagtgcctgacggaaacatggtctaataataagttaagatagcagcatttgtaaacatgagtaatatcaaaagtggttaagaataaatacatggaaatggctaagaatttgtgtttcatcatgtacaaagacagtagtttgtaaacatgacaaaatacggaagcaagcagctaggtacggggggaacataaagaaaatatgagactttttcacagtttacagcacgcattgtagcactttgtccaacttataaaggacagcatgcaaaatccagcttggggttgcgatgagtccatccaaggtaaaaaaattctggcagcaatccaatccaaggaagaaaaaaaatctaggagcaaaagaggactcttgtcagaaaggcaatagtgtttggactattcattcattccaattgcaatttaagttgtaccagtcagcaagtcaaaagatgttgtgcatattcatatcatctcagatcgcaccgcatgaaactgtaatgcatcagatatagaaaaccaaaattattcacagtgcaattcttaaagaatgtaaactaaagaatgaactgaaaagagacgatatcgtctcaaattcatctgggacctgactgaacaaccaaacaatgtttttgcctcaattaaaagagtaccctctccttcaccttgatctgcagatcaacttgtttcatcaatatatattcactcttgataacatgcctgaagacatgaataatttcctagtcagtcttacgttagacacagatgtagctatgcaagactgattttgtaaaaaaaaaattacacatgccaaattggcaaggttaaagaccagagaagaaattgagtagtataagtacacattttttttaatttctttaatagccatttttaaaaatgaaattataatattagcaaacatcatttccttctattcgaaagcagggtaatcaaagaacaatattccacaaaaacaaaaaagggtgataaatatgaaggaactgccatatatatgatttttcgaaatcttagctgattcaggtaattaccttagctaagatatggtagtgtttaagttgctaagagagaagatgcatgatttattgaagtagctgcccttgat

SEQ ID NO: 107651 - DNA, 532 bp, Oryza sativa
acagcgacatcgccatgtgtgagctctgttttagctttggtttcagaatgttcagatcggcatctgctgtgtgcatgatgcttgtccctgagaagaaaactcactggtcggaacagaggcaggaacagctttgttatgtggaggatcatatacttctagtgaacatgtatacatgcagacaacaagaacagctaaaagggcagtagcaaagaaccaaatgcaagatagtttgagctactaacactgcatgaacaaagtggtctctgcatagctctcagattttttttttttgaacgagcatagctctcagatttatagtgcaggcttcgactgcctgcctggtcctgtttatttacgttttaaaatttaaagagacgatgaaatcaggaaaatgagtgtggagtaactctgaaagttcagcaaattggccaagtgatagcagtggcttgactccccaagtcaacgattcaacaaacagaaaaagtgagtgcgtagtactcagtataaataaatactacctccgtattttaat

SEQ ID NO: 107652 - DNA, 684 bp, Oryza sativa
ggtcaagcttagcattggctacatgatgattatcaattcctttaattaccatgaattgttcatgtaaacccccaagcccagctatccagtagcataaacagtgttgtttactctggaaaaatataaagtccattccttcctaagttccaatgagaacttcagccctacaagtgtcttcagaacagagaacagcatgattcatgatcctcctatagtctagtctatctaggtactttggtgaatcctgaaacatttcgaacagtcaaacatgcatggttgcggcaatttttgagatacgccatcaaaatatagtaatcaactcacttagtttgcataaagaactagtaaccgtagactatgcttccaaaagagatcaaaccttgctcattggtgatagtggtagcgatattcctccaaaatgaccagcaacgattcggcaatgagctactgtatgtccaggtccagagatgcttcagtaatcagtagttcagtgattcagtcactccaatgtgtccagagatgcttcagtagtttagtgattaagtcattccaatctggcatccctcttcatctcttcctccctcttgatatccttcttcttcctcatcttcaccctcgggttcatcggtcgatgctgcaaatgctcagcctggaaggcaaccatcggcctgagcacccccacca

SEQ ID NO: 107653 - DNA, 649 bp, Oryza sativa
ggtcgactctagaggatccccctagtcaactaaggaacaagccaatttttcattgatgcgcgcctgctaaggcccatatcttggcctcgtccttgatttttgtcagaagaccactcggtgggagctccttatgctggaatgttctgcgatttctttcattctagatctcctaggcgactaggagcgttagggagcgtagaacctttttgggtgcctcttttacacttgtggtttaatcccaccattctaacaccgacttgatgtaccgcccaggtagtcggacgctattaacgcaggaagaagctcatgagatcattcgcgagcgcttgaggtctgacattcgtcgggggcgcatagaactggacgccgacttcttgcagcagcttgttgatcaggttcgcgatcatattcttcagcgtcagcgccgtggcactgccactgtcattgccatggatggagtactggaggaggatgcgtacaggaacggtgggttcggcgcttgccccgcgtcgagcaaggccatggtcgaactgcaggaggcgatggcaagcgaccccagggaacccgggtgcgctgtgtgcctcggaggatttcgaggccggagagaagcttgaccaagatgccctgttcgcaatggttccatgcgacc

SEQ ID NO: 107654 - DNA, 533 bp, Oryza sativa
aattcggatcggagaaggtaaagcacaggattacggtgtaacgaagaagacgcgcattcagttttttcctataaaaaaaatgatgggctaaaaccaccaggacggagcttccggcccgttcccagcccatttgtatatttctgcaagtataccaccacatgtaaggtctagtgaaaattaattattttattactcctgagtgtactgattgccaaatatatcctgtcagtacaaagtggcaggccgatccattactgtcgtgcgtatcaaaagcagggagccgatgatagccaggatctccttagattaatatgtggccatacatcgccaaagttttttggtaacccatcagaaaccagcataggcacccaagggaaaatggttcagctcagctaccattacttgttcaaactcaaagaaccaaagtcccagcctcaggtgatcgataggggcgtatccgagtatgtgcatgtttcagatcgagtagtcactcaggcaagctccgacgatgaacatcgtctttaaaaaaaaga

SEQ ID NO: 107655 - DNA, 505 bp, Oryza sativa
ctatagggcgaattcgagctcggtacctttatgggacggaaggagtacttcccataaaaaccaacatagtaccagatgtgacacattctattactatgaatatggatatgcctttgttcagatttgtagtactaggatatgtcacatccggttctaaattaggttttttatgggacggagggaatttgatgtttctagtcccatttaatttagttagtttttttttcgaatcaggagtaataagcaaaagggtgtgtttagttcacgcaaaaattagaagtttgattgaaattggaacgatgtgacggaaaagttggaagtttgcgtgtgtaggaaaaatttaatgtgatagaaaagttggaggtttgaagaaaaagttgggaactaaaccaggcctaagaccaagggccatacatttgaagtattaaaattttgacgtgtcacgtcagatatacggacatacatttgaagaattaaatgtagactaataacaaaacaaattaca

SEQ ID NO: 107656 - DNA, 1645 bp, Oryza sativa
acataacaatgatgaagaagaagacgaagcaatgatatgcatccgtttcttgttccctgagtagattagtttaatgttcggtattcagcaaggaagcacttttttcccgctttgttatgtttaacgatgaaactagaagaaagtgtagttgctcatacactggggttatgatatcttttgattatatagagagtattcaccgtgcatctttcatgaaggcaacttcttaagttaaattatcggaattttttaaacaaaattataatattaatcgctcgtgagaccaacttcgttgtagtttaagccattcttcagattggagttaaaaatttcttgtcaagtggaagaatttcagcgccgagaccttctgaatcgaaggccaacatttcgagttgaaacttatattgttctgaatcgaaggccaacatttcgagttgaaacttatattgttttgagttaatgggaaaacgttgcatgtagaggtggccactgcagatagcggcagggtcgacacaggcacgcagcaccggaacataagaaacgaattcgaggcagaatcccaatcagatcgaagaaacaatagtgatgtcccagttaatcgagagtgattcggattccgatctgcctcttacaaaaagaaacgattctagcagcttaatcagcaatagctcaatactctgttggttttgccccatagccaccgtacgtctccgatctacgttcgcggccaatccagtcacatatccacttcaaaactcaaagcaacaatggccgatgaacagatcagagacctgaacttgtcggagacccatacgttgctgctcatcaacctttatttgtcacacgtacaggggccgagctacgttccacacggtgttgaatcagcatacatccacatcaatcgtgatatcgaagaagatgacgacacgtacagtgatgacgggttctgcgccgtcccggcctccagcgacgccatcgctgcgctgccagtgccagagacgacggtgagtgagaccgagacgagggaggaggaagcatgtgcagtttgcctagagggatttaaggagggtgacagagtcaagaagatgccttgctctcatgacttccacgcgaattgcatctctgaatggcttagggtgagccgcctctgtccacactgccgttttgctctgcctgctgagagggattctgaacagaaaaacccagaaggggaagcgtgagatagagcatatatggatttatggttattggagtttggctgcacattgtaatgtcaaaaacataattggtattaggagtttacaacgaattagaaattaatttgatgcacatctttttttgtccatgcaactatgcaaggttatttttattttgagtaaatttaggcagtacagtggcaataaaggaacacggagactataaagtgcacctcatgtgcttcctcggtgagatgggccgtgccggcctgtcacgaacaggccgactgtgcttgggcctgcgtcccccacccatgcgtgcgtgcaccaggaaaaagtacactgaaggtccctcaacttatcatcgagttacaaaatcatcctccaaccgcaaaaccggatacaacgcatcccccaacttacaaaaccagtgcaaaccaggtccctta

SEQ ID NO: 107657 - DNA, 1919 bp, Oryza sativa
cggtggtgctctcggcggtttctattgaggtggcggcggtcgcgctctcagccgattctattgtcgtgaaggattgctggtagggggaggagtgactcatcttaccctctttttatgatgaactaatatttttctgtctagctaagtttttagaaatattctgatgagatgaaatagagtttagaacgtgtttatactataaaagtatattcgtttttataaatgtctaatataccccatagaattttggtatgtccgatttgcccctaaacgataataatgaacgaaatctgtgctggactttttaaaccgaataaaacggggttttagaatgtatttataggagaaaagtctagattaccgctctagtttgcatttgtccgatttgcccttgaagtctaatgacggagaagacacgtcccaaactattcaaacctgaagagaacacgaggtttagagtatgtttacactactctatgtctaccttttttgacggttaatcttcacatatcacaactttggacgagctattcgaataaagacgatcactttgatctataaaaagatagttttggtaggttatagaataagagatttcctaaataacgctcaactgttttgtttatacaacaataatttaactcctaacatttggttagtacaaacattcatacttcaacttttctctcttggtgagcttatcgacttcagcaacaacactacaatggctaagataaagggtaaaatttcaggcaagttcgggggcttgtggaaaggttaaaagtgatggagttcttatctaggaagaatgaggtagcagttgaccggcagtaggtaacaatgaagacgatgcaacgaggatgtagcggcaccaccggagtcatgaataggaggcatgtggtgggcgggatatgcagccgagaaatcaagtggcttggtgatgtggaggaaatctcttaaaagatgatgtagagacatctcgctagatttgaaaaagataaaaacttgctttgagaagggagtggatatatagaggaaagcagggttaatgaggcgagagaaagcagtcaatgagggctcatcgacgctggtggtagcaccgttgaggcaaggacaacaacatgtctcgcaattttcaaaccaaacaaaaaagtttgtagagacatctcactagatttgaagaagatagaaacctgctttgagaagggagtggatatacagaggaaggcagggttaatgagtgcgacagaaagcggtcaatgaggggttgtcgacactggtggcagcaccgtcgagacaaggacaacaacatgtctcgcaattttcaaaccaaacaaaaaagcaaaaaccgtgtatcttaaggaagtaaaaggaaggcaaaaaccgtgtatcttaaggaagtaaaaggcacaaagatataagattatctattgcatcacaacttattaaccgagagctgggccttttttttaacaaaatactcatatagacattcccctctaatttgtccctaaactctaataacggagaaaaacgcatcccaaattcttcaaaccgaaagaaataaggttttagaataatttttacactactgctggtccactccctttttccgctgttaatcaccacttatcacaattctaggcgagctagaagcaagtactagtatattattatcgaataaaactatcattttggtttataaaagctaattagactggccaaatctttaatttcttgaagcgcatcaaattggtatttcacgcactttatttctgctgcaaagggtacatgccatttctcttgataaaacagaccatttagtctcataataggcatggatgttcccaagtataaaagccttcagcaacaaacgcgtcagtcagtactaagcactgatccaagaggaggagactaaa

SEQ ID NO: 107658 - DNA, 1670 bp, Oryza sativa
agggttaccctctccttttcttggcgagcttctctgggtgaaaactacatcttttagatgggcgatggcggcatcctggatgtcgtgaccaccatggtggcatcgtttttggagcctcgtctctgtggtattgtcgtaggcctagcggcgttcgcccacgcttagcggggctcgtttggtgctaggtttcaccctcagcggcttgtgcttgggtggtagtgcgtggtgtgtggcaatgcatcttggtgcattttgatgttttctcttataacttttattccttcttaatatactcgggtggcctcctcggccttcctggcggaaaaaataaacgggaagtggattctaaactctcgaggtgacatcacctcgttgtttgtatgtcacacaaatctctactattataaaaattaaagatgtttttaccggtactttggtacgttatccgtgaataaatcggtttttaagttcgttcgcttttagaaatacatctctgtatttgagtcgggttttaagtctgttcgcttttggaaatacatatatgtatttgagtcaagttttaaatttgttcgttttttaaaatacagaaggagtcgtataagaaatctttttagaaaaactcgcatgctaacttgagctgatcggacttctaattgcaactcatgattttctagaaaaatatatatccaagcgaattcccacagtaaatttcaccttaactaaactatataataataataagattaaaataactttcacccgttgtaacgcacaggcattttttctagtgaataaaaaatttagaaaaaaaatcaataagatagattaatatatgataaatcacttcacaaacatgcaaattcaaatttaacttctacaagttgtagcgaaaaaccaaattaaattgtgggtagttaatgtatattcgcagttaaatttgttttttttttttgcaacttgtacttatggagtgatttatcacatattaatctatcttgatgaattgttttatttcttataacaatttaggtttaatgcaaataataaaggatgtcccctcggtagtttaaaatagtttcccaaataaacgggccatctgaccacacgtttgccgagctggccaactccggcccggaagctccgttccggtagtatcagcccatcatattttcttcaggaaaaacggaagtccatcatattccaacttggcatcctatgcttccgcgtccgcccatagatcccacacaaatccgtccgagtccgactcatcccaaattccccggccatatccttttcttcgcctgagatcaccacctcctcctaccagcagcgagaacaaccagacggaggagggttaccccctgcttctgcttgcgttcgcgcacgcatggatcccacaaccaccacgacagattccgagtgcgacttcatcaagaagatccctagttggatgataaggaattcgccaatgcattgtatggaggccggccactttggcaaggatgccgcctcctccgccgcctccgccaccgcggacgccatggcacatgcactcccctacagcgatcttcaccacctgagagtcgccaattcggcagagcagagctgctcggtaaacatcaagtatttcgaggagggcgactacatgtggtctatgccctgctcccaca

SEQ ID NO: 107659 - DNA, 564 bp, Oryza sativa
ggggagtggctcgaagtccatcccgattttggctagtaagctcggcactttcccatgtttaatctttggcccatttcaccatttggtctggacacaatctggcccggttatatatgcttgggccgaggttacactggtacacaattttcccttgtatttttcacaaggaataagtccactttgactcccttgcaaaaccggatatctcgaccccctgaactattgaaaccggtgcaatttgactcccttggtagctttggagggcggtggcgctgacgtagtgatgttgacctagtatgtggagttgacgtggcgcttaggtggcatttgaattaaaaacgtatatgtgggacccgtttgtcattcacacacataaaaaattgtgggacacactgacatgtgggccccacatgtcatcctcctcctctctttcttcttcctcccctcttcctcccttctctctttttttctctttctcttctctccccttcggtcggccgcggggagcacaggatggagcggcgacgggcagggtctagagcgcggcggcggcgggagctgaaa

SEQ ID NO: 107660 - DNA, 645 bp, Oryza sativa
cgttccttggtgagcaatttatttttgtttttgtgatgcttatgcacgctgatttgtttggatatataaggaggatgtaatcacaaattttttatggggttcttctctaatctgttactgggggatgtataaatgctttagatctgttactactgttgaatgcataaatggttttgagtaaatttcacaaaactacaagtattttgcacaatttatcacaaaactatatgtactttgtacaatctatcacaaaactacatatttaagaacttgtttctcaaaactatagatttagtgtattcgtttatcacagaactacatatttagtgtcttcatttatcacaaaactacatgttttaataatgctaaaacctatagttttgtgataatggagacactaaacctgtagttttgtgataaatgaagatattaaatctgtagttttgtgtaacaagttcttaaatctgtagttttgtgatatattgtgcaaagtatatgtagttttgtgataaacgaagaaattgaatctgtagttttgtgaaacaagttcttaaaattgtagtttatgatcgatcatgcaaagtatctgcagttttacgaaattaactcaatggttttatctcctactgtgaatgtataaaatca

SEQ ID NO: 107661 - DNA, 684 bp, Oryza sativa
cgagctcggtacccgacttacatggattaattattatctgtcctaacatgactatgaaagcaatgccgtccaggtggtggggccagcctcaacttcaatggttaggttagtgctctccttccacggattgaatgtgaaccattgcactactgctagacatcactatgcaattgtttgctaggataactttaattaccatatttaaagtgtatcggtttagtgtaaaattttaatacctatatatatatttctcgtactttctgaaagattgaaaacttctagtactttatcatgactatgcaagcaatcgcagtacctactacctaaacatctgatcacatgccatctaaggtcttattggttatacatgtattctacctgtaattatccccatttcataaagtctctaagagaaagacaaattaatttgaagactaaagagagagaattttcatgaagagtgtaatcgttaatgagaggaacacgtatactcatagtaaatggaaaattcaagtacgcatataacttaaccacgccttatctctttcttaatttcaactggcatttaataagtgtacagtaaaaatgacctaaattaggaatggcagtgagggaaatttgcaacaattacgtccttgagctgaaaatgctagaccgtttgcaatatctcaatattaaacttag

SEQ ID NO: 107662 - DNA, 660 bp, Oryza sativa
tcacgatctgatttttactcctttcatttttcaactctccttttacaaaaccgctttcaatatttatcaatgctctctattattagtttacatttaaccaccgataaattttaaaaggttaaagcaatgatgaacgaaagctatgcagcataataacttttataaataaaatggccaaactttcaaatatatactaccagttaaagcgaattcaactaaaagctactaacttcataaattattaagtgaagtgttactgcagattaaacttggatgaattaatattttcataaatgcacttaacaaaatagcttaaaatataaacacaaggtctacgcaatgtggtagaagatttttttctagaaaatgtatttttcaaagcattgagcaaataatatgctttaaagtttggtgaataatttgaaaggaataaggctgagttattttgagcactttgggttagctactcccttgtattttgtgagaatatttcccgaagtgttaaatggtatgtgttttgcaaaactttctatatacaaattaatattctgaaaaatcaaataagtttattttaaagtttataataattaatacttaattaatcatgtcctaaaaagttttcttgttttacgtgcggttgtttagcactgctcgaacgaa

SEQ ID NO: 107663 - DNA, 758 bp, Oryza sativa
caaaaacaccacaaggacccggcctttagctagtcggacgataattgatggtcttgactgagaagtcgtgatcatgcactgccaggcatcggcatcgtgtgtccatcgcttccctgaaacctcgctgtcccgtacgtcgccggcatcgtcgacagcgatgcacctgctcgcgtagtacgtgaatgcgcctgcacctagaccaatcgataattaaactgtacccatccgacgaaagagtacgtactggatctcgtctcgtcgagagatatagctcgatcgatggatcgatcagtcatcagtgcatgcactgcacccaccaagccaacgtattacgtatacttagctgcaggttcagtgaacggcttgcatcgcgtcgatatgatcgaatcggacctagctagtagtagtagtagaagggaccagagagatgtgtataggagtaagggtgtgcatgtgtgtgtttgcgtttcttttttcttttcttttttttggcaataggggaaaatttggactgggaaacttgtactgccaatcatatcaaaatgtcttcaattaatagaaataatagtatttttgggtggttcatataggtataatgattagtaaagggtattaatgaaatgaaactcgaatagaagtagatgagtgcatagaaatggacttattcagagacaaataaacctataagatttaaaaatttattatagaatatatcagcttacatctactttttttatcacaaccaataataatcaatc

SEQ ID NO: 107664 - DNA, 680 bp, Oryza sativa
cacattggaagaaacgaaatttagcacgaattcgttccgctaaattctattaaaagtgcatacacatgtgtgattattgattaaacaccctgttgattggagatatgcacccatgacttcatcgtcttatctacgatcatccaatgcttgactcgtccaattcttatactttatctttactagtaatatgtctatgcgttgcaaaagacactacaatataaacaatattcctaaacggctaaaatgcatttctgcagatggatgtagcaactgcatgccctcaggtgtatatagaaatagggatttcccagacaggtaacacaaccacacgtgaaaataggatttttacacacgacacgtttacccgactgaaaaataaaagaatttttgaataaataaataaaaattccaaaaagaaaaatcctaaaaaccctaactcacgtatctttctaaatgcgcgcgcacaccttacctctgttaggacatgatcacctcctaaagacatggctggtatattttattttgggattaacgaaatctcaagtatctcgttatcgattggtatcttgcgaaccactaaaataataatttacgtgaacgctagtgcacctaaatctacttaaccgtaaatacgagcacctgagttaaattagaagccagtaaacccaaacgatcggttt

SEQ ID NO: 107665 - DNA, 586 bp, Oryza sativa
cgagctcggtacccagtcttctttaaggttcaattcccagagggaggaaaaatatctgtggagaagtacacatttgatccacaaatagctagaagagagcttgctgccatgattgtactacatgagtatcctttatctattgttgatcatattggatttaaaggtttgtgactgcacttcagccattatttaagatggtgactcgaaacactattaggtaataatgatatctattagtttcagttgtctattaaaaatatctgcaattaagaagaaaaaattaacatttatgcatttttaggaaggacattatggactattacatgaaagaaaataagaaagccctagcctacatggctggaactaagtcaagagtggctattactacagacttgtggacatctgataaccaaaaaagagggtacatggctgtcacagcccatttcattgatgattcttggacacttagaagcattatcatgaggtacttgatgaacaattaatttcatttcctactgctacatatttaattcagcatgacattagatttcatttttgcatcaatctgaatttaatctaggtttaa

SEQ ID NO: 107666 - DNA, 553 bp, Oryza sativa
ccttcgagcacaatcaagttccccgaagatagtgctggaaacgctaggaaattgtaggttatcttgctgcgagtaatgtgccggaacaaattgattgaggaatagttgaaactggaaagttttggagtaccccagctagatatgctaatcccctatgtccctctcgttcgtggtgcatatccatttattgcataaaacaattattattgtgcttaatcgtcaaggaaatggaatcagcagatcggtagatcaggtaggtaataattcctgaatcgtcagaacaataaccataaatggaattgatggtccaaaagatcgacactatcctccgttttatttttaacatgctgtgctgctaactggatgatactgctatctgtttttgtatccgtaatttcctaaattcagaacatggtgcatcgcagtagttgacatataggggcacctgtgcagatagtctttactgcctcttctgtctattgttttccaggctaggcctgtctactctacttagaactgttaatatgcactactcactagactttggagctca

SEQ ID NO: 107667 - DNA, 1185 bp, Oryza sativa
gacccgtaatgttcacccagatacattagcaacaaaacatcatcttactttggtactacatacaaaccttaatcaactaaagaatttgcaaaacacatgttgcatgtacccacctgggagttatccagcacgcccctatacacctggccaaacccgccctctcctagaaagcgatcgtcactgaagccccctgtcgccgcatacagctccccgtaggtgaatgactggccatgaataagcctctccataccatggttcgagatggaatcagcatttgtggtatttaaattcacatccatctctgcagaaacaatgataacagatgagcatgaggcacactaatgcaatggtgtcagctatttaaattcaccaagagaaagaagacaaattaaaccaaaccattgtaagattgcagaacataaggtaataacattaacatatataagacaaagtaaaagtatttctactagtattgttatcaaaacaaccgaaagcaatacagacaaaaaagtaaaacacgcgtattttgtgatattactccccccgttccaagaaaagccagtgaaagctgacaagaaacacccaagcggagaccttactcaggagatcaggacaaaatcatgccaatgcccaaacaccatttctttacgaaatcaatactccactggcaagaaatcaagtaaagagtttcaacacctttcaaagaaaatcagaacagcacaggcaaaccataatatgaaagaaagggcaattcaatgcccagaatcacgttccacgacattagtacaccatcggcaagaaaattaaacggactatctaaatttccaaaaaaaaaatctgattacttgcgacatagcacggattagaaaatagaaaaatcatggtgccttctgaactgttttttagaaggttcaaagcatcccaagttccaacttccagaaataaaaagaattcaggtccatgccttgatgctaacgagcaaaaatctcaatatacgtttaagaacatcacaagtcataaccgatgaagcaaagataaggggaggaatccaaaaccacggtgatcgcgcgagagccagcaaccatcgcccgcccggtgaatccaagaagggagtcaagaaccctcgcataggaagtcagaaaaccacgaagctcgaccagtcatcgcccataaacgggtcgaaac

SEQ ID NO: 107668 - DNA, 863 bp, Oryza sativa
tgtgctcggtaggagtttcaacttcgactctgtgtttttttttccgcacgccttccgagccattaaaggatgcattgttttttcttaaaaaaaatatgtcgaaagttacttaaaaaatcaaaaatcatattgattcatttttcaagtattttgagctaaactctctccgattttattactcttgacattttgaacaatgttttatatacctttgactatcaatactttaaagatatttagttaaagtcactagagcaatagatttacctacaaagtactataataaaagtaaaattttatttatttaatttacatattataataaaaaacatagtgaaagatatatttggagaccgtatagttgtctaaaacatgaagaattatagaaccggagggagtacttaattacttatgcgctaatgaattactccgttttatgtacgcgggaaagaagttcccaacccttaccttcgacacatcctaaacattggaaaggaaaatgaaccacattgtaacaaaccgaatcgacataccaagctaaattgtccaaggaagaatggaccatcaccgaacttcgacagggcagcttctatcttgtccagagcagcaactgatgatgatacataatttcagtaaatcagcatgtatgcaaatgaattttctcgaacagcatgcaaatgaattaaaactgcaaatctccttatctacaaacatggcatagatgctgcaatgctagattgacacaactacttcctccgttccacagtataagtcattctagtattttccatattcatattgatgctaatgaaattagatagatatatatggttagattcattagcatcaatatgaatatgaga

SEQ ID NO: 107669 - DNA, 672 bp, Oryza sativa
agtagttcgactattttcctagtaaaagttatttagattcgaccaagtttatagaaaaaattaaaaaaaatctacaatataaatatattttgatgatatgtttgttttatgttgaaaatattactatattttctaccaacttgtttcagacttaaagaattttgacgaggacaaaaatcaaacgacttataatattaaacggagagaatactccctccgtaaaaaaaaacccaacctaggacagatgcgacattttatagtacaatgcagggtgtatttagttcacgccaaaaatagaagttttattgaaattgaaacgatgcgactgaaaagttagaagtttgtatgtgtatgaaagttttgatgtgatggaaaaattggaagtttgaagaaaaagttgggaactaaactcggccgcatattcattgtactataaaacatcacatctcatctaggttagtttttatgggatcgagggagtaagcaataaggtccgtatccttttcaatttaagacctactaccataagacgtactctcttcgttccataaaaaaccgatatagtactagatgttaacacattgtagtactacgaatatggatatgcctatatctagtactaggttaagttttttgaaacggagggtaccgagctcgaattcgccctatagt

SEQ ID NO: 107670 - DNA, 1352 bp, Oryza sativa
aaaatttaatgttcatgtatgtagaaaagttttgatatgataaaaaagttaaaagtttgaagaaaaagttaagaactaaacaagcatctagtgtggtggcgttttgggattgacgcaaaacccactatgccactgtgccacaaatgaaacggtcgacgttgttttgataccgggccggcagcatggtgttttcgcttttgcagtgcatcaataatctcgtgccgagctagaagggcaacaggtcaccgacgttccagcctcggcaccaaagcaagatgaaattagtacttctacagcttttgcaacaccaatgtccaatgagctagcatgtggtggtggatatagttcgcatgtttgtggttttgcaagtgaatggttttcacatttcgacgtgtgaatccaaatgacccgatggacacacataactgtccgattagagaagctcatatgatggactggataccacgttggcgtgaataatctcttttgaagttttggtccttcctcacaaataaactccgatgaaaactttttcatggaccatcctatgtatacctacatgaccacaaatattatgttcctgtttgaaagggttccaccttttttagaaaaaagttcttctactatagtatataaaacaaagttttcaaagagggccaaccggtggaaagtactaggaaaaaattttcaaatatgatttgtacatctcaaccacaaaaccgggtataatgactcctcaatcaatcaagaccagcgtaaaatgactccctcgatgggtttgagggtggttttgattgatgtgatatctatgtggcaaccagtcttaaaagaaaataataaaaaaagatgtaggacccacttgtcaataacactatatatctcctttcttcctctctctgctctcattgggcgtttggggtgatgcaatggcggaagaatgccagttcctatatctcgctccgaacgaaggatggagcggcggtggtccaaactcagcagagtgagaaagcggatcaaccgagaaaggcggcagagtgtgagtcaacggcacactccttgacagccaacctcgacactctcatggagccgctagacgagccaccattgttggtgattgaagagaccgagttccccctcccacaaccttccatggcgctatccctccctatggcacttgcccacgttgcggacaagaccatgcggcaggggcttatccccatgcccggcgacagcgagtgtcagagaggaggggtcatcgcgacgtcattgagcaagaagctgcagcgggaggaagaagctccggctgagggcatcaatgaggcctttacggtgccgtggtgtaggatgggttg

SEQ ID NO: 107671 - DNA, 871 bp, Oryza sativa
cgcgttggttatcttgggattttgatgagccgtagtcggatggcacatgaacaggttcatcatccctgctacatgggagcgttccatgtgttctgcatcagtaatacaggttgttaaattgttaagtacaaagttagcatttgacattttccaagggattaaaaaatagtccaatttgaaggatcaagttggcgtttaagcaagcgcaactgctctatttttaacaccggagtcaattgtgcacatgtttatgctataatttttggcagctacacgtagtcagttcttcgtacagttgagttactaacattcaccaaagtgaaaaatttcaggtgggcttggtccaatttgtgtggcgtacaacaccgacaatccgtccatctccttgctatcctaaacacaatcattctggttgtggagacacaaagggtacaggttgtttcctcaatacctaacaataatcgtgaaatatgcctgtggagctagccgccatgaaccgaaaaacaaaacgtaggaggagggaatttatgtcctaaatcttgcgagacataaggcaacatagaaacctaaaatgcagaaatacctatgcgagattgtttagttcctaccgaaattacggtaatcctagaaacattaagcaggttatttaacttttgaccaataataaaacacctcttgtaatccgcatgcttacctctctgagtcatggtcaccagcctcctccccagagccgcagttcttagcattttagggtccaagccattctcctcctcctccttgcaatgaacagatggtgattgctcggacacaacagagcaccagctcccttcctgggaggagttcacctgagtgcatgaaccagccgaggagc

SEQ ID NO: 107672 - DNA, 612 bp, Oryza sativa
actggagggagtatctgtctatcagtgatgtatgtatagaaactagagggtgcagaatagaaaactaggatttattgatttatttgcttgattattagaaaaataacaatatactgtaaaacttctccacactattgaaattattgccatgtttctcttaccgctagctaagtaacgatttgctttggagttgtatatggagttaccacaaatcaatagtgtcccaactaaggccccgtttggcaagtcctaaatccccacccatccctggggatgggccaggaaatctgatggtgtgaggattaagatccatcagtttttttaatgaaatcactatcgcctctttctatgatctcaaatttaagccatacaggattaaacactactactacttgttttgtggaacatttaaagacccatgcaaaataaacaacttacatgtgccgatggccacataatagccaaactgattatataactcttgtataagactttacagtaaaactgacttacatgctaataggtggattggtgaaaatgttgcattctaatgttgtaaatgaaaaaacaacttcgcgaacagttttctctaaatgtaggacaattgtgcca

SEQ ID NO: 107673 - DNA, 1413 bp, Oryza sativa
tacacatcctcctcggcctaccatgcacagtgcttgcgggcgccaaacacaagtctcaactccttgttctagaaaatctgggcgccggggaaatgcaaattccatgcatagctcatcatccagaatagagtttggacgtctgaccggcttgcgaaaggagttgacaaaacaacagccattgccctctctgtcgttgtaaagccgagacggccttgcatctcgtcaccatgtgaggatatacaaagataatctgacacctcgttgctagatgggtgggatatcaacaattggtgccggctcagtgggaggaagctcggtcagtccatcaatggtgggagagcctagcaaatacgctcaacgtcctaaaaaagggtcttcgatccctcatcttgttagtcgtctgggaaatctggaaggtgagaaatcgacggattttcgaccacaaagaggtggcaacaagctttctcctaacaaaaatcaaagaagaggctagcctttgggctttagcaggggctaaaagattgcacgagttcgtcccgcaacttgtatagtgtatagcttacggtgacctctctctttttcgctttaccctagaggttgattttcttctactctattaaatgaaaaggcacttttgtgctattttccgttaaaaggaaagataacgtcacgaaacattctattaatagcacaaactcctaacttgttgctaaacgttctagtgaagggtgttatgttttcatatcattcaagtgtgccaaatggcttcataaaaaaataagaccaagtctatgtaatattataggcaccagaatcatcgtatgtatggtcatatataccaatgatttcaccgaaacactcacactaatggtgctttgaaaggacttatgatgtgactcaacaattcaaaaaccttatttcccttttaaaaaacatatttctctgtttatattataatatgttttaactttttaatcagacaaactttcttaggtttgactatatttataggaaaaaaaacataacactatctacaacattaaattagtttcgttaaatctaacatttacatagtattatatttgttttgtgttaaaaatattactaccctattctacaaactttgttaagttagaggtctgcttataataagtcaaaacgtcttattaatatgaaactgtagggataataaatactagtaaataagtttgacaacaaaagattattttcaatgacatgaaagtatatttaagaccaacgacattgagtaacatagaattacaccagtattttattactcaaacatgacttttacaccacatgtcaacttcggtttattggaagcaaaagctgcaaaacatgtactaaaaaaaagagtagcaagaaaagaggattgattttttgtgtgtgtgt

SEQ ID NO: 107674 - DNA, 533 bp, Oryza sativa
atccatcggtagtttccgagtttccactacggctatgttcgactgccattattttcactgtgctgcagccaactagcacagtgtgttgtttctttcggctgtggcagcgcagcggctgtaccaagcggccgaacaggccctacataagtacatatgtgatttccaccacatattttcccagcatatccatataccatacgatttagatagcatgcttgtgctaccaggttttatgccttatctcacaacaacagtgttgtgattttttaagaaaaaaatatatttattttttaaaagaataaaaaatacaattacaatttcaaagttttgcaaaaatctcctcccgctctaccttagggaggggcataaagcaatctatgtaacacgacaattttgtaggtgcccccctcccgatgatttatctccctatgtaacatctcccatagggcaatttattgggggggtggctgcaaaattggcacgacgcaaaggttgatgatgcatgggtcgtgccatgacaattttgataaatc

SEQ ID NO: 107675 - DNA, 512 bp, Oryza sativa
ggtaggcatgacgaggctcgcgccagccgcgctccggagggccaccgccgcatctgggatcccctcgtcctcctcgcgctcgtccgtgcttgctccgttcgcgcctcgcctcttctccaccgaggcgtccggagaaacccccgcggcgggcgccgccgcccaggggtcgcaggacgagcctttcttcaagccttctgacgaaggtaggtctcccatccttgcggagccgattgctttttttttccctgtggtgatctgtaattaggggtttgaggtttaaatgtttataatgtctttagccgcttaggatttggggtcaggaatgtagattgatggattagatacagtaaaatacctcactctgatgttgcactaatgagaaattacattctttttattccatattggtgcgaatatctcacatgacgagtgtcaaacttttgaaaatgcgaaccacagcttctaaaagttgtacttttgcactatcatattgcaatacggtttttttttcc

SEQ ID NO: 107676 - DNA, 549 bp, Oryza sativa
cagttatataaagttcggtttccctaaaaaaaaattattacgcgcgatcgagcaagcgagcgcgcgcgacgcgacacgacgccctcgctaaacaagttacactaatacgcgtggcacgccgagcgcgcacgtcgtcaaaaggctggaccccggaccacacaagaaaagcgcgcggaaggtggggggtaaatatgcaaaggcggttcagacgcgggagtcgcccaaaaaaaaagcaggccgtctcgaccacagccagccgtcggggggggataagcgaaagctggagcccgtcgccacaagccttgtggtttgatcttaataccatctcgctctccacaaaagcacgagtagcattcgatcggtcactccgttccctgcatctgcatgtgccctacttacatttcatttcattcacctgctttaattttgtctctcgatcgcttgattcagtggctaattatagctccaaaaattaccgggtaatcctagtgctcataccgaattagtaatactctaattactccaattatcaagatcgcagatttcagc

SEQ ID NO: 107677 - DNA, 717 bp, Oryza sativa
tctaagatagatctaacgataataggttcaccgatttaaataaaaatcgacggagatttatctattttattagggtgccacgtggagacttgagagtatttatagggtgccatgtcacggtttgagagtgtttgtaggatatttaatggattttgaagtataagatagatagatagtactacgtacatatggtttttctctttatcttatatggtagaaaactatattttatatttttctcccgattatgctatgtaccttttttactttatcacacatatattttttcttccgacgaacggaacataggctttattgtttttttgggaatcatcgtactgtacttatgattttttgttttgccgacggtacgtattttcccttttatacagggaatgtattatatacacacctaatgattcgtaataggtccaccaatttaaaagaaaatcaactatagatatagatataatctaatggtctaaaaatgatgggtccaccaattaaatgaaaatcaacggtgagattagacagtgccacgtggcggcatatgagtgtttatagagtaccacgtggtggtttgagggtgtttttagaaagtttaatggacttttagtatataatagatagatgcccgacatattagaattcctcagcaataggaaaatataaattataaaatatatcatgagtagtttgatgcatatgttatattaa

SEQ ID NO: 107678 - DNA, 1750 bp, Oryza sativa
cttaaaattaagaaccggtagctatcatcagtcatcaatacacgtttataacagaaaccggcaccaatagtccctaaaatcatagagacctatggacaacacataggtgctataataaaccggtacctatggacatagctaggtacctataagcgcgatagtatagataccagtttttatgttgaaacagcatatatgggtatcacatatgtgcctcttgataaaaaccagcaattatgagcacatagatgccagtttacagttaaaattggcacctatgatgacgtagttcatatatgtgtgtttttttatctaactttttcatataaagttgaatgaagataaactttatattaaatttgtagagctcaacgagatctataatttaattttgtaattgatgaccttttgatttaacgtcatttggatgtccgaaaatgtgttataatgtctcggatcaattttcgtaagagagtattcaagaaacaatctcagatggagaaaaatatatgaaagtagaagatctagatgaggtctacaatcttgtactccctccgtcccttaatatttgacgccgttgacttttttaaacatgtttgaccatttgtcttattcaaaaacttttgtgaaatatgattggaaaataattaataattacttaatttttttgaataagacgaacggttaaacatgtttaaaaaagtcaacggcgttaaatatttagcaatggagggagtagttaacaaaattttcgttcgagctcgtctatagtgttaaatatgaattataagtttggatcagagtggtctgaaaagatgcatttgtttccaagacaactaatgtttgagagaggtctttagttccaatgttgcttgaagcatatctatgaatatgggttgtaaaaatcatgggacttgtggaagggaaatattactgtataggtaccaaatattctttttgggatttttagcacctgcaaaaaactaaaatagttgcaaccggcacctatagtagcacttaaacaggtaccaatgacttgggtcattggaagttattggtgctggcaccggaaccagcacctataagccctttagaatcggcaccaatggacttttgtgaagttgtgttatattgcaagaattcagtgttttgttagtatgtatgtacgaggacagcattttttttttctttccatcccctatgtcattgtcatctcagaatggaaacaaggcattgcaaaacatggtgatgaacaggtatccgtgatttagtggtgagaaatatattgatcaagcttgaaattcttggacagaactgtatataatctgaagatacaaatatttcaaaatgacgaccaagtgcaacgctgaagtgtcattttaggaagcgagaacaatggcaattggccccgccgaggtcttccgcaccctgctcaatgccccttatgtcacgaagaggaccagactatacaacatcttattgtttcttgtgtgtttgctaggcaaattttggttcattatcttgcagcgcgttggacttgcggtgcttgcgcggttgcgccacaacccacggagaactcatttgatgattgttttagccgggccaacatcttgttacaaggggttatcagcaaacgattaaatagtctaatcattcttggtgcatgaactatttggaaacattcaaaacgactgtgttatcaacggggctgccccaggcgtttcagcttgtctagttcccgcaagtgagg

SEQ ID NO: 107679 - DNA, 732 bp, Oryza sativa
gagttcacagaaatttgatttactctaaaatgtgttgttttcaatttgttatggtttttagaagtttacatgtttttctgttgaaaatataaaagctttaggtacttcatttagattttttccaaattttaaataggttgggtccacaggtcagtgagaccaatatgcaaaaaggttcctaggtttgaaccaagccacagttctaggcccatactccctccatactcgtaaaggaagtcgtttaggacaatgtttaagtcaaaccttaaaaatataaatcataaataactatcgagttgttgagtttgaaaatgtaaaaattatatgaatagatttgtcttgaaaaatacttttataaaaatatacatatatcactttttaataaatatttttatagaaataagaagtcaaagttgtattttgaaaaccgtgtcgcggtcctaaacgacttttatacggatcgagtatgtcattgagtggaaaggttagacattgagttgtttaaattctcaaaacaaagtcgtgtttccttctcccaccgtgcgccgcctttcgtcccgatcctgttcggattctcctcgcttttatttatgtgttcggtttcgtggtttttccttctcctcgctcgcacaaattctccatggactcgcccgacggtacagatgatccacccccgttcgcagcctccggtcattactcattaccgccacgcgatcgtcgtgctccaccctt

SEQ ID NO: 107680 - DNA, 726 bp, Oryza sativa
acacggtccgtctgaagcattgcacattaatttgcatctcaaactgtagtagcatgaggctttaatctgtctgatcagtttgcacctaaacagcagctcaacagcactgcagttcagctgaaaatgttgcaaaagtttacccaatgaggactcacatagggggtatatatatgagatgcacttcttttccttgtcatgtccataatgataattgtcctcttgcactcttcatcttgccatgattcaatttgaatctctggattggcataaacaaggattgtcccacacaaagctatactctagtctgcattttctatacaagaagtatttgaatacttttttttctaccaacactacaggttgcacccttactttgtgtttttaattcttggatgtaggcaacaggccttgccctcgtatattcagccttgttctgacaattcatatagcaactttgaagcctagctccaatgtttcagtgcagacattgaagcagcaaggaattaagccattgtgccgtcagattaacagcatgaacattaaatccactgaagcaacaaggatgtaatgcttaattgtacacattgtgacaaaatctgaacacaatgaaacacgtgagtgcatattttgaacagaaactgaaatcctgaaaaaaaatcagtgaataacctgaatgaaaactaaatgcataacttgacatgaatttgattgtgcactagtaatgta

SEQ ID NO: 107681 - DNA, 580 bp, Oryza sativa
attaaatggtgaaagatatttcagacggaacgaattggacatatatatatatatatatatatatatacaggggaacatgcacagtgactaattggggcgatgtggcgattaaattcttatgagtttaagccggaacgttgttccattgtgtcattgggataggggcaggggatcaagctatttggccatatggccaatcgctgcatatcattttacctggagccctgggtctttggggactgtgaaaatggaagaatttgactatttgccacttttacatttgccaaataaccatattccgttcgtaggattgaacttaagaattagccatataccgttcgtaggattgaacttgccaatttgccattgtagagagatggttttgtcactctttgcccacttttacactgcgaaggggcacatgtgcatgcccacatgggccaatgtgcaaaaagaccactgtacccctgctagctagttgtatgtttctcaagcgctaaagcctggacgcatggaattttaattttaactcattcaccggtaagaaacttggtcacatgctcattttttctattttaaa

SEQ ID NO: 107682 - DNA, 747 bp, Oryza sativa
gtacagtagttcatcaccaatgctcaaatagttccaagaaaattcttgaacatacttggacactcaaagtatttaacaaaactgtaaccagctcatttaatgattaatttaatatgtgaataattactgaaatgttctttgtattattaaaattagtaattgagctccgaaaaatccgagaaaattccagagagtataattaatcatggagaatttaataaaaattaaatccaaccatgatttatatttaggagtttttacttcccacatttaacttcacttgtaaattaatgaacatttaatataaattctaatattaatttactaaataatttataaatcctgagacagaaattcaggctgtgacattaacagtcttgaccgaaacactggtatataaaagctgctatggaatagagagcattctcatgagccttaaaatttggtggggattgttagatttaattggttaattgatccatttaaatcaattaaattaaataaattccaaggctcattatgctaggaattcatgtgtattcattctctaatgggatatcaatgggacgaggagttttgagaattaatccatttgattagtgaattggtaacttatatcaattactcctaattgatggatggttgatggttgtatagtggaggatggttcatcactagttgatgataattaggtgctctattcctctttctggtctattgggaacctacatcaattacttctaattg

SEQ ID NO: 107683 - DNA, 735 bp, Oryza sativa
agtatgaatagaatttgctggtaaagaaattaaccatgtaaaaccggtactggacaaagataaagaaaacaagcgcaatttaaaagtatcactattagcctcaccacattgcgctaaaaattgacctacatgctcccatgtggtcctaccatcttcaccactaaacttggtaaattcgggaactctataattacgaggaaacggcatattatcataatagtcaggatacggcttttggtaaaccttagcacgattcctagtttcaatcccgaatttatccctaataatcccaccaattatttcctccatattatcaggcctatgttgatttggtggtggatttggtggcctaataggttgtgtttgcggcgcaatatggttatattggacttgcctagtatcgggaggataccccctaccaacatcattataagcattaggaacatgtgggggaacttggggattagttgcagcagtagatacaggaggatcaaatgttctaagatgatacaaataactagcattagtccagggcctggtctgatcgacatccagaggcgcgatcagaccggcctaagtcccggtctgaccgccggggtaatacccggtcggacctgccatttggcctgtcggaccgacagtgaagtcgcggtctgaccggccatcaggcccggtcggaccggctgtgtgcgccactccatcggttctactatttgtttgatctataagggcttg

SEQ ID NO: 107684 - DNA, 666 bp, Oryza sativa
gtaaagatgaatgatagagtcattatattttaataggcataaccatgtgctcaatataacatggcaacttctatatcttcaaaactagatgacgtgctaagaaattcttttataactacataaatattatttgctcatgatgcaccaaataactacaagcgactccaacaaaaagttttccataacaagtcactgacatgttgttcatggacccacatctcaatgagagaatgaaggtcaacttttggtcttttgggccaaataaggattttatcccataatatttgaataagtaaattatcaaaattacattatcattcataagtaaaatgagttaggtaaaaggaaacgtaaagaccgcaatatccatccatccatccatgtgtgactccaagaccaaccgaaaaagaaaaaacacattcccaaactcaaaccaacaaggtcaacagaaaaaaatgcttgtgtcattctttctgacagtagttggattcgggttggatcagtttttgggtaaattacaatagccaggaagttttgcaccactaatcaaattgatatattccatgtcaatgcaatatattccaaaattagatcgcagtatactgcatatgatatattccatgtaaattacaatatgatatattccaggcatgcattgacatggaa

SEQ ID NO: 107685 - DNA, 626 bp, Oryza sativa
gtgagcagcaaatacactctaaaaatttgcttagatattacaaatggtgtaaaacaaattataattcttttcatcgatattctctgatctattttaggtttttgttgctgtggaatgaagggtacacgcagacgtacccaccatcgagccagcctcctttggggtatcagaactactttggcaaggagcagcacccacctttgtattacctgccgtcgcatgaaatcaaaatggaagcaaaattagatcgcagtatactgcatatgatatattccatgtcaatgcatgcctggaatatatcatattgtaatttacatggaatatatcatatgcagtatactgcgatctaattttggaatatattgcattgacatggaatatatcaatttgattagtggtgcaaaacttcctggctattgtaatttacccaaaaactgatccaacccgaatccaactactgtcagaaagaatgacacaagcatttttttctgttgaccttgttggtttgagtttgggaatgtgttttttctttttcggttggtcttggagtcacacatggatggatggatggatattgcggtctttacgtttccttttacctaactcattttacttatgaatgataa

SEQ ID NO: 107686 - DNA, 1431 bp, Oryza sativa
agcattcactcctggggaagggagctttactcccgggtgccaacccttcgtagtcctagttgaaataaccgggactaaagatgcataccacgtcaaaaaaacgcgtcggatgtgggattcaaactcaagatctctcacctcaaccctcacgcgtgttacgaaaacggtatgaaaatttcccgacggtattgataccgtttccacaaaactaatataataatactatttttaccgatggttaccgttttcaaaatttagttttttttaatttctgtcagcatggcattgaagttgacactaaggccttgtttgtttcagcttaaagattattgtaatctagattattaaattagattactctaagctgaattataataatgacataaaataagctacgagttgtttatttctctggattattagaggcatctaagggtagtaggtctttagccactcaataatctgaaaaaagcttctctagaggagattaatggattatagtaatccggcttatagattataataatctagcataataatctacttgtttgtttcagcttactcctaataatctagattataataatcctaagctgaatcaaacagggtctaaatagatgaattcataaatatggaaatttttcgaccgtttccgttcgttttcgaaaaataataaaataatgataccgtttccgaccgttttcatctctagtatacacatctgacttggatagagatgctttatttttaaactaaccctggaggcatctttactccgggttggtaacaccaagtggagctaaaaatatctttagtctgggttggtttatgaaccgggactaatgatcaatgtttagtccggattggtgttaccagccaggatgaaagatcctcctattttagtctgggttggtaacagcaactgggactaaagtgatgatctttagtccttgttgggggcctgacacggcctgacaattattgaaccgtggctaaaaatgatcttaaatcccagttagtgttcgaaccgggataactgtgatttttgtcgtggctaaagatattctttagtctcggatcctattcgaacttgggcaactgtgatttttgccgtccaagcaaagattagtgttgatatttcttaaacggcattactagaaatataattcccagcaatgacgaagaaatattcatggtatatttatggtcacaaatatgatccgtaagcgcacggatataccattttagcatttcaccccggagtattccaagtatcatatttgtttaatcccaagggaagatatgattagagagtactatgctaatagtttatatattacttgtatacatcaaggctatgttggggttaagttatttaaagggtatgtgacacacagaagaaagaactatgatacttttgctagatataat

SEQ ID NO: 107687 - DNA, 641 bp, Oryza sativa
agcgtgtcgagtggtaacgatttatgatctaatacttgcatggtttctggtttacgcggtagaaaattttgatttatgctatcgtagcctacgcgtattccatcaggttgtgcatcactgcctactccgctgatagctgctccacttccacgaccgtctctgaaccaacgcagctccacgccctcggctaatcatctggaacatctgcctgaaagcaaggtaatccctgtagatattgcgatctactaagacataagtgctaagcctaacatgatcaccctaatgcggaatttaggattactgaccgttgtttgaagccattgcaattgttctcgcttggtccggagtggatgtagaggatgcagaacctcgaaccacctcgcgaattgtcggtgtaggagaagtggtcgtagcagtgagtacaccggcttaatcccgaagaggtcgccggtgatcacctgcggggtggcggcggccttccggtcggcctaacatgatcaccctaatgcagaatttaggattactgaccgttgtttgaagccattgcaattgttctcgcttagtctggagtggatgtagagatgcagaacctcgaaccacctcgcgaattgtcggtgtaggagaagtggtcgtagtagtga

SEQ ID NO: 107688 - DNA, 622 bp, Oryza sativa
ccatcaatattactcaattaataaagactagctatgcttgcaatgcataatttgcaaataaaatatcaacttccactatatactatactactaacatagatgtaggagaagcacatataaatggagaagaatcgacagaaagtaaatggtcaatcaatcatacgctgtcgagatccagacttatggatgaatgcgcaaagaacacagaattcacacgatccactaggccttctggactgacgagacaacagggagacggcctgccgaaaattgggctgtttgggccagcctccccatctccgccgttgatcccaggttttggggtgtggatgtccaggatgcctccctcaacgacagttggagggcagaatgaacattttgcatcacctaaccgtcataactgccctatgtaaggacctcacatcctcactctctgcacacactcaagaagaagagctctctccctctctcaagtttagtagtatcctagtgctagtggagtagaaattataaaagtattcttagtcctcgggtcttcacgagaattttggtatgtctctagtagctatcctctcttcttttgtaagacctatggaattaatagaatattcttctttataca

SEQ ID NO: 107689 - DNA, 727 bp, Oryza sativa
cgttttcgtaacacgcgtgagggttgaggtgagagatcttgagtttgaatcccacatccgacgcgtttttttgacgtggtatgcatctttagtcccgcttatttcaactaggactacgaagggttggcaaccgggagtaaagctcccttccccaggagtgaatgcttgtttggttctatggctgatttttggggaaatttgtgcccaacccctactcgtcacgtgtgaaggaatcaggccgcatgtatggtgtggggccactctcttttggattgagacgacggttatgcaactttttaccaaccatggatggaggtttaaaaatagacttgaataattgtgtattccttatcttggtctggtcacttttataatgtttaggtgtgtttaattctatttgaactacactcttgttcgagtgttagattgtaataattggctgcagctctgtttagcaaaggccgggatgttatctattccattatctaaaaaataagtgaaggaatcatgccgcgtgcatggtctggggccactctcttttggattgagatcctcttccttaagtcagatgacattaaattctttgacatgtggacccatagaactagaaaaaaaacgggtaatttagaaccatgccattataattttgcaaagtttgagatatgccatcggtatctcaataacatgtaggacccacatgagtcaatgacatgtgggtcaggatggc

SEQ ID NO: 107690 - DNA, 663 bp, Oryza sativa
tgaaagcgttctggaaatgatgtagtgttgcaagcgcctgaaaaaaaaaacaaaccacctcagagttcaaagcgagctgacggctgcaccaccaccagtccatgcacccatcaatacaaagttcttgcttaacccaaaaagagattaaattgacctattagacgtttgtgcccataaatcgagcctctctatgtatatataattgtagaaaatattttaattttgctcttagtatataaaccaataattcctgtgcataaaacaggacaagcttgtccacatcggcataacaagcaaatatggcaacccctcattctaaaaataaaatgacacatttttcagagaaacaacaggttcagggtcaaaaccagcccagcagaagggagtcaggcagctccatctcatgaaccaactgaagtttctcatgtcactggtactgcaaaagaatcccctccataattttctggtaaagtgtcagtggcaaatcaccataattttctcttaatcacaagagactaatcacaaaatgtgtacatcttcaaacttaatagctgatttgcaagccacataatagaagagcctgacagccgcaccaccaccagtccatgcccccatttatacaaagcaagacaaatcatctgtacgggaggaggatttttgtcc

SEQ ID NO: 107691 - DNA, 503 bp, Oryza sativa
ccccccccccccccgagggggtcaggccacgtgggtgaccgcggctacccaagcctctagtcacgatacccccggccccatgtcaccgacacctgcatatacatatacacgaacacttgtggaatatgtgagattaagcacctatcactatattggatgttttattatctgaactttatgcagatgttgtcggtatagaatctgcatttaacatccgccaacattcactaaggttagggtaaaggaaataattagggtaggttaaaagagttctaaagaaataatacttgaaccaaaattaagaataaaagagttcaaataacaatgattttaattttgctaatatagtcaaaagccagcatgatgcagtcaaattttagtttaaaatttgaggatgttacaaacctacccaccttaaataaatctcatcccgagatttgcttaggagtcttcaaaaagatacgggaattccaattgtaaataatcttcccgtttccaggttg

SEQ ID NO: 107692 - DNA, 596 bp, Oryza sativa
aattcctcttcatacattagtattagtggtataatgctaagtgtagtagtatagaatagtgttcggagtcctcggagtcttcggaagagttttcggtatggctctagcagctcttgtaatctcttctgtaatactttccgtattaatgaaatactcttctttatatatcttcggtgctttgcttagtcttagtactggtcttactttatatctgcattatatgaattgtgtgggtagcctaccagagaggtgtaatggtgcgagtttaatgtctaatttatcagttgctctatgtcgggtgcacggctatagagtagtatttagtaatgttagcatggtgcttagattattaaatatcattaattgggcatatatgttgcaggacattagaggtgggccgctgatggtgatagctcagtatgggtatttctccacgttagtatatattcctaagacaaattcgaagggagggtactcctctatatgtagccccggttggacggccatgacaggttgtcgtaagtatctcgccaacccagggtggtctctcgaagtaccaggaggacactgttagggggtattggccacatgattgt

SEQ ID NO: 107693 - DNA, 548 bp, Oryza sativa
tgaaaccttagcgtggtgtggatggttaggggagggttatgcggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttcggcctgttgcaacgtggtgtagcgttggacagtgattggttaatattgattaattactacaactgttttactgccttcaactactgcttttaaatgctagctttatgcaaaagaacctttagcctcctttggttatatcctgcatcatacctcctcttccggtatgacttgctgagtacagtgggtagtactcagtcttgctctcttttcccccacaccagagtagaagttctttctcaattggagccgtctcagagaggttggtttcgtcgctgccgtcaa

SEQ ID NO: 107694 - DNA, 731 bp, Oryza sativa
cttataaatatagaactatctattccatatttccatgacagttttgtgtgtctttctgcagaataatgtaattacactgaaatagatgatggtctgagttctgaaatgcagtccaaaacatttttaccaagcaaaggaaagcatcttgattctactataattcccatgctatgtttaaaagaggacaagattatctagcattccagcaacttctgcatatgacatgttaaagcacttaataatacattctcagtttataaattagaaatatatttacttcttatatgtcttacctacaaataatgctattcttatccggatacacaatatcctcatgtatagaaataatgctgtcatcatgctgagagagagagagaggtcatttgtgaagaagagcaatactgattcagaactaatcatcagctgagaaaaataaatcatattatagtttcaggtttgtcactctatttagtaaataatgttgttccacttttttttgttaatgcgtaagttccaatcttagcatacctttgtcgagttaaaatgataactacacaagtttcttctgtctttgacaccttggtctccacagtttcatttcacttttcaaggatgaatacaaattaccaaaggggtccgtgattgagccctcaagagaatcaagacatgtgcttaaaataagtagtaagctctatcttcaccatttcttccctttctttgtcgttttttta

SEQ ID NO: 107695 - DNA, 705 bp, Oryza sativa
atagggccaattcgagctcggtaccctatctatatggaaattaaatcaggccaatatatccagtgaaaccaagtggtattggttgataccagtaaacatgtgttttctctggcattttaagttgcagtgttctgatgacttctaattactaatgatgtgatgcatatattctatggctggttctgtatttctttttatttgaatgtaattcgcttcaatgatttgatgtggttaaaggagaaaatatctaaggccatgtttggtttctcaggagtccaggagttggagccatgcaaacatgcatcatgctaatgtcgacctgagcttccagattaggccctgctgtattgatcaatatattcaggtcatttgaggctctaaattaattctgatgataatttttattctgctgtatttgacgggcctcatgcatctgaagatctggattactgtggccgaattcgtagttctgattttggggtgttaaatactgaaatcaataccgctgtccttgctgtcatggagggtatatggtgatctggttacttcgattacatcgagttggaatgtcaatgctctctgaacctcgaatttattactgagttaccggattagattattggcttcggaagctgaggcttgtgcaaatgatcctgcgtgaagtatgcacataatttgtttcccagacgagtttctgcttactat

SEQ ID NO: 107696 - DNA, 557 bp, Oryza sativa
atatgccattcttagtaaataaaaaccaagctaacttattcgtaagaaacctttggattctcccagttctctcctcaagcaacgatcttattgaatatgccaccatcgtaattctgatagacaattgtaatatataccattagaaataatacactgtagtgtagcaaaactgatgtctagactggagagataaaccttacctgaattcaaaagaaaaccaacttacagaggctacatataaattgtttataaattatatatgtttaaattacaaatagtactactccatttctttttcacaatctttgccatgtactttcggcataaattcaatggttaattaatcggggtccaattacatagaagcatgaaaacaaacaatttgcttgaaaagttcaaaagtgaaaaattgaagctattagtgcagattaaatcagagcacaatgaaaaatccaaatacactccactaacccaatttaattgctaggctacctgtatggtagccaaacccctcagccattaaatgcttagacagatccctcgagagtagtagaaat

SEQ ID NO: 107697 - DNA, 627 bp, Oryza sativa
ccagttaaggtggaggattgatcagagtcatttatatgatcctcaggcccaacactgaaatgaaaagcccagtcaaaaaaacactagaatgaaaaggtgccacatgtatagaaatacatatctgaaatagtaagttatcatggggaaaaaatggctcactcattgggtaattgcagatttttgatgggatgtctccatctctaaagcagcttctagtattagtgcaagactgcttcactatggaagacatataatcctttgaataagcattgtagtccctttctttacttggcactgcatgagacaccttgatgtgagtttatggaaattgttcacaatttttttataaaaaaagaaatctctaaatgctatacaaatgggagaacctatggcaatgagcatagtgttgatattaggttccaatgttgtgattgcaatgtcccatttttcgaactttcttctagagttcacctagaaaaaaagatctgatcagtacttcaatcccagctgatgagttcttttagatggaatggatgcaggttctgtagaacatcataaacatggcaagattagggtctctcaaaatttcatcaccaacagtggcattagagcacctggtaaattggt

SEQ ID NO: 107698 - DNA, 799 bp, Oryza sativa
tattacaatctaacactcgaacaagagtgtagttcaaatagaattaaacacacctaaacattataaaagtgaccagaccaagataaggaatacacaattattcaagtctatttttaaacctccatccatggttggtaaaaagttgcataaccgtcgtctcaatccaaaagagagtggccccacaccatacatgcggcctgattccttcacacgtgacgagtaggggttgggcacaaatttccccaaaaatcagccatagaaccaaacaagcattcactcctggggaagggagctttactcccggttgccaacccttcgtagtcctagttgaaataagcgggactaaagatgcataccacgtcaaaaaaacgcgtcggatgtgggattcaaactcaagatctctcacctcaaccctcacgcgtgttacgaaaacggtatgaaaatttcccgacggtattgataccgtttccacaaaactaatataataatactatttttaccgatggttaccgttttcaaaatttagttttttttaatttctgtcagcatggcattgaagttgacactaaggccttgtttgtttcagcttaaagattattgtaatctagattattaaattagattactctaagctgaattataataatgacataaaataagctacgagttgtttatttctctggattattagaggcatctaagggtagtaggtctttagccactcaataatctgaaaaaagcttctctagaggagattaatggattatagtaatccggcttatagattataataatctag

SEQ ID NO: 107699 - DNA, 686 bp, Oryza sativa
ttacatagaatggattactgactcaagtctggtgtcattgatatacacaggagagttaatatagaatatatgatgttactaatatatttatcaattgattgatttagtacatggacgtattttagtgtatgcaggcagcgcgcaatggcgcgccctagcatctagtaaaattaaagtttctcctgtgcaacctatgagtaggcaatggttacaaagtataaagttccctgctccagttgatctgttctgtctctcaattgcctaaggtggtgagaagcgggtgttctacaatttttaggcgtaagggtaagcctccgtgcacatttacttaacatgagagagagagtactcaaactatgcacttgtacattttaaatataacaatggtagcaactcctgatcaacaaccaagtttattttcctttcgtcctttacttgggacgagcaaaggtttaagcttgggggtttcgttgacggttgttacagacaatatttgactgccaatagaactaaaataatgaagaattagctatgcttacaatgcatgtttgttttcaaataatatatttccacttgtacttggagaataacatgttgcaggaatttatcaaataaaataaagagaaattggagaaaacctcactcctaaacaagcaaatggatacggagggaccacatgtcaagtg

SEQ ID NO: 107700 - DNA, 617 bp, Oryza sativa
ttgtctaccgacaaatgtatgcttttttatacatgttccatttaataaaagggttgtggaacaaaattaaatgctaaaaaaagtgtcctcttcatccgtagtgtgttagtttgcagcagagcacatagatgtatggtaacaatgtatcgttgcccatttttttatggtgttaatgcagcccagacatacagggttcaatatcataagaatgttagctgtccatataccatgttttcttttggtgcctaggaaactaaaatataaaatatatttgttatatcttaaaagttccacctgttacaacatatgtaatatatagtagttagtatgttgccctccctagtacaagttatacagtccgattcataaattagaatatcaggtggatggcttgatttgcttacaacaactacttgatgctacaattgtagcactcaaatcttttatgcattgcaatcgcacttaggcctgtatatatatatatatatatatatatatatatatatatatatatatatatatatatataaaccatgcatatatatgtttcaatacatatatatgcatacatatatatatatatgtatatatatatatattatattatattatatgta

SEQ ID NO: 107701 - DNA, 653 bp, Oryza sativa
aatttttactacacataaatgtaggtcagaacttgtacaatgtatggtttaaaaatatatattggcaatttctacagaacttatggataaacagaaacaaaatatgggttatgaatgaaaaaaaagaaaataattggctggtagaacattttaatatattcatagctagaaaatgtgtaacatagttctgatgttctatagatggcacatgtcagttttgataatgaaaggttgctagcacgggtgcaaaacaaaagagtaaattaagacacctaacagatactgtaatctggcctaccaagtacaatagaattgataagcgaaaaatatatgctacaactacgtatgaatatacaagagaacacagttcgtaagtacattctatcatcttgcaattgagttccctgtgtagatcagaatcttacctttttccatagggcgtttttaaagcttcaacttcatgttaaaaaagagaggaaccattcataacaaatgatcatatgatatgttactgaagatccatttgaaaagaagttgaataaaaaaggaactaaatgaagcttactggcatgtttttccccgccagagtatggatgcaagcgggccgacccgcgagtcacttataggtcaaataaatcatattgtatgggttt

SEQ ID NO: 107702 - DNA, 688 bp, Oryza sativa
gtgccatgtgcttagtggtctgaccagtatggtaccgtagtctgactatggccctagtggtcaaactggggacgactcattttagtttgacttttggtcgcctcgggtttgcatggttggacaggtcacataacaacagtctgactaaggccagctaagattgggttgattaggacttatgtccaagttggttttgagttggatggctattgcaatattcttagtgatttacacacattacatatgatgtgtaaacgctaatttgaatcaagttcagaagaacttgtggtaaaaaaattgtttcttggtttggttatgacgttatgtacagttattacttgagggtgagcgtggtcgatgaccttagataggaacaagacagatgggggtgttgaggttcagtcattcagatagtcaatgagttcatgtgggacacacgggtagataacagtgcatgcgaaggtgagatttccatatggaattcatgggagatgtgcatcttatggaaaagtataataatttaaaaatagtccaagtttggcgaggacaaactcggttatgcgagtctttcctctacagctacgagccctagataaagaaagatttgtggcttgtgacagccatgttgcgggtatataaacactcggggagagcaaaattgttgaggatttttagagaagaattaggg

SEQ ID NO: 107703 - DNA, 686 bp, Oryza sativa
ttttccttgttttgcgtgccagcgtgtagttctcgtcgtttcggaagtccgcggtcacgaggaaaagagttcggaagatcaaagtgaagaagcaaggcaagtcacacattcccctttagcatgttgatcccaatttacaaatgttttactatttgcaaataaatatgcgtgttttgctaattacatgggatcagggtttacctatctgctcgcttgtgccatatttacttgatatatgtcctttgtcaacattgggtaataaatcgactagctcatgttacttatgtgacctagctagaactatatgcttagccatgcttaattaccactagctcagttgatgggataattacaatattagaccttttagtatcagaatgagctgcgtgctcgagacatctggccatgcttcatggtcataattatccaactaaaatgcgactgaagggtgggctgggggtgcatggttttgctagtcgcacccatggcaattaaggaccggttcacgggaaaccctggaagaatttctcgtacttaccacaagccagcgtgggcaacggctgggcttgtagtgtagctttcctctagccgacgcatccaagcaagggtgggtgtgatggagcggggcgggccctcgacaggctttgtcgctttccgaattacctaagcaccagaggggattgccc

SEQ ID NO: 107704 - DNA, 606 bp, Oryza sativa
atacagaggtaccacattgctaattaacataatgactaggtcagtccccattctagaaactgcggtcgcacccgttcgtttgacataagtacctggtgacaacttatatcgatcgagacagtactagccatccggaaatcatccaattcgtatgtcctgtcccaatctaagtataaaacattttaaccagattgtaagcaaaataagcaatactaaattatctgggtttctatggttgaattatgcatgtgaaagtagagtattgagtagaaaggttataaataaataacttgtaaaatataggcttaaacgatcaaaatgtgtatagtaacttgccttgctcgatgtcctgagattgactgatattatctaatgtgtcataagattcctcaagaccaagggttaaacatgtaaaattcaaattcaaaagggattcaaataaaatccaaaaataggtaaaaataaaataaaatataaaaatagcaaaagtggtctcaaaagatagagaatgattttagaaaattttggatcaagtttcactggaaatgaatctatattttaaaaaatatgggcttctaaagtttgaaaaataaattaaatgttaaa

SEQ ID NO: 107705 - DNA, 631 bp, Oryza sativa
aatttctccatcgagtccttgcaacatgtaagctcctttagacacaccttatagatttggaacggtcttttccaattcggcgaccacttgctgaatttgttatcccaagtcccaatcagcaaaatcaacttccatacatgttcaccgtccgaaaaagtcttgggcaccactttcttattgtaatgtcgagcaactcgttccttatccttggtaacctttgcaagggctcttaatctagattgaaccaagtcttccctttcatcggccatgagattataatattcattggctgttaaatcattttgtaactccgttcttcttgagccgattctaacctcccatggtaacacagcctcatgtccataaacaagcttataaggagggacttggatcgacccatgacaagccatccgataagaccacaatgcttcatccaatcgagtatgccactgccgaggaaaatcagaaatctttctctaaatcaatttgatcaaactcttgttagatgcctcggcctgcccattagcttgtgcataatatggtgaagaattcaacaatttgatacccatgctatcggcaaactgaacaaactcattggacacgaagatttaaccctgatcggttgtaaggt

SEQ ID NO: 107706 - DNA, 607 bp, Oryza sativa
atgtcatataagaaagcgtgcaaactgatctcatgtcaatctagtttttttattgtcatgtgcaaaaaaaataaacctcatggtttaaactactcttacctatccaaaatgtgcgacaaactatgaagttttatcccttgagcacctatctttttgtgatgaggaccagctgggatatgattatggctatcttgatcaactaatggtgcatgctttttatattagatttacactagccgccaacccgtgccttgcacgggctatatatcacttatatattataaatactaaattatgcaatttctttgtattataaaatttaaaaatgtaatcatatgttaccaattggtaactttgaatttcgttattaaataaataaaatgaaatattcaagatggatacaacttcatatttattaatgaaatttagatacatcgatttggactaaagattgagctcataatatataatgcagtgaaggcatgaccaataattttgcatccataagaggaaataagcagaacatgaaaattatattagaccatactaatccacctaatattttcgtaattgcattatggcaataaccatatatcctataggaaaa

SEQ ID NO: 107707 - DNA, 540 bp, Oryza sativa
ggcgaattcgagctcggtaccctactcaagccgattacttacatttgtagtttattggaatctatgcatgtgacacatatgactttggtgattcattattgatcatacttcaattggctaagtgttttgatgccatgatgattattgtttcaaaagccatttgaattagtattcatctagacatgttagtccttcccatccagccacgtgactctatagcctggccctccccccgcgcctcgcgagtcgcagaagcagccggggggcctcggggtgccacgtcacgcccttcgggccctcgcgctgcctcgccccaaggccctcgcccaactgtcatgtggcggggggagcgtgcgggaaggagacctaggctgaaccgccatcaatgcgcgcggcgccccaactgtccctcaccgggtttaatgctgtaagggcagacgtgtggtgccgtccgactaacccacgttaatcgagtgtgaccagactgtgacaggcctgtcacccgtcacgtccgattgaatgggtggttcgtgcccccac

SEQ ID NO: 107708 - DNA, 582 bp, Oryza sativa
tttttctatgcatttacataatcatatataacttaagactatggaatatagcttgaaatacaatgcaacataatgtccaaagcattcatacatatacttccaatagtagtacatctatgtgcaaagtcgtatcttcaaattcattttacatagacagagacaaaattatgacagaattacaaacttaaaactgtcaaattttatttttgttacggctaaaatattatgaatttgaggttaggattttatccctaagtgtaatactattgaaagtacatacgtgaatttttctagattttttagtgacatttgttagttggtgtgcacgtgtgtacacgtgaaagcttgtgtgcataacatatgttgcctcaccacaattggatcagaaactctacacttgttgtctatgagtttttaaccttatggttacgttcttgtatgattgtcgaggaagtttagtagcgcatgcgaaacgaaagctcattagcatataattaattaactattacaaacttaaaattggatttatttgattttttttaaataacttctatgtattctttttaaaataccattcaacag

SEQ ID NO: 107709 - DNA, 906 bp, Oryza sativa
gcatttttcttgatttactgagacttgaatgggcttaaacggagctcggatgaattagatatgaattttagaagattcactatgtttttactataaacagaaaaatccttaattgatttattgcgcaataattaaattcctagggagagagagggggcggcgccgacatgcggggcccacatggcagtgactcgggtggcggtccgaggtggactgggtccacggaccgggaaagaggcagtgcaccacgtggtgcacacgtggcgctgacgtggcgcacacgcggcggccacgtggcagccacacgggcggtggggttagatggccccgatctaccgcccgatagatcggacggcggaggcggctcgcagccggcgcgcacgggcacggctcaaaccggcccagcgaccatggcgcgcggcgacgcggctcgacgcagcggcggcgaccggcagcgaccggccgggggcagagggcggcagctaagcggctaggcggcggcgcggcggctaagcagcgcgggagagaaagaggaaggggaggaggtgtctcaccgacggcgattgacgacggcgagcgacggagggcgatgacggcaacgggacgagctccggaaccacctagcgaacatgatgaatggggttagagagagaggaagatggaagggggcgaggacgccggccgaaggcggcggccatggcggtgctcaccggcgcatggtgcagagtgggttccgacgtcggaatccgacgggagatgggtggacggggtggcccgcacgacggcgaatgcgacggcgtcgacggcgcggctcggcgcagcgactagcgatggctagcggcggccgagcggtggcgacggcggcggaaaggagggcgacggcgctagggcggtggagtgcacggg

SEQ ID NO: 107710 - DNA, 615 bp, Oryza sativa
ttcatatcgtaaaactacgagcataccttgattgacaaattcttgatgggaatatgcatctcacatggtatccgctgcgtgatttcatcaatggggcaggggggttcatcatgtgcttgcactgcttccatgctctatgatcctacttgccccgttgaggcgtagctgctactgcgattgcctgaggtgctcaccatgacgggcataatagacagttgtgtatcaagtccccgctgttcggccaggagttggtccacttgtcttgacaccttctctgtaatccttgcatcgtagttcgaggctctatactcaagatctataatcttagcctcggtatctctcatgctccttatgtgactcttgtacgtgcggatgtcctcttgaaatccttatttccaaggaaccatgcatttgcctcgcgttcgtcctggatgctcagcattatgtattgcgagcataagctcgtccttctctctgttgggccggaatgttccctattccccgagcatagccatccactgcatctataagtcggcttgttgattcgcgaatctcattgcgtatagcagggagccatcaacgggaatgagcgatccgccatgtgcatagtgccaa

SEQ ID NO: 107711 - DNA, 703 bp, Oryza sativa
ttaaaaaaaagttgaaaaatacaatttatttgcaaatacttaacattattgtaatatttgtgtatcacatacttttcaaatattataaaacattaggtgaacaatgcaaacaacaacattgcaatatttacaaattaattagtagctaaaatactagttgaaacatttaaaaaaactatgtgcaacatttaaaaacactcactagtagctaaatttatttttcatcataatataatcatatgcggtcctgttataaaaatttatttataacagatttaatggtataatcggattgtaaattggatatgtaatttaagagaaaaaatagtttaaaattaccaaaaaggacttgaaccaacctaagcaaccctgctttattcttatactcagtgcatgcatgtagagtttttaactagcatgagtgttggttttgatgtgcacctgaccacctataccgacagaggcctgggtgtggtgctcgatccatagtagcttcgggatagagcgcccaataaaaatcagattgtacactacatgcatgcaagtataccatattttttctcctaaactacttattcaatctacgaaccgatcatcccgttgtatttgtcacaattaaatctttacaacaatatattatatgattatattctaataaaataaaaacatatgtttcaaatcattaaggctgtatttagatggt

SEQ ID NO: 107712 - DNA, 3621 bp, Oryza sativa
atatttgagccgtcgtattttgaatgccgaaacgaggaatgactttatagaaagacttcgtttatgtctatactatgctttttcgacgtggcaacattacttgttatctactacttgcatagttgcttgtcaagccgatgttattaaacatatgttgcaaaggccaattttgagggggagaacatgatttggcttatgaacaattaaaatatatcaaaggccaaactgcagttgattttatagtagatcatcatgtggatgttgcttatgataatgaggtttacttgcttagtgtttgaccttggaaggtttagtttaatggttcttctggtaaggaaggacaaggtatagctgtagttttgttttcgctcagtggtttatgctttgagacatcggttcgtttagaatatttttgtacaaataatcaagccgaatatgatgttttttattcagcttataagtgttgcaagctatagtggctacagatgtagaagcttttggtgattcggaattagtgatacaacaagttgccgggtatataaatgttttgatgggtcactaaatagttatgatcaatgctcggatattattgccaattttgatgatattttcattcgacatattgctagggaggaaaaccttagagcaaatagtttagctcaacaaacatatggctataatgtgaagagaggagtattcttgattttggaaaagtcggtgtttgaattcaaaagtttggacaaaattggcaagattacagaccaggagtggtttgactggtgcattgcagccggtctgaccggtggtgaccgtctgtctaatcgcctcagcatggccggtctgaccggtggtgaccgtctgtctaattggtctgaccggctctgtatggctagtctgactggatattggaagaatgggacgatcgatttagaggccaaattgattgtaaattcgggcatttgtgcctaggagttagaggaaaactggagaatccctttgatatattatttgaaagatcctagtcttagggttgatcagaaaatttgatgacatgcatttaaatactttttcttgatggagagttgtatcgccgaaatgtagatggggtgctattgaaatgcttagataatgatcaatccaagatttccatgggagaggttcatgaagggatttgtggaaatcatcaatgggcccataagatgtattggtttcttaggagagtgggattttattggccgaaaatgattgtgattgtttcaagtattataggggacgcaaagcttagtcaacagttcggcaatgtccaatttaatcctatcatcaaaccatggttgttccgaggatgggctttggattacataggtcaaagttatccttcattctcaaaagggtatcgattcatgctagtaacgatagattatttcactaaatgggccgaagccatgtcactcaagaatatgactcataaggaggtaatttactttattttaaaacatattattcatagattcggcattccttaaacattaactacggatcaaggagcttcttttatgtctaaggaggtaagaagttttgccgaatcttatggtaatgaattgttgagttcatctccttactacgctcaggccaatggacaagccaagtcgagtagtaaaacattgttgaaattggtcaaagaaaagatcgaagaacatccaaagaggtgttatgaggtgctttcggaagcattgtgggctcataggatatctaaacatggtgttatcaaggttactctttttgagttggtttatggacaataagccattttaccggtggaggtgaatcttgtctctgttagatatataaagcaagatgatttatcggttgaggaatacaaagcattgatgggagacaatcttgatgatgcgaccgataaacgtttgaatgctttggaagagatagagaaggagaaaaagggagtagctaaaccttacaataaaagagtgaaagcgaaatcgtttcaagtaggagacttggtgtggaagacgattttccctttgataaaagagtgaaagcgaaatcgtttcaagtaggagacttggtgtggaaaacgattttccctttgggttctcgatctaaggagtccagtaagtggtcacctagtagagagggtcctattcgaatatgtggaatcgttcgaggaaatgcatattttctggccatactacaatgagaacgattttagagagcaattaatggaaaatatttgaagaaatacttcctaaatgtttggcaagatgcataggaggtcatatggccggtaattggatcatcgccttgagataacatgttctatgcttttaggttcacaatgttcaccaaaaagttaagggcatgtgtttacacccaaagttggtgccaaggttcaaattaggaaaatattgccgaaatttggaagagcactgggggccggtctgaccctcgtgtgttggccggtctgaccagtggtacgcgggttccttcccagggccagtctaaccgtcgtgtgttggccggtcagagctctgcttgtaggccggtatgaatggtggtatatggccggtcagactagcagagtccgatcccgagtctgtttacgttgggtctcgggattcttttttcgagagggtatgtttcgtgtttccattggtttctattccgagttggatatggagggggacctataagaggcaagaccaacccttgtatataggacaaggccggttcaattggaaaaaaaaacctatctacacattatccaatctagccaattgaatcgctttttcaatatttctcctagttctagcctagttcgtccatctttgtcgatttgccctgtaaatcatccaccttcgttgcgagagtgcgaaatcccttcgtaggtttgtcctgcgaaatgccttctgttagatatttatcgcttgttctacctaaatcggctccactagccggtttaatctatcaaacccctagcttttgctagagtgcggtggttggcgactctatatcaccgcaaggtgtttaggtgtcccgatcgtgattgtcttcttggaaaaaaaagttactaacagaaggcatgatgatgagacaccggtgctgatcttccgataaatacacataaggtaattatggagaactcattattgatgatccaaaagcctcctcacaataactggctaccactccgttggttaccaaccataccaaaacggattgacctctcattctaataagggtatctcctgtaatcgaatcaagagcagaaccaaaacaatagaatatgcaatctgaacataatacaaatataacatgaatctcacaaattgaggttccatcaactgaactactgatgaaactgtaaatggcagaataatctaagcaaaatctaactctaaatgatgatgcccactaatgatatactccctccgtcccataatataagggattttgagtttttgcttgcaacgtttgaccactcgtcttattcaaaattttttgaaattattaattattttatttgtgacttactttattatctacagtactttaagcacaacttttcgttttttatatttgcaaaaaaaatttaaataagacgag

SEQ ID NO: 107713 - DNA, 945 bp, Oryza sativa
gcacttagtcctcacaccgaaaagaaagcagcggcagtggaaaaaaggcgatcctagtgtggcttcagctccactccacaggcaaaacttaactggggtctgagccttggtcctctaacttcgtcttcagctcaaaagcactacacttctaaaaagggggaaataatagcaaggctgagtacaaccaccgtactcagcaagccacaccaacgatgcagacgtgcaaggggaacacaaggacggtttgcggctatttgcataaaggcggttgtaaaacattttattgagcaaaacagtaaaactgttgagtgattatagtaatattaaatctccactgatcaatgctacaccacgttgaacaggcccaaccaacccacctgaactacagtgcattgggtcgatttattaagtgtgagactaatcacggtgaatctggtcgatcgcccataaccgcgggcgcggctactcgaatagttttactctggccagaggtgcacaactgtacccacaagacacaatccaccgacatgtcaccacgtcatcatgtacctatgatgaacacgtcaccacgtcgagtgattgtgacaagacccttcatataactcttccgtaaccatccacaccacgctaaggtttcacccccacccctcaaaaggcagtgggcggtcccctcttgcgccgcggtgaatccggcagctggacaaccggacaccccggccgacccaactccatcacgcccaccctcgtcaccggtgcctaagaaatggtcgagctatacttcagatcaagcagttacccattcccgcttgtggcaagcgctgtaagtcttccaggggtgtcccgtgaaccggtccttaattgccatgggtgcgactcacaaaaccatgcacccacagcccaccattcagtcgcattttagttggataattacgaccataaaacatg

SEQ ID NO: 107714 - DNA, 1128 bp, Oryza sativa
cccgctctatcatcatttgcaatcgttgtcttttagattgacccctatttcagtatttcttcttttcaatgtctagtttttgttatttctaaactgcatttttataagaattctcattttctctcatttcagatcttattttttattttcaattttaattaatattgtattatgttctttgtacactgttctttcaatattccctattttgttattttgaatttcggttatttctaaattgtattctgaatttaactcttattttgtttctaatttatttttatatttcatgttttatgctgcatcttacttatttcagtgtgtgttgtaaatgaaccttaacttattttatgttttactctcttctttcaatattcttaattttctattccaaattttagttatttctaaattttattcctacttgaaaacttatttttttttattttcctaactttttaaaatttttattaatctcatgttgtgttggacatatatgttttttcatattctttttaatattaaatttcagttatttctaatttgtattcggacttgaaccctcttttttcctcctttctatttttagaatttatgttctttatttcctgaattttaattaatatcgtattgatgtctccatggaatattcttccaatatttaatcccttcagttttgaaattcaagtatttttaaaattaatccttttaaattttatttgtaaaataaaattttacttgaactttcatccttttttttaataatgaattttaaattattttttttttgaaattcaattattttttaaaatatattctacaatgaaatggtaaggattttttatttccaaattttaaaataatcccatgttgtgttccagatgatctcttctttcattatttttaatatcaatttttagttatttctagattttatccctacttgagctcttctttttatttttataatttcaaaatatattttatttttagtttgaattttaattaatcttatgtggtttgctagatgaactattatttcaatatttattactccctatgtaccaaaatataagcatttttttactaacacggtctccaaagatactactttgatcaacaatattt

SEQ ID NO: 107715 - DNA, 738 bp, Oryza sativa
ttgtaagacgtggatctgtatgtcaccaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgtttcgggaaaatttggagttttgcctctttggtttgcgggaaaaatcttggtcgttctttcggatcggattttttttttttttaaaaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttg

SEQ ID NO: 107716 - DNA, 670 bp, Oryza sativa
gtgcttgcatgatttgccctcatgttcactgtcgtaagagcttgagctactacaaaaagcaccagaaacttcaaaataacagtggtggcataaagcaaacaggaatacaagtttcgcaagaagcaaaatatctctatttttttcagtgtagcagagaaagccaagacagcttgaaggctaaaactagggaaaaacttgttgctatgccgatcaatgtcatccaattgaatgattcaagccgtaacaatgtaatgcaagactatggcattttttgtttcaaaatttccctggtacctagattctgaactatgctttagctgcctaaacttgatgccatgatagctcctaatcacagataaattgaattcaaaagaacaaagcatcatagctccggtaaatgccatggattgccaccctctcaggcttacagaatatttaactgactgaaaaggaattttaaatggagatgcgaacactcatcttcaatagtgagctcaaatcatatctaagaaatccttgtcctactgctgatagaaccgatcactgactattaaactaggaaggaatgaggcttttgcctactactggtgcgattgttacacattgaaaaagtacatcacagaaattctccaaaccatgtaattcgagctagcattcagtgctcattact

SEQ ID NO: 107717 - DNA, 1040 bp, Oryza sativa
cggagacctgctctcccaatcactggtgcacgctggcgagcaggatggaataaactatgtgcgacaacactgtatagaggaggaggcaaaccctaaattgatttcgcgtgtgtgttgactgaaaacacggcggcttaggagatttgcttcactccagtgcaggtccaaggcttgtctcaagtgtcaagagcatgtaggctgattttatcctgcaaccagcaagaaagacaaaaacgtaattagatgaacgatagccaatcggccgatagggccgatgacttattgtcaggacccaaccgatacgggtaaacctaattggctgtggctttatgatagtcaattagagccaaaaccctaaatatgccctattggttgtaggactgtttcttttagtttttatcaatcgttttaagacaatattatggaaatagccgatagatcaatacttagagcgaagaaagataatgtactggctaatactccaatacagacttatataaacagattaatctataaaaatataccaaataacaattgatcaccagatatgaagtttaagcggtcaatctaactcgatgtatttatataaagcaatctatctatataagaggcaattataaataaacagatcatgaaactcgcgctatcatatataccaggtaagatggactgaaaccccaatactatccttagttatgattagttccatgttagtttcaattatatgattctaagcacggctagggatgatgcatcacaaagtatgcaaagaacataaagtctagacaaaattgctacaggatatcgtgactaggcaaaatttgctataggacatcgtgacttcacggttttagctgtagtacaccgcacgaagtgacttttgggggaaaacactcccaaaagttggatatttgctagtgcacaccgcaagcattaaagtaataattaacggttagagaggatatagaaatcgtgtgaaatgtcaaaaatgcccttgggcccacatgtcagctatcctatctcttttctctctcaatccc

SEQ ID NO: 107718 - DNA, 1353 bp, Oryza sativa
gcgccgctggccggagccgtcgcccgcgcgaagtgaggagagaggggcgccgtcgcccgcgcgaagtgagaagcaatttgattttgatcaaaatacaaaacgacttataatttcaaatggagtgagtacttatcggacttcgctaatatttttttctccagtattttagttaatcagtaataaaacatactagcagtgaagctcacccaaccacccaaccagcctgagagcgtacccgtacataccaccgctcatgcatttggtacaagtcggatatgcaatactgaagcttaatcgttagccctcgatggtgaaaatactatcacaattacatgtgcatataagaaacccttacgacttctttggatggcagaatttttcgttttttttgtatgaatcattttaatccccatgaaattcattaaaaaaattctcaattccaacggaggctttaattcacatttcagtaatacatagagttcgactgttcgagtgatcagtagagcagcgaggtgtgtggtacaacgaggcattggggggaaataaaattaagactccatacagcttgtaaaattaagaattattgaaaagtttggatggattttagatgagaattcgtaactattaatatcaaattttatcgctattaataaaaataaagtttgcatattggttttatagaatttagtcacatatcggtatatgatataagtagtaccgtatatatggagggattatcaactaataccccattgttatccacaaattcaatgtgtaatcttaccgatgatctcggccttcacctaagaaaaacctcacatcaaccaatgataatcttattatttgcaattagctagaacagtaacactaacgatgaccttgacagttactatcatgaggaagtttctatcccatttctcatgcctcgtcttgttgtttcgatcgttatgtacagcaaaggaaaggaaaagggaagattaggaagattcgttttaacgagataagtcattaccgtatgattaattgggtattaactattttaaattttaaaaattaatcatttgattttttaaaacaacttttcatgaatttttttttaaaaaaatatattattaccagttcggaaatcatctgccgaacacagcctagacgacatcgataccttttcctggtggcaagcaaagtggctagcttaatttcaacatgcaagtagctgcagccaaacagcatataattttggaatattgtaatagaagaatatattgtaccccgtccgttcaaaatatatatatgacgtattttaattaaccgttaaataagcaagtttgactatagtcttgcactattttgctt

SEQ ID NO: 107719 - DNA, 926 bp, Oryza sativa
cgaaagaagaaggatttgcggcatggtcattcttctcagatagctgggggttcttcttcaaagagtactggctcttcttctcaaaagagtcctagcagtttagatacacaggagatccttacgttactacatcgcctcattacttctgatttgataggtttagttggttcggctgctttgacttctgcacaatctggctctgctatttatggttctcactcttccaatgagagattatcatctgcttcaggtattttttccatggattcttgattatggtgtttccttccataagatatcagataagtcttgcctttcgtctatttgttctccttcagttcctataactgtctgaaccaccgattgtacccctctttctgttgttgttctcctttcttcgtttagtgttcctatcatttcctatgttccaaatctgaccatacagctcatgttcgttggacaacttgctgattacggttgccatgttattcttgattttgactcgcgttgtgttcaggatcatagcacgggtctcctggttggtattggccctcgcttccattattcacagcatctttgggagcttgactgactgttttctttccttgcttctgctatagcatccttcactcagtggcatcattgttggggccatctttgtggctctcgtctgtcacctttagtttgtcaaagtttattagggtctatgactggagatatatccttaaatcaatgtcatggttgtaaacttggtaaacagatacaacttccctatcatcctagtgagtttgtgtacaagcatccttttgttcttggttattctgatgtttggggccctgctccctttacttcaatacggggtcatcactactatatctgtcggagatatgggcctgggggtatgcaaagtgaggggatgttacctt

SEQ ID NO: 107720 - DNA, 514 bp, Oryza sativa
tccgaatgattagttcccaacttaccataccgaaaacagtctatactccctccgacccaagatataagaaattttaaattgataagaaatatcctagtcctaagaatctggttaagttgttcagattcttagtactaggaaatttttcatccacttaaaatctcttatattttggtgtagggagtattagatttgacatgtactagtactacttacgaaccaacctttgttgctacaataaaaatgaaagtaatgctactatgtctctatgagaccagaagaaaggtcattttagggatggagacaatactccctcccttcattctataataatcattggttactcatccaatttatcctaaaataagtacatgtttagtaatcattgcatttgtgtttgtgaaagtagagatactactggagaagtgatctttgctggctcaagctaaaatcacattagtcacggttcgagtaaaaaccggagtaaaaatatctatagtcctgttttaaagcc

SEQ ID NO: 107721 - DNA, 561 bp, Oryza sativa
taatatgattttacgacataattatttttagacatccatccgtattaattatttctgttttgaactttctatattttcagacagagccatttgtgcttaagattccccttttaaagtagtggtggtaataatctgccaccccacctgctatcgttgctactttttcttgagttgcctgaaaattttcaatatcacacattagtccaatataagtgaattgccacaggcacactgtacagtatatgagttattatattattcaatgtgtttaaacattgtcaagtgctcctcgttgcaaacaatgtgtaactggtttgatgcaaaaaccacacatctatatactcactccgtcctaaaatatagcaaaatactaaagtagtactcgattagacaccacctggtactacgaatgtggacagacccctatcaagattcatagtactaggtggtgtctaatcaagtattaggttgctatattttaggtcggatggagtatctttctctcagtagcagcatggcctttagttacattgatcaaagcaaacatcatggtcataaggg

SEQ ID NO: 107722 - DNA, 633 bp, Oryza sativa
agcacatttcgacatgtagaactcaaagaaaaattccacatcccaattctgattattattggcattaatttattagggtttcactcttgcttttacaccggtattttctcgagaacaattataaattcaatttaggcttgggaaaagaacttcagggtgtgacacaggaggccaagatttgaagatattatgctagtgactaaagttaggagggtataatctgaagggaatcctattagtcttagcattaatgaaatcggtagggtctgaattgccgattggtcccagaaaaaagtgattcggatgttgcaaattggggattgcaacttgatgagtaagatgctataggaaaaaggggaaacgattgaactacgagagagaaaacgtgctaaaaagaacgatttagccgacggtacttaccttagcatactcgatgattggcgcactcgagggttcggcggaggtcgacattgtcgaaggtggagttgtcgccgcaagggggttcgcctgcgaagtcgccggagaactcgaggaaatcgccggagaagattggggaaagtttcggttggggcggtgaaaacggaagtgacgccgtgaaaatttcaaagcagtggttactatttaaaagaggcg

SEQ ID NO: 107723 - DNA, 626 bp, Oryza sativa
ttgagagcttccatgagagtaacacggggggtgccgagcaagcaactgtgcacaaatcgactcatactcggagcgaagacgggtgagaactatgttttgctaaatcaacaggaacctcatggcttcaaagatgaagaggcaggagtgttccacacaaagttcaagcaggtaattattggagagaggaaaaaaatcgtttctagggagatgagaagtctaacctagttctggcttaagaattagcacttgtattcatctaagaagcactagacccaaatatatataggtatatatgtagaaaaccccttgtacaaatagaaaatagatatccgtctaacaataaccttacaaaaattaagtatagtggaatgagatgcgaaagcctttgttattaaatcaaacagatattgcaaaactattattagctagtacgtaaatatgcaacctgaaattaaatttaccaacatagcatttattatattggaaccggaggaagacaattatatagtaaaaaatatggttggtattccatagaatgattctatgtctaagttggcatgatgaatcaatgggctatttagaaaaatttgtcctctatatacatatgtcggcccagagtaagaaaa

SEQ ID NO: 107724 - DNA, 737 bp, Oryza sativa
tcatccgaaaaccaccctaaatgtcaaaaccgcgatgaggacccacctgtcagccaccctgccaaagccggaggcctgctgggccggcccaggttcggccgaaccctagcggcgtccagtcaggtcagccctccacgtggacgtctaggattgcttctcaatgacagttgtgaggataaaatggacatttcgcatgatagtaaccatcataccgaccctataaaaggaggagctcattcactctcttaacacactcaagcaagctcaaattcctcttcatactttagtactagtatcttagtgctaagtggagtagaatagaatagtattcggagtcctcggagtcttcggaagagtttcggtatggctctagcagctcttgtattctcttatgtaatactttcgatattaatgaaatactcttctctatatatctttggtactttgtttagtctgagtccttatcttaatttatatatgtgtcgtaccgattgtgtgggtagcctaccagtgaggtgcaatggtgcgggtttaatgtccgaattatcggttgctctatgtcatgtgcacatgtgtagattagtatttagtaatgtaagcgtggtgcttagattataagatatcattaattgggtatatatgttgggggataatagaggtgggccgctcatggtgatagctcaatacgggtattcctccacattagtatatatccctaagacaaattcctggggagg

SEQ ID NO: 107725 - DNA, 764 bp, Oryza sativa
ctgtttgtactactcaactccgtatagccgccaaactgtttggcaccgagtactacctagtagtacaatacacgtactgggagtaccagcgtttgtttgttggtgttgaaagatttttttttcttttttttaagagagttcgtgttgcaacaatagaaggagcggacaacagaccgtagaaaaaggctagactttttttttttaagatactccctccggtttcattttaattgacgctttggacaatgacacgctctacaagatataccttggatcttatttttctattataatatatacaataaataaatacatgtttacttttattacagtgttttgaaagacaaatctatatatgtttttctagtttctttaaactaaatatttttaaagttattgatggtcaaagttataaaagtttaaccttaaccttgtctaaaacattaattaatatagaaccaaagggagtaatagattaactggtctccacagcccaagaaaaatgaactaccttgtggctttgtattgctatgctaccgtggttgattgcaaaattgcagataggtaaatgacctttggctacacacaggggcggagctaccatgattcctgggtattcccgggaatacccaacttttttatcaaaaaacaagtatacttttagtatatacacatgtacacatattagtgcacctaaatcctcaattcttcgatccaaacacagtccaactggcctcttgcaacgcctcctaccaacccgaccc

SEQ ID NO: 107726 - DNA, 641 bp, Oryza sativa
gtcggcgcggcggtgagcctgctgctttggccggtggcggcgccggtggtgatgatgaaaggtccaggcgccgcggccacctcatctcccgcgtggccttcgaggccaaccccaagctctactactacctcctccgcaccgccgccgccgcgtgacgacgtacgacgacgacattacgtacgcacgcattgtgatcgttgcttgtggttctacttctacctattaatgctagatgctttcttgcatggtcgagtatgttcgttcgatcgatcgggatggctgcttgtttccttgttgctctgtaatggtttgaaactaatatatatataaacggaggagtatttcagaaaattttctgcgctctagttctctcgttcttgtattgaatgaggcattcttgcgactctgaacgtcgatctatatcccatatcctaagcctcatcttaactatgagtctagacacatattcttagttataaaatttatctttttcacagagagaggagtaatagttgtgatcgatattgtcatactctgtgatgaagccaaagtaactttttgtacatttggagcttagtgtaattttctttttatattttcttatgtgcgacaaatggtttttataatggtagaatgattaa

SEQ ID NO: 107727 - DNA, 898 bp, Oryza sativa
aaaagtagctagtaacattttcaacccaagacaaatttattatggaaatatattcaattattgatttgatggaactaatttagtattataaatattattatatttgtctataaacttagttaaacttaaaatagtttgactttgactaaagttaaaacgtcttgtaacctgaaacggagtgactaccttcgttttcatattaagtcgctttgatttataagtcaactatgttcaaattttattaaatttatagaataattaaacaacatgaaaatagctttattatatctagcattaaatgtatatttataatatgtttgttttatattagaaatgtttgattcgaaaaaataagccagatcatcatataatatgaaatggaggaatttgaaaacttcaactcatcggtgccttcctcggtcaattatggtgcagtggttagctggtactagtacgtatcatgatgttgatcgtgtacctcgtattatccttgaccaagtgaatattgatgtgccatccaatgtacctgtccaagaatatggatccattcaaaaggacataaaagaatatagagtgttgccgttccccggcatttccatcggaaggaggactgtaattacccaccgtacccttcaatcgcgaaaacaaccttacacataaatttcttcttaaagatatttagatggtatacatgaaaatcacgtgtgtagatttatctcagaaagtacttttacaaattgtgattttattaggttctaaaaaaaatgcaatacgaagtattagcggaaacagtatttttaagactatgtcagaattgctttttgtttgatgggagggagtcaccgctagaaaatcgatttttcacggcgtttatctattttttttctctgacgtctat

SEQ ID NO: 107728 - DNA, 1008 bp, Oryza sativa
tgaaaaaaattaatgtgttccatgaaatgaaccgaaggccgacttgtgattagcatcgatcgggaagggacaaaggcgatatgccagctcttatataagatagaggatttcaatggtgtgtgaggaccgttctaattatataactaggtgaaaccccgcgcattgctgcgagaatttagtatgataacaaaaaaaataacgtgtaagatagctagataacatcagattaagtaaattaatatggtctatgataatttaaatttaaatagtatgtaaatggtgattcaaacgtaaaaagtaaggtggtatgactttatggaagaagaaaattagggagatagtttggactgtagattaatcatctaaagactaaaaacaattaatgtgatatgacttaattatagaaaaaaaggagaaagataatttggaccatagattaatcatttaagcagtaagtgaggatgaactatataagtatataggatatacattaaaatattgtgtgaattatgttggatgataatttaacaagtttatatttgaaaagctcttaaattataaaaactataaaaatatagtatgtttgcatgatgtttaaatgtgataattgttagtggatgatgatgtgtcatcttgttaattagtggatgatgatgtggcatcttgttagtggatgatgatgtggtatctttgcatattaagcttaaggagttagtaggggataactttatatttatagtaagataggataagaattgcaggagagttttatgatagaataattgagattagccacgcgaattgttattggcagtttctagtaaaaaaaagtgctttcatggtgacacaagactacatccacttggcactatcatcatttttgtcccggttggtgttatttaatctcggattcaggtctcggtttataacccaggactaaagagtttacaaaccgaactaccgtgggtttctcgagcagtggcaggaggaagccaattaagtgcagca

SEQ ID NO: 107729 - DNA, 656 bp, Oryza sativa
ccgcgtgccgcgccatcatctagtagcaacataatcattttatttcaattagttttcgacaataataatgaagaatatttatagttatgtaatcatattatatataggttcgcaagataatcaaatataactattcgagttcatgtagtatcacttaataatattatattagtatgatagagtcgtggatgcatgactatgactatgagtattaatactcacaaatattgctatgagtgtattaattagtatagagatcagaagttatacttactttatataaaaataatatcatatcggtaatgggacgacacgtaaaaataatatcttagaaataccatattgatgatggaacacgcaaagaaaattagagtacctaattaacaagggtatatctaattactaactagttagctactttttatgagatatatatgatagtactactataatataatgtagctagctagctttttatgagatttgcaagtattagatagtagctaggactctgtccatctagaagaattagcttgctaaagtatgtatacacatcctctctacatgcattattggtaaattagccatccccatctacatcgttgatcactcttatctaacttgcctccttcaccaactctccgttgtacattact

SEQ ID NO: 107730 - DNA, 761 bp, Oryza sativa
ccgcgccgccgccgccgccgccggtgtgctgcgatgaccttaatttatatatatgtgagtgcgaaattaattagctgattattggttagtttcaggttatttttttagtagaaaattaatttgtttgtgatcgatcatatatatatgtggaggactctcttaattgtttttttgtttggtttgatttgatttgatgtgtattgcatgcaatttgcagtttgggtgtgagatcttaattatattaattaaacactatatatatacagtgtgcttatggtaaatgcatgggttttgaactgaggttagatttattaattcgaactatgtttgacattgctatgactatagtgattattgcatattgtgaaataattcaaacttagctaattaaagttgagatgctttttttgaagttttagatccacaagaaataatagcattgcgaaattttatttagcttatggtagacatcggtagctagaagaacaaactttggaatattggttgtaagtaaacgccggaattaatcaatgaattccattacctcgaatttgcttctctgtaacaattcgttccatttgttatggcttgtatatattcaatagtacttaataactcgcaagacacttgttaaataaaataacaacactagctggttcttggttttgcataatttctagaaaattactgaggagatgtgaaaaagggacttgtagaatgtaccgttatcacgattcatgtctaacaaaataatccactag

SEQ ID NO: 107731 - DNA, 699 bp, Oryza sativa
attggtaaaggtaaagtatatatagtaaagccacgcactgtagatttattcttggacaaaaccatttggtgtttttaaagtaaccacaatatgaggataaaatgggtaataagcaattaatgctagcttcttacctggtaagatacattgtggtagagatggtagttataaccgagtagtatgcttactactagcaataaaccattaaaatatactatttgctcgtgtatgcataacaatcttctcaagtagcattaaatgtgaaccccatcttaattaccacttcagcactaaacattatgaaacctgctaataacaactattgtcggatattgagacccacgttactatcaagttggtaaataaatattgtggttacccttatatctcggacacgcctttctcattaattgtccaataatattcaattagaaaagacaaacacatggcatcattggttttatatttatcctttttctatatgtcgaagcgtataatcatctgttaatagtgcagcatatccacaatgtgtcgcgacataaaaccgccaataaccttccatgccatgacatcaattatctgccctttatttggacacaactagtattcatggctcgaatgtttgacgtacattgataaatatgattttgcaagcaccttaaataaacaaatttcacaagcacatggcaaatgtgaact

SEQ ID NO: 107732 - DNA, 2167 bp, Oryza sativa
ttaggttgggaattaattgggtcctgcaagaaaacaaagtatggtttggactagccgctaatatatactagtatatattttttaagcaaattaattaaggcatatgctttgcctttgtgtatattgatagagcaggggagatgcaaatatatatatatagttgattatcaattggattgtgtaaacatatatttatgttgctgtatatatagcacatactattacaaattaaaagtacacggtatgaacatatataatttcaaattccctaccgtgtacttttgtaatggttcgatggcaataatagttaagaaacatcagtgtcttaatccaaccacaatgtccacccttttcaggagccaatagccactcaaaagagaaaacaattaaaggatgtgttattacaagataaacataattaatagggtttcctcccttggatacaaaagaagggggccctggagacaccacagttggttgatccttccaaaatgtcaattaattagtaagacacatgattaaattccagatacccatgaagcactatgtccggtctgttgtatatatgttcagcatccaaatatgcaaaatttgggtttgattcttctctggccagcaacagacctggcatgcattgttggctacacctttctcttccaatgagcacattattatacaggtaaaggtcaaagctaaaatacatgccaatgagttgacctctaatgatgcattgcatttagctactatctagcattagtacacatgatcgacccttgtatatatgcatgcatgcaatccaatttcagtatataatatattcttataccaaacctaaacaactaattaaattaagagaagatagcaactaatacttgatgaaaccagccaacaaaagcaccttatttctcttgtttaatttgtttcatatagcgtgcatatatatatttttatatctctgttactgccagttcaattaatctcgttctgctctgcatgtgtgtatatatatctcccttaggattatttaataagaaactcatatatatatatgaatatatcacacacacaattaaccagaaatattaggttgccagaacacacacaattggtatatataaattaagagatacacaggtaagtacattagtgtattaattaggatccgtgattaattatatataatctgtacacttactttgttaaaaaataattatgtctatagtatatattaattatctgtccgtacgtgcaggagtatatggttcaaactgtactgcctgcttgtgtcgtcagatatggacgactcctttgcgtttgcatacatcatacaatgctgaatgcctgaatgcaacactagataaactgtgcgtgtacacgtacgtacatgtacatacactatacgtacctaatacacgtacttagacgccggtagctgacgtgtcaattcatctcttatgtgggctccacagaattgatggcaatggcgtcgtacgattttcttgtacagcttatctatagctgaggatcgatggacctctcgatggtgatgaattgagtgatcatcaatggaggctttcaatccgagtttgaagctgatctctactattataaaaattaaagatgtttttttattagtactttagtacgtcatccgtatatgagttggtttttaaattcgttcgtttttggaaatacatgtacttatttgagtcgacttttaagttagttcacttttgcaaatacaaaagcagtcatataagaaatctcttttaaaaaaaactggcatatatactaactcgaaacgattagactcctaaccatagctcataatttttaaaaagaaaatacatccaaatgaaattgccacagtgaatttcaccttatctaaaccatatagtagtaataaggttagaatagacttcactagttgcaacgcacgaacaatttttctagtgaagataaaaattaaattgatgtatgtaaaacaagaaaaatcattaacacatgattgattaagttttaattattataaacttgacaaatggatatatttgatattttaaaacaacttttgtatagaaagtttttacgcgaaacacaccgtttagtagtttgaaaagcgtactaaaggaaaccccggtaaaatatcttaatcttagaaaagaaa

SEQ ID NO: 107733 - DNA, 657 bp, Oryza sativa
aaatagatgatgttttagtatacatataatcgaatgtcgaaatcctaacccatcattagtaaatggaaaaaaatatacaacgattatttgatgtgtgaaatagaattagagaatttattatcaaaaaactttaacgtagctgtatttttttaaaatatttctatgggttatatgaatgtgtgagacagtattattgatatcttgaatgttttatgaaaaaagaaagaagatgttgtaagaacaatctgggttaatggaaaaagtcagagaagaagaaagtggtggtggtttcagattacagttgaatgagatgctgtcggccaggtcggctacaacaaacaggcaaagccaaataaccttgtaacacaaaatgaaaacaagaagatacaaaaggtcagggagaacatatcttgaccttcttggggtcactacaaagatgatgctaattaaagtcaactctacaataataaacaggaacaatatatggtctctgcatttcacatggatgcatgctaaattgtgtctaattgtttaattattggattggaaaacccatgttatgattctgaaggaattgccttgttttccatggattttctgtgttctgataagttattccaattcagtgtatatataacaatcacgtacgagtcgatt

SEQ ID NO: 107734 - DNA, 686 bp, Oryza sativa
gtttgaaaattgtgccacgagtatttaaattttcatccacttgttatagaataaactaacgggaccaaatgtaattccatccatcccacctgcggtttctcccatctacaagggctaaccttctgagcgcgctccatctctctcttcataacagacaactttcattatccagattggaaaccaagcccaacagcacaaacacaaagtcttaatactccgtacaagaacaagaacataacacgacttcattgggaataagcgaaacgacatatttgtaaacgaaaaataatttacgaataaaactttcatatatgtgatcttagcgatataaaagcaaagactgaaaaataaacttcgttgaaataacccaaaatcaaatctaaatttaaggttgaaaaattaaatttaggctgataaacataagcataagcgaaaatatgagaccgcacgaaccttctaccttctcttgacagtcttttatcatgctataatgcaccacatgtaccccttatgccaaaattagctctaaaattatatttagtgatttaaagtttgaatgccactgacaagccaacaagtaaactacagagcaaattaatatggtgcaatctgtcatcttccaatgttgacatcctcttgcttggctagtaaccacgttttagggcttggtccggagagcttaaaat

SEQ ID NO: 107735 - DNA, 1601 bp, Oryza sativa
acattaggatggcacatctaacaagcacatcctcttaacctagtggctggctgctagtcccaaagcatcttttaactgtcttgtgccggagttgatgcatgcatgcagccatacatgggtaaatcagtttaaattaatcacatggaagctaaaacgccaagttttatcatccaaaaggtctaagctccaaacgtcaactaatttgaaaccggagggagtacatgtttagggcgtgtttggttgcctgcatccatgtatagtgagcagcgtgtttggttgtgcactggctgatataagcaaatattatatgtatatgcatgcatgcacgaggacgaacgaagtaaccgaaggcacgcatggaatgatggaagaaacgtgctgcaaacaaacatgcatgtatatgttgctgtgcatctcggaggaagaatgatgacattttttagtcaaaatatactaaaaacgtacgtaacaaaaaagaaaaaaaatatcgggaggagcaggtagctagttagctagctatatactccctccgtttcgaaatgtttggcgccgttgactttttagcatatgtttgaccgttcgtcttattcaaaaaatttaagtaattattaattcttttcatatcatttaattcattgttaaatatattttttatgaattgcatataattttacatattttacaaaagtttttgaataagacgaatgatcaaacatatgctaaaaagtcaacggtgtcaaacattttgaaacggagggagtagtaggttaattggtgaactcaagcttatggaaacctgagctcatgcaatatatgagtaatatacagttatgtcgatctagttaattaatactccatctgaaacagatgcagtatattaacctagtatactagctagctaatatactgctacttctgtcgctctagtatattaaacagatctggttgtaagacgttttgattttggtcaaagtcaaactacttcaaatttaactaagtttatgcataaatatagtaatatatataatatcaatttagtttcattaaatcaataattgaatatatttttcataataaatttgtgttgagttaaaaatattattttttttctacaaacttagtcaaacttgaagctagcatgtattttcttggttcaccttcctctgtctctcggtccatattctacatacccatattggaacatagacaatgggttttatttttttatttttaacgtaaaccgaattttatcatattaacatatttaatttgtatatagtgatgaatgacaccatatagtctatatatgttgctattttctttaaaaattattaccatatattttgatgccatcctccccttcattagctattacattgtataaacccatctctctttatttttaagtttttatgtattatatatgtagagcgcggcatgcgcagctagccaaatacgtactccaacatgtccaataactaaacgcgtttcacaaaattatctgactatatcatgtctatcatatattgtagacgcccttaaaccctaaaaatccaatataatctagctagtatctcaaaatctaaagggtgcctatacta

SEQ ID NO: 107736 - DNA, 722 bp, Oryza sativa
aagaaagtgcgaggaggccaatacgtacgggagcatgacagtacaacatgtatacttcacatcttttcctcatttgatatctctctgatgttatttgagaggaatatttttgtatacggcttattattaattcgcagccacatgtttggcagcacatgctatatattagatgttgtattatcctgcaagctaggactgcatgctgtgaaccgcaaagccgttcattggttgcacacttgtatataagcctacagtttgctactagtatacatgatatccaaatcatactagtttattaatgtgaaatctgaattattttatatctattcaatttaccaccgcgcttatttattaatttgaacatgtttactcattttttaaaaaaaccgaatgaattacaaaagacatacacgtagtgaggcaccggtgttggtggctctgtatgaagaaaaaatgattcttctaaaatacctctttgccttgtcgcttgtgttatgctatatcggacctcttctttccattgccttctctcttcatccttcgcagaactagaattttcttaattctagagttgagctaccgtagttcgcataattttatctttattctctctctttttgaagaaaaaggaaaaacttacatatccttgcacaccagcactccaatctctatggttttcctttctcgattaattatagcttttaacacaaggttgcaatatg

SEQ ID NO: 107737 - DNA, 526 bp, Oryza sativa
ggttataaatggaacatgttaatattttcatttatgtgaaaaaatagggctcataaatctccgtttaagattcatagtatataacactattttccgccactataattaactactccctccattccaaattgatgtacatatttcatagatacactaaaaccaaaaaaactaataactctctcatactatatttactttagcaacaaactcgatgcatgcaccatccccactatttcctagccaatagcaaatcaagatattgcatgtgggttataaatatttgtgtgcatggatgcatgcattaatgtctatttactccaatgcacaaataacaaatagacttaatgaatgaacataaatatgtatatcatttagtaataatcttaaaaaaactatatgtagatcaatttagaatggagggtgtattaaatagctaacactggacacatcataacaaacaacttgttccctttcctccccgcatctccctatcttatcactttagcgcgaggaaatgatggaaata

SEQ ID NO: 107738 - DNA, 697 bp, Oryza sativa
tcttcctactacaacataatttttttaaaaaaataaaaaaacaaaattaaaaaaatttatgtatagaaatactatatataaaaaatatttgaatttaaattcaaatttgaaacgggtatgtaaacttttgacttataaactttgggtctataaactttaggtgtataaagtttagatgtatagaaatactatatataaaaaatatttgaattcaaattcaaatttgaatcggatatataaacttttgacttataaactttaggtctctaaattttaggtgtataaactttagatatgtaaacttgaggtgtacaaactttaggtgcaaaaatttactaaaatagaaaagtaatgcggtgccaaaaaaaatcacgtggagaagggggtgatcgagcctggcgagcgatcgcgcattaagaattttggaggactttttctacaagtgattctttttccagatgagcgtaatttcaaaatcttaagatagatctatgttagctagaaataagggagaagggaagagttgggggtggctagagggagggagtacgtgctggctaccggaattttgtattttagatagatctaatgggtaaaattaatggttcaccgatttaatgaaaataaatttttattatttattataacctcatataacaatttaagagtgtttttagagcatttacattgtacatgc

SEQ ID NO: 107739 - DNA, 868 bp, Oryza sativa
agcccttgttagatccaaactttttcttcaaacttccatcttttccatcacatcaaaactttcctacacataaactttcaacttttccatcacatcgttccaatttcaaccaaacttccaattttggcgtgaactaaacacacccatagtattaggccccgttcgatctccacaattctggcacgcaaaacgagaaacctccttagcacatgattaattaagtattaattattataaatttgaaaactgaatttatttggttttcttaaaacaacttatatatataattttttttaaataatgcaacatttaacagtttgaaaacaagaaataataaaacaggtccttagaatgtgtaccatttaggaccggaggtcgtatacatgtaatcctcgtcggtgggcgctagctgcatgtgtttgtgcatgcagatcaccaaaccggaaacgtccatttatacctgctgctcatacaaatatactccctccgacctaatataatagattttggaatagataaaacgtattctagtattataaatctgaaaatatttcccatctagattcgcagccctatgatacgtcccatccaacaaaaatccatttatatttaggagcacataaacatgaatgaatgctgtctggacttctcctgtagggactgtagcttggatcctggttcaaaggctgcacgcagccacgcatagtacagtagagactcaatcatgcatctgcattatatgtgacccaacggcaccgcaaatcccacttatcgggctatatacagttcatatttcaattggaaagaaaaatatttcccatttggaacgagacataattaagataccaacaagggaaatgataggaaa

SEQ ID NO: 107740 - DNA, 635 bp, Oryza sativa
atatagtattgttttctactcaaggctatgtatttgggggctgtccagcttatacatatttttagatagaagaatctagcttatgcatatctgctcaacaaatgaagtaaatgtaatagcaaagctaaagaaatgcagtaaatatgtctaataaaaattcaatataaatatgaataaactaatgatattttcacatgcaaactaactagataaacaaaaaaaacatcattgttcaggcagcagagttcttgacagcccagaacatcgacccaatgcaatgaagtgtccaggcaaacagctgaaagaaagaacttaaaccaggtacctgtcgaaccattgctcgttcttcttctcaaaaaccgtggcaccgtgctagttatgcagatcgcccaacttcagtaatctgaaatggtagtctttgagaaataaatcctgcaacaagaaaaaggcagcacctgtcagctactcagttttctggaaccgtcgactacatacaactacaagaaaataagaaatgattagcaaacaagcctaatattttctttgtcaatttgtcaagagtgccaacatttcaaaagcagatggcaacatattcaagaaagaaaggaccaatccacaccgcaaacgacatcaca

SEQ ID NO: 107741 - DNA, 633 bp, Oryza sativa
gtgattttacccttgtatttttaaaattgtgattttaccctcactattttgaactgaagctcaggtatgcccctgttccgtcaggaggactttaatggtgttaactgacaggtaaaaggacatctatgcccttgcagatttggcttgtgaggactttgtgttttggctgtgtttcacgattacagtagaaaacggaggtatgaacttgccctgcatgcttaattattttaacaacgaaatccaactttgtaactacacaagaaatgcgattctccagcatatgtttaaaaaaaatcaagggatttattaattaagaaacactatggactgaggtatgaattcaatgcctcaatgcctgacgtatgaacttgccctgcatgtttaatcattttaacagtcaagggatttatgaatatgcaaacaagaaacactactctcatctctttctttcaacaacagaatagctttgttggtcctgtccagtttaggaaccaaccaatagtccaaggcagtaagaaaaataaaaactaaagggggagtgacaaagaagaaaaagtaaaagacaataaaacctcaaatgttcctctccttcctctccttgctgttcttctcctccttgacaccatcatgcct

SEQ ID NO: 107742 - DNA, 1344 bp, Oryza sativa
agtttattttacagccgctcgaaactcttccaagtttgaggcccatgcttgttgcttcagtgccaaaacaaaaatgtgttgacaatatgcggtatatcatcatgtcacttatcatttaatttacacttccaatgttatttaaatcatcatgtcagtcagtgcagctggactcaaggtttccgcttggccgctagcctgctaccttgcttgcttgcagaattggaagatgtaagaggctgcaggcaatttcttcagagagatatgcaactgtatgtgtttcaattggtgtctcagatagaacattcttttttcagcccaactcgatccaataggtgtcttagctccacttccagaatcaagatgtagtttttagcctagagagaaatgacaaatagatttccagccacacttccagctacccaataggtttctgcttggtcgctagcccaccttgtttgttgagaaagatgaaaaatcgaggaatgaaatattctagatgttagataagcatggacaattcataattatggcttgggtttattttgctgttataattagtcttgttttagactcatcgtaacaatctcagtttgtgatgatatgcaaaagttcaattcgatccgtcacatcattgataaaaaaaaaatctgcctacttggtttgtgagattgtcacctggtgacaattctgattaaccttttctgattgagcacttgcagagaaaatacaaaataaaatgttttattttaaacagccaaagtgtatgtacgcagtctctccaattgcctagctgtactaaatcctgtattatggtgtttggatggaattagtgtctttttcaacagcacttaaatgttggtttttcctgttaccttggctccttgcgatgtaagcctatgtgttttgaatgatcactacttgatgtaattgaggacagcaacgcatgatgattcagaattgatattttagtttcacctccctgggtcagtttcaggcgtcatcggtgcagatcaaacattctagccattatggtatgttctttcactaattttagtttctcctgatttttcttggagagaacctattatatgccactgagtttgtcacggatctacgatttgccactgactttatcaagtttacaatatgccatcgacttttacttaatttctacgatttactatcgccgtttagttagcctccgttagtactctataaatttgctcaaatgactaaaatacccctgggacaaaaaatttcaaaatttggataaacattatgaaatatcatattttaagtttttggccaaaatttgaatgtttataatcttgtgtttataatatg

SEQ ID NO: 107743 - DNA, 746 bp, Oryza sativa
  unsure (1)..(746): unsure at all n locations
tcactgatcagaggtgtaccactgtacccacaagacacagaccccacatcatgtcaccatgtgcctgaataccaccacggtacctcggaaaggagttgtgacataccccttgcataacacaatccactacagccgcactctttcctggatcataatcacccccttaaaaacaaggcatggactccccagcgacccccgtgggcttatctccgccacttctcagtctggtgccccgcaatgaaccatgctatnacaaaaanaaagggcgcactaaagccgttgcccacgctggcttgtggttggcacggttaatgtttcacaaccgaaactcgtgaaccggtccttaattgtcatgagcacgactctcaaaaccatgtgatcacaacccaccattatcaagttttagttggcacattcatttaaaatttttttttcaccaatcacgattggccatcgtgaactatcattaagccatcattaaataatagtgagtcataagttatcccaatagtgtgctaatgtttctaagcatggctaagcaatcacatctaatatctaagcctgggaaaaaaacccccccccccccaaaaaaaaaaaaattttttttaggtaaagctcaactagtcaagttataataacccaaggtatcaaggaataaagtaatcaagaacaaaagggctataacaaacaataggttaattccacccaatgacattcggaaataaatgcaatatttgaatagaaac

SEQ ID NO: 107744 - DNA, 619 bp, Oryza sativa
tgttgcagatatagattcccgttgttttttagcctcgcttacaaggccataactagaaactgcgaatgtctttgtccaacattttatatataaggaatgatgagctgtagacttgacagctttgctggtggaagtagaccagtgcttgctacctgctgctggtaaggtaaattccttcgtccgtatccgccatccctgagtattgtgaaactgtgactagtcacatactattatttagtatacatccatataagtgtacaattagtttcacatgtagatgagatgacgagtacattccccttttcataagaaccagattcacacccgtcgtacttgattattttctacttcgtggagattgagtcttcatgtactgcatgaatacaattatatattaaccttttttataactcatagttttttattaccttattttaatgttgcacaatgttgcaacgatttatttcatctaccatgcagtttcctgcacttcgagaatttgttggtacaggaaggcctgtctggggaacttgtgctggactcatcttcctagctaacaaggcagtaggtatgtgagccacagcaattggtttaatctttctttctttggaatcaattg

SEQ ID NO: 107745 - DNA, 587 bp, Oryza sativa
tcatcattaagaaaataccgaaagatatcatattttctaacataaaaacttggtacttcagagtatctcaagatatcaatttttttatgtagaatttaggtatttaggttgtgtttagtttcttggccaaatatttttttaagtatacggacacacatttaaagtattaaacgtagtctaataacaaaacaaattacagattccgcatataaaatacgagacaaatttattaagcctaattaatctgttattagcaaatgtttactgtagcatcacattgtcaaatcatggcgtaattaggttcaaaatattcgtgtcgtcatttatatgcaaactgtgcaattgatttattttcatccacatttaatactacatgtgtgtgtcaaaacattccatgtgatgtttttggtaaaaaagattgaatataaacacggccttgaggattgtaaaatttccctgattaaatacccataatatttgcattagtttgcgtgcttttgagtttacttcggcatacaaaatattcaaaacaatttggcaaaacggaatggtaaaattcacatgtgttacactgacaaatttactta

SEQ ID NO: 107746 - DNA, 695 bp, Oryza sativa
ataagaaaaagggaagaatgtaaatagaacacttttcgcatcataaaaaaactgtcagctaagaaagaatctacattatgtcataagaaacctcattttgtgttccctgctggggccatcatggtctaccattaaatcattgattaggcagtcttttcacccttattactaatacacccacaacttatttatttaatttcactaaaacaaaccaaccttgttttcgcaaatagagatgagagagtctgttcacaaccttataaggtcatgtaatggttggaataagtaaaaaaaaaaaagatgaagaaatctgcatgtttttgtgcatatacagattgaacagttgatggcactactattaatatttcaatgacacagtgtagttcttgaaaatgaaaagatcagtcaatgaaaattgtgtttccatctttatgttctttaaccaaccttggttaactcttgctttgcaagaacatggtaatgccgttctgtgatcctctgcccacatattatagctatgaagaatccatacagcaaaccaaccaaaacaatagccaatactgcaatttaagtaacatttaaaacgttaattattttgtcaacaagtttttaacgtagaagtagaggatatagttcttattcctgtacacagacaacattcacagggcaaaaatatgtacatcaagacctgtgca

SEQ ID NO: 107747 - DNA, 1239 bp, Oryza sativa
  unsure (1)..(1239): unsure at all n locations
cggcgcttctttctttctttnagtttcccttcttcctcctttctcacggcggttgtttcggtcgcttttccgcttttcngggnggtggggggtgccttcttcttttcngcngttaccgcaatgagctcgggccggattcggccgttcnacgacgccgaaggccgggttctcngccgcaccgacggggagacaagatccgtcgccgcgatcgcgccagggccactagtctctaaagtctaacttatatatttaaaaaacattacgaatatacttttatgaaagagagtttctcataaaaatataccaatataacttttcatattttaaatatttttacgtctattaaatttttaaggtttcaagatttgactgcacttataggagatactactatacaagaatcaacgagaagcgaatttttaagttgcgataaactggtagtagtaagattttgtgaacaaggataatgcatatctgcgtaaaaaaatatatagtgcaaatcacatgtacattgaaaatctagaaactattgtcacaagagtaaaatttttaccaaccaaacggccacaatgtcgcgcagggcttatccggggcactactgcccttgggctgaaagtgcggccacaagcccacaatatcttgcggggcttagccggggcaccacggcccatgggctctatctccctcaccagtaaagccctagcctccaagaccgcacccgtataaagccgcagacctctctctccttctcctcccccgccgccgccacttgcctccgaaaccctagccgccccctccccgcggccgtgaaaatggtacgcttctccctcctcctcctcctcctcctcctcccctccgccgcacgacgggaagatcgcacgcgtgcttgtcctcgtgccagtccacggctccgcgcgcgccgtctttctcatggtctttctcgatgggtaggatgcgttctttattcatgttgatctgccgtagatggggggatcttgagccggaggagtagctagtttctttgattatgcgttttggggtctagcggattttaacatgagatggtttctctttagcgacatttttttttgttcatgttgatgtccacggtgattgttctagttatgtcatttttatcttcaagacttaaatgctttgaatcgccggtatagaccaagataattgcgtgaagatcgacgttttttccgagctgaccctctagatgcttgaaattttgtg

SEQ ID NO: 107748 - DNA, 665 bp, Oryza sativa
  unsure (1)..(665): unsure at all n locations
atcccgcagtttgtgagagttttgtgtcaacacagtgccgctgtctgggtgcgggcaggacatgatgacctcaactcctcaagtagcacgggcggccctgcctgcctgccacgcacggcagctccgctcttccctgggataggcaggccagcggccgggccacgctctcgtggtaggccagtgtcgcactcgcacaagcaaatagtaaagcgaagcaaagcaaaccgagcaggcaaactccccaatcaattgccaaccgaatttcgagcaggttcggcttttgctcggcaccaatcgctgcatgtgtgcgtgccaaccccaaacgcagcagcagcagctcgcggacccccggagaccgtgatatcctcggccgccatcgcgcgcgcgacggaatttcgcaccgcgcgccaggatggatgaaccgncacaccacaccacacgggcaccgnctgccgggcgcgcggggcgcctgtccacgcccacgctacaggagtttgccgatcgcgcccaaatcccccgctggaccacgcgcgtttttacgtgcgccgtacgcgcgccccacgccgacacaaacacacacacaccccggntcgcgccaaaccaaccggggcgccacccccttnccccttgcggtgaaaaaacaccggggacgcggatgcggacac

SEQ ID NO: 107749 - DNA, 735 bp, Oryza sativa
  unsure (1)..(735): unsure at all n locations
caacggtttttaccacagcacaagcatatttaccggtgccgttgagctcatcaatgtgctaacgaggtctccgaacggtggcaagctcgtcgcagcaccattgatgttttttttttcctctctatagtttggaggagaagatgcctggaaacgtgacaacgataattcaaattttaggagttttcactggcacacaacatgtttagcgaatagtagtgatatttttctaatacagtaaatttatagttcctagaaaaaatatccgtgcgttgcaacggataaatgctattttaattttataattgttataaggtttagttaggtaaaattcacagtgagaattcgcttgaatatttttttaggaaatcgtgagctgcaattagtagtccgtatttcatctaaagttagcatgagtttttttttaaaaaaaatgatttgttatacgactccttttgtatttccaaaaacaaacgagcataaaatccaactcaaacacatacatgtattttcaaaagtgaacgaacttaaaaaccaactcaaatgcggatgacgtaccaaaatactggtaaaagcatctttaatttctataatagtatatatatgaatcaaatttatctttgatattaaatataaacgggaagtttctgtatgaaaaatagacttttagttttggtgttcacttaatcgataccataatgatgtgctgctccctacanngngagtctatcaccctgg

SEQ ID NO: 107750 - DNA, 721 bp, Oryza sativa
gctaaagcagtcagcagaatgcgttttagatgtcgcctgagcttaattatacagtcaccttggtgattcggttgtaaaaccactcggatggatatttcatgtgccttgactatatgtttagtttttattcaactaatcacatagtcgggggctacacctaattaggtgtatctagtcgaatgcacctgattttttattttcagcccttcatggtttttaatttcagtactcgggagaccaagcccggaaatatataaagcacttggattaatgtttttagagattacaagaaaagactatttcatcgactataaaggtctcaggaaatactgtgaagattatggataccccatacccacacagcatgtatatccgactgggtatgggggtaccatgtataaatagaatatctttaaagggtttcgggttaatttcataaacttgtatatcaagaaagcacccggattttaagtcggttacgattgtgtttaatctataactgcttattccgttagagaatatgggcttgtactttataatacggaactccttcctctatataagaaggggtctgggtgcctcttggggcacgatttttctcccagattatacgatcaataatacactcggcggatcaatccctagacagaagtagggtattacttcttattaagaaggcctaaacctgtataaaatttcttgtctctaaacccatccactt

SEQ ID NO: 107751 - DNA, 692 bp, Oryza sativa
acatatctacattcatgcccctggtttaatgggatcatacctattatcttaatacgtatatcaagaaagctttatatcacatcaagctccgatccaacactagaatcaatattactcctacttattaggaattggttacaatttgcaacgggcaatgcaacttgcatatttcactttgtgtaaggtttagcgaatacttttagtttatataagcatatatgttgacataagttttactttgcactatgttatgtctaataattaatatccaagtgaaattttataaaatatgagtaaaacttgtagaacttgttgaatcatgatgttttacagtctcattaagatattatgatatttcacgagattttcataggttgatgatatatcgttctgatgttaagtaacttatgtcaacaaaactttggcgcgtaaagcgaaattattaatttgctacactaccctttgtgcaaattaaagcaaaacacgttacattttacactatgcaaattaagtgtaaaatttactcagtagttaatacttgcttcacttcaaaatgtatgacgcacttttcgtacaacaaaatacccgtggttatttgatatgggctaaaatcatgtggtaatttcgtggaactcaaaccataaaacctggggttttctttttttttaaaaaaaaaagaggtagtagtgagg

SEQ ID NO: 107752 - DNA, 660 bp, Oryza sativa
aaaaaaaacaaaaacaaaaatgttgctacctgtggccatacaaggtcagggacgtgacaggactgcaaaacatgccgaaaggaggagtacctgtcctggaaacgtggcaagctgttggttgttttttcagcatacgtgctgtatttttatctagaaaatgagcatcaggacagcacagcttgtgtacctgtagggaagaagaagaagaagaattattcagcagcaaagcggatgctcctcctgctcctaccaggcaggcgcacaacctgccagcgctgctaatcaatctccatgtgccggcaaccagcaccaaccgggagtgccaatacacctaacaggtttgtttttactccacttttaggggccggcaaccagcaccaaccgggagtgccaatacacctaacaggtttgtttttactccacttttagggcccgtttagttccccaaaatttttttttccaaaaacaacacatcaaatctttagacacatacatgaagcattaaatatagataaaaagaaaaactaattgcacagttatagaggaaatcacgagacgaatcttgcctaaatagacagtgattagccataagtgctacagtaacccacatgtgctaatgacggcttaattagtctcaaaagattcgtctctgatgggcta

SEQ ID NO: 107753 - DNA, 650 bp, Oryza sativa
ccccgatctatcacggcttttatttcccttcctttaaaccttaaaaaaacatcttctagtttttagagtccattgtctcgtcatgttctgttattataatttttaggagtgttgtcaaccgtcaatattgtatttctctatgatccgcctgttgtctcccatatttattgttattgggattttaaaaattgaatataactatcgttggggttcattttttactttctagaaatccgcccaaccgccgccagctccgccatactatactcatgtatttttattatcattgagattttaaaaattgaacatgattgtcattggattttactttctagaagtcccatcaaccatcgtgatcgtgctacttaacggcttgtctatcgtccctcctcttaatcatcattgggattatatttgtggttttatttatagtttttagacgtcgcatcaactgccaccaacttactcctttacgggcctaatgtttctcccctttttattgttatctgtcatcgttgagttcgagatggactatttttttttctgaaaattccatatttttcattccgatattttcttatctgtaaagtgtattcctacttgaaatcttagaattatttttctattttcaaaatttattttatttttta

SEQ ID NO: 107754 - DNA, 759 bp, Oryza sativa
aaaattagacttggcatatgttgatcgtgttgaggtaggcaattccggattacaaacaaatgctgagggagagagattgtgaaagaaagaaagaaaaaaaaaaaggaggatgagatgaattgaggaaaggcggcaaggtgtagatagagacggagacaatcaacaaggatgaaggaacaagtctgagatggagggcgagaagattgaagtaagcaatgctgggttagaatttagaaatgctgacggagagattgtcagagagagaggatgaattgaggaaaggcagctaagcaaggtgatagtgttttgggaacaaattaaaaagtcgccgggcggccacggccagacgtgtttgttacccgtggcacgtacgagtacattaatcactacatgccagcttacatttctttagctactatatagtagctagctttgtcaacactggtactataaatgatgacgacgacgatgaattcgtatcggagagagaagaagattgcaggagtaattaatttgttgatcaggtctgtatgtgttgtcaaaaataaaagcaggtctgtatgtactgtcaacttaaatgtgagacataaacagtgcaaaattgcacctattttaggattgagggagtactaacacaaaatagaaatagtaatagacctcctcgtgtcgtgggacttggaattggactccctcttcttctttctttcctcttctacttttcttcttttacataatagtattagtattacaatataggag

SEQ ID NO: 107755 - DNA, 574 bp, Oryza sativa
tttccattagtgaaactatgctcgtagcgcttttgtcaactgtattaacaacacaacattttaaggcaatgaagatgacgaaccccagtgaattaccaattcacctcatgaaaaggactacagctttactaacatattgacctctgcatttctgattaccagataagatgcaacaatttgttaaaatattaaatttccaaaatactgctggattcatgattatattatttgttccatatggatagttagcagctttcaacagatctttcatttcaatcacatcaggttttctgttgaagggtctaaaataaagttgctttctcatgattgttggtgacaggacaaatcctacacaggaaccttagcataattctgaagtacaaaggcacagaaagcctacttacataaattgagaggactatggtaacagcaagaattgcataccctgcattatatgcaggaaacatgtgtatgagatgcctcgccacaaagtagcagaagacggcaaccgggattgcaattagagagaaagatagcagagtggccttggcatctggtcccaaagataaccctt

SEQ ID NO: 107756 - DNA, 644 bp, Oryza sativa
gtcccataaaaaatcaacataggacaggatgtaacatttccttgtaaaatgaatctgctggacatactgggaaacttcatatctcatcctagtatgtgtttatcattagctgccaaaggcacatgaaatgtgaatatgtagtaacatttaatcaccagtacatattactctttctcttcttttaattacactatcaaataaatgtttgtatatagtagtgacaattctgcatatatatcatggatgatgcattccttgtactttacatgtttaatctgtctgcaaacaaatgctaccaagagcgaggggtatggaatatatatgaaattattaacttacctccagcaattaatggatatggaatatatatatagtactctagcataatgtgatcagatcgaactgatggtaagaagggtcaatcggtactagctattgtacatcaactctatccacactaaaccttggaacagaagccaaaaagaaactattaggaaaatataatactaatgaagctatatagctacggtgaatgggtgggtaatggtaaggggggcaggttggctactatgatctataaagaacacgataagtttgattaatatatatatgaccccacttagcttgatctctttaagttattg

SEQ ID NO: 107757 - DNA, 870 bp, Oryza sativa
tatctacgtactccctccgtttctaaatatttgactttgactttttaagaatatgtttgaccatttgtcttatttaaaaaatttaagtaattattaatttttttctatcatttgattcattgttaaatatatttttatgtaagcatataattttgagtaaattccctgtgtacccctgaaaactcactcaatccctttcatacccctaaaatttacccgatcccttctgtacccctgaaatttcaatttgatcccttccatgcccctaccgttacattttccatcattttactgttacgtttggttgcaaatgtcttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaaaataaaatttttatttgaaattttaataggacaatggatttttttatcaggagcattcataaaaaaaaatgttgtgaacattggtatacctatctttatatgaatgctcctcatttttatgaccttttttttaaaaaattaatacgtattttttttatttcattatctaaaaatattttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacggtcaactgacgggaggggtatgcaagggatcaaaatcaaattttgggggtatataaggaagtaagc

SEQ ID NO: 107758 - DNA, 1135 bp, Oryza sativa
tcctaaattacaggacgctatcttttaaggaaaattagattcgataacttttaactaataattttactgattatatatgttaagtattatgtatgttatatcattatatttatattttaaagtatttttattgatgttaattttatatcggttgagaacataacacgtacttaaaataacgatcaaagtatgttatttaagatcgtatgaaataaatatatattatacttttgactgatcaaccaaccatgaaagactactactctactaattagtactctaattattaagctagtacgtgttgtccgcaatatttggccattaattaattagctaattcatcgtctaataactgcaattatataaaacttaatttcaggaagcgggtggattgcttaaggcaatcaaggagaaggtcatagtatggcttgcagatcagatgctgagagccacggactgagaaaagttactaatattaacgatcaacctacgaattgataggttggtcgagctgcacattgtatcatcttcgtggagctagggctcgacagacagatcgagatcctcgtcaattaatttgcactgcgcctgtatatgtaataatcttccagagagacttgcaataacacggttgctggtaccgtagtatgtcagctagtatgcctgatgacaaaacaaattagtttgctatctgttaattgtaatactaatacttatttaattagtttgcaatcttgcagaatatatggtggcctatctgtagatagtccatgtttgatagagatccaacttctaaatttagcttcaggagttaggtctgaagtggagttgtggagctgcctaaacccagctccacctcaccagaatgtgacaatttaagagaaccactttaccaataaggagattggtaaagtaatgccatgaacccagaggacattaattgtcacatgggcacctcaccaataaggagaacctccaatgtgacaatttaagaaagttgcaaaatctagaatataatatcggcgtagctatttcggacatccgaaacaagttttcgcctggagaatccaccagagacatgggttagagagagagagagaatgttactaatattcgtaatgcccaaaataccaaa

SEQ ID NO: 107759 - DNA, 523 bp, Oryza sativa
ctaccccttaacttcattatcacctgaaagtctaggtccacaactcacccaccttgaggagacaaacaagtctttttaccccctctccttaatattcactgagaagagagatagtagctagtggctaaaattggctatattttagcatgcgcacgcgtgttgtgtgtgtggactcttttctaacctcaatctagagctacctctattcttctcttctctggtgaaatgagcaaccatgatctcccacctgccagcagtaggtgtcctcctaactttccatccatgacccccccctcaaatcactaaaattttcatcccaattaaaaccctgctctaaaggtgcaatcctcatcgaacctaagactagcatcaggttacttgtgctaggcaggtaggtaacttgtcctcatgcgtcccactattcctagaggttctcagttaagtagatcgaggaggaggtagatgtagtaaagaggtggtggccttggcgtgttatctaagagtgatgtatgatcgtgtgtca

SEQ ID NO: 107760 - DNA, 759 bp, Oryza sativa
taaaaagtagaaatattgacataaaaagtcctctaagaagatagagtaagcatagttcaaccggttatttttctttagaagaatctgtccactcagattcaagttctagatttaatatatgcgctcgtatttatggctattttcttatagtggtaggcgacgtacctatcaagaataagacatgtatgctcatcagtgttaggaaacgataggcaaataaacgacaaagaacaatagatcaatcacataagacacgagatttaatgtagaaaactcccaaaacaagagagaaaaaccatgggcgccagtcagcaaaatatcttcactatatcggggtaaggttacaacggcgaacgatggcttacaagaggtatatatgaaggtgaaaccttaaaaggataacgctccgacctaagcctccggcgacgggcctccgcttcgctctggcaaaagctggcctttattatgtgcaaatgaatttggatcacaactcagtaatatggtgattgtgcgcttgtttatatgagcattcatgtctgtatgtactatgttttgaaaatcagaagatatctcgtaagaaatactgatgaagaaagtattttggattaactcttactacagattagaagcttaattagaagcgtgtgcctatgatatataattcataatatgtaagccgaaaagaagaggacactatgatcggctcttgtgccggccggttgagccaaatcaaactcatatttctcctctctcgtacga

SEQ ID NO: 107761 - DNA, 752 bp, Oryza sativa
atcatccagtgtgatatcaatacaaataaaaattaatcacaaactgtccaaataaaattaatggcactctctaatataatatatgataaagtattacttgagtgatcgtgcaaatttgttttttgttcgatcacacgggatataaatacgtgtacacacacatatgagtgtatcttctaattatattacataccatgagcccatcggatttttcatgtgaagtttatttaggaaatgtaataatttcacatgttattctttttaaggaatgtcactggaaataagggacaattgattgcgttgtgatactactataaaaaaaagttgcatgttcataaattgtgggagtacaggtaaccagggaccatttatgctggtgacatgttgtacaggaaagacaatggaccatcactgttgcagtggaatctggcatagcaaagcatcagatcccttgattataagagatcaatgtctcccttaattgtcactcacatgttcaaggcagatgaatgaatttattaaaacacccccattggaccatatttgtccaaagattagtcagtagttcccatatgcatttagacaattgtcgtgtgtccgtgtacaaagattatgctttagctaactgactaaccagttattccttatccctggaaaggatcaacgacatttttctagttactacttgggttacacacatacaccatgccgacaaagttgttcaaacagattgttatctgattagagaacgt

SEQ ID NO: 107762 - DNA, 692 bp, Oryza sativa
ttatatcttctgattttcaaaacatagtacatacagacatgaatgctcatataaacaagcgcacaatcaccatattactgagttgtgatccaaattcatttgcacataataaaggccagcttttgccagagcgaagcggaggcccgtcgccggaggcttaggtcggagcgttatccttttaaggtttcaccttcatatatacctcttgtaagccatcgttcgccgttgtaaccttaccccgatatagtgaagatattttgctgactggcgcccatggtttttctctcttgttttgggagttttctacattaaatctcgtgtcttatgtgattgatctattgttctttgtcgtttatttgcctatcgtttcctaacactgatgagcatacatgtcttattcttgataggtacgtcgcctaccactataagaaaatagccataaatacgagcgcatatattaaatctagaacttgaatctgagtggacagattcttctaaagaaaaataaccggttgaactatgcttactctatcttcttagaggactttttatgtcaatatttctactttttagttttaattcatcagtttatgtccttgaataattatcataaacttatttccatccttcatccacattaccatatcaaacacattaccataactctcacgcaagtaaggtgaaacaaggac

SEQ ID NO: 107763 - DNA, 746 bp, Oryza sativa
tattagggcaggagagagagttgtcccgactttagttcatcggatttgttttcttttatatggctcaacatctccaatgcagtcgcagagtccagaggaaaacggcggtatagaagaaaactggagtattctatttagcacacagattactgctctcttcccttgaaaggccacatgctgatttgtttctcatactccttccgttttgaaatgtttgacacaattaactttttagcacatgtttgaccgttcgtcttattcaaaaatttttgtgaaatatgtttgattgagaaaatcccttatatacccctgaaatttttcctaatcccttctatacccctgaattttgcttacttccttatatacccccaaaatttgattttgatcccttgcatacccctcccgtcagttgaccgttagttgaccgtgtattttctataaaaatgaccattttacccttggatgaacaaagaaattcatgaattacattattaaaaatataaaagcttctcgcatgagactattatagttatgagtttgttgtgcgatgcattatttatcccaaaaaatatttttagataatgaaataaaaaaaatacgtattaattttttaaaaaaaaggtcataaaaatgaggagcattcatataaagataggtataccaatgttcacaacatttttttttatgaatgctcctgataaaaaaatccattgtcctattaaaatttcaaataaaaattttatttt

SEQ ID NO: 107764 - DNA, 599 bp, Oryza sativa
ggctaaaatcatgtggtaatttcgtggaactcaaaccataaaacctggggttttctttttttttaaaaaaaaaagaggtagtagtgaggcatatacacaggcgcacgtacgtacctgacgatggaggaggaggaagaagaagggatagtgaggagaaagcgggcatggacgacggggcgattggcggggtcggcgcagtcggcgaggagctggaggtggatcagcacctcctccgccttgccgccgcacatgtccaccaaatacctcgccggcatccgcctaaagtggagacggagctggcgttggagctgatgatcatgctgctgcaggaggcctccactctccgccagccgttcgaatatcctctctgccgccgccgccgcctcctcctccgtcaccggcgccattaattgctatatatgctacctggtacgtgtgcttctcttctctcgcgtgggctctcctcccggccggaggccatcaattgtggctcattcttcatatttatttactctctttctactcctaagtactaagtaattaagaggagtcttaatggttaagtatatattaaccgcctccattgatcgatccatcga

SEQ ID NO: 107765 - DNA, 596 bp, Oryza sativa
attgtggcttaatgcataaatatgacggataaaaattaaagttggatagcaagtcaaaaagatctgtaaaagcaggggaatgcacaccttgttgactcaaagcagacaacagatagtccaaaagatgacttgagcattctgacagagtgcttaaggtgcttcctaaaactttcttaattagcatcggcttcttacttaattaatgtttttggccattcaaaacacaagcacatggccacttcgccatcgataatatgatagtggtggggggtcagcatcatcatatcgccatcgataatggcatgaaacatttatcccacacggttgcccggtaaagaggccagcacaaataacgcatagaaaagtaggataacgacttaacgagtcataaaaaatagagaaagaaatgagaaaaagcagggaaagaagctttgcattgcacaccatattgtcttaaactcaaaggacacagcatacatatatgaatattggggcatatgacacagcatatcggcacttataatctcttctctactattataaaaattaaagatgtttttgtcagtattttggtatgtcattcgtatttgagtcgg

SEQ ID NO: 107766 - DNA, 608 bp, Oryza sativa
ccatagcgtcggtccgagggtgccgagccactgtgcacctagcacaatgtcgtagccgttaagcggtagtgcatagaagtcgatgtcgaactcgtgcgagccgatggagacgcgctgtggcgggcacctgcccggtgacggcacgcgatctccattggccacggctactctgaggccggggcggctctgtagagggaccctagcctggcgcgcagggtttttgaataaaaattgtgttgaggccgagttaaagaaggcgaacaggttctgcgagccgagacgagcccaccttaattctatattaagggggaagaattgaagcgagagaaacgagcgagcgcttaatctagcgtcgggcggtagcgcagcctcccacgccgtatagcctgcatgcagcccgtgaaggcgattaaaaacgcgttatatgggccccacaaggaacccgcctgatcccatcctccagctctcatcgcatctcatccaactgcccaaatcggcgtagacgctcacgttcctcttcctcttccgcacctacgcgcgaaatcacctccagccttgggcgtgaaatcgccgccatacatggtgttcctctccctcttccaccccta

SEQ ID NO: 107767 - DNA, 518 bp, Oryza sativa
ttgtcactcatatgcttcttgaaaagaggaatcgatcgaaagggtagtcctcgctgcttgcgctgtggctggacctagacgagctccgcattgaggcgcggctttccactgttccagccaagatgacgcgggtagcctcatggtggtccacgtaggatttttttttaagctaaaggagagagaggagaagccggtgactaattagggcaagtgctatgatagatgtgactaccacatttaaatttatctatattattcactcactaactatgagacaaaccatacaatatatcacctctaatacacaaataccaatatttctaatactctcacattcttcttgaagtttgtgtggaggttgcctcttggtttaagggtgtctcatcatctctctcatcacttctctcctctacctcatcactcaatccaatgtggcacttttagggggcaacacatggagcattagagcaaggctaataatatagccagctgcttactgaatagatctttacaggcta

SEQ ID NO: 107768 - DNA, 517 bp, Oryza sativa
gcgaattcgagctcggtacccggtccatgacgtacatgtcaaggcagcaaaacataaaaactgacagcaactcatgttcactacagggcccacaaaatcatctcaaaccggatggattagcggcctcttgtgcgaactactactgccaatcgcacgtcttcacgatgtctgtctctactagggagtatactggtcttttcctggacagaaataactccctgtccatttcgctcctaatatcatacaatcgttttgacccttaatttgtagccgtcaaagacggctccaattcgcctaccacgacgatgacatggcaattatttacgggtaataattccatcatgctagcaaatccaaacttaaataagagtatagaataagcttgcgttctgtcgccacctagatccgatcatgaatcatgatctgattaacttgcatcacacgcgtatcctaattctatcaagaatcctcgcaaactgaaaaaaaggaaaaaaatctgacaagaaaagaagaagaa

SEQ ID NO: 107769 - DNA, 1301 bp, Oryza sativa
acatatactactgtaaaaataatatctagttacacttatcatacacatattatgttctatagtttatgttatagctggttataaaactatagcctgctattcttatctcttctcgtttatcttttgaatatgtactgctattgtacctgctccgagtcacaaggagaggtgagctgaggtgagctgcggcgacgtccaatcgcggcggcagcggcggagagcgagcggcagggggggtgggatttgtttgtcttttccaaatgcggcggagactggacagacggcgcaaatccccacgcctaacgaacacccacaccggcccacacccacggtaaaaataaaaaaaaaaagaagcaaaagctaggcagacgacgagacagtgattgtgtgatgaatatctcctgcttcgtttccttcggatagcgtgcctcgccttgcagctgcagctgagtaccgggtgattgaaaatgaccacaatctttttttttttacagtgccttccctccatctgagatcatcatctcctgtcctgtgtgcactactaaacctgtagtagtattttttttacagtgccttctaaacctgcttaggggggtagtaatttaattactagcacgggctcaactatgggattgctttattacgctgctttagatgaagtaaaccggggcgtccactgataggcgcctgtgggccaacgttcctcgatcgatcttctgctggcttaacatgacatgagtgcttcatcagctgaacccaccagaccagtcacctgtttcgtagcggaaaccatcacctgctgacataggaaaatgctaaaaggacgttctctctcgtttggacgggatgatacttctaagatatcatctaatatctacacaattttcattctaaaatataagtatttttagctattaatctggacaactccaaaagttattatattataagacggatgcagtaatatataggtatcggttgataccccgttcagatgagatgatacctctatacctaggtattaggtagtatcattttatttgaacggaatattatcctgtagcattgcccgttaacatatcctactatctatatcgatcaatccttgttgcattcgctggcttgaattcttcattcttcaaaggaggcttgcatatgcatcaccgtacgtgatcgggacggacgacacttgcggcaaaagttccaatgtggtcgtgggctcggaataggccggcctgctactctctacatagaatctggcccaatagatactctaggccgaacatgaccaattaatccag

SEQ ID NO: 107770 - DNA, 1327 bp, Oryza sativa
agagaaaattgtatttgaagtatatgtggatgatgcctcttatagatggagtggtagctggtttatacaaaccagataccactatctgtgtaattacgtccatatttgagggagtgacgtctcggttcgtttgactccattcataaaccacgccggtgcgcatgctatgctgaagtaatctcgtgttgggccaacgttgacaaggaagaaattttatcacaaacagcagctgctacctctgcaaatctctatgaaatcagcgttgacgctgacgtttttgtgacaaatggacgacttcgatcgtaattgggcactgtgtacagcgattcagaacgaatcaacgaggattgacttatcgccttccgttacatcattcctcaagcaatgcttcccattattattattattattattattattattattattattattattattattattattattattattattattattattattattattattattattattattattattattattattattattattattattattattattacacttctctccggttccttaattcctgacgtttttgataagattaaggtcagatttgtgtagctttggcaatcaataacttcaaaagtatttagtttaaaagaactaaaacggagttgctagaaatataatgcaatatgctacagtcgattttttttcagccacttacacagtagttacacctcatttacaccccacttacatatgtaattagtatgtaattttcgaatttacatatgtaattttagtacttacatatgtaattttgagacttacattgtaaatacactaaaattacatatgtaatttagggacttacaatgtaaatacatgccgactattttttgatgaaaaatatggcgccataaatatagctacacccaactaaaataacatacatatatattatctttcaaagttttataataaaagtaaacatgtatcttttatggtatatattataaagaaaaataagatcaaatatatattttgaagaacgtatcattgtctcaaacaataaaactatggaaccggagggagtacatcatttgcattatgcaaatcaacaagcaattaatcaagcaccgagttcacaaaaaaaaaaaaatcaagcaccgccacggcagctagctagctgcacgtaccaactgactcatccaccatcatcagtgcaatcaatgcagtgccggattattattgtccatacggtgatagtgacacacagacttttgcatgcgtacgtcatcatcaactgtggacgacgtcgccggcgccggacacgaacgcgcacacc

SEQ ID NO: 107771 - DNA, 878 bp, Oryza sativa
taaaacaaagcaaattaactcgaccgcagtaataaggctctcgtctttgttttagatacgggataaaaatatttatatgtgtattcttaatggttcaaaagttttaaaacttaaattctgttcgtgaccgataagacaataagtagataatgaaaactaattcctcatacacacagaaaaaacgaagttcaaactgaatgtaacatattttagtgctacgaatctagttaaatatatgtctaagttcatagtaacaggatatgttataatcggttttaggttagttttttatgggtctaaaggaagtaaattttaaacaagagagggagcatttgattgattttagagagagaggagggaataaactcgtactagtagagtaattttcttttggaaaaaaaggatgggaagaaagagatggaagtccgtggcgtgggccaataatggggcagccaatccaagggcatgcaatgcaacgcatggtatcggagtcggagtaggccacctcgagccgtgcgcgctgtacgacgcggttgactcatcttcccacctcctcttcttcgagaatccccaccccatcgattccccatacaatacacatccacaccacgctggccatagctgccactacttcaatttccccattgcatttgcattgcccaccgggtaaaaacaccattagagcaaggggatgtttactcgggtattatatgagatatagtattggatgttcgggcactaattaaaaaactgattacagaatatattaagcctaattaatctatcattagcaaatgtttactgtagcaccacattgttaaatcatgaagcaattagttttaaaagattcgtctcgtaaattagtcgcaatatgtgta

SEQ ID NO: 107772 - DNA, 580 bp, Oryza sativa
ccgtgtttagattcaaaatatttttttcaaacttccaactttaccgtcacatcaaatatttagacatatgcatagagcattaaatatggacgaaaaaaaaaattatatagtttgcatgtaaatcgtgagacaaatcttttgagcctaattacgccatgatttgacaatgtggtgttacagtaaacatttgctaataatggattaaatagtcttaatagtttcgtctcgcagtttaggcggaatatgtaatttattttgttattagtctacatttaatactttaaatgtgtgtccgtatacttaaaaaaatttggcacacgaactaaacactacctatgatttgcaggtatgattttttgagggggaagatagcggaagctccactacgccacaagtgcatccaacaagttttcaagtttgagtcagatttggtcccttttgaggagatagatgaaaggcccaattcagattttaaatgggtttgcaagccctgatgatgtcgacaaattcaattagctagttcatgcttacttttttttattctctcaaatccatccgtttagaaattaaagcattttta

SEQ ID NO: 107773 - DNA, 646 bp, Oryza sativa
atcattttttctcaatcaagatttcaagtataattatacgaagaagttacatgaaaaattaaaaatctagtaatctcattttgaaataacaaatccaaacagtttgatgcatattagtggtcaaagctttatgagtttgatccataaaagaaacagagggagtgatgtatcactatgcatcttgtaataattaataaatgcatgcatgcatacatcatgttttttgttcatatacatagtaaacatactacaagttaagtgctcatacgatctttagaaacacaaatgcactgcttctaaagcataccaagagattgatatgtaactacacactgctacatacacgatgcacacactaactgcatgcaatttggtttttgagaagcattgtggcaccactgctcattaccatgaagttttgctttacctatattccgtttttcctgatgcttctaaacttaatcaaaaggaattcactcatgggttcatgcccaggaatgcatgcagatagcattttctagcatagcaggaggcagatggatcaacatatgagatgccctatatgcaagcttataagcgtgctacaatatatcatatcatatcatgagatatccatgcaagtaggcgtacctgttacaagcttggc

SEQ ID NO: 107774 - DNA, 613 bp, Oryza sativa
tctgctttatatttctcatgaagttagctgtaatgtttacagaaatgtggtagtactaagaaaatgcactatttctcatgtagtgtaccacattatggacattttctgtctgatctaatgtatcaaattgaaaaacggataattgttcatatttttagatttccgcttacttttccattacaagaacttcaatggtattaacaattaagtgctaatcttctatatgatgcactattcaataaattggagattatgtttgctccatttccttttcatttcatggcagacattattatatatgtactagaaagagtggtgaacatttttttttaagatttgatctattattgatttcacacagacatgcatcagctatcaggaccaggtggaataattgaaatgctaattgagaactttgcatgccccacatagtacagcaactactccaagccaagtttatttactagtaaaccaatttccaacttatatccatccatttattaaaaatatgcatgtacattgtggtgttactgagtttttacttgtagaaggtcccatcttagaataattattttaataaaattccttaagttgatctctgcaaattaggtgg

SEQ ID NO: 107775 - DNA, 587 bp, Oryza sativa
tgactgtcgatcgaatcaaatatgacatcggctgaaagataaatgatacgtcatcggcgactggccgatcggctatcgtttatagatttaaccgcttttttcctgtctttatttcttgttgattgtaggatcaaatcaactggcacgctcacgaacctaaaggcaagattgttggacctgcactgaagttaagcagatcttccaggccagtatgtgtttttcgcatcaacacccgtgttacaaacatcaattagtcacatgcccttaaacacatagggctggtttggttttataccaacttattgtcctaccaaaagtttggtaacttcaatagtgaaaagtgattgtttggtttgctactaaattttacctacattagttcaaattcaatacaacctaatttagtagtgccaaaacttgttaatgttttggcactaccaagattttggcatggcaaaaattggttccaaaacaaacaagcccataacactattgaaatcataaccaccttttgaatcccttcgaacaaaggtcacacaacgaaatttctcttataaatacggatcagccaaaaaaaaaactgataa

SEQ ID NO: 107776 - DNA, 718 bp, Oryza sativa
caacccaacttgagccaccagaggagtatgcctacaaaagagatcaagcttgggatttaggaacccaaacttgtctaagtttgggtccattgatgttagtcaccaaagcctttggcacccacacacaagtgcggtactcatcattgtaattcccattaaaataagcaaccactttgccctctgaatttttggaattacatatgaatcatagtaaagaccctctggccggaactttctggcattataaccggaacttccggccagcccctttggcctatcagaagcccagaacttcctgacaaaatgtccggaacttcctgtcttacaggacaggaacttccggtcattttgcccggaagttccgggtgtctgaccagtgaggggacaagtcatctcacttgcttgtggagcatttccttctcttacaaacatcaagcattctttcccatttaccatcacacgcttagacacaggacttccactagaaaacccgagcccgtgtccatccttgttaggatgagcggtgatggtcttgtaaagggcatcttttgaatggtatgtcttcatgcatccatatttcaccaatgtgcccaacctttcattctctttcttaagagcttgcatagcatcaacattagtagcatgagagttcaaatcaatattgtaacacctagcacaaccattgctagtagatgggttggaagaattagaaaccaca

SEQ ID NO: 107777 - DNA, 643 bp, Oryza sativa
gaggaagctgatcacgaaccaccaggctatcatgcacctcgtgatgtcaaggaatgagtaatatatttaatacctattgaactaggttggaccaatggttcaaccggttgaaccagtgaaccatcgaaccaagagccttgtcggctcaattactagtccggtctcaataactataacccctgcccactcgagcgcgctcatattgccaaagatagattttattgttgttttggatgagcttctcgaagatgttgatgaagaaggagttcatggtgggcatagctttagacaagacaccggtatccgtcagtgtctgctttagcaccttgaagatgatcttgtaagtctcgacactcttcctaacaccttgaagatatagatcttgttgatcttgatactcttattgacacctggaagatgtagattcagtagatctcgacactccttttgaaaccttgaagaggcagacgttgtaggtctcggtggggtccaccatgccccgaccatccacgggaaggggaacttagcttttctaaattcttagaagctgactaccaacccacagcttctcaaaatcttaagcttcggaaacatacccataggttttgcaaggaagctaggggatggcatcactgtcattgcg

SEQ ID NO: 107778 - DNA, 1987 bp, Oryza sativa
cgggggactgttaatgcataacaactattttcctaaaattagcatatatttactgggcaatctagtaagtatcatagccaaattgcttcaattgcatgcatgttaagaatggcaggatcatatggtctacggtagtctacaatgtagtaaaaggagaaaagatatggactgcctcaggcagagtttctgcagcactactacagttaacagatacaatttacggaataaatttcaatacagataaactccagaagtaaattaatttatactgaactgataatctgatattcacaagttttaaccatattcaatatgttcataagacaatgtgatctctaaattatttcataagatgtcggtgccatagtacatctttcactgtacatatgcattccaaacagatgaacctaatatctattatccacatgtgataaatctgccacttggagaaaaaaagaagcagcatcaaactatcggccttaaatgtgcatccacatcaccattctcaaccacatatcagtggagtatggcaatgctacccaacaatacatggtcccaaacactttaatgaaagcactattgagaacataatcgttcaccacatgatttgactttttgtattttatacttttttctcatttgctcaagaaaaatgaggctaataaaaagatagtaatggctacctttacatattcacaaaaaaaatgtcatacagtctttctgttttatgtaattaatatatacttccatggctatacggagagtatgctttgttaagaaaaagggggttcttcatgaaagaaagataagtggtagctgattttttttttcatacactgacttaatcagaaatagattaaaaaccactcggtcctctttttttttgggcaaggaaatcaagacagttctctattatgctagaagtatccacttgatttatactattaacacattagctcttctgtaaaaaatttcaaccttgaattgaatggactgccaatcgtgcagaaataatctgataaaaacacaagttgcaagaccaaatagttaaaaaaaggaattgcggagaaaacagttttttttttttttgacgatgaaaacagcaggagagactgctactgcgatatattaaaactatataatagttacaaattacatatgtacaaattatcatgtaaaatctttcgaattagccgctttctgttaatctgaatcaacaatatcatcattaatcatacagtggcaatactagtttccattaagacaacagaaagcaactcgtacaaaattgaagcttcatgtcaattccactggaatatatccaattaatacacttgtttaactcagtgcttgaaagtctgttttagtcgcctatgtgtgcatgtgaatgcagaacttgacaatcaaagttgcttatagaagaagaaaaatggatgcttaagaaaaaactgttggtaataatcaaatactgaaactgagactaagtagctagttcagttcaaatgagtaacactattacacttcaagtggcaatgggtcctaatgacaagcattagtgtgcctcaagtgtcatgtgaatataagttatatagttgtatgtgcgcatgcatttgttgcgtctgcccatgcatgtgcatgagagcatgccgcatgggcatgcagatgcagaacgtgggcatgtgcttttttggggatagaagggccgtgcttttaagttcttgatgcataaaacttaaatatgaactgctttgtagttaactactgccctggttgttgttgtaaagtttattaaattacaaatcaaactgtcaaagcagacatgtcagtcttaaattagctagaagtagattctcttttggggtgacatgttcagtggcagtataaatctcattgatgagttgcttggtttagttcaatctacttctgataaccaccagagatctaataaatcagaacagggaaaaacaatgaagtatgcaccaaattt

SEQ ID NO: 107779 - DNA, 705 bp, Oryza sativa
gctgcgggacgtcgattaattccactcagagtgatactaacactactacgaaaaccatctttcatggcgggtattttgggttttcactggtggaatttggagctgctacaaagcaaaggctagtgaagatcaagatcttcactagcggttatccaccgccagcgaaaatgaattatcgctggcggttgataaccgctagtgaagatcttgatcttcactagcctttgctttgtagcagctccaaattccaccagtgaaaacccaaaataaccgccatgaaagatggttttcgtagtagtgttagtatcactctgagtggaattaatcgacgtcccgcagcacccattcagtggttcgtcatgcatatgtaccgccaccattgatgcccctttcgctagccacgaagagaaggaagaatctaacaaacggggctaaggacatttttgacatgttacatggtttctttctcatatctcattacactagaaaaaatgtccgtgcgttgcaactggtgaaggttattttagtattattattgttatacggtttagttaaggtaaaattcactgtgggaattcacttggatatatatttttctagccaataatgagctgcaattaggagtccaatcatctcaagttagtatgcgagttttttaaagacaatatcttatacgacttcttctgtattttcaaaagcgaacga

SEQ ID NO: 107780 - DNA, 527 bp, Oryza sativa
tgttgggccttcctagtagtcacacttttattttgtagttgatgacccctttcttcgtagctccactgtatattttcctcggtattcacactgccgaagtagactacctatataggttacgattgtgcgtactagcgtgtgggaaaacttggatactcattattactcatttatttcgaagacctgacgagatgtcagtgtggttacgaagtggagaagtgttttataaaaacttgatgatgcgggagtcagtacctggtcgtttggctacgtattatccataagtatcgtttcctttgagaaattcattcaaacataaaacaatacgaccaaaacatgctggacacctacgttttagctacctgcgatagtgaccgacatgacgctataccggatgtgccccttcgggggtcagaaggtatatttcgagcattctttttttccaaataaaactaatagttttattagtttgtcgcatttcatgctttttcaaatcatgaaatttgactaagttcggggcaaaaggt

SEQ ID NO: 107781 - DNA, 603 bp, Oryza sativa
ccaccaccggcttcctccctccacctctctacatcattgttccctctccttcatcatattcctcaccaacccacatcatctttctatgtttccggtggctcccacgagtagattaatcgtcacttatcaacatattcttgatttccgtgccacctccatcatgctcctccattctcatagcttcagcagtgccccattgcctcaacgccttcccgacaccatcgcgcactaccaggctatcacgccctagcctcaaaacccattactcctcctaatctgaccatgaaaaacctaacccagtgggatggtagccgtgtccttgttggagggttactggagttgttgggggtcgctgaaacttgaggagaaggaagccattgcatgaattttcaagttaatcagaagtcacaaaagtagtaagattgttcccctaaatttctgtcgaatggcagttagcaaaatccattgaatcaataatcactaataggttcttagatttcttttgtatatctccatggtgtctcctcctccccctttagtcttcttggtatttgaaccatttgttactcaatcgattgctatctttatctttgttgacgggga

SEQ ID NO: 107782 - DNA, 1318 bp, Oryza sativa
agcaataattttctacaagtgtcagtccagaagttatgactgagagatcagaagatgtggattacttgtctatgagcttttcaatctccgcattcttccaggcaaccaacttggcgtggacaaaattttccttatgttttaccgcagaaccctggggccatctccccattctttgcactgcaactgggctattttcgccatctgaatggttaaacgcaccgccattatgatcacttccctcataggcaccaccagcctcaaagttccaatcacgagctgcagatgaaagaattgtcataaaaaatatttttcagaactgacgagactcatgagatttagatcagtacctgaggatatacgagaagacagagtatcagcctgccaatccgtttgatccactgcttcatcctcttcttcactgactttgggcaatctccattcattgatagcatccattgcccccaaacgcctacggtaattatgtgaggagcgagctcggcgcatcaatctagctggcgtggccttgtggatgaatcttggtggcactggattagttctctcaactgcatgttttcaagcgcattcaataaatgatgcgatgcaagaaaaagtcaagttaatctatggagggaggcagcagaagtaatcacatctcctatccagaaggggaggttgtctgggcgtttgcagtctgatgtgtcgtggtgtggtagacggatttatgaaatctcctctgtttggcagcctttcttggtcttcttcctgcagatgattggcttcttaacatttccaaatcacgtatgggaaatgaaaaaatcaaaccggcagatagtacaactaaatggatacaaccaaaagctacttgtaataattctatatggacccagacagagaattatccaaatttagtttgatcgtgtggaaaacatgtaataacataacaaacaaaatgactgagctaagaattctctagtttttggctatttcaagattcagaaagcagaaatgtaacagcaaaccaagattgtcaatacccttactgctttgatatttgaatcgatcaaaggtcacaaatcaaatccaggaacattgataaatcttgcattgaggcactagaccaatggttaaactggaggcgtttgttcctgtaaaccatgcaagaaactgaacaacctcatccaagaaaccaccttcctccaaagaactaacgcaagaagtcggcgaagttttccacaattcaatagttacaagctacgcaagaatgggaaattaagaccaaaggcagcaaaaaaatcaagaaccttcaggactgcgcctc

SEQ ID NO: 107783 - DNA, 707 bp, Oryza sativa
gtctgcttgggctggtcgagtgggccacagtgacaaattgtcgtagacttgggttaagcttaagcctgatccggtaactttccgatcttcttgggccgctgaagaaatctcatgcaaatttgggccatggaagtccaacgagctaggcctattgattcttgcctacaagcccaagcccgtgtacaacgcatcccacaccgttcgttccgttgctgcaactgagctgccattgctggatgcgtctgtgacggaatccaaattacctgagctgacattacacaaaactggaagacaataaatacagaatagcaaagcaaggatcggatttccgattaatcacagttcatacatagataaggtgaagctggacggataacaatatttgagcaagaaacactaagcaaagaaggaacgtgcagcttgcacactgagggcaggcaggcagacagacaaacacaagagtggcactcatgtggaaaagattccgaattgcaggcgtgatttctcaatcatttctgcgcaaagcgataaggtaattaacaacaccattgcagcctcgcagcgtcattaaacgacagcaatgcacagaggaatgttgccgcttaataatgcagagagcaggacagcgcaactaatctctgaaaaattagtggctaggagccttggatcatagcaaaaaagtgctaacaactgcactataaaatgcg

SEQ ID NO: 107784 - DNA, 1025 bp, Oryza sativa
tgccacgtattccaaactgtttgttatttgtaaagtttttttttccaatcactctatttagtacggttttagatctcatatccatagtacatttgaagtttatatgctaaattatagtgcttaaaatttaaaatttatttgaaatgagcacaaaataatttatataaatgttatcaacaaactatattaaatccatagatttgttaatctagaaatatccagctccaaaaatcttggatccacagctatgccaaaaaggacctaacattgtaatcaagtagctctactagtagattcttgtagtgtaactagcccacttgggctaaaattctagacttggcacgagtactcgtatttatggtaaattatttttttagtggtaggcgtcgtaaccgttgataatgaggtgcttatgttgactttatcaatctctagatatatcggttcagtctttcgaagatactcggaataatgtgcgcgcacctgcgcatgttgtgaaagctttgtgtttgtacaatgtttcttaaaaaaaacattgtaatcgagttaataatttcaaatgtcaccaagtatgtttgttttattgttcaaactaaccctagcaaaaattggtgatgtcaaattttttatatgtgatgagatggatttggtttataccatcatcaattttttttgaggttttaagagtgaaaacttccgaaactacataaattttagtaggatagcaatgttggttattgtcataccaaaggttaaaagtgttagtacaaactaaacaagctgtgtatatatgcagggcactgtagatctgtgaagcttattgcaaccaagacttttaaaggcaagcaatcctacatggcatattggattctactggtaattaattactgaagccacacagtcagtcggactggagtgctcgatgtggtctccgccagtagaaccacccgaaccctccacgcacacagagcacacagaccttcgtcttccatggcgcgtgcagtgagctaggtggtcaaacgaag

SEQ ID NO: 107785 - DNA, 749 bp, Oryza sativa
ttaggaattaaaaaaaaggaatactagaagtagggtatagagtccatatagaaatacaattaagaaataatagagattcggaattaaaaataaggaatattagaagtagagtatagagtccatatagaatttaaaaataactaaaatttagaataaacataataaaattaaaagtagagtttagaatccgtataaaaatgcaatttacaaataactaaaattcgaaattaaaaaaaacatgggaagaagagtctaaagtcaatatagaaatacaatttagaagtaactaaaattaaaaattaaaaattaaagaatattgaaagatgagtttagactttagagtccacatagaaatacaattagaaaaaaaaaataaaaattcaaaaataaaaataaataatattggaagaagatcctagagtctatatagaaatacaatatacagataacgaaaattcagaattataaaaaagaaatattaaaagacgagtctagagtccatataggaatataatttacaaataactaaaatttgatattaaaaataattaataactataattaataattaacacgtatataaaatacaatatgaatattacacattagtagttccgtaaagttagtacaaaatttgaaattatgttttcattttaatatatttaaataatacattgagaaaacatatatgttataatatgagagaatataatgatgctagccgcgcaatctgcgcgggccaccatgct

SEQ ID NO: 107786 - DNA, 641 bp, Oryza sativa
cgtcgttgcgccgtcgccctccaccaccaagctgtcagcaaccgccgccgccaactgccgcgaccacaccgccgccgctgtcgccaacaggcgtcgccagccgaccaccaccgaccgcacccagatccggccgagagccgccgtggacgttgcagatcgcgggcgccgtcggcagccaccgccgccggcagcaccaccttcagaagctcctgccgacggatgtcgccgccgctgccgccgcgacgggtgcccctgccacaagcttgccctgctgtcatcgccacgttgtcgcgagctccgctgcccccgccacgagctagctcgatccggccgccgggtggctagatctgccttcagcgtggccggatccagcgcctctgccgccgtcgccatccccgccgccgtcgacccagccgcgtctctgccgacaccatcgccttttggctgtcaaaccttacaattcgaatttaaaattccaccccctctctcgaactgagctattccgatgataaatcactaggacgacataagacagacacataacctacgtaccacaatttcttcccgccgccgtctccattcctgccgccagccgccaccccgccagatccggccgaggcggcgcggatctggcggtcacc

SEQ ID NO: 107787 - DNA, 706 bp, Oryza sativa
agtagtacttttgtccacagctactagtataataacacattttttttagataatggaatataacatcccagccagtataataacacatgaatagtactttataagtggcttatgttttttaatttttctaaaaaaattaaataagacggataattaaagttgaacacggaaactccagattacatttaaatagtacttctgtccacagctactagtataataacacatgaatagtactttataagtgacccatgtttttcaatttttttaaaaaattaaataagacaaatgattaaagttgaatacggagactcaagattacatttaaaatggcgcggagggaataactttgccgttaaaaatctaaaaagatagaccatgttatctgcatgtggagaggagtgacacggggtcacgggccaaccgcaactgtcgggttcaaaagatgcgttcgcaagaaagcaaacagattagagtggtggccccgcatgcagaggtaacaactgatcgaaaccacggcatcccgatcaagttgctggtttagctccacggacgcatgcctattctagtgctccactgccactatctttagtagcgccgtgtcgggctcccatatataacgtccctcgccgtctccatttggatttcagcgatcgatctctaccgcaccggccccgcatgcctgcccactgcccaaataaagcgt

SEQ ID NO: 107788 - DNA, 695 bp, Oryza sativa
tttcttggataaattgaacagtttagtttgtttaaaaccattgaaaaaaaatcaataattcctagtttcggtcactatgtgtttccaaatatcaaaagatagagatagccatttaggacgatgctagaaaaattgatagcctaagaacaaatcaatgtattttagttagacataattttctctctcacaaaatattcatataattttaaaggatttgaaggggatttttggagtcagcctaggactaagccctaatttccctagcttgtagctccacccttagagatcaccaaggaagatgtcgttgccttttcacatcctgcatttcagtgtcctcgctagtgttgaagtaaagaagacatggttttcatgttgctaagggctgatttagtttgaagacaaaacttgccataccaaaatattggcattttaaacgtaattttgttaatgtttagtttgctacgaatacttgtcaataccacacaaatgttgccaaaatattggcattggcaaaaaacttccacatgatttggcattgccaatagtttggtatggttgcaaactaaacaagccctaaatctctatcagtgtctaccgtattcttaaggtactcaatgaagacttacgaagtattttctatcaagttattcatgataattagcggtgatgaccgatcagtagtatttggtagttag

SEQ ID NO: 107789 - DNA, 1111 bp, Oryza sativa
agcgaatcgacgacgactgagctgctggatttttttttcgccccactaatccggccctgataccgtgtagcacgacggccaccggggaggtcgccgccgatgagccccaccatgagccttctctcgtcgtcctcatcctcgttcttccgccgcaactgccgctcatctgctcgccagttccgtcagctggtacggactctcctgatctcgcgattagtttatctgtagcttttgttcgtcgttagctgtttttttatgtttgttactggacggttcgtggtgtcttcaggggcggtgctaaagcgtaaaggaggatgttgccacttgcttaatttattctattttagatcgagtttaagctcatatgggtgtctaagtttatattaagacgagtgcatacatgatgaaaatagatgatatatagcttaaaaaaattttttgaccggttcctgaacacctccctatatatactagctccgccctcccccgctttggtcgttggggttgggtgtaagagacagtagcgtcggtccctgtggccctgtgggcgcgtagattgagttagctgcgtggaatggtgtatggtaaacactactcctacctgtttggattttaggatttgcttaggaatttttgtttggattttctgaggttatcagtccttggactccttaccagcgtgcactacatcagtttcttcgaattgcgtccagctagctaggggtaggatgagcaatggtacgtactatgtacctgaaaaccaaggtgatacttgagtgaaatctatagtttttgtgtgaacattgtagcttgagatcgagcaacccattgtttcacttaattgtttgttagcaaataaagattatttataagtaaaacttttatatatgtgtttttaggcgacgagtaggtgtggatggttgcgaaagtgctgaggcgttgcctccaaggtagcccaacaagattgacacggaagactaagtgtgtcattctattcttttaatatattgacgtgtaatacttttacgtgttcgagaaaaaaaataagtatgtcacttcatttcgtcctcgtgacccgtaaaagaaaagcaaatgaagtaaaataaactat

SEQ ID NO: 107790 - DNA, 702 bp, Oryza sativa
ttggttcgacagaccgatctatctaatataatgatatacagtgcaagtgtgcccctcaaacatggtctgccaaaatgccaacaccactgttacatttgggcaagcacgggccgaccgttcgccctcggggtgatagggcgattaacgtgctgcaacgcaagccacacgcacaccaaccgtgttagtttatctcgtcgtacggagcagatcaatcgaatagctctgattgaccggagcacgtacactgtgctgtccgtctgccaaagctcgatcttacatatccatctgacggccacggcgagacggatatcgagtggatagatggattcacgcgcccacaaagatctgcgtgccatccgaggctaacccacaagtggggggaatataacatggtgtttgtcggccactttggagtcctttaatattttgcagcatactccgtacttgtacgagttgttgatttgattcctctgcatcggcacgccgccgaggagaagaaaaaaaaggcgagggtgccgagcatgcaacgcgatcgccttctagagtcttcttctggattagtacgtaccgatcaactaccgagtaccacgtacatatcgcaagtgccagaggaagggatggatgatggatcgtcgtctttcatgcatgaaactaataatcaagcagacgtgtaatagtgcttaattattggagtcttaatta

SEQ ID NO: 107791 - DNA, 667 bp, Oryza sativa
ccctcaccaagctccgactccaactccgttgtgggaggccatgtagaggagggagagagaaagggaagggggagtgaggatgccaccacgtggaggtcgcttttatttttgccacgcaaatgcctagtcaatacgagtagattgggttaacttgtcacgttagcaaaatcaaccatctatactattgtcacgccccggactagtaccgaccggaactagcccgtgacgctccaaattaacctgttaatcgataccagtcccaggaaacagtgctggtatcacaggaagacagattatcacagcaacagaggtctctttattatagagtagaggtacagtcatgttgggctgtggacagatcccgagctcacaattgcattacaaaagggaaacggaagccaggacttggaccaaacaacacaggcgcgacttgggaactaagccgaaaccctaaaactcatcgtagccggcttgctcctggaagaactcctcatcagcaggatccgcttcatcttcttcagcaactggggggggattatttatataaagcaagggtgagtacgggagtactcaacagccatgggaaataagtgtttaatgcaggcttcaagaaaaggctgttgtttttgcaattgattttatttgaactcttttctaaaaacaacta

SEQ ID NO: 107792 - DNA, 517 bp, Oryza sativa
cattctagacgcacaaaaaatatatacaaaagaccatcgatattgcaaacagtaggaccaaactttatcctacaatgatgtcaaataattaaaaaaaggaaaaggctatacatactaactttttcttactaaattcctactaacactgatgtgtcatgctatgagtgcatctagattttttgtaactgccatctacttaaatcaaatggttgagatgattgttagtaaaaatttagtaagaaaaatttagtacgtgtagcattgctcttaaaaaaaatgttatgaaacagcgaaaactacaagatgcaatagaaatccatcgtaatactacaaatatgaatatacctttatctatttatagtattaacgtgatctaatttcatcctacattactgtattttgatggaggttcacaatgggatccgccaattagttcaggcaaaggcaacagcctgggtttgaacggatccgcccagacggcgttaattgtccttcgatccattattacagaaacact

SEQ ID NO: 107793 - DNA, 1231 bp, Oryza sativa
aaacatgtgaagagagagaaataaatattgaacgataattggaaatcagtaacaaactaaaaatgaaagaaattgttgagagtaacaaaaaaaagtggaaatcaaacgggtggttttcatgattcctcacgaaaacatgtatttaaggccgtaccgatgtgtatgatgatgatggataaaatgtgtattcaaggctttacttcaaatcaggaaaatcgtacctaatcagccatgacaatgaaaatcacgaattaaagcacgcggtttagaagcttcattctcaaggagaaacaaacaacgggctcaccggagttaacccctgaaacaaggatcccaacttcccactaccggtaacacggatgaccacaagcaacccatcttgactcccatccctccggtccccccaaaagagtaggcacgcgcgcgcgtatagtacgtatcacatgaaaacgaggtccctttgaagaaaaataacgactcccatccctccgttcccccagaacagtagtagcagcatcaccgcatcacctccatgcccttgctcgtgcgcatgtatcaacacagtcacacagctacgcaccacgagtccaagcttctgtttgaaagagtttaaaattctaagaacacacaaatatatctaaaaattcttttaattttgggaaaaaaaactcgagctggtataaagctgaagcatccctaaaaacaagcccaagacgaaatgacgaatgcgttacgacatgggcggagacggagggagatcagggtcgcgagtacaggggcgttggcttcaccgatcgatcgattgggcgatgggatctcgctttatcccccccgcgcgcggcgtcgcccgtcgtctcactgtccgcgcggcccggccatatttatgcgcgcaaccaccccgctgtcctcggtgcgacgctgcatgcatgtccgtgtcccggccggtgcggggcgtggcgccacgcatgcccgtccgcgtcaacgtacgcctcagcgtactacacccccatctttcgtgcgtttctcgcacacgccgcagatcgaattatccgttgtgtttttgtttccgtgcggctgcagagagaaaggaagtgactggctctctctgtctgtgccggaacaaggttaattacaactgccgtgattgttcgcgctttgggatgggacgaagtggaggggcccggatcgatcgaaccttgccgtaatttcaaaggtgcgggcaaatgcatgc

SEQ ID NO: 107794 - DNA, 1393 bp, Oryza sativa
ctatagggcgaattcgagctcggtacccgtgtagggaaaaaggctaaacgaactgttgttgattttcgatcagtatccagtacctacaaaataaggcgagctgaatttcttgtaaggaagtggattggtgaagtacaattgggataacacaagttgagaaattcaatctcagagtatgtacctgctataagcgcacattgttcgaagatcaacttatcaggcactagtagcattgttgtattagttttcagtacactacagaacaaccaagagggatgctactgttagtattagattagctagtgtctacttgtaattggaacacagggaaaacttcacaactaacagtcaagtctgatcggtttcaaacacagtcaaatctgaaaccatgcatctcgcctagttcaattttatatataccattcataagtaaagaattgatctatgtacagtagtacgttgctcccgaagttggcatgatattgttttttggttaaatttcctgcgtttgccagggacttaagctatcccaaatctcaaggtatgcaggcaaatttccatttctaaaactttttttagaaaaaaaatgcatctaaaacttattttaaaagtggtcattttggctaattaagtgcccacgatggagtggcgagtaagtattagttccaagactcccatgttgattcaaatgacgagatgtaagagaaatatgcggagtcatctctcatgaaagagatacaagtcattacacaagctgcatgaaagataaccatttcttacatctataatataactaattaaaagatacataaagttttcggggtttttctgtccgtccagtttttttaggcttctgattttttttttctgattcgatccaccacacgcacacgcagcacaattacattaaatatatttattagccggttgtgcaagttgggcctgctggatcgaaaagagacagaccgagcgaagggtggtagtgtactaggttggggctagaaaggaaggaatgaatagtatttggcccaaaaccaaggaagaatttttcattaacttttcaattatgatgtatatagcgatcctaatgtttcaatttatcggagctcctaatagctattatatcattggtctttacccactggtataattctagttgtcaaatgtgaataaatgaataaaataaaattgttatagggtattagggatagtatcctaaagttgttgttttatgtacatatgttaatttctaattaaggaatgcgtacataatattaacaaaattatatgtaaggaggggatcctctagagtcgacaatgttttttcttacaaaaaccttacaaacaatgatgtgatctctatacatcgactaaaatctagatttaatttaac

SEQ ID NO: 107795 - DNA, 612 bp, Oryza sativa
cgagctcggtacccggcctaccgagggtcatttataaagggtgtgactctggtctttttttcctctcaaaatttaaatgtacaaataggccctcggtttgtagtatttataaatggccctaagataaaacttattaataagtaggcttttgtttataagttggacaagtaattttgctatgtaattcatgtgcatatatcaaactaaaatttgctatgtggtgtgcatatgaaactcggttgggtaaattaagatgtttttacacatacccctcccagagagacactaaacattatgcagaggtaaagaaaataaaaatcagatttgtgggttttttttttaccaaaatacatcaaatttccttaagatatttagaaatattttgaccttcgagaagttagtacaaaactaaactctctatcccaaataaattttacgataattgaactagcagttgactgtgccaaattattgtgttctaaacaaaccatagaaaatatatagtctatttttcatgagttcttaaaaacggataaaattgacagaaataaaaattataggataccttgaaaactaataaatatatgttctaaataagtcgtaactaagtcg

SEQ ID NO: 107796 - DNA, 1451 bp, Oryza sativa
catatatatatatatatatatatatatatatatatatatatatgaaggggctttcatgatatttcattatttaataaatcccttcaaaatattgtctaattcaaaaggggtttgaaagttttacacatattttacaatattttcccttcaattatatgatacaacccctagtgtgaggtacaatttatttcaatgtaaaaatatgtattaaatccggtgcaaagcaaaccaaggttcactctatccagtgcaatatgcaatttacttaaaaaaaacctaccaatgcgtttcatatatcgtgttaaaataaataaattgataaagctaccttaacaaagctttggataaaatattttaaatgcccataagaaatctatggtttgatttaaattctactcatgcaccctactaccattagtggtagaaggtactgaagagtgttggtcaatttgaaagataactgtaaaagtgccaaaatagcttacagtatctcgaaattgaaactccaacaatttgaattgcgttgaattatctacttacacaattagtctggtttgtagaatattttttcttcacctggttttgtagaatttctagtgttgtgtagtacttctacaagaaaacacgatgcttgttctacgtagctccacctaccatgtgggcctcatggggccggcgaacaatggtacgactcatatatgggctacaagtaacaaaggtctgcccaaacgtcttttttgtagagaccctctttttagaacaataattttttctagagactagaggtgttatttgcacccgttgcaccggggccaaacatatgcgtggtgtacaactggacatctctcctaggcctccgagaagcatagccggtggcttgaggtgctgagctgagtctgaatagaatcactttcatttctttcattcttttcacgagatcacgattaaatccttcagcagccagcctagtagggtatgggtagacagaccagccgtacctccgtttgctagctgcagccgaggggtgagagaccaaggaatggccaaaagtgctcgtcatataatgtgtggcagatcgtatcgcaccattttatgatgagacggagtaggtgaccttcaataagtagctgcgcaacattacattttttttatgttttcgttcttttaaaaaaaacttatttatattatgtcgtgacattaggtcacgaataagtttggagataaacaggaaagtttcttttctcgcctatccaaagaaatgagctcaaatacaaaatacagaactttgatggctaatgtttctctagtagtattaaattatgtcttgtcttgcaacatgcttttgatcggcttatataccccacaatcgtacatgtgagaatacaactttgcccccatgggcccttgtgagtttaaaattatactcttgccatgtcagcaaccctagatgt

SEQ ID NO: 107797 - DNA, 941 bp, Oryza sativa
agaaaaagaaaaggcagagtccatatagaaatccattttaaaatagcagaaattcggaataaaaaaaggaatattagaagaggaaactaaagtccatatagaaatccaagtagaaaataatagaaattcggaattaaaaataaggaatattagaagtagagtatagagtccatatagaaatacaagtagaaaataatagaaattcggaattaaaaaataaggaatattagaagtagagtatagagtccatatagaaatttcaaactaactaaaatttagaataaacataataaaattaaaagtagagttttgagttcgtataaaaatacaatttacaaataactaaaattcaaaattaaaaaaagcatgggaagaagagtttaaagtcaatataggaatacaatttagaagtaactgaaattcgaaattaaaaattaaagaatattgaaagaagagtttagagtccatatagaaatacaattagaaataataaaaattcagaaataaaaataaataatattggaagaagagcctagagtctatatagaaatcctagagtctatatagaaatacaatttacagaaaattcggaattaaaaaaagaaaatattgaaagacaagtctagtccatataggaatatatataatttacaaataactaaaatttgatattaaaaataattaataactaacacgtatataaaatacaatatgaatattatacatttttattttcgtaaagttattgcaaaatttaaaattatgatgtcattttaatatatttgaataatataatgagaaaacatatatgctattatatgagagaaaatataatgatgctagccgcgcaatctgcgtgggctaccatgctaattatttttttaaaaaaatacaaataggtcgtcaatgctgacccccttcacatggtgtcggtattagtg

SEQ ID NO: 107798 - DNA, 536 bp, Oryza sativa
cgagctcggtacccccgaatctacctgacctcagtttaggatgtaaacgcagccagcatgggcatggcaggtcggttccgtttgggtcccacaggtcagcctctttggtgaacttctcttacaaacggcccatcatcgtggaaataagcaaaacggcataattacaaatgaaaaataatttatgaataaaacttttatatacatgtttttggtgatctaataaaagtaaaggctgaaaaataaacttccataaaaaaaacctcaaaatcaggttcaaatcaaattcaagattaaaaattcaaattttgactgataagtataagtataaacgaaaagatgagatacgaagactccttttggtgaacttatgtaggttcattttggattattttaggagggtaacaaatcagcaattttgtttggagtctcatgaataactctgtttcgtttctaactctaccctaccaaaaacaatatgatttttttagcaactttcgtatataaacttttttaaaaaaagccctatttaactgttt

SEQ ID NO: 107799 - DNA, 556 bp, Oryza sativa
tgcccaaactactaaacggtccattttttcaaaaaaattttataggaaagttgctttaaaaaatcatattaatctatttttgaaatctaaaatagttaatgctcatattaattccgttttacgaatcttcccaatcttttcaacccccttcttctcgagctcagttttctgctctgaaactaaaaacctcgtgaagctttttcagtattgtggcacataaatgtaacttggcaactttgaaaagagatttgtttgaattttttttaacttatatcgagctttcacaaatatttgaaactttgaaaaacttgttctttgcaaaattgaatgaaatttgtccactgtgaaagagtagcaacaaagttattcattgcaagcctgggaagttttgtttagctcggtcgaactaggtgatcagggcatcctccatcatcatactattcatgtacttatattactatattagtactatattggccggagagagtctggtatgtcatataaggcccctctccctctagacgatatagcccagcagaagggagacattatttac

SEQ ID NO: 107800 - DNA, 706 bp, Oryza sativa
ctggttaagtcgcctgggtatgaaatcacccccctactcgtcccctttttctccaaccactgataattctgtttcgcttgggggttccatgggaattagtggtcatgttccgccgatgagctgtcctcagttcaatggagatagtcctcagatgtggaagagcaattgtgaggagtattttgaaatttatggagttcatcctcgcaattgggttcgggtggctggattgaattttactgggaacgctgcattttggttacagtccataaggtccacgttggttgggcttagctggcaagcgttcacagatttggtatgtctccgttttactaaagctaggcaggaagtacttattcgtcagtggttccatctcattcaggattcctctgtgtctgactatgtggtgaagtttgatggtataatgcaccaactcttggcctataaaagtgccttaccattgaactattttgtcactaagtttgtggaaggtctgaaacctgttatccgctctagtgtgctgatgcaaaaacctcaggatttagactctgcttgttctctagccttattacaggaagagattttggaaggggatcaatctagtcagtataagaggcctgaactgtctgtcacctatcgacacactaatcgactgtctttccaggctgccacatctattcctgtcactacagttgctgcagctgatgat

SEQ ID NO: 107801 - DNA, 662 bp, Oryza sativa
tcaacacattttttaaccgaagaaggctgagaacaacatccgtcccctttcatattctccatttgcaaatattacttgaaacacatgacacagctcctgcatttcctcggtaaaaaaagttaatagagaccttaatcagaatttttaaagtttactatataaaactgacaatgatggtgaatattttcttctgaatctacatgtacaaacaatacacaaaagtaaatcatagttcatcataaataggaggagcaggagcaggagcagcaggtgctgggacaggcacattcttgacttttgctacaacgtcttcagctgatattgagcctgatctgatggcatcggccagcttcctttgcagtgtcaacaggccaatacgtctcgagacaacatatagcaccgccaaggagaaaatgagaaaaccaatggtaaggatgatcctggtaaagaaagccaattagcaattggtacaacccagaaaatagtattaatactaagtattgcaccggcagaaacttgtttggcagataagaaaattggaatcatcaagtaacgtaattggtaaatcaaatgcgcatttggttccacctttttttaaaagagaagagcatttctatctatactcctttaaaaaggaatagtggtggtggtgagtggtgaat

SEQ ID NO: 107802 - DNA, 668 bp, Oryza sativa
gagagacagatcatttgtacatccaatgacaaatcatcaacatcaagtgtgccctaaaaataaagccaaatgattcatcaagtcctaccaattctacaatggcaacaacatttaacattaaactaccaagttgttcacatgcacaaatcacaaccatagttgattcgatcacagggctggggctgggcgtgcgtgtggtggccaccggccggcaccctacgcctgtggcttgtgggttagaggtggggcatacccaggattttgaggttgggtattcgaaatgggaaggggtgattttttttttataacccaaagcctaatatgtttaatttcatgtagttctaaactactagttggataatatatagtggaggatctaaattcagtactagtcatttcatactttcttaaaaacatatgcactataattatacaaaagaacaattgtacaaagcttcacaaggttcaaaaatcaaagttcaattggtgaaacatatggttataatttctattgttccctagtgatgccctttcgatctacatttactacaactggattcactggcaatcaatcaatcaaccatccatggcttcaaatggaaaagatgttcccaataatcctaaatcacagcaccactgaagcaaacaacaattaccttagggtttct

SEQ ID NO: 107803 - DNA, 2036 bp, Oryza sativa
ggatttgatgcaacagtaaaaggtctgtaaatgaaaaagcaaatccaggacctaattaatcttttctggccatccagtactccactgcacacagtcaatcaccaactctctccaaggcgtaaaatgcggcgagcctagacaatccgaggccgagcagccatccacacgccaagagtttgtttggatcctttcattcaagtactagtaattcaataattgtcacccactcttcatatagagtgaccgagaatgggatctaaacctttagtctataaataactttataaattctaaagatttaggaataaataaaagggttgggttaaaatttatatacatgtttgagttagaatattagaaaagggttgagttgaaccgtgaaagaaccgtcagctgtatgcatggttgggagaactagatatttgaccctaaaagagataaaaggtcaacattacacatacacttaggccatacatagtgtgagtacctaacgagtgattcaggctcactacatcagagttatgatggcatatcagccatagatgtgtcctcgtgaggcttctcgtgcgtcgtcagggcacggttgcctcatcagggtgagtgcttgggctcaccatgtcagagccgtggtgatatatctaatgagatagttccttcacaaggcttcttgtgcctttgcagagggcacaattgtctcattaggatgggacacttgcaagtgtagctaaagcatgcaagccacgtcggtaaggccatcgccccacaatatgccccctccttccgcgtggttgcacagacctcaatgttgcgagtactgacaatgtcggttggaaagcaaagaggcaatggctagagatacgaccgacaagtccgcaactagtggagagggtcagatatagatagaggaggaacgtggctaagagtagcactgcatactattaggaccctgtcaccattgccatcaccgcgaccaggagatgtcatcgaccaagtcactgccttttgccgccgaacttgttgggtagagctgccctcaacatggctggatttgaggtgaagaaggatggcggcagccaggactagacagtggagtagcccgttgatctaaaccaccttcgatccaccttgcataggtcttggtgacgtcagttggagagggggaaagtcgtggggctgccttcgatccacaatagtgaagttgtggtggctggagtgggaggagctgtggtgcctagagtgggaagatgtgttgataggcaaaacgaatataattagtggttgacaagtaggccaatggttatgatgtaacttttgttgatgattctaaaggttgttctgcatatttatttaatgtaaaacatatattagctaagtttatgaactgaattatttcaggccctagtcaaagccaccatacattgtgagaagggtattataagatataacttcaatctacattccacattctttctccctaaggccattcttagaagtagcttccatcgtgaatgcccttatgcagttttcccgtccaatttctacactgaggtagtatatatagtaggggcaatttgcagggaaaatgatggaagacattgactagaaataaaacagattgttcttttttttttccatcaatagatgaatcacaaaagttggcatggtatgaaaaagtagagaaaaattaagcctctcattgtatgcttctcttatttgccgaatccaaaatttaaattttaaaacttaattttagagttatttataagtttctttgttcatactggcttttaaattgtgaattatttttgttagtttgttaattttttaaggacttatcaacccgtaactcagaccaatcaaaacttaataagtaatccgaaatctcttcaagtttactccttcgggagtccaataagaccggcatgcatcaacatgctactcatcggtcgcacctcgcagtagcgcaactgaaacggctgcctcctgtacgtgcatgcagatgcagccgcatgtcgtctttggccgtttttgcaggt

SEQ ID NO: 107804 - DNA, 696 bp, Oryza sativa
tatggaagtattccctccgtttttaaatatttgatgccgttgactttttaaaatatatttgaccatttcctatcatttaattcattgttatatatatatatatatagacacacacatacatatatatatacatatacatatatatatatatatatatacatatatatatatacacatatacatatatatatatatacatatatatatatatacatgtatatacatatatattacatattccacaaaagttcttgaataagacgaacgatcaaatatgtgctaaaaagtcaatggtgtcaaatatttagaaacggagggagttgaactagtttcaacagtcagacgaaaaacaaattgtgaaccattttcctgcacaagctaccttttcctttgaattgagaggaagagttttacgcaacttgtcaacagtggcttttcacggtggaacctaataaaattcaaaattttctaggcatgacgttatattttgtaaaaggaacaaaagcaccgggcagactttttgagtgtacactggcaagaaaaaagaacttcacttcgtttcgtcagaatcataagaaacaaaggcagcaccgcagcacatcaaacattttctgccattcaaatgcacaacatatgatccatattattactgctagctaacatccagagtcttagtattctcatagccacacatta

SEQ ID NO: 107805 - DNA, 532 bp, Oryza sativa
cccaacaagattgacacggaagactaagtgtgtcattctattcttttaatatattgacgtgtaatacttttacgtgttcgagaaaaaaactaagtgtgtcacttcatttcgtcctcgtgacccgtaaaagaaaagcaaatgaagtaaaataaactatgattaagaaaacaaatggaaacttactccaagttgtaacatttaaattttaaattataagtataagtcaaataatgactgagacctcgaatgagtagtttatgttaatgaccatgctacaaaagttgactcttgctctgtttgcgtagctgagcttgtgaactgtctcagttcgatacacgattgataggcctagtctagtattgatgctttccactgcctgtaaatgaaaaggctcaataactgccgcttgtttagttggtgaaaagaaaatatttagttgtcacatcgagcgtttgaccatatgtcggaaggggttttcggacacgaatgaaaaatctaatttcataactcacccggaaaccgtgagacgaat

SEQ ID NO: 107806 - DNA, 628 bp, Oryza sativa
cactaatgatggacccccagctcttcactttatgcttactggtagtctgttgggtggaagtgtgagcggttaacactatcacacaggcaagagatcttcccacaaatatttcttagtaatattgagacactataatatgatcaatcgatactgcctgaacgctgtcgaattcatattaaaaaccaatttggggccgtattttattttaaatattaattctgaaaaaatattttgttgtgttctagatggacactgcttctaatattctttatttttaattctaaatttcagtaatttctaaataagattcctacctgaactttgtcgaattctacgaattcgtgttgagatcaaattttgggattcatcatgacgtgtctatcactccgctctttttttttaataatttcttctatacttttatacgggattcggtaattaggattaccaattcatcttcgaaaaccctatatcttagtcgccaataatttataattatgagacttacatcacttgcatatataaggtggggatttacatatgtaataattttgagacttatagatctaatacgttaaaattacatatattattttagggactcataacgtaaatacacgcttactat

SEQ ID NO: 107807 - DNA, 1352 bp, Oryza sativa
agtaatcacaaaccggttcacttccatccatctcgccgttgttccatcgcttccaacttcctccaactgaaaaattgtttctcggctcgtgccaggatatataccgtctcggcgaacgcgccgatcgaaccttcgcgagcacccatccatgcatcgatcagacgttgttgttctacgcacgtacgctaccttcctcgtcgagccgccgcaccctctcttctcgatcgtcgcacgctatccaattgcctcgggcatggctggctgcggtttcggcgccgcacgtcccgctccccgcgcgtacgcgtacgtgtcagctggtcgcgttacggtttcgatacaggcgcggtgcatggtggcgtgaagacagcagccacgcgcgctaggccgctagctggcgtcgttctgagttcgtcacaagcaagaaccaagtctcgtatcgatcccgtgcgtaaatttgattggttttgcgcatgtttttgtaatgataaatcgactgagaaggttaaattagcgtggtgctagtttgagatttgcgcacgctgtagctgattagttggtgctttctgctcgtcgtggagacgcggagagtatctgatccgtgaaagcaatggcacgtgggtggggcctgaaaaggtccgtcgtttaggttcgctgtgtgcctgtgtctgacaaatcctgttttatgagtagtactccgggtgcacgtagcagtcaggtgcagcaagcctgcaaagcgacgtggatgaattctaccctatgaccaggaagcatcaagcatggtgcaacgaagagccaagggcatggaaaatggttgctccacgtaagctgaatgcgtggaaccaaacaagaagattttaattaatttcgagtaggtgatttttttttctgtttcgtattttcaatgacgagcacaatacaagattttttttcctcaccccaaaaacgagtggacgaataaaatatgctactgggatatactttttttataaatatcatttgagtttaccttttaaacactatgtggaaaaatgctcttgaataaaggagaaaatattggggagggtttctctgtatgcgtgatgagagagagaagagcattatgtgcagttctttttcttattacgctcaccgcatctatgtatcatctttaatccagtttagttatgcgatttacaataaaaccattatagcagctacaacaaccaagtattgaaattcatttgttgacgtcggtaattgtagttgtcgattgcaactgcattgcggacatggtaaaacataaccgagcaaactctttatgagattactatttgatgagagtttcctcatcaacaaaaatttttgatcaatgg

SEQ ID NO: 107808 - DNA, 526 bp, Oryza sativa
actggtcgatcatgcatgcaactacggtcgccgtcagaagtcagaaaaatctggtcatatagcgctctgttcttcttgacttcctgtgaagttctgatgctgtgacagcgtacaagtgcactcgttgtttgtactttcggatctgtttaattatcacgttatccaaaacataaattaatgtttctgatctacctgcttcagatcatgctgtcatcgctaaacgctaattggcgatccagtaatgataaagtatgttgctaataaagcgttggtgccagtgtcctgaaacaaacagtgaaacctgatcaggttagtctcaataatttcgttgcatgtgtttcgttatcttgtggtggaagaagcctaagcaccttcctggtagtttggtaccatggttgctgcaggtccttgcatgcaggtgtgagactgtgagtgaagaaactgccttgatttaaacaatcatttctattttctatgcatccatgaaacatcgcactaacaaagcacaaacccgttctatataatt

SEQ ID NO: 107809 - DNA, 643 bp, Oryza sativa
tccccctcaaatttaatgtacttctttttgaaaagatcacgacgaagttctttaatgttatttgtaccttgataaaaattattcaaagcaacccaaatctcatgagcagtttgaagatgagcaacacgatcataatccgaacgagaaatcccactcaaaagaatattgcgagctttgcaatttagttcaaaagcagttttttcagcagcagtattaatagcttcaggaatcacacaaggaagagaaacttttctccaaatatcataattctcagccataatgtaagattgcatcctactacaccaatgagaaaaatccgttccatcgaaaacatgaggcttagttaaaaacttattagaagcagccatggcaaaaactctagatcggttaaaatccaaagaagcaaacaaagctttgataccacttgtaggattgaatcacaagaactaagccaaccaaagggggggggggtgaatggttgagatacccaaaaaccaaaaacttttagcggaaataaaagttaccctcgaaatcgatggatcgcggtctgaccgaggtagtcgtccggtctgaccgtctgaaagccaccggtctgaccgagattgaaactccggtctaaccgcctgatcagctgtcgcttgct

SEQ ID NO: 107810 - DNA, 574 bp, Oryza sativa
acttttatgcgctgaaacaccgaatgaaatctatctagcatcaattcttatgctttttgttactattctcatctgcgtgccttacaaatatactactacataggaccattagccctgaactatgcatgtagctgatcagcgtccacttgtcaccactgttaccagatgcaagatatcaagaggaacagtcacccacactgtggtcggaatcattgcaaccacacacataagagcaggtacaatagcagactattagccagctataaatatattttaatgagataaacgatgagagagaagagcagcgggctacagatttgtagccagctgcagcacggactccaagacatactgtgtgtatgacaggtgagaccatatattaatagtgtagtaagcaactattgtatgaattggctattaaatcggttatagatgaattatagctagtagtgggctatactattagacttgctctaaaggatctggccttgctacctctccctgacacacgcttcatcgatcatgcaagtatccaagcacaaaaggccggatactggataggggcatgaatgca

SEQ ID NO: 107811 - DNA, 673 bp, Oryza sativa
cataaatcaatcttcaccatagagcaaacttctaggtgcttctattttggatccatttcttgccctccacctccactttatccattctttaaaatcatctccaaataactaccaatgacaatttggttataaattttgttaccatgatctacgtgttttggtgaaaatttctacagtatgttattcgaaaacagagggagtactcaataattactactacctttatttgtaaatataaatatttctaggttattggacagatattaaggtagacaagaaaagatagaaatcccacaataaataaatgatggataggtagggtgtatgggtaggtgggagtgagagatgtgaagaaatttgaacgggaaataataatttataggacaagtagtttgtactccctagaatagtgtgctagatattcttatattttgaaaccagattcaaacgttgaaagtttctgtattttaaaactgatggagtttgtttaggagactctttaattaggtacctactgcacactacgagatcctgcatgtaactaacacaaatgtgatgagtagcatgttgtggtcttagcagttcattcgcttcgaccattcaattttcttaccttttctaacgaaagaaattactatctacgttttctaatatatgatgtcggtaacttttt

SEQ ID NO: 107812 - DNA, 614 bp, Oryza sativa
ctagcatacacaagaaaataccatatgtataaacaaagctctcttttatcaattttttcattgtcatatttttgcttgataaaaccatgaggtacaaactccccctcaaaacatgccaaaagaaagtcataaaaagcactaactccccctcaaaataacctccaattcttcccgaacaaaaatcaagaaaaaatcaaagattttgaaaaagacatccaattgccaacgatatcaccaaaattctcaagaattgacatacatccaatagtattaacaaaaactactacctcaaacattagcacatgaaaaagctaataaacaagagaatagaccaaaattatgtcaatccaaaagtaaagtgatgttaccttgctatacaatcgtcatctcaaagttaaatgcacatggggagtatgccgccaaaatacctacgaacgacaagatgtcgagacctccgtgttggggttagaaataagaaattttggaatccaacactgagtcacaccaccactagaaccagtaggtacatacacacttacaaaatcagaatcaaacttaccaaaaaactagcctttttgcttcacaaaagtctgagttgaatttcgcacaaaatt

SEQ ID NO: 107813 - DNA, 686 bp, Oryza sativa
catacgcatacaatacctccatcatatgccatatggaatctccatcaaccacgtgcatcaactctagccttagtatcccgcatgatatttgaccaccacggacatcgtcttaccaccaagccgactcccggtccatcaccgcaaatactctcccgaggcatcgagtcacctacacatgaaacaaacaaagaaaccatattccgagactaagctatctccaacttgactcattagtagcaaacaacagtattacatacgtataatatccatctagaagccataaccatgaaacaatcacggatatccaaagaaacaacccgaaaccgaaactgacacagcgtcgaccggtcagaccgcgggctgcgccggtctgactgcgcaatacacgccggtctgaccggcacacccagcccggtctgaccggtcccgacaaactagtaaatcctgttcattttctgaaaattgattatctccaaaaccacttcgacgataatctccaaatatcaaaaccaataatcacatatgccaattgttcatcacaaaataagaatcaaaacacacattgatcttacaaatgattcatcaagaagctacgccatatagcaatgcaacctaattttcattatgcttgtagcatgacatgatttgtaggtgggtggaagttcttttggcgccatttaggttgt

SEQ ID NO: 107814 - DNA, 701 bp, Oryza sativa
ctcctattctctcttcctcccatctctctcgcttgcaagttgcaactcgctcaaagagaaagatactcatactcgctcaaagagaaaaatactgatacctcctcaaaggggttgtttagaccatagccaaaatacatcttaccaaattttgacaatgataaaattacagtaagttgacaatattaccaagttttggtaggattccttatgtatttattaagttttggtaaaagaactaaatatataaatatatagacatatttaacaactttttatttaaaaaaatggtatggtttaaaataacatcaatctaaacaaccaaaataatttagagagtgtgggatatgaagaagctgttagaatgtatataaaatttgaaaagaaattattttgcttcattgccaaatgaacaaataaagagcaagatttgagatttgaagaaactcttggagatgcttagactagacgcacatttagattgctaaaaaaaaacctgtaaaggcaaagatcgacaaggacaagttttaggctgagtttgtttcttggggttgaactcatctctaacgcacgtaaaacagagagactcattaacatataattaatcaagtattaattattttttaaaaataaaaataaattaatataattttttaaatcaactttcgtataaacatttttttgcaaaacaaatcgttaagtag

SEQ ID NO: 107815 - DNA, 1340 bp, Oryza sativa
acagggtggcccatggacccatactggcagcggaagctccgaactgtctccagattggtggcaatcccttgccgcgtgtccacctgccctttcatcgacaccaacaaatttcccttgagccctctccgccgccaccatcaaccgcgtccctcgtgacctcgtctcgtcggttcgtcgctctctccgcgagaaaacgggggcacagtacactttaccggctagtttcgatcgatcacgcacgcggagcgcgggcgggatcaaaaccctaatacggcccgcccccgcctcgatctccgtacaatgcgctcgccgccgccgccgccatgagcctctcctccctctcccgcgccctcgcccggtccgcgcgctcctcccggcagcgccaggtgagtgcccgagccgcaccccctccccttcccctctccgattggtgtggcttcttcctgcgcgtcctcgccctaatggctcgggcggcgtgtgcggatgtcgttgccgtagggttctctgctcggggggcatggcgggctccgtgcttcgtcgccgccgctgccctacggcgagttgggttttctgcgcagctatgtgacgtcagttatcgggaatcgggcagcggtggcctccggggcagggaagggtggggactggaggttcctgcttgctagccggcagttccggcggctattctccgacaagtcgaagaaaagtaagctttctggctggttaggtggtttttgggggatatctggtgactctgttaatatttaacgttgccttttttattcagaccacgggaagcattcggaggaggagaataaaggtaaaggggatgagagtgacaagtccgactcaaagagtaagtgcttattttaacctgcattcctcgctcttgtgttggatatggtttattaaggtgttgagctttgcaaaatattttgaaagagagtagacttttacataccagtggcgacttaaccttccgagtgctgccctaaaatcatgctatatcataacttgtgatttctagttttagtatactgataatagaaaacaatgttaagaagatgatatgcagagcttttgtaagtggcaatacatgttaaacagagtggggctagttgatgttttattttattgcacaaatacccctaacagtatgtaagtatcatgtatagctgaaaatgctaatatttgagttttagtgcctcataaactgcccgctcacctttaagggagaggtactagcatgagtattgtggaatacgacaacatgagcctttagcccaaagcaagttggttgcgtacaatttgtaaagtttgatgcatccgtatatagcattata

SEQ ID NO: 107816 - DNA, 673 bp, Oryza sativa
tgtgtgtctatacacacatacatgctatctagatacatcttcacgattgatttttttcttttttgcaagaggagtagtccctccatccaaaataataacatcgcttttttacccatttcacacataccaatataaattaaaaaatatctttcactttatcaaatcctaatataatttcactttattaaatcctaatataattggtcctcactttatctagttcgaatgtatttttctcacttttataaactctaatgtaatgattacttaaaagatacaaattattttcaggacaaataagatggtgaaagataggttagtttttatgagggagtaagtctagacttggggaagcaactttaaatggtctacgtggttacgagtgtatatacgattccaatttaaaatagaacctttccatgctgatgtttatgtatttaattaaattcagtgcgtgagaattttgtgagcttctcgcggatttacactgccagagagtgtggtgtcacgatgaaacgacacgcatgggtgtattagtacatatatgagtggtgcttgatgctacgtcgtgtaacgtacgtgtagtaggttgctaattgagcatgtccatgctgtcatttcgttattagtagttggaacaagctttcttcagccataatgcacctagcacacc

SEQ ID NO: 107817 - DNA, 631 bp, Oryza sativa
ctatagggcgaattcgagctcggtacccgccaattagcgattgctttctcctgaaggagattttagtgtgttagcccgttcttagctaacttttgtgacattattttgctcttttttcttttatttgtgtacaactatacaatgacactgttttgatgcttctttgaataaaaaaatgggcattaattgcatgaaactgttccagaacactccttgtacgttgtcctttttgcctatatttttctttcatgagtatccattttctttcccaattaaacaaatctgtggatttgtttcccacaacttgaattcaaactatctaaaatcaagagaaaatatattacttccatcatttcacctacagttaattatttataagcgtaacacttattaccaataaaaaatgatttggtcgtaaagtttttatatatgtattctcagagaagtcaataaaacaaataaactatgatggaaaaatcaactcaaaaattgagttgtaaaatttaaagtttggctacagctgataagttaaagagtaaacgatggttttaactcctaaagaaaggtgatgctgtatttacataagaataaaaggggcaattaaaaatactattacagacaggtacatgga

SEQ ID NO: 107818 - DNA, 647 bp, Oryza sativa
gttaggtgtgttcatctggccttgctgacaaagcagagactccagctaccacacagttttggaacagaggctgggaaagctgcacattagctagtccaaaattgcgatggcgctgcttgcaaaactggagaatctggcatccaacataacacgtcattttcgccttgaaggaggaggtaagctttatccttcacgcgaagtgaatagcttacactttgcgcaatgaccacactgtcagaggttggttgtgctcggcgctggcgaggaaggggacgaggtgcagagacgatcgatgtaagagcgatataatactcggaaactaaagggggtttttgaagaaaatacaccatccagtcctagtgagcgacgtggaccgtgcagtttagatctaacggtatccaaaaaaaatgtctgcttggccaccaatttttcatctaatggatttcaccaattcaccctatccagatttggatgttacacatgattacggagggaaaaatccagaaaattgctcctgtagttcttcgagttcacgaatcaagtctccagagaagacgccgtatgacgatgacggccgccgtgcttcgccgctcagctatctcttatacgcctgcgactgcgagacgcacatcgtaactaaacctttt

SEQ ID NO: 107819 - DNA, 671 bp, Oryza sativa
ctcctgatcaagtaatgttgcccttttgttgcttccagctatcctgtgtactatctgtataaactagagtaattgtacatgtgcatgatcttaacactgatagttaattgttttagattctataaattgagttgctctgaattcagattttagaggtgaatttatgagaatttagggtaattgatcgtttgttatgctttttatttacagtttatatatacaccctttggtattttcatcactaacattactactgtggtaaaatatccgcactcttaagaactcctaaactgctctagaaaatgtgcttgtaatttgttagtcattcaatttgatgcgaatctatggtgttagcttcactaagcatcttcatgtttgatatttatcatacttctggtttattatatattttgctgataattaatttaaagtcaaatcattttttttgttccaaaccttggaattgaaaagtcaagtcattgatttcttgagagggatcttcaacatgtttgacacagacaatgtaagttctatgcactgatgtgattgttattctcctgaatcgtattcaactctttgttgtactgagcattttttgtaataaaaactgtcattttacattgataatttgaaaatgccttttggtataatatccaggatggagctttgca

SEQ ID NO: 107820 - DNA, 1196 bp, Oryza sativa
actaaacacatacaaagatatcagcccctctggtataaattcgcatatgcgatcaacatcactccttccgcttcaaatatactccctctagttagccctaaataaatatgttttagattaaaaatttatccccaaataaatatagttttactgatcccctagactactttaatacttccttttgttttctttttactattttaccaattgtaatctcttctcttttttctcttcgcattaatgaagaacataacagttttttagtttctcgcttaatactccctctttattttaatgtatgacgctgttgactttttaaataacgtttgaccatttatcttattcaaaaaatttatataattatcatttattttattttgacttgatttatcatcaaatgttctttaagtataacataaatatttttatatttgcacaaaaattttgaataacacgaatgactaaacgttggttaaaaagtcaatggcgttatacaataaaatataaagagagtatgtttttaactagtcaaaattgtatgaagtatttaattaggaaccgagagagtatatatttatgtgtccatcgctgtgtgatggatgagccgatggcggagtttttattagcgaaagagaccatgtcctgccccggctgggtctaccccaattgcatgacaacttttttttttacgagaaattgcaggacgactttttcagtgcatagtggagtagtatttcctatactacctcgtgtcctcgaccatgctgctatcccagaattgaccgagatgacgtttggattgacacccttgtggcgaggggagcaatgtggttcaacttcaactgtagcagagtaaatgaggatgtgtttagttggggaaaagaaaatttttaggtgtcacaacgaacgtttgaccggatgtcggaagggattttcagacacgaatgaaaaaactaatttcagaactcgcttggaaaccgcgagatgaatcttttgagactaattaagccgtcattagcacatgtggattactgtagcacttatggctaatcacggactaattaggcttaaaagattcgtctcgcgatttttcccataactgtgcaattagtttttctttttatctatatttaatgcttcatgcatgtgtccaaagattcaatgtgatgtttttgaaaaaaaaatttgggaactaa

SEQ ID NO: 107821 - DNA, 715 bp, Oryza sativa
ctcaacataccgagtacatcaatataaacatataatctcagtattaaactatgctaaaatactattaaaatacatttagcacctcctatcttatcaatcaggacgaaaaaattgaaggggggactcaggggggtatccatgggtccgataggtgtaggggggatttgagtccgctctacacccacattggatccgcccctgagaaagcgatgagtggaaagggaattcatattctgttcgctcgatcgtcgtctcactttctgcaaggttggttgtttggtgagagatagcctggtttagtttccaaaatttttttcccaaaaacatcatatcgaatctttggacactcaaatggaacattaaatatagataaaaaaactaattgcacagttggcacgaaaatctcgagacgaatcttttgagcctaattagtccatgattagccataagtgctacaataacacagacgtgctaatgacgtattaattaggctcaaaagattcgtctcgtggtttccatgcgagttatgaaattagtttttttattcgtgtccaaaaaaattttccgacatccgatcaaacatatgatgtgacaccgaaaaattttcttttcatcgacgtttgaaaaaggatgtactctctgaaggagagagaaagagagggggggaggcaactatgctctatttttttcccaaaagaaactgtacgctgttttt

SEQ ID NO: 107822 - DNA, 588 bp, Oryza sativa
cggccttgatggcagtttctcattttaagttggggaagtacttcctttgtcttgttctagttttgcagactatttcgttgcagttccccaaagaacgaaaatgcaagataactttctggtacatttcaggaaaaaaaaaaagggacaggagaactagattgcaagatgttatcaaaacgttaacaagtactacaggtaaactctcagggagagggcgagaggctcaggctttccaagctatgagcacgggagactactactcatcatacgctagtgatgggttacaggaacagagaacaaatcgtcaagcagatttcagaaaaaccacgaacacctttatacaacttctcatgccctagtgctaggttacagccttacaggaacagagatcaaatcgtcaagtaaatttctgaaaattcatgaactgaaccactagttatcggcagattcaacagattgaacgcctgcgcgaagtggaaatcgcaatctagcaaaatagccataacttggcatatgaacacctttatacagcttctcatgcctcagaaatattaataatctgttcagcaaacatgcgatatacaccta

SEQ ID NO: 107823 - DNA, 577 bp, Oryza sativa
ggtaccttttatattttgaattggtattctcccaatgctcaatataaagatgcgcaaaacttttatgtatcataaaaaaaaggctaaagtacatgacaaaagaaattttacggtcattaaggaagtaagacattattatattgtacaagaaatatggttaacttctggtacctaatcaacacctggaaaatcactcatagaacaatatattagcagactattactatgtattgtaacaattaactgttccgaatggctacttccttattctccaagtgttttgtgtaaaaattttgtatgtaaaagttttttttaagaaatcaaataaagctatttttaaatttatactccctctgtttctaaatgtttgacaccgttgattttttagcacatatttgaccgttcgtcttattcaaaaacttttgtgaaatatgtaaaactatatgtatacatataagtatatttaacaatgaatcaaatgataggaaaaaaattaataattacttaaatttttttaataaaataaacagtcaaacatatttaaaaaagtcgacgacatgaaatgtttagaaacgga

SEQ ID NO: 107824 - DNA, 653 bp, Oryza sativa
aggagacgcgagccaagctgcaggttagcccccccggcgggctttcgccactgaccggttggtacagggttctaaaaatttatttcatataaatataaatataaatatagtatgatcgtagtgttatattataacgtatatataactataataaaatttaaatgtaacttttaaagtctcacaataacatactattttcatgaagttgactagtggaggtcgtaggatcaaatcccctcatctatatgtgtgttgtgatttattctcttcctcacaaatgtgaggtaagagaacttttaccgcacattgtactggtagtatatgctgccagtatttacaagggtacaataggaatttgccaaaaaaaaatgtaattggttatttaggtttaatccctagatgtttgtgatgtcatgtcgtgagtcactacctcgcgaacgacttggagagacgagccccgacagcggcgtgcgacttggagagacaagccccgacagcggcgcgcaacggcggtgtgactcgtcgccgctcggctgctctagtgcgggcctgtttggttggtgccacattttaccacacttgaggtatgttagtttgtccaaatgtagctaatgtttggtttgtttctataactttagcatgccacactttct

SEQ ID NO: 107825 - DNA, 559 bp, Oryza sativa
agcgcttagacggaaatacccaactttaaaatcctggctccgccactggctacacaaacgaatgttagccatgtctaaaaggattaccatgttaaattcatgttgaaatatttttttaaagataatggaaaataatcatggcctttaacaaacaagcgatggagccatttcaacgaaaaatatgtataaattagagcaacctttgataaacaaactatgaaaatatacatattggtttgctctcaccttccttttgttttggattatactcctctatcccaaaaataaatcaaactccagagatcaatctggacacatgtgtatccagatttttatttttattttttttgtgaggggggagggggggctacggagtgagtacacgaaagacgcgtgggcatgcagaccacactcccacatccatgaataccttccactcccaatgctcacacacccacaaatgtgcctctcactcgcaaaccagaagcacatccctggtcccactataatgttattgaaagtacatccgtgtgtgtggaatgtttattggaaccagaat

SEQ ID NO: 107826 - DNA, 513 bp, Oryza sativa
acttgcaccccctccacgacgaaaataatatgtcacaaattcttctcaacgtaatgataagaatgagatttgtttagatccaaattttctacggtacgaactaactttaatgcaaacacctctagagatctaaactgagactcttttaccaaatcaaagtaaacttcccattccaactgacctatcacatttaatatatacttatgcccttgaccaacatcgtatctcccataaaaacgaatctccacattatcctcggtccatccaagaacttctttcactcgtgaccttagttcatctagagttgggtgggtgggaaacaaaatagtcttcaatgacatatcctcaaactcaacatgtccaccaacataaggttccaccactctaccaccatagtaaacacgaacaagtctatccatctacaccaaaaaatcaaatgtaactttgcaacaaaaattaaatcttcatttttaaacgtagtccaaaccgacatattataaccaatgcataact

SEQ ID NO: 107827 - DNA, 656 bp, Oryza sativa
ttgtctattggtatagctttagattggtgccaccgcaatggtgttagttaattaaaatacactgaatggtgggctgtgggtgcatggttatgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacaccttggccagagtaaaactattcgaatagccgtgcccgcggttatgggcgatcaaccagattcaccgtgattagtctcacccctaggttagcttaatgaactggtgtagttcaagtggttggttgggcctgttgcaacgtggtgtaccgttggacaccgtttggttaatattgaataattactaca

SEQ ID NO: 107828 - DNA, 681 bp, Oryza sativa
cctatagggcgaattcgagctcggtaccctggggtaacgtagcgtgaacctgcgggcattgaccctttatttggctacaacctcttagtattttctttgatacccagtagctgggaatttgtcaaaacaaaatttagaagtagccgggaaccgttctgggggccactgccccccttaaacggaaacggcccccggcctgtggggcatggcccatcgatgacattcatatgtaccgcgaggacatttttagctcctatatttatcgggtgcatggccttgatcatttgttggatgctaccacaactatgaaatttattcagaacgctcgatcttggctcgaggatgcgatttgaggctacacattgtaaattctgcctacagtttcaagtgctcggaaattcagggtctcatggggaaagacattgtcgctgtcaattgaaaagacatttaaacacattttggcagtccacactgtacacaaactatgtatgcaaatgctcacctacacctggagacatgaacatgcttgaatacagcgttgtctggttcaaatgtgcgcccgctaatgcaactatagatcgacttggtctatgcactgacggatgacatacaggcaatttattttttgagaagcgaagggataattttttattctgaccaccgactagcgaccacgtgggt

SEQ ID NO: 107829 - DNA, 866 bp, Oryza sativa
agggggccgtatgaaagagtggtggctaagtgggtcagctgatgtctgatgggtcatgacggagtgggtcgggttggtagaaggcgttgcaaaaggccagttggactgtgtttggatcgaagaattgaggatttaggtgcactaatatgtgtacatgtgtatatactaaaagtatacttgttttttgataaaaaagttgggtattcccgggaatacccaggaatcatggtagctccgcccctgtgtgtagccaaaggtcatttacctatctgcaattttgcaatcaaccacggtagcatagcaatacaaagccacaaggtagttcatttttcttgggctgtggagaccagttaatctattactccctttggttctatattaattaatgttttagacaaggttaaggttaaacttttataactttgaccatcaataactttaaaaatatttagtttaaagaaactagaaaaacatatatagatttgtctttcaaaacactgtaataaaagtaaacatgtatttatttattgtatatattataatagaaaaataagatccaaggtatatcttgtagagcgtgtcattgtccaaagcgtcaattaaaatgaaaccggagggagtatcttaaaaaaaaaaagtctagcctttttctacggtcttgttgtccgctccttctattgttgcaacacgaactctcttaaaaaaaagtaaaaaaaaatctttcaacaccaacaaacaaacgctggtactcccagtacgtgtattgtactactaggtagtactcggtgccaaacagttgccggtatacggaggtgaagagtacaaacagaaatactcgtatcggatcggaatttctaaaaagaaaa

SEQ ID NO: 107830 - DNA, 557 bp, Oryza sativa
gatttacaaatgccagattcaattttcatcctcttatagccagcgtggtgaattctcaggttaccaaaattgccaacctcaacagttcagtccaagataagtaagtttcaggagcatccgcagtcctagctgggtcagttcaagcagaaccagtcggtccagttttggcaaagcaaaggaacagaaaggtcgaatccagccagttcaatcgtgcaggtttgatcaaccagtcaatcaatcagttcgaagcaggatgtggcagttcaatgtgcagatcagtcagaccgccgaccagcaccagctttctttctagccatcccagaatctcgggacgagattcctgtaaggggggtagatttgtaacgccccgattttcgttcgggattaaaaatcattaaataatgcattttctagaaattaaataaaagttaaatcaatttatccaagtgaaataatgggagaattaaaattttcccttaaaaatcattggccgggaatattttgcaatattctttgtgccctaaaatactctccggaattttccgtgaattttcgga

SEQ ID NO: 107831 - DNA, 567 bp, Oryza sativa
tccaaatagcacgaaattcaacattcatatctatctttttcagcagctccggagagtattctcgtgtatgagcatactcccggttgctcagcatgtagtaggcttttctctcccgatcacagacaaggtcgaggtcggtgtcgttcaggagtcgtcgcggagcttcggcgtcttccaacgagacatcagctgatgaatgagtactagactcatcatgatgacttgatgaagagccggaccccttggacagatgagacaatcggctcctcattctgcacaatggagcaagaacagactaacccgacgggggttagaatagcaagagtttcacccaccggttagttccaccaaagcaacttgtatatatgcaactagtgtttgaatttgaggaaaactataaaagcttgaatgaacttgagaacaaactttggagagggaatgaaaatgtattgaaatgggggggaattccctctcaggcaactggtttttatagggtacccacaactgtcagaaaagacatgtgggacccaatagccgttggccagccaaaaatggtaggtaactgtt

SEQ ID NO: 107832 - DNA, 1191 bp, Oryza sativa
cagcaaaattggagaaaaagagcaacggggaggcgagatttggaaggaagaggcggcggcactgtgcacggcacggctggctcgggctctgcctgagttggaagatgaacagtagcgcagggagggaaagtagacttttccggctgagctgagaggagaggaggcggctcaggttgggccggcggaagagagaggaaggaaaggaaggaatgggccgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaacaaaattacaattagaccatttaatgattaatttaatatgtggttaattactgaaatgctctttgtatgattaaaaattaggaattgagctccgaaaaatccgagaaaactccagagagtataattaaccatggagaatttaataaaaattaaatccatccatgctttatatttaggaaattttatttcccacatttaacttcactagtaaattaatgaacgtttaatataaattctattaataatttattaaataatttataaatcctgaaacgaaaatcaggatgtgacaaatctaccccccttacaaagaatctcatcccgagattcggaacggctagaaagaaaaaggcataggtaaactacagtctatcttttattccacaactccaataattattctaaggttttaaagaaagctactgctgctttggaactgatggctgagctgtatcccttgagacgcaaccggcactgcatttgctcctgtgaggacaatgttgttgacttggccttgtggctgttgacgcttcggcttcggacactcttttacgaagtgacctggctcataacaattgaaacacacccgatgctcccttccattactgttatcttcttgagactgatcctgctgaaatgacactgattgagtagcttgctcatcattgtcttcattgcttgcattagtctctgagttgatctcaccactgatgcccaactgttgtgactgttgttgtgactgttcttgacctgcagaaaaagattcaccaatttggagtggcttgatacgctgcctctggctactaccttgtgcctcctgggataca

SEQ ID NO: 107833 - DNA, 768 bp, Oryza sativa
gcgaattcgagctcggtaccccctttaatattctccctcccacactagccgttggtgggcccaacacaaaggtgccggttttttgtatgtgaagacaaaggtgccagtttttggtctagaactggcacctttgttccgatagtgcttttcatgcctcacacaaaggtgccgttgttggatcgagaaccggcacctttcttccaatagtgcttttcatgccccacacaaaggtgccggttaggaagacaaaggtgccggttttgggtctagaaccagcacctttgttccgacagttgtacttatactccatcccttgccactcgagctgattgagcaagaagagagcggtgcctctccttcttgcctgattagctagaggaggggaggagggtttgctccattttttttgtggcgtttgtgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcata

SEQ ID NO: 107834 - DNA, 538 bp, Oryza sativa
cagcaaatctctgccaaccaacagctttccaaatagcacgaaattcaacatccatatctatctttttcagcagctccggagagtattctcgtgtatgagcatactcccggttgctcagcatgtagtaggcttttctctcccgatcacagacaaggtcgaggtcggtgtcgttcaggagtcgtcgcggagcttcggcgtcttccaacgagacatcagctgatgaatgagtactagactcatcatgatgacttgatgaagagccggaccccttggacagatgagacaatcggctcctcattctgcacaatggagcaagaacagactaacccgacgggggttagaatagcaagagtttcacccaccggttagttccaccaaagcaacttgtatatatgcaactagtgtttgaatttgaggaaaactataaaagcttgaatgaacttgagaacaaactttggagagggaatgaaaatgtattgaaatggggtggaattccctctcggccggctggtttttatagggtacccacaactgtcag

SEQ ID NO: 107835 - DNA, 581 bp, Oryza sativa
atgcgcctagattgtattgaacgtgtgttgtgtcatattgtcggacttggctcaatcggctaatcccgtccgactcgaactctgccgatcttggtcgtagccgattcggaccttagccgatccttactctgtttctgggacaatctctatcttgaactccgtctcgattcctccttcacatccgatccttggattaccaaatttggtcgttaacacatgccccccaagtccggaatattggataatgtttcggatttgtcatacgtcgactccgagagaatatcgtgcttgccattttccgactgttattcagcgctttaaatactaaccgttgtccccgagaaatctcacaccgtttcctccattttcactgccgaagcaaactccgtcctctctctctccggcgaccccctcgatgcacaaagcgatttccaggcgatctcttctccgtccaaatttccgcctgcagcgatgtcgacctccgccagcccgtctgccgcgccatcagtcgaatatgctgatgtatgtgcccatctcatcttgttttcttctccactgtcccttttggattattagcatct

SEQ ID NO: 107836 - DNA, 1127 bp, Oryza sativa
cttcaaagcaacattactcaggttattgcactcggtgtggcacatccaatatgtgcagggcaaacaatacatggtgttccattgcctgtaggccactcaagggttgaagtggaagacgtgccaagccaatacagaggttatgtgctacagttttcttcggaggaaggggttgacactctgggcgctgctcttcacaacctgatcatatggcccaaacgctacatcgttatcacgttgaacgatggggcaggggatccaggcgacggtgcttccagcccttcaaacggacgaggtgcaaatctagctccttctccgcctcgacagaggaccttcagtccacctcgtgaaaacacacctaatgaaccacatcgtccggagaagtccacaagtccacccccactcagaaaaaagacccgaacaccaagtgcatcacagatgtctgttccatcaagcaaatagtgactcacacattccaattcatacttagtgtcaaagccaacaacatcgctgcctaagaagacaatcaatgccagcatcacttcactttttggtcctaagaagctcgaggaaccaaagattccaattcctccgaatgtcatcgagcatttcatcaagtgcgcaccaccgaagtcacctaagaagcctatatcggacttctggagaattcttggcaaaaaagatatgcaagctcagtagggagttgtaccttgaagagaaagcgtccaaggaagttgatttctgcaagtcagctggtttgaaaagcctagacaatctagatgaacttgaagaggccccgattgtactgcgattccaacttggtcaaccgatggtgcttgacacggaaattgaatccttaggaactcaagcgcattggctgcatgaatggtatttggaggaggccaaaaaagggggtcgggatgttcggtgcctactacactgatgtggattttcaccaccccagtaatacatgctttgtagaatttaaggaactcttccagttgtaccaaagaagggaattcgatatctgcctcctgcaattgtggtcattttgagtcctttgatatcttgtcgttcttaatccatagcattctacgtactcagtaattctcaactgtgttctccttttg

SEQ ID NO: 107837 - DNA, 880 bp, Oryza sativa
gtctcctatgaattctatcacccaaagaattcggccaggcaatttggaatttgccaactccccatcggcttgttctttgctgacaaaattcaatgccgcggagaaatttcatcaaccctgatgatggatcggctactcaacatccaaggtcctcccttgggcagcattgagaatatagaactagcaagattcaggagcagaaattttgatagatggtggggagaatggaagcagcatctattccatcagtcggcctctatgtatatgacagatctattccctgatgttgtccctcaggtacatccttactttgcttatttcatttgcataacttgttaaccaacttgaatcttaaaccaacttttccctttatcctacagacaacagaatcttcccatccacaccaaagcaacagtggcagagatatatagtataccccaggcttattgcccaatggtggtggactaacccctccagttatcggctatcatgcccctaagaccgtaagtctgctccaagggcagatgagagaaccagccgatgcaggcaggaaaaggaaaaccaaagtgccagcaattgatccatcggttctggctctcaagaagaaggccaaaaaacagaaacccaagccaaccgatgatctgcctgcccttgatccatccattgaacaagctttggatgaagaggaaatcggagaagatgttgatcaagccgcagccgaagtaagtgatacagataaaacaccatcggcttcacccaatcaaaccccttcaactccttctgccccagctcatttctcgagggtaagtaccattccctgattcccttttataaccattttatcttcagccgattacttattaatcttgtctttgcagaa

SEQ ID NO: 107838 - DNA, 682 bp, Oryza sativa
tttcccaattaaaataatcactttaaatgatctttaattattaaaaacctccaaatgctcaataatttcaaagaaaaatcctgaaaatacttggacactcaaagtacttaacaaaattacaattagaccatttaatgattattttaatatgtggttaattactgaaatgctctttgtatgattaaaatttaggaattgagctccgaaaaatccgagaaaactccagagagtataattaaccatggagaatttaataaaaattaaatccatccatgctttatatttaggaaattttatttcccacatttaacttcactagtaaattaatgaacgtttaatataaattctattaataatttattaaataatttataaatcctgaaacgaaaatcaggatgtgacaaatctaccccccttacaaagaatctcgtcccgagattcggaacggctagaaagaaaaaggcataggtaaactacagtctatcttttattccacaactccaataattattctaaggttttaaagaaagctactgctgctttggaactgatggctgagctgtatcccttgagacgcaaccggcactgcatttgctcctgtgaggacaatgttgttgacttggccttgtggctgttgacgcttcggcttcggacactcttttacgaagtgacctggctcata

SEQ ID NO: 107839 - DNA, 1111 bp, Oryza sativa
gtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacacaaacgccacaaaaaaaatggagcaaaccctcctcccctcctctagctaatcaggcaagaaggagaggcaccgctctcttcttgctcaatcagctcgagtggcaagggatggagtataagtacaactgtcggaacaaaggtgctggttctagacccaaaaccggcacctttgtcttcctaaccggcacctttgtgtggggcatgaaaagcactattggaagaaaggtgccggttctcgatccaacaacggcacctttgtgtgaggcatgaaaagcactatcggaacaaaggtgccagttctagaccaaaaactggcacctttgtcttcacatacaaaaaaccggcacctttgtgttgggcccaccaacggctagtgtgggagggagaatattaaaggtgccggatttgggctgagatccggcacctttgacttgtcataccaagaaccggcacctttgtgtaggacccaccgtcgggatgaaaagcattagtgaaacaatggtgccggttttgggttgagaattggcacattgtctaaaaaccggcataggttaggtgggagggagaagattaaaggtgccggtttagggtctagaaccggcacctttctctgacacaggttttaggtgccggttttaaaatgaaaccggcacctatttggatataaaggtgccggtttttgaatatgtggagcatgggggtgggcgtatgggtgggcaagacattataggtgccggttttaagtgtgccggcacctatagtggcgacacctatt

SEQ ID NO: 107840 - DNA, 2414 bp, Oryza sativa
aagcaaagtaaggatgtacctgagggacaacatcagggaatagatctgtcatatacatagaggccgactgatggaatagatgctgcttccattctccccaccatctatcaaaatttctgctcctgaatcttgctagttctatattctcaatgctgcccaagggaggaccttggatgttgagtagccgatccatcatcagggttgatgaaatttctccgcggcattgaattttgtcagcaaagaacaagccgatggggagttggcaaattccaaattgcctggccgaattctttgggtgatagaattcataggagacttgaatgtttctcccttgatgaataccgacaggaagaatgcatgggctgattgcagctgagaagacttctctagacttttggaatctctcatgattgatgtctttgaatctaaagtccaatgggagatccaaatgcactgagtcttcataaggaaaccaaactcgagcatctttctgaaaaccttcatagaagctgcagaaccaatccttgagcaattcggctcttaattttgctcctgcatcggctggtgtggatgcatattctccatatgacatgcatctgcgatgggtgcggtcttctttatcatcttctacaatcggctccagtcttgggaattcggcttctgtcacaaatggccgattgacgactgtcatgaccatcaggttgagccaagactgtagcagccaccatggtccacctgctccaaccactgagccgacgactatcttggccgatgcattgttcagcatttggtataagtagccgaggaggatcttgcctagaggaaattctctttttgattccagagcctcggctgcaaactggcagttggttgtacgaccacaactagatccacagaaaaggaacttttctagccacatgagcaaaaaggccacatgttctcgaggagtaacagatccttggcccatatatgccgccacataaccagaccaaccacctatgctcttggtcctaaagtcgtattgattattggtgttcagactcatagggttagccgatgaggtcacatctagaccaatgatcatggtgatatcaatcagagttggggtcatcggaccttggttgaacagaaaagcgttgatggtattggaccagaagtacgtggcggcagccattaagggttcatccttagccgaatttgctatggtgagggcgagtgcttggccgattccaatctcgtcctagtgagtttgcttgttagccgatacacgcttgtaccatgtggtccagcttttctcaggggaagttttttctagagatggccaagacttgaaggtgttcttccaatgacctagattagggttggccaatctgaaagggattctattggtttcgccaatgatgaaattagtgggtcgacatcgccgatcggaccaaggaaataatgtctctcgtgcgatagacttgggattgtgaccagattggaaagatgctaataatccaaaagggacagaggagaagaaaacaagatgagatgggcacatacatcagcatattcgactgatggcgcggcagacgggctggcggaggtcgacatcgctgcaggcggaaatttggacggagaagagatcgcctggaaatcgctttgtgcatcgagggggtcgccggagagagagaggacggagtttgcttcggcagtgaaaatggaggaaacggtgtgagatttctcggggacaacggttagtatttaaagcgctgaataacagtcggaaaatggcaagcacgatattctctcggagtcgacgtatgacaaatccgaaacattatccaatattccggacttggggggcatgtgttaacgaccaaatttggtaatccaaggatcggatgtgaaggaggaatcgagacggagttcaagatagagattgtcccagaaacagagtaaggatcggctaaggtccgaatcggctacgaccaagatcggcagagttcgagtcggacgggattagccgattgagccaagtccgacaatatgacacaacacacgttcaatacaatctcggcgcatcaccaccctttttattttcgttttgtttcgacgagttcttgctttcgggttgagctgcaacggttacgatcttcaagaagaggtaaaacttgttatggcggcttgcgttctcgagattagtgcttccatcttcatgacactctaatcttgtttatgtaattcgtcgagttatcatatatcttacataatctctggcaatatcgctatctaacctacaatcggctaacatctgtcagtagaaggcagccgattaggttaaatatcgatattgacttagattatataagatatccatcactctatgacacatccaacggcttgattgtctagatgttgtccttcttttc

SEQ ID NO: 107841 - DNA, 1576 bp, Oryza sativa
  unsure (1)..(1576): unsure at all n locations
acaactttagtgagtttatgattaaaatttagacaattctgatcaactaggcaaaattttaaatttgaaacaataggaaaataagtgtactctccatctccatcccaaaatatagtaacagattagacactgcctattactacattacaatagcgtgtcgattcagtaaataggcaactgcatcaaaaatcaccctgggaaaccatgctaggccatgcacagtgagaaacgactgtcctaaaatattaatatttagcataatcgacagatgtagtattgtatccaggtattagtatttagcataatcgacagtggaagtattgtatctagataatatccaggtgcacccccataatcgacagaggtagtacttagcatattcatgtctcagacccataatcgacagaggtagtacgtagcatattcatgtctcagatcacacacatgagcaaattttgctaaggggaggagggaagaagaagaggatggatggggggagaggggtgntcctctgcgtcgggccgtcgttgacgccttcaccttcgacttgccggtgaccctcttcacctcgccgtcgcaccgtgccgctgcaatcgaaatcagaatcaaaattcttgtcttcctcccctccctttccttgcatcccctccgacaacagcagcaagaatcctcctctctaagcaagaagggcgtgaagcgnaagttctagagtctttgtaagnagnagnagaatgggcttaacgcatccgccgctcacttcctcctggccaccgcacgctgtagagccgtcctcaccgctgcgtcaagcagccgcaccgccgcgcgcagtcgagccctcctcgccgctcgcctcctcctcgccaccgcaccgcagcagacgacgacctgtagggcgccgcgccgatataagggataaggaagaagggatgagagatagagtgaggcatatttaagtaaaggagatggtaccggttctaacacaaataggtgccggttctatcattaaattcggcacatttgactattggaacaattttttttcttaaaaaaattacgggcaaaaacatcattcaattttttttataataagtagagataagcgtgttatataaatgtaactttatacagtattaattataaattacaatttctttcttaaatttaagtttcactataaaataggcctattacttaatatgttcaaaaaagagtataaagggcaaaaaaaaagaaattaaatattagaccgcacaaaatatgttccaagtttttgctgatttaaatcaaatggttgccatacaaatccgtagaatgaagttagaaattaattcaaaccctaactactatcccttccgcatgatcggaccgtacatacaacgcttggtcattctcttcagcagttgcctcgttttccgtctcgatatcaattgtgggtagcggtggctcatcgggctgatcgtagtcatcttcgtcaatgatattctccattccgacaatacttcgcttgccttttaatacaacatgacatggcctcatgagtgatgggtccttaatatagaatatttacttaacggac

SEQ ID NO: 107842 - DNA, 1314 bp, Oryza sativa
  unsure (1)..(1314): unsure at all n locations
agagaatatgagagctcttgcttgacatgtgtgactgaagtgagaagagcaactccttttatagcctcccaatgacggttgtgacggttggaatggtcgnaaataccctccaaccgtcattgggggctaatccacaccgtccaggcaaagccctggatcggatggcgctgaggaggattcggccgaacctggggccggcccaatccagcccatttttggctggcggcctcctccgttgttcttctctgcagacttgtgaattttggcccggtttgtcgtgtcaattctgagttcttggcccactcatacataagtctaattctcgacatcgcctaattgatttattgtctgtgttgatgtcgattctcctccactttattgttattctctgcaaaaggttagtgaacctaatactagtggaatattattattctaacatgtatatgcattgcaagcattattagttctcctctattttggcaatattgatggtcgaaactgatcgataacgactgtcaacaaaaccccccaagcttgaacctttgcagctcatttacctcaggttcccagataattgtttgctatttatatttaacctttgagagagcacttacctatgaacctatatataagagatataaaacagagcaactcttcatcatttcaacaaagagaactagcttgtcttacctagcataactcaaacctatcctatctttttttttggtattttctattttgcaaatttttatgttgtcttcaagtttataagatgcaattggaaagcaaatatgtaattggaaagggaaatatgcaattggaaagggaaatatgcaatgtgatacaagttacctcagtggggggagagatatctccccccaagcttggctttccctcagggtccttgataaggattgaacccctgaaagcggaagtacgcttgaacatcatcgtgctgttgctgcatcatgttgttgatgttggcaaactgagcatcagcagattgttgccattcttacgtttgagctatgtgttccgtgaggttgtactggatctcccccgtctgcacatcaagggtatccattctcctagtgatttcacccaagtcccatcgagaagaactcgagcgccattcacttggagatggaggcataccacttgatctaagacgttggttgtccccccattggatatcatgaggcacacgccaccggtcctcactggcacttgcccagcttgagactctaatgctgggcgtggaacttgggtccatccgggtgcatccccagttggttcccaacctgcctcatacat

SEQ ID NO: 107843 - DNA, 915 bp, Oryza sativa
aagtaattactacagtctatgtactcaagagaaattccttgttgtctgcatagcatgggtctcaactctcactaaaagtttgtaggagttcactcaatttttgtatgccactttattctttttgtcgcttaatattaataaacagatcacaatgccatattatataagatgacacaaacaacagactacaaccagatggaatagtcaagtgaagcacaagctgattacttcagtatccaagtaggttgcatccatagtgctatcatcatacagcttagcaaaacaatttcttgattaaggttatcaaaacacagagttataattaacttactcagattacaaactacactgatataggttaagtaaaattttcaaatcattgacatatttgtgttgattgacattcttcagtaaaacgcccactggcgtcccacaacctgtctgtttcaccaagaaaccaaacccaccaacttgcctaaaattaaaatcaccttccctcctttccccaagtagcaaatccaatttcacatttcctgtttaagaatctactcgattgtgacagatcactggtcagagcaaggccctacagctcaaacaccaaactcatctgaaatttcagcagaaggaatgcgcaattaattctttctcctcgttcatccccaagtcaaccccgaccccaagatgaccaaatctttctaatcttgcgatggctacacaaccccaagtaatcttaagcaaacaagctacttctattcaatcatggcgtgcgtcgccaagaactcaaccaacgttcaaaacgaagaaaaaaaaagagaactaaacagaacaagaactagtacactttgaatggaccaggaaagatttggaaagaaactgaagattacctgcagactagagagctcagattagatgtat

SEQ ID NO: 107844 - DNA, 547 bp, Oryza sativa
catgtatgctaagtgtaactgtcgtatattagaaccctacacaatcttacatgctaagtataattacaaatataataatcttatactaaaactcaaatagtgatgatatatgctaagactaagtgacgtatattatagaacctagctagtcaataattatatactaagtctaattacaaatataataatcttatattaaaactcaaataatcttatatgcttagacaaaaatagccatctatgctaagtgtaactgtcgtatattagaaccctacacaatcttacatgctaagtctaattacaaatctaataatcttatactaaaactcaaatagtgatgatatatgctaagactaggtgacgtatattataggaccctagctagtcaataattatatactaagtctaattacaaatataataatcttatattaaaactcaaataatcttatatgctaagataaaaatagccatgtatgctaagtgtaactgtcgtatattagaaccctacacaatcttacatgctaagtctaattacaaatctaat

SEQ ID NO: 107845 - DNA, 872 bp, Oryza sativa
ttttaccctattacactggttgcttctaaaaaaaagtgtggaacatcagtttgtgttaaaactgttccaaaaacacttcatgaataggaagatgatcttgtgtgcataccttccttaaggcgtcaatgtttagttccatacataaaaaaattaaaaaaaatacacaaaacatccagatgaatggccttactaaagcatattttaaagacacgaaactgacaaactttggagtaatcgataatttcatatatatggacagctgtcagctagagaaatttttgtgtcttcttgaaattgatatgtttagaacttggtgcagaacgaattaataattaccatgtgttgtcttcaatgtcttttgtacagccattttctcgtgcccctatttctttacacatcctggctagctacctagcgtgtggtaaaattgtttggaatggaaataaccgaataacatttaaataaacttcgttcgtatcaaaacacgactacacataatttgatttgcttcagcgcacaactgttctttgaataccctcaccagggttcttcttcttccccattcagatagtcgatcacaactacgctggacagtgaaataattactacatttctaaagtttagggacgaattgtgatgggaatgggaggatccaggaaagacaacaacactggttcatcatccaatcctggtgaaccaaactgctaccatgagtcactggttatttaggtgatccatcaagcttcttggtgtcaccctatgaatttcttgttctgacccactggaaataagagccccaagagcagcagtagtacctaatggggagagaagaattgtgattcaaagatgcaatgctgactttgagtgtatac

SEQ ID NO: 107846 - DNA, 684 bp, Oryza sativa
agcccggtagttccaagagtctcagtagcatcttagattctgggttcgattatccatgagagtgaattttccaggattaatcggcgttgtgctttcagtgatttttctaggacttatcggcattgtgctttcagtggtagggggtgagtgcacgtgcgttgtgagtgtcagtgttgttataaatttataaaaaataacttgagaaaaaacaaaaaccgaaatagaaacacctaaatgcgttgtgagtgtctgcgttgttactatgtaatttaaaaaaaaagaaaaaaattgagaaaaaaaagccgaaatagaaacaccgaaaaaaatccgaaataaaaacagcgatgtaatttaaaaaaaagaaaaaacaaacacagaaaaaaatcggttcggtttttcccgaataaatccatcgccgttggctggtcgatctcatgggttgcagcgtggggcccatgcgggacatcagcggcgcatgcatgcgaagattccaggaacactgtgtggggtccacatttaagctagggaaaattggaatcatgccattataatttttcaaatttgagatatatcatcctaacccacatatcattgaatcatgtgggtcctacatgtcattaagataccaatggcatatcttaaactttacaaaattataatggcatggttccaaattacccagga

SEQ ID NO: 107847 - DNA, 4361 bp, Oryza sativa
ggccattttcaggtgatttattcagcttgtgggtaggggtggaaacgagccgagccgagccaggctcggctcggctcgtggaagctcgcgaaatgccaggctcggcttggctcggctcggctctccaaccgagctgtacattaggctcggctcggctcgtggtctggctcgagccggctcgagctggctcgtaagcttgcaatagcagcagttgtattgccagcagcagttgtgttgcttgcaaatgacttggttattcagataataactctcaagtccctacaaagataattaagtatattgtatgcagccaacatataacaaattgatggctttttttggtttccggccgaaagtctttctattcaaaccgagcctactaagctcgtgatctgctcgcgagctggctcgggctcggctcggttcacaaacgagctaaaacccaggctcgggctcggctcgttcaggattcgagccgaaccgagccaggcgagcccgagccgagcttgagccgagttcacgagcccgagctatttgtccagccctacttgtgggtactccaatgagtgtactcgcgtctgattggtcggatgtgtgtttcttcacatgacaggtggtttttatacaaaattcctgcatacacatattgcaccaatacttgtggaaaatgattagtaataaccactaccactaagtttgatgtattatttcaattgttgttttccaggaattgacgatcatttaaggatggtcaacatgtagatgaaagttacatctatccaggagtcaattgacatgtccactttgacattagttgcgctttacgctaaacttaaaactcatgagatgaatattctttcttgcaaagttgattctaaatatagttctttggattattcttcatcttattttgatgatgcctcttcttcatcggctcttgttgcttgtactgcctttaatgccaagtccgattatcaactcgagctactcgaggttgaggattttgctttgcttattaacaagttgtctcgagctacatattgtttgagattaactattgaaattgcaaaaccaaaatatttgaatcttctcttattcttggagttgccttgcacccacacgcactgtagatgagttaggtcatgttgagtacatggaaaacattgtgaaatctgatgaagtgctttttttccctagatgttgcaaacaagaagatattaagatagattatgaacattgcgctaaattgacttggatgcttttttactaaaaaagttctttggaaaagttttggatggcaagaagaaacttaacatgaatttagatcaatctaaagtgactacttataataggggtataggctgtaaaatcaaggagtttattcaagattttgtgtgattaaacattggtggtttgctatatttcatctgtgataaattggtttcttgtgatgagatttcggagattgataaacggttggtttttgtgaattggatgtgtggttgacctgggcggtcagatcggccgagtgttggcggtcagaccataggtcttgcagtggttagaccggccggcccgacggtctgaccggcaaggttctgcttgatgtcagtttcgggttgttcgttatgaataatttcttcatggattagacttctagatggcttctatacatatggataccgttatgctaatatgatttctttgttgttgcgtgtgcaagtgttgcttaaggcctcgggagagtgttgccggtgatagatcagagtcgacttgggagaagtggatgtctagggatcaagagatcatgcggtatagtaaatgctagagaacaatgcacgtggtgatgaaggatccatatgacatacaagaggaattgtgtgcatatggaaagtggagtcaaatttggaagagtctgaattcaagaaaattgatagagataaggaaagagatgagttggatatttgcaaaagacggtttcccatgtggttgggagtcctaattgttgttagatttgtgggcattgcgtagccacatcgagggtataagtagtagatgtgttgaagcctctagataacgattttttagagagtcgagttgagagaaaagttagggttttgagtctagtcgagtttttggtgagtagtgttgttgatgcactttgtaaaaactagttgatgcaataaagtcgagatattccagtctacatctatgagttttcatctactggtgttttcttgatccctacagttacaccgacagcaaggtacggtctaatcgacgggagggcggcggtctaaccacaggtagcgtggtggtcacaccggcggtaggagggcagttcgaccggcggcttcaggacttcgtcgcctacttcgtttgaggtaaatcttttattccgtaaaatattttggggtttttggtttcccctaccattcacccccttctggtaggtttgtttggccttgttgcatgctacaaaggttttgatactcactatttttttactaaacatcaaactatctttttgagcataactaatcaagataaaattttgacaaaacctaaacctaacttttgcaccgttggccacatcaggcaccaaaaccaaaacctaaacctaacttttccaccaatcgagatgtcctagagaatgttaggcaccctggtccaattggaattgggagaagttgttttctatagaagtgactacggatcgggggtccgattttttagctaaaaatcaggtgcctagctcagatttcgctagcgcatgcaggtgcaccatgcacagtccatagcatgcatcaaaagccatgcatctgtaccagaaaacaatagttaggttggttggtttaagtttctttgaatacactttaaactattttttctcttaaattatttctccaattcatgattcagttgcaccactaaattctttacaattaaacctttaaaacaaaaccacacatggttataatccaatgaaataaatatttagttttattattgaactttttaaaatgttgcacctatttcatttaaatgtttcagctagaattcactatttaatttacaaatattttagcaagtattttataatgttccaataactataattatagtttagtgctcatatgtgatataaaaatatttcaacaataccagcttctgtaaatatactgtatctctgatatgatttttttttcactcattgggactcagtgttaaatataaatggttgttagtgttgcatcccgtatttgtaaatgctgcatttctctgaagcattttatatagtgaactgaaacaaacttctataagggatgaaacaacgttcaattttttatcaaaatataattatgtgatatcttgatgtagagatttaattataagaaatacaatggtgtaatcgtattgtagacccgataattattttagaagaaaaacatttaaagagggagaaaacgtacaaatgagtggaaattcataaatggacatgcaatgacatgtgcaggatacactgtgaatgagaaaagaaaagaagtattggaagaggagctagctgcagagaagtactccttccattccaaatttatcaatgttattttataggtacaccaagacgaagaaaatctaataactttctcgtactatatttactctaccaacaaactcgatgaatgcaccatccccactatttcctagccaatagcaaatcaagatattgtatgtgggttataaatacttgtgtgcatggatgcatgcatcaatgtccatttactctaatgcacaaataacaaatagacttaataaatgaacacaaatatgtagctcatttaggaataagctcaaaaaaaaaactatatgtagatcaatttagaatggagggagtgtatacttcatgcatgctgaaatgatgaaggtcgtccgcagtgtaggtggagcccacatgtcagtgagcggtactacacatgcaatactgctggggatctcaattgacactgaagatgtgaggaagcgccgattgtttgttcgtggattgggcgcccgactttaagtattatctgttttctatataatatttatatttgtgcaatcattgttggcgaacgttggtgcatggagaactagttgtgggatctgtctctctgagtgtaattttatagacagttatgggacgggccagcctacatatgtacaacatactgtttataatttttatgcttgcttcgtgtgatcaggtttcattagcttgaggtgttatggttaagagtcttgattttatctgatattctccacttatggtgttgagattcgtcaccgtgtactacctccgttttttaatagatgacgacgtt

SEQ ID NO: 107848 - DNA, 989 bp, Oryza sativa
atagaaaaccacccacacatgaacattcataataaatttcacgcacatgcccgcgcatatgcgcgggctaccttactagttgtataaattagctattaaattgactatggataatttgaagctatagctatactattaaactttctcttagtaacaataacatcaaagcataaaacaaataaattatgtaggctatcctcgttagtatctccggctcttacgttaacctccaacccttggatatgttggacctccacaggcggtggtatcagctttgagctacaacagccaaccaaaccggcttgcatgtcctatctaatcatttattaattgtctacatatagttcttgtgtgtcaataatatatctgtactgtaaccatttattgcagatcagtttagttactcgatcttttaatttttagatgcaacagtaacagacattgtatatatacacctgtagtgacctagcacaggcgacaaagaactaatgggagatttgctccgttctaacaaaaagtatctcgatgtaccggtaacttacggtatcagatccaacgatcggaaacgatttggtaccgtgatataccagtacctcaagatactttttattgaaccggagcaaatctcattcttgtgtctccaatgcttactacacataagttttatatttgaaggccgctctcatggatcctataagaggttaggatacatggtaataatgttggtagagaatgaaaatacgagtaaaacgttgaaacagatataaaggcagagcatatcttcctcaaaaccattttttgcttccaaagtttatatagaaatatgcattgggaatggggaggaattaggaactggtttagaacatgaaacccaatttctcctacgacgactcttgtcttcctggagttttcaactgaatagccactagatgaaacgaaaagcttggccatcgtggcctgaacaccgagtgaagacagcactagattta

SEQ ID NO: 107849 - DNA, 1422 bp, Oryza sativa
ttttatttaaatcggtggatctagatcgttagatatatcttaaaaacaaaaacctcccatgtccgcatatcgtgcaccacgcacgtactgatcaatttgtacgccccttctgttcctttctctttttacatacctatcacaattaaaattaaaattatctttatggaaaaaaatcacaaataggcattaaagtcctttcaacatcttataaatatttctaaactattgtgtgacactcttaaattagagaaacattcatccatttggttttcacttaaatcatttgacacattattttacatcgttatttgatctttttttaaaaaaaatcatcccaaaccatattcccttcctctcatccctatgggcattaaagtacatgaacgttttgctaatcggctacttgtctcacttaaattaaaaaaaaatccaatcatcggtttttttacttaaacattaacacattattttaggtcatcagaaagaaaacatccaaactctctctatttttccttaattttctttgtttttcctatctctatgataattaaaattaaaattatttttatgggcaaagaaaagaccacaaacaaatctccacctattaggtctagccaattattttttttaagttaaatcaataacttaatacccatattgactatatttaattgctaacaaaaaattacattatggacccacatgcatattgaggcctccacttaataaaggcaaaaatttctacaggacattaaaaaaacgtgtgattagctgggagacactacaagaatgtatatctgctacaagacactgcaaaaaatggtaataagctgcctgtatacccgcgatattattttgttatccaaagtaaaaggagatagaaacaattgcgaaagtatgattttgcccctttctgccatgtgcggctcgcatatagctctgacgctgtcgacgccacgacatgggcagcagagggtatggcagcacagcactccactgcgagaccgactgcaatagcatgtgctctgcggcgccctgctcaacatgaaccaggaggtggcccatgttgtgctcccctcaagtgcggtgtgtggcggagcatcggcgccggcatggcccacgcgctgcagaggcgacgagtgctggaacaatgcggaaccatgggcctaggcgcacgggccctcctcgataccccgcccccagagagccacctcaccggctgcgggtgcggtggcggcgttggaggtgaatgtgatgcagacttggtagggaggggaaaaaatcatacttttgtgattgttttttgtccaattccttttgaatattaaataaccccacaaatattgaacagctaattaccaattttttcgatgtccactcataaataaaaaatacatggtttaaagtaattttagttcacag

SEQ ID NO: 107850 - DNA, 1077 bp, Oryza sativa
agtagctctaagagttttaagacaacaataaataaaccagtgttgttactcgaacaagagcgctgtcagaccttgttcggttaatccctatgagggagggatcggaggggatttattccacacctattatggtgtggaattattcccccttaattcccttcaatcctcttcaatcccctctaaaccaaaccaggcttcaatgggataagttccaaagatagactagacatatagattaagcaaataatattggcacattattaaagatcacgtattcacatatcagtgccgttcttttttgccctaatagatcatgtaaaatgtatgcttagctccatctaaatgttctaacaaacgtaaactactgccatctaatccctccgttaaaaaacatgagggattctgatcacaaatatgttagcgagtaacatgactgaacatgaaaaatgttctcgatgttcctcttcaattatttgctgtgttttctcttgttgataggaaaaaaatgattcctaaaaagacgatgtggctgctttttcaggacaaatatagctccttgcaactctcaaactctactaatcacttctttcatgatgttgcttatcaattatcaccaaatgttctccacactatttctcttctcttgcatccaactattatctattcacacattcgaattgttatctataaacaattaatgaatcctcaaatgtgcattattaaccaaaaagtagagaaaacccaatggcacagtatctcaatggtgttattgttgtctattgtcacccagaccaagcacgcatcataatattgtgctctcgctctccttgggggaaatcccagcattgttctagcatctttacagtccaagattccaagtggatgacctctgacttaaggctgtgttcttcaccccatttttccaacccacctctctcgttttccgcacgcacgcttttcaaactactaaacggtatgatttatgcaaaaacgttctatatgaaagttgtttaaaaaaatcatattaatctattttcaaaaaatattagttaatacttaattaatcatgcaataaaa

SEQ ID NO: 107851 - DNA, 1216 bp, Oryza sativa
ttttgtaatttgtaagtgaaaaatatatcattttgaggaagatatgctctagtgggcatctcatctgtttaacaatggtttatcccttctttttctcagcatcattttttctactttaagtgtaaatatatcattatctaaaaaaagtgtaaatatatagttttgaggaagatatgctctggttgacatcaaagacttgaatacgcatagcaaaatgcttacagaatatagtgacatggttagattgatgagctagtcatgacttgcctccttagtggtgggaagaaaatacatagcctcccattggcagcgagagtgtgtgtgcaacagctaggagaagaacgagcaataagaaaaacacaagagaggaagaggagttcgtctagtacagtggttcttgccagattttcatcaagttagtgactggagactcaaacgtgatcagcttggcaccaaacttggtgagttcattcttaactcagagcacttcagtctgctaagtttgtgcgataattaattgagaagagcaccatatttcgggtctctgcagtttcagcatgtggagtatttggtagagtgttagtttgatgaatcaaacgatgtcccattgggcagattttgtcagcttggaagaaactcatatattattagttatgccaagtttcatgcaatttgcatatgtggtttgcgagatagtagctaataactgaaggggggcagaacctgcatttttttttgtttgttgttttgttgttatggttgatgttgatgatgccaagtatataacttgatgatttacctgctgctaagatctatttgtagatgttctaaagaagacttcagttatacgccttgttgattataatggaagcttgtactggaccggttagtcccataattttttactcctcacaacgaggaagttttcagacataaattagtgtgcatgtaatcatcgttgtttcactattgttttgctagttgaaactatccttaatgtttatcgaaagatgaggcgctgattgtatggattttgtttgttggatggtgaatcaacattttgcacgatgtgattgttggttcaatcccaacattgtgttacctatatccttatatgacaatgatcccgtgagaaattaagggagttaaaatatgtaaatttgcgttaactatgcccatcacctccaattgtgctagctaacatataagatacaca

SEQ ID NO: 107852 - DNA, 1592 bp, Oryza sativa
tacatgatggatcacatggggacctctattataatgtagcatttagggctgtaagaagagtggctactcgagctcggtttggctggcaatcaagccgagctcaatacctgcttcagagctcatgagattagacaagccaagttagagacttagagcactaattctcttactgagttttttcattgaggcatcatgttgtgatcattgtgagcattattcatcggttcaattttaattttcattttgtgtttttttttgacatgcttaatccctgatgttatcgttcgagttcgcttcgagcttgagcatatgtagaccagcttgctcgagctcaacttgttgacaaccccgatggtattacacagtacatgggcctatcatgcccataatcaaaagcctctttttggatgaacaagaaatgaaggacagaattaagtttcttacacacttgcacagttgcactgaaacatttctcttaaacaagagcaggatttcaactaaatcagaataaaaagaacacttagaagaactaaacttgtggagattgaagaacggagggaacttgcatctacaatactggaactagcctatatatatctctgaatattatgacaacaaaaatcatgcttatctgtgcggcacatcataggagacaaattatgcataaacatatttattcttaagtagacaaatctaagccttatattggtttctagcacattgtggccactaaataaaacaaagtaataaggtgtggtgcatccaagaattcagtcacaagattgaacatcatactaggtgcagctgatgacttggatggagctcaagttcttcctagagccacccattctcattatattgccaacttaaattttaaaaaagcgaattgataatatataatattgaagggctagagaacattgagattgcgtggaaaaaaaagtgcacgacaagttttatatacacatcttccatgaacaatcctaaatcgtatatattcttgtgaagtaaaagctttgtaccacaacaacatattttaaggaaaatgatgaacctcctgtgatccactagtatagggttctataagggcatggataataatgcgctataaaccaactataaatttgtgtataaaagagacagaaaagtgaggagcactgactatcattcaatagctagctctacatatgctccaagatatttacattaaattcatagagaaagaaagagaagagaaaaaatatagacaaccatatagttaacctattatatatattaactctaatacgtgctaatatccatagttagctatactattatacttgctctaaggtcatgtaaaggaatttagagaatcataatattagagcattgatattttctttcattgcggaaggcagcattgacagagcttgacctaaaatgtagcaggggccaactacaactctttcaaaacaagaaagaaagaaaataaatatactgtatcaattatgttagatgattgattgagcatgaaagtagtgttagagagcacaaaatcctggttttcttataaaaatgaccatagcggacacatatttccaagtacacaa

SEQ ID NO: 107853 - DNA, 1298 bp, Oryza sativa
ccggcgcttggagagagaaagcgagctcggggaggggcggctagggcacttcgaaggacgggacttgaggggataggtagaggacgactagggggtcctttatataggcacgggagcttgggatcaagcccacatcgacgggaaaaactcgggaaagtctagggttctcgccggaaaaaggaaaaattgaaccgtgaaattggaaaggatttccataaaaacttttggggatttcttggggaaaaggaagaggagattgataggattccattcccgtaactaatttggaaaaaggagcaacgaggaggccggattggtgggaggaggcggcggcagtagggcacggcacggctcggctctggctctgtctagaggttgaagaaggtactgtagtgatagggaggaaaactagactttggctgggctgagaggaagggagagagaaggggaggcaatgggctggattcggcccaagctgatgaggaggacttttatttacttttccaaataaattaaccaatgagatgatctttcaattgttaaaaatacttccaatgctcaaataattccaagaaaaatcttgaacatacttggacactcaaagtatttaatataataatatacagatcatttaatgattaatttattatttaaataattactgaaatgttctttgtattattaaaattaataattgagctctgaaaaattcaagaacattctagagagtataattaatcacggagaatttaataaaaattaaatccagccatgctttatatttaggaaattttatttcccacatttaacttcacttgaaaattaatgaacatttaatataaattctattaataatttattaaataatttataaatcctgaaacgaaaattcaagctgtgacagtaccactagcctgtaaaaccggtggtttgttttggtcatgaccagcaaaaacgaaaatccattaaagagcgtttccacatggtagaagctcctcaggaacataagattatcatgaggttgatcttaaactgtcatccacgcacaaacagtttttgtgtatgttctgccctatttgagtaacaacgctcctggtctattaattgttgtatgagaactattctattttttccaattttatattaactaggggtagcccgcacagatgcacgagcaccttatttattggtgtttgaaattttgtgacgattgtttatgtatagggtttttatttaaatttttttttactcttctaaatctatgtttattaataactctctacatatcctttgtttaa

SEQ ID NO: 107854 - DNA, 903 bp, Oryza sativa
cgattgtttatgtatagggtttttatttaaatttttttttactcttctaaatctatgtttattaataactctctacatatcctttgtttaatgagccttatttaatgatgggtatcttagtatttttttcattcccccttaattcttataaaatgttaataatgatggagatatatagtaataaaaaagagctttattcatatacgaatttatttgtaacattgtagattgatttagctttacatatttgaataggaaaatagacatcgtatactagttgagaaatataattaagttggtagaaagttgttagatgtccaatggtatgaagtaattagtccaccaattttattaaaaaattaaggtggatattttttcgtggtaattattaggatcttttttttattcagtggttaaattaattgttgtaaggaaaaaaaagaggcgagagccagtgggttcatctcgtcggtgaggaggcaactggatacatgtgttgtacatacgctctctgatggcttgatcgatcgataggtttgttttaagatatagatataacagttaataaggtccatatgtaggggtaaaatgattttttttctcagaatttcttatatttactttaatttattagagcgtcgtgtggtggcttaggaatgtttataggaagccacatggcagcttggtaatgtttgtaagacgtttaatggatttttagtatataataatagataattcatgtcatagtaattaatatatcaatctgtaattaaataatttccctagattttatgtgtttgccactgaaagggaatggtatatatcccagtgatgtcccgataattttttctgagtttgtcactgaaaattaaaggtatattcatccaagtaacgtataataat

SEQ ID NO: 107855 - DNA, 5788 bp, Oryza sativa
ccccgccgcgcgcccgggctggcggccgtccccgccgtctgcccgggccgactatcgtgccgacactgagccgccgccgacgccccccaggtgccgccggccaaatccgggcgcgggatcgccagatccggccttcgaggtgccggatccgcctgtcacacctctggccgcggtgagggactttgtcggcttcaccccgtcgatgtcgcgccggggtgggagacgccaagaatagggagagcctcacctttgccttccctgctcgccgccggctttgccgccggcaagctccggcgatagcgaggcagcggaagagggagtggaggtgcgggcggctagggtttttttgccccccgagccgcccgcgcgaaagcgacacggggagagagcctaatcattcgcttgttagaatttttatacggaggtaaagcaggtgtttcacaagatcccacgagcacagaaaagaataacatatatatatatatatatatatatatttgatcataacagatcatatatatatatatatatatatatatgatctgttatgatcaatatgtcagttttgctgtatcaacttttgcctgagaggcgtccacaaaccacactatccctgtgctgttcatcatcttcacattctccagagaaccatatttatcctggcctggtttgttcccatacatatcaacgctccatggtcatgtggctgtgagcacgactctagtgttatttatgacaaaatggagcagcattaagtccactggaactcaacaaaatatttacatgttgtctcacctataagcttgatgggcatctaatacatctgcaaaattagtacgtcatgcttctgtgatgtagtatgcggcagagcccagacactggctcaacatggttgtcgaactttagctccgccgttgtatctaccaaaaaattaagcatatctccgctgctgtgctctaccaaacaaaattgacaaaattattagtaacaaaacttatctaagatttagtactacaaaaattttggtatggtttcaaattcaaatagagcattgataatatatactttgtgcatgcttgcgcacaagttgtaatgtatcatggtggacgcacggcatagataattcagctactggttaaaacagttctccggtatattatagtgcgggtgcgtataattaaatgtataggaaaaatagcacgagtgatgatgtttttaggtcctgttgttcctatcatgtaaaatctacaacattaatattaatcggtaccaaaaacattatggtcaccataaacatctatctagtaaaagtccatgaaacttcctacaaacgctcataacccgccacttggcactcctacaaacgctcctaaaccgctacgtggcacttttaatctaaccgtcgattttcatttaaattggtggacctactattttagacctttagattagatctatttagagaagtcccagcttcatcgaaattatttaccagaaaaattaatgtacataccgaatataaacctctcctattgttctcttaaaaaaccaaacagacgtacgtacgtacaaagattaaaaaaaaaccaaaaaaccatatgtatgccgtaagaacaatacggtctttcgaatatagtgtagtacgtattgtgtatgcctttctctgttttttatttatcaacgaacagcaagtacatacttaagacttatctatctatccacggtctttaaaataggatttcctatattataaaataaaatttattactccacaaatatgcacggttaaactaaattaatataaagtaccaaatcaactgtctttaaatgttcatcttttaaattatttctcaaatatatatctaacttataatcctttgtcattctttaattaaataaaatactaatcacttataatagttatatggaactgctaaattcattacgaaacatggtgccgacatataatacgtaatgtgataattatttttcaaataatttagctaacatataataactaatgtcatttttaaaataatttcacatgaaaaaaatgatcaacttggtgtcaaattcacttggcaaatatataacactaattcaaatctacatgcagaaaaagtgaaacaacgttgtggtttacaatcagatttgattttattttaatgtatgtgatattaagattctctttttttttaaaaaaatagaactatttgatgggaatttccaggcaatgaccttgctatattacgaccccttaatccatcaggagaattacggtcatgtatggtttttctttgcgaaattggtttggtaacaaatgaaaaatcatttgcatcaaactattcatcatatattttttatagtttagaaattctaatatatcaaacataattgatgatgtatgtcatacaccccactgaagtaagtataaatgcactccaacaaattagttactttaaataattttggaaaatatattcttagaattagtaaagatgtcgcatgtaattatgaacaatacatgaatgaaaacaaaccgaagctaaactatatatcttagtcaaaatataaagaacaatatggtactcctagatgtcatggtcgtatgtctgtttagttatatttttttatcaaccttgctcatctgaaaagagaatattgtatctacgcaataaaaaaaaataagcattactgattaataccatgcacaattttgtctacacaaaactttaaaaaattcactagggaaatattttcatcacctacattccctctttttttcccataaagggcatcaagcatgttgtgctaccacaagtgtagcaagggtcatacattcggttgagttgaagccaccccgacaaaggctactattgacaatagtgcataactttgtacttactgatgcaattatctatgagggtgctgatagtgaactagacattaaaattacgcttcatgctggcattgtggggcacgactatgtcgactcaggacctatgtttaaaggcagtggagaaataaagtctcgatggatacggtcagcttcacccattaaaggggacattcatatttgattttaacggtcatcaaaattaaaaaaatcttataaattataagaaaaaaatatgatcatcggtttacttaaattatttagaaaaaaaatagaaaaataaagtacccaaaacctcgtcctccccggcacatgcacaaaacattgccggtccccttcaaccttggctcatgctctccgctctccattcctcccccttcctatgaataatactgaaaagaccatatttttaatatatatacataacatttctaatctaattgttactctgttaaataattaaaccaacaattattgatccgtaatgcctatatttttaatctaaaataagacttgtataaaataaagtagaaaagtagaaaaaaagtcaatagggattgaatcaaatcaattagagagaatatagtaataaatttctaaaaaatagaaaattggaacaaccattgtatgttccattgccataaccatccatctgtcgtggtattatgagtttctcatatattattgcatatataagacatactaaggtagccagacgtagtagtacttagttggttaaaaagttatatatgtgctactatcaactttaaatttaggactcatattgcctaggtattttttttaaaagaacaccataaatcacatatataaaagggaaaggacgcatacaatatatatatctcctatgtatttattgtctcattctttcaagaaaataaagaagatcattgataattgcttatagtaatgaattaaatattatatagttcaaaccttacaaatgtcttgtaaaacaatatctaagcaatagcgatgaagaaaatttataaagaaatactccctccgtcccaaattataccaactataatcaaactcggtagcttttaactaataagcatagtagctatatctaagtattatgcatgttacatcactagatttatattttgaagtactttcatgtgatgctaatttcatatttgttgggatagaatggaataaagtactggtcaaaatatgttattaaaacctgtgtaaaaaaaataggtcttataatttgagacagagggagtagtatttttcaagcatagcaggtatcatccgattgatattcccagtgtaacctactttacatgcccgggcgaatgcgcgggctaccttcctaattatgctaaaacgagtccttttttggtttctattgttttcaaggataggaagatgttgtttgctatgtattaatagacacagagtaaaaaagtacaaaatattggggggggggggcgaataaaaatatgatactctcccccagtcccaacattggaagatttctgggttctcacgctagctgtatataaatacacctaggacaatactcatattcctcgcttactaacaatgtcaaattctcaaacctcgagtctattacaaacacaaagggtacacttttagtagatatcggtagaaaaggaaatatattgtgaataggaggacacgggatgaagtctgtcagcaatgatgaaggcgctctagttccttggtcactagcacgaacaacaacgcaaaatcccattagggtattcccaaccctccacctcagatggttgtctatagaatctattaggctgccacataagcaaaattctgatgtggcaaggtaattaaagaagtgagggaagaaaaaagagagaaacggtgtctcatgcacaaaaccggatcggcgcaggcaccaagactcaggaaacgagagaaatcagcgttggggcaactcattgtttcttctgtccggatttttctcaagctcctgatcttctatgcctgttcggtactactactctgtagattgatgttgatctttgggtatatgtattgatgagtgccacaattgatccttctctattcatatgacatgcaaagagtcattaaattttcttgtctataaaaactgctatagacactatgcattggagaggtagtgtctacatacatttattattgtttctgttgtctagacactatctatagacaccatgggttaggattgcccttacagtcagcacgcaacatagaacatgccgccatccatcacatatgtactgcattttggggctgctcttgattatgtatgatatgcttagtgatgagctgccttggagatgttacgagctcctgtactcataccaatggcccccaagagatcaatgtccatgaaataacccaaggttgtagacagcgaccacaactcgaattctctatttatgccgcataattccatcagattgtttcatactggctaaattatttttttagcatttttacgttatttgattgcacaaccatttattgtacaagaccatgcaccgggaatcgctgcgggaggaagattggaagcgagcgtggcacctttgtagagcgaggactccggagaagggaattgggatttcggttttcctacttagggctactgttggatcttttttttacataaaacttaaaagaaaacttgattgggaacaaagacgggattctgttgtgcattctcttagatgcgagaggttataagtgtataaaaataagcacttggattgtctatgccacgtgattccgtcaggttttttcatacatgcattttgggttgcacttagttttttttcccatttttcagatattagattgcacttattgtcgcctggaaagaagttggctaatgatcta

SEQ ID NO: 107856 - DNA, 518 bp, Oryza sativa
ttcccattgtgattcccctacgtttgtttttttctcctctatagtgatcattgctggtcggcgcccgtgtttttttcccgcaaggattttccatgtaaaattcatgtcttcgttgtgtatctattttcataacaagtggtaccagagcattggagatcaatctactaatcacgtagccaccggtgtgattttttcggatcaaagaaatcgatcttggcgacccctatcgtctcgtcgatcacgcgagaatcagcagcccgcgctcgtcgagagaaatcgcaggagcagcaggacgtacaggcgtcttctaccagcgcacgcgccgaggaaaagcagcagcgtccaatccatccatccggcagcacacgtcccgaggagaaagaaaattagtgcaagtgctatggtagatgtgactaccacatccaaatttatccatatcattcatttataaactaagaggcaactcatacaatatatcacatctagtacacaaatacaaatgtctctaatactctcac

SEQ ID NO: 107857 - DNA, 620 bp, Oryza sativa
cattgtgaaacggagggagtagaatataatggttactccattccagctaaggttatttctttcggtttaatagtttttgctaacactatgcttagaattcattccaatcgaaataatagtggttctattccaactgacactgttttctttaattttatactccctccgtccctaaatataagagattttggttggatgtgatgtatttttagtacaacgaatctggatatcaaacctaggatgtatcacatccaaccaaaatcccttatatttagggacgaaggtagtagcttgtgatgaattttatgaaagtatttttcttttattcttgcaccgatatgttttgaaatattttgtcatagctatttgtgtcttctgctccaatttgttttaaatattgtgtacttggaaatatgtgtccgctatggtcatttttataagaaaaccaggattttgtgctctctaacactactttcatgctcaatcaatcatctaacataattgatacagtatatttattttctttctttcttgttttgaaagagttgtagttggcccctgctacattttaggtcaagctctgtcaatgctgccttccgcaatgaaagaaaatatcaatg

SEQ ID NO: 107858 - DNA, 656 bp, Oryza sativa
tttgaaccggagcaaatctcattcttgtgtctccaatgcttactacacataagttttatatttgaaggccgctctcatggatcctataagaggttaggatacatggtaataatgttggtagagaatgaaaatacgagtaaaacgttgaaacagatataaaggcagagcatatcttcctcaaaaccattttttgcttccaaagtttatatagaaatatgcattgggaatgggaggaattaggaactggtttagaacatgaaacccaatttctcctacgacgactcttgtcttcctggagttttcaactgaatagccactagatgaaacgaaaagcttggccatcgtggcctgaacaccgagtgaagacagcactagatttaggggtgtaagtgggtcaaccgcgaatccacttataggtcaaaataagcgggctcgcggcttattttagtttataagtgggtttcgcgggttagtcacttacacccctaactagattccatgatgaaagaagtgattagcagattccatggtgtgttcagttgtaaggaacaatatatttatatcgttaacatataataagcccctgaattgcattgccatctaataacatatatacgaattcagtgttttccatcgacgttagagattgttcatca

SEQ ID NO: 107859 - DNA, 2794 bp, Oryza sativa
tgttgtgttcagatggaaagaacaatatatcgatctctttaacatataataagcccctgaattgcattgccatctaataacatatatacgaattcagtgttttccatcgacgttagagattgttcatcacgctagctgctagctagtagtgactaaatgattgtattcatgacaaaaataactggtgtgggaacactaacatgaataatttctttattgagtttagttatggcacacacacctaatgaaatcactgacgtgcactagtttgcaaaattgatatcctcacgcctcgttactctcataattaagatggcgtatgcttgatagaacttttagaaggagctaaagcaggtgtttcacacaagatcaaagaggacaaataagaacgacacacatcaacgtgatatttattaatactgtgatatttgctttgtactttctgtacttctatgtcagttttgcaatgggcctaaggggtgtgttgcatgtacagtttgtttgagcagtactcctgctttattcttgttgttttaaaactcttgatttcttctttagtgtaacaccaagactccgaattggtcctgggttaaaatttttctcttaaggacaataaaactttctcatcataaacttaaataggttaataaaataattttacaattcgactggataaaaaatggtagggaggcatgcttgttcacacatgaatgctacttattgatgaatctctgaatcactcctcatcactagcagtcagcaacaattcacactggaacattattaattccattggatcgcaacgaaagaattagatgctgacacctattagcttgataaggaatctaattacctagtggttccagatattgtgattcaagaggattggagctaaaaatctgtgctgttctccttcctgtatactcccattcctatcgcaaatcatgcatggttgtacactacagtgtgtgcatgaagaatttgagacagtgacccggtacacctgaagaccttttacggtacttgggagctatgaccgatacctcccaacattctttacatccaccgttcattttttaggggtaacttagaaaaaaataatgtaaacaaggtcagttcagtaattgtttaagccaagccatccctaactaatttctcaactcgatcctattttacagctaccctacatctaactcctctgctagccatgatctgctgctcgtaattctcatctctagctcattgtttggacaccttatttatgaattttgccatctacatacgtatacgcatggactactgccactaatctaaaactaatattctcatctaatcttaaatttgattccgtgtaatgattcccctcttgtaatccatacgtacgtgagcgagaggtagagaatttttaattcatctaccttccgcatcatggtaactacctcctccgtttcacaatataagtcattctaacatttcccacattcatattgatgctaattaataaatctaaatagatatatatgtctagattcattagcatcaatatgaatgtgagaaatgctagaatgacttacattgtggaacagagggagtatgatggaagtaaatcactcagttttaggtcctaacccagctcgtcttttttcttccacctccgatcgaaatgattttaaataccctagtaaaatcatgcgctactataaggtgatcataacaacgcagaaataattaacaaaccctggatatgtactggaataattctcaatcgaactaaagtcaaactttctacgatgattaaaagtgatgataaaacacaattaccattatagcctcctagcttttatatctggcccacactcttaagtaccctatgcaccagtatcttctatcttagttcgttagattaagagcaatcaacggctctaatatattgcaagcatcgtagaaagtctcatatctgaaaggacaagaagtgctctggtcaaggtatatatagagcagttgtacgttgaggctactgaaattagtgttcaccgtaatgatgattaacttaaaatggttgtcagtttgtttcctcttcgaacaattttcccactatatgtcatcactcctagcagtggtctatctataaattttcttgagcctgggcaaagctaataacggataacaaatacaaaagaatctatacgcaaaacattatagaccatctgccattgacccaacaaattaaaattttggtaccgcttcgcgcgaggtagtaacagaaaacgtggttagtggcagcgttcctcaacccaggaatgtcatccctattcggaagtgcgggatgatcattttcgtccccgccatgtaaaaactacgacaagtagcgtatcatattcctcaaccaattttctctcgttcccatgatcaaccctgggaactttacgattatgcttcaatccaaaatggcccatttataatactccctccgtttctaaatgtttgacaccattgagtttttagcacatgtttaaccattcgtcttattcaaaaacttttgtgaaatatgtaaaactatatgtatacatataagtatatttaacaatgaatcaaatgatagaaaaataattaataattaattaatttttttgaataagataaacggtcaaacatatttaaaaaattcaacggcgtcaaatatttaaaaacatagggagtatatgtaggatcgtaaagggcctttcccaccccaaaagctagccattgaggtgacaggcttccccagttatatcttagctcatttgccctttca

SEQ ID NO: 107860 - DNA, 561 bp, Oryza sativa
cctatatatttctcgagaatttttctcctaaaaatttgatagatgtaattatagtacaatcgtagtgtaattacactgtaatttgtatgtaactacagtgtaacttatatgtaagtttcacgtaatttgaatcattaaatctattataagatttgttttggtgaggaagaaaaaacaattacagcacacatatatgtgaaagaatttgttcccacaacctccattttaccgaaataacatgttacggagagatttttaaaagttacatacaagttacattatagttacagtgtaattacatgcaagttacagtgtaattacactacgattgtactgtaattacatttctcaaatttttaggggaaaatttgttgacaaatatatagcaaaattgtggattatttagttccccatctgctataagcaatatggataattagatgcccacagttcaacaagggagaatttagtagtgagtctatataatcccatttaatattggccaatttagaaagtaacttcttatattttttattggagggactgattgaattgattaat

SEQ ID NO: 107861 - DNA, 732 bp, Oryza sativa
ccagaatatatatttatgctatatatgtacagaaattatatatatatatatatatatatatatatatatataacaatatgcttaattttataggacttgtgtcctctgcctttcgtaaacgttctacatatacaaagtcgttgcaaaaatcaaatggctggtcgtgttttaaacccatagctcatgaaacaaataatggttgctagggttctaaattaacttctacatgagccgatcacgtcgcctccgcacggtacagcttaccgttcttgcatgctcaagctcgtcctgttcttcaaatgtctgcattctgttctttgccagatagcaggggccagagccggttgccgctgctttccgatgagccaacagaccacagtgctaaacctcacccagagggtctaagtagtaaaacatctgggcatgggagataatcgacgggaagaacatgtaatgtcgtgtgctcgttggagatgatgaccaacacttgtcgtgttgattttcttcctaactccttccattcttatcacaatacttgtatatagactgaatttttcaagttggaatttgtagaggggccggctgccagccagttgcctaaggaatttgaaaggggaagaagagccctaccttgggctatattttaagaggccgcagtacctctaagaagtttaaacaacaataaataaacaagtgttgtaactcgaacaagagcgctgcagaccttgtcgg

SEQ ID NO: 107862 - DNA, 1122 bp, Oryza sativa
tgatttacctgctgctaagatctatttgtagatgttctaaagaagacttcagttatacgccttgttgattataatggaagcttgtactggaccggttagtcccataattttttactcctcacaacgaggaagttttcagacataaattagtgtgcatgtaatcatcgttgtttcactattgttttgctagttgaaactatccttaatgtttatcgaaagatgaggcgctgattgtatggattttgtttgttggatggtgaatcaacattttgcacgatgtgattgttggttcaatcccaacattgtgttacctatatccttatatgacaatgatcccgtgagaaattaagggagttaaaatatgtaaatttgcgttaactatgcccatcacctccaattgtgctagctaacatataagatacacacctaccaagaaaaaataaatgcatacttatgtagccattaatatagaaaatagttcacacttatatagtgactccctatggtccacgtaaactagtgtccacacaaattatttgatatgccacgtaggatctaatattgcgacacgcttaattaacaaggacagatgaaaaagcattgtcttgcaggagacattgttgtggtataaaaccaacaagttaaacattcataaaacatgcattatggagaagaataatctttaagataatttccaacaagaaaatgcaattatgagagcaagacgaagtcataggacataggggggctgtttgggggagcttctagctgttgttgcttctcccagaattagaagctcgcccaaacaatccagcttttggtctagattctgagaagctgtacttatagaatctagaaaataaactagaagttagaagccgggaaatccagtttttccaaattatcaagctaccaaccagctgcttttatttactattggacacactaatagacactatgtactgtaaatattgcttttattattatgtctatatataaataggagacactatgcagtgtaaatattgcttttattgcttttattattatgtctatatgtcattagttaagagggataggcgttgctatggacagggtgcagtagggtgttattacaagtta

SEQ ID NO: 107863 - DNA, 650 bp, Oryza sativa
ggggaatgaaaaaaatactaagatacccatcattaaataaggctcattaaacaaaggatatgtagagagttattaataaacatagatttagaagagtaaaaaaaaatttaaataaaaacctatacataaacaatcgtcacaaaatttcaaacaccaataaataaggtgctcgtgcatctgtgcgggctacccctagttaatataaaattggaaaaaatagaatagttctcatacaacaattaatagaccaggagcgttgttactcaaatagggcagaacatacacaaaaactgtttgtgcgtggatgacagtttaagatcaacctcatgataatcttatgttcctgaggagcttctaccatgtggaaacgctctttaatggattttcgtttttgctggtcatgaccaaaacaaaccaccggttttacaggctagtggtactgtcacagcttgaattttcgtttcaggatttataaattatttaataaattattaatagaatttatattaaatgttcattaattttcaagtgaagttaaatgtgggaaataaaatttcctaaatataaagcatggctggatttaatttttattaaattctccgtgattaattatactctctagaatgttcttgaatttttcagagctcaat

SEQ ID NO: 107864 - DNA, 595 bp, Oryza sativa
ttgaggggataggtaggggacgactagggggtcctttatataggcacgggagcttgggatcaagcccacatcgacgggaaaaactcgggaaagtctagggttctcgccggaaaaaggaaaaattgaaccggaaattggaaaggatttccataaaaacttttggggatttcttggggaaaaggaagaggagattgataggattccattcccgtaactaatttggaaaaaggagcaacgaggaggccggattggtgggaggaggcggcggcagtagggcacggcacggctcggctctggctctgtctagaggttgaagaaggtactgtagtgatagggaggaaaactagactttggctgggctgagaggaagggagagagaaggggaggcaatgggctggattcggcccaagctgatgaggaggacttttatttacttttccaaataaattaaccaatgagatgatctttcaattgttaaaaatacttccaatgctcaaataattccaagaaaaatcttgaacatacttggacactcaaagtatttaatataataatatacagatcatttaatgattaatttattatttaaataatt

SEQ ID NO: 107865 - DNA, 743 bp, Oryza sativa
  unsure (1)..(743): unsure at all n locations
agcgggtatgattccctgtgtttagcgccctatgaatgngtaagattgcctccctgcaggtcgactctagaggatcccctccttgttgaaagcaaccatcaaactgttcagactgccgtctgaagtatccgattccatcgatcaaattccgttgatcgccaccatgttccacctagcgtccatgtccgtttcttgacaccctgtgtagttgtcgcagcatggagcacctcactcgtacctctaccatggatctcccgcatgctttgataccacttgttataaaaccaaccccgaaattgacatcagtagctaaacgcagaagaaatgccataggagatccaaacacaatgacgacaccaagacacgatatttggcacggagttcagctgaggcctacatcttcggggcactgattacgggcgctcctccctgattagcatatataacatatcagagttacaacgactcacggncagacgccgccggcagccgctccctctcgctatgttaaagtcgcatgcggttataacaggcacacctctgtatttaagagagagatcctaggatagagtccgactcatactttagtcctaatacctattacaactncaagttctaaattgtaaccgactttatacatataaccgacacaaactcttacagaaaggatagattgcgtggtgatagattaagcatctcttcaaattactatggagggntatatctcatactaagctaagttg

SEQ ID NO: 107866 - DNA, 730 bp, Oryza sativa
  unsure (1)..(730): unsure at all n locations
tgggggnnatgaacccgttgttagtgccactttatgtttgtgaacgcatccccgcaggncgactctagaggatcccccgcgttggtttatgtatgatgtttttgtctttttacataaaatttgaccgggagtttttaaaaatagatgacgacccgtcatagcataaattaaagattatagtttcttttatgataaaacaaatcacaataaaataaattatatatattttttagtaagacaaatgctcaaacatcacgtcaaaagttaataatttatttatttatttattttattttcaaaactagcaaaaatgcccgtacgttgcaacgggtgaaaaaattgtaatgataatatactttttttcatgaataatcatgccaatcacaatgtttgtattttaatgagcagcttgttttttatataaacggtcttttttttcttgcgaaattttctcaaaccattcagaaatggcgcatttctttctaaagtttctttctagaatgtttttttttgcttttttatttacaacgaaaaccatatttttctccctttttttcttttcttttttcgtgtgtttttttgcctttttttacaattattttctcgcgcgtttttttgcttgttttttttcaaatgttctttttttttgctttttatcaatagaggagaatatatgatgaaataaaagccgtgtagtaggtggcaaaaaatcaatggaccccattctacc

SEQ ID NO: 107867 - DNA, 569 bp, Oryza sativa
ctatgaaaacacattcttcacggaatatagcaatatgtagaccaaatcgatcggtttattttaatgttgctcttgatccattacagatactcggtgtcaccactcaccaccagcgcgcaatgtagaacaagacttgctcgtattgatggttgtctttgacaattgacatgctaggtcaaggcatctaaaagagaatcagtttgcacctacaacaatttctttaggcaaaacctggcttagtaccattaattgcactcgagtattgttagtactgatgtactataacacaaagtagaaaaattaaggctgtgtttagattcagggtgcaaaattttggcgtgtcacatcggatacacggacacacatttgaagtattaaatgtagactaataacaaaacaaattacaaattccgcctgtaaactgggagacgaatttattaagcctaattaatccgtaattagcaaatgtttactgtagcaccgcatggtcaaatcatgtagcaattaggcttaaaagattcgtctcgtaaatttacacgcaatttaaataattaattttttttctatat

SEQ ID NO: 107868 - DNA, 1629 bp, Oryza sativa
ccgagaactcctgaaatttatcattactatttcttaaaactccattgtaaaaacgcaaggacactttactattatctataaatgtcatcattgtaagggggtccatcgagctaggtcaaagctaggcggcgtacatacacggactgtgcagctacatgcatccgatgaacaggggttggggaatatggaatattctcttgcatgccatcgatccaaacattcgtctgaatctagacgtgtttgtacactcgtaacctgtccaagcacggcaaagacctgacctgactgcctgcttttaatttttgtttcagagaaaaaaaaaagaagagcaagtcaagaactgcagctgcaaaatctcgatcagcaattaattagtcatcttaattagctgctacttctagtcttctaaaacaaatattattcatcttaattattcatacacgatctatatatgcagctacctccagtccatgtatatataaaagctaacatgatggtgtgatcgacgatcatcaaagatccccaaaataatatctcttactaatatatatgtgcaattatttgttgattagttatgcataacttatccggttatccttgcaaggtaatttattctaacatatgcacatattaataaatggagactttcaaagagtacgtacgtgtacttcgtatattaataatatgtcatgtatatgaggatatcgagattatctctcgggtggatttaattattatggatccaggagcatttttagaccaagcatgattaaaaagtcgtccatgagccccaaattaattagttttgaggaaaacaaaaggagccccaaattatgcgtatggatgcaagttggccaactatttgattgacatttttacatgttactaattctcctgtttggaaaaaaatgcgtatatataagtgaattagtgagctaattaattgtactatatatgcattgcaacttctgcatatatgtggattgaccatctatatctaccattcaatgttaaaattgcagagtcatttcttgcgaggattaaaatatttttaattatatatgtataatatgtcatatcgatcgatctgtatatatattttttgagggaaagatctgtatatatatgtacaaggtagttaactgtctacggctatatgtaatgtgttatatcgatctgtcatgtgtatatatgtacctgcttgtacgcattaacgatattaatcagccattgttgtccaaaaattattgaaaccataagtttttgagctagatgtaactgatcattattaacaggaccgaaccctagcttaattgatcgatctattcgatcattccctcactacctaattaatctaattctgcctgctaataaatataattaattgtccactcccctgatcaaaatgatctttttccgattaattttcctcaggtcgaccaaaacggataatagtttttattttatgatacccaattgtgcctatatatagatataggtatagtcattatatatacttacccggccgtacacgcgactgtgtactagcaggcactacgttcctgagcaaaatgaagcgtgcatgcatgtgtaagcaaagattttgtgccaattattgagtcttcttat

SEQ ID NO: 107869 - DNA, 812 bp, Oryza sativa
  unsure (1)..(812): unsure at all n locations
tcttattcaaaaacttttgtgaaatatgtaaaactatacgtatacatataagtatatttaacaataaatcaaatgatagaaaaaaaataatagttacttaaatttttgaataagacgaacagtcaaacatatttaaaacaatcaaaatggcgttaaatatttagaaatggagggagtatatattatctccagaaccaacattttttaattgtggataaaaacccagcctctatatccactgccaatttccagaatcatctggttattactagctctcatacatatgcatgcaagcactaatcctttgagatctactggctagaaagttgagatgacctattgtctccataagagagcacaaatcctcatttatctcactgtccaactgcttttgctgtttggttagtgcatgtaaaacaaaaaaaattgcatgacaaatgagatgagaagattgagtttgagatcagaaataattagacataattaaagttaattaactttgtgcttggtggaagccacatcttcatcaacacaagtggtcctagcaagatatcattgtacttatgtttatgcatgtcgagctttgattttataaaaaattggcgccgcgngcctgttgtttggttggggttcctttagagtcgncctgcgggcntgcgngcttgagtttnntntggtgtcgctgtatagatgtagtgcaacaacatggccagcggggggggggggggggggganttattgaataaattaaaagaattacgaaaaagttgaatagtggaaatacgatatttcctaaattcatcaacagtgtg

SEQ ID NO: 107870 - DNA, 692 bp, Oryza sativa
  unsure (1)..(692): unsure at all n locations
tcagtttagtatcgattcaagttgttagtttggaaatcaccaaagaagaaatgaaagaggagaacagcatgcaaaattccacgaaatataacaagataataaacaagagctgcaaaaagagatgaagtgcaaattttgggacgagtcagaattggaatgatattcagcagtgacacagtgtatctatcttcatcctcctccctcaaattaaccaatgttatttcatacaaaaactatctgacagaacaaaaatcacatcatcgagaaaaaagaattgcataacaactactgacaccaagaaaaaagagcagaccaaggagtagagaaagaaagtctaagggtaatacggaactttttctaatataaaagtaatggtaaaattaagctccaaaaatttgaacaagtcttatcgtaaacatcaaatatatatctacaattgaagcgaggtgtgataaatattgtcaaaccctgtattttattttatttcgatcgggagggttactggaatttgcgtcatctttatgcaggttagaaattccgatttaggttgtgagatccatgtttgaaaacatggcggtcgaacgagggagaaaaatgaatgtacttgttctaagtacacatggcatttctttttaatttccatgcatatatatatagtctactctctctcggnttcaaaataaatcaaccta

SEQ ID NO: 107871 - DNA, 1553 bp, Oryza sativa
caacaatgccttttcagtattagtaaaaggtgctttattttccttaatcttcacagcaatatgaggtccataagaaaaaatatcgggaacccaatcttcaggatctaaacagaatgagccatagggcggcctatgccaaaatatacacctaaatctgtagtggacagtatttttctcatcgcgtattccctcctccctagacaaaaaaaaaaaaagtgaggcaaagacatgaaacttactcccgtatgttctttctcaaatagatgtgtgcagtcaaattataatttgactagatgtgtaatttagatacatgaataataatgggataagtcaaattttcgataagaaaaaaatatgtaaggtttatttggtactctcggtgtcgatcttatcctaaagtttgtgcctataaataaataacagtaatcttttcttctatcaaataaatacgcaaagcttctaagtactattctattaaaaaataaatacgccaagcttctaagtgatgcatgattgtgctgtttgatggtcatatacacatgcatgcatacatggtaacatgatcaaaataactatatatggtgtgcttgctagtacttggtgataaatcccatatactttctagagagaaaaaatctaacaattatcgattaaaatagcattcacccgttgcaatgcatgggtgtttttctagtaatatcttatttggaagaattattggtttatttgatgtagtatttaatagagaaaatttaacaaaataacaaaaggttttatggttaaattaataaaagttgtagaaaaccttggttattatggcattggcgtttgcttcttccattttttaattgatgatgtcgttgagttttagacgttgcgtctaaccatttgtcttatttagtgtaaatagaaaataaatttgttatacttaaactaccttttgataataaaaaatcacaataaaaacaaatgatatttagacattttaataaaactagtgaacaaacatgatgtcgaaaaatcaatatcaccatctattaaaacatgtagggtgtatataacaacaattatgtggccctaatgctttataaaactgcaactattggcacatatttaatttccaaacaatacaatatattggcacatatttacttaattaatgctcatgtaataaagtgtccacaattaatatttgaaatattgatttcttcatgaaaatgatttggtgatcacctgagctagagaaggtgtagaaggccgaaggcttctctggtgaagtggtgagtgatgagcgattcgcataatttatagggaaaaaatctttctaattttctacatttaaaaagtgaaaaggaaacttcgtggcataagaggcaagcaaaatatttacctaccttttcttccaaagataaatgtcatttcttcattgattccgacacatgccaataaaccaaaaagattaaaatatcccaaggttatcaaatttcaatgcaactattttctactttatctactttcaacataattattctcttcttttataaacttcgaca

SEQ ID NO: 107872 - DNA, 509 bp, Oryza sativa
tgcacatatgtacaaaggaataaggatgtgcttgtactgtgtaaattgatctagcaaatttgtgcatgatgtcatatatactgtgaataaatgaaatgtttatgtatctggactctgggattcttccatttcttaaaagagcatttcgagatcctctgttcgtttgaaagacaattgttcattatacgcactttttcttatgcagagacgagcgttgacttaatcgttcgctatcagcctctattgttccatatatagtgatgtggtgacatttagatacgctgttaggtaattcatatagcttagtttatcattaaaagcgctttatgctctcagtttttcatgcttgtactggtttttgcagtgagacaagtggtctcacatcgtggtcccagtatatcatatattttaataatggacggagcacaccccgtgcagggaccaacaaccctcgtcgaatttttcatttaagacgaaactatcgtagtttgtcaatcgccacatccttt

SEQ ID NO: 107873 - DNA, 1415 bp, Oryza sativa
cgcaccacattgtcttccagcttgtatgtgacactatagaaatttgtgtttgcatccctcgcggtcgactctagaggatccccacatatgggcccacttggcattttgtatttttttatcgtccacctgcttaaacctaaggatcggttgtcatttcaaataataaccgatcggagggaattaaaaaatactaatagctttttaagctgtgcttctaagcttccctagttttattgtagttgaactgctatgagcagtgattttttttcgaacgcgcaaaagtcttgcatgtcaataaggaatagcatacatcggaaatacgccgaggaggttaccagggtaggggtactacagtatgaaaggcatcatgaaattttctagaagtccccacaaaaaattttctagaagtccccacaattaaaaacacatgcatataagagcaaatataataaaagaagtagtttttagtttctacctgattatctctaattttacccatatcaactagtgctcatcaacgcagaggatagtatgtacaacacactctatactgctagtacactggtctggccccagcaataatctgctgtagttttttttgttttattttgctaccttaatatacccttcatttctgtcactttgatcttgaagctcaagtacagatatattacatcttacacgaggggtgccggccctacgtggtgttttatggctagcgtaaggtttttattatacttgttctaattaagtactccctccattccaaattgatctacatatagttttttttgaggttattcctaaatgatctacatatttatgtttatttattaggtttattcgttatttgtgcattggagtaaatggacattgatgcatgcatccatacacacatgtatttataacccacatgcaatatcttgatttgctattggctaggaaatagtggggatgatgcatacattgagtttgttgctagagtaaatatagtatgagagagttattagcttttcttgatcttggtgtacctatgaaatatgtagatcaatttggaatggagggagtagttaccatgagacgtttataccgtaataattcacaccttctgtaatattcttaattattatgacatatcgacaggtatacctcaattactataaaaaacataattaatttattggaatgtaaacgagaccaaaccatatatgtattttacatattaactcgattattctgcgtcttctggtaatccctacctatcgccggtttagatgcctgtaaaaaattggctaattttcttttatgtacacagacacatattttaagtattaaacgtagactaataccaaaacacattactgattttgactgttaactgggagatgaattttttgagcgtaattgattccgcc

SEQ ID NO: 107874 - DNA, 1510 bp, Oryza sativa
  unsure (1)..(1510): unsure at all n locations
ctaaatgatcnacaatttgtgtcatttaataagtcaatcggtatgtgggcaagggagtaaatgacattgatgcatgcatccatgccccaagtatctataaccacaatgcaatatttgattggttattggatagcaaatagtgggaatggtgcatgcatgaggtttgttgctagagtaaatgtagtatgagagagttattagcttttcttggtcttagtgtacctatgaaatatgtagatcaatttggaatggagggagtatttttctactacactttaatgcatatgtcttatactaatatgatattacctttccaattaaagttttagtgggatagattttaaacgatagaaatgaaacgaattcttcgtggaatggagataatattgatcagtctagcaccgcgttaggggtggacccaggaggatgggacttgtggggcccagctgccagtgagagagagagaggggttggaacttggaagctagcagccggcgattctttcttcggttaatttcttccccaccttgtgttgactgtttgacgttgttttcgcgacatcgagatggagatacgtgtgtaacttagctgattcgtctgaaatttgagctcgtggggctttttgctagggttgatgtgctctgctttgacttcgttttgaaaatgagatgatcgatgctgtagctaggtgtcatgagcttatgtcgctccctgtatgtggacagttctcggttgatttttgttttttttttgtcacttgaaaagtactacctctatttaaaacataaggattcctaatttatttagcatagactaattaatgttgagaagaaaagatttattggccttggtaaataagggacaagtggaggtggaaggataggtgggggtaagaaggaagaaaatttgaatgaaaagggacatgtaatactgtcgctagaaatctttgtattttagaataagatttaaacgctagaaattttatattttgaataaatagatcactctcattggatcgaccgtaacgcacaataatgtgtatttagtcttatccgcttgcgtggattgtctttcacatgatggatgacgttatttcattactattttcacttttctaaaagatatgattgattgtaggataatatataattgtcattagcactcctctaataatttatttcaaatcaatcacattactttattacttggcagtttatccaaaaatgatgcatcattgtttggaatggagcccagtgtcaaccttttggattctatctagagccagacctnctttntttttcatgaacatcaggatatgtaccagcgtaggtgatatattgatcccagcaattttgtcttgaggttcttggtatatattactctcccccttcttatatatatatatatatatatatatatatatatatatatatatatatatatatgacactggctagttaaaaattgaactaggccaatatatataaaaaagacatagggagtacttttt

SEQ ID NO: 107875 - DNA, 641 bp, Oryza sativa
ctcttcgactactcaagtgatgaggatgctcccatttgcctcatggcaaaggagcctaagttaccttctcctctcaagtcatttaatgttgatcttgttagtgatgaggaggatgaggttgaggatgaagttatggatgacgaattgttcaagtccataactaaagaatccctaccacacttgagtgagttgcttgggagaattgaggaccaatatgcaactcttgagaggcaaaaggctttgctcattcgtgagaaagagcggtctcatgaactcaagagtgagcttgctaaggagagagaaaaaaatgaggctttggtacggctttacaagtaaaccaaagagtctcatgctaatcttgaggtggcgaacgctcaacttcaagatagagtggatggcttggacaaagcctacctctctcttgaagagaagttcgaaaccttaaaaaatagtgtctcttttcctagtgagccatcttgttccaaaattgtcccaagtaatgaaccatgtgtgagatgcaaagatattgatattgaagcttatgctactaactctatctctttgagtgccttgcaaaagcaaaatgagaagcttatgggactccttcacaatggcctacttaagtgccatatgggtagtaa

SEQ ID NO: 107876 - DNA, 1255 bp, Oryza sativa
tacactaaaatcctacattaatattttttaaaaaaatttttagtgaaaacattaaaatcctacactaaaaaaatatagcatcagcatgagctatgtgctcaattaattacaattataaaagtcctactatttcttcttcgcacatcataaaccaccacacaatgttattttcatgtgtggttgtatattattcgttgaaaaatgtttcatgcacctaatatagccaataatagtgccttcatttttctacattgtccttacatatttctaatcaataacgatgcttaatccttgacttttcattgaaatatgaaagatcataatagctatatgccaacgttatacgactgctataaaagtcacattggcaacagatacactgagctatcttaagatcagatttgagatgttagtatccatagcattttcatatgaggtggtcatgcattcagacttgagatctcagagtgtctaatcggctgccacgtgcaccttctagatgctaaactttttttttttgcaccactactcctaccgacacctcatgtacgtatgtgtacaaattaagtactcccttcgtatttagggtaggacgcaattgactttttaaccaacgtttaaccattcatcttatttaaaatttttgtgtaaatataaaaatatttatgttatgcttaaagaacattggataataaatcaagtcacaataaataaatgataataatatatttttttaataagacgaataacagcgttatattaaaacacggatgaagtataaaatactagtattccgtactatgcacagtagctaaatacagtattgttttgtccagcagtctagcttgtgttttaatttcttccatgtgcataacttaattggtataatgccattaattatattactttggtttatgttcattacttaattgatataacggcatcaattatattactcttgtttgttaagcatattggtgactacgacttgcataatatatagttgcaaacgcatatatgcatgggttaatcagattattaatttagagcaaagcatctaccttggcaatttgctttggtgttgttattatcagtaaccgcgatggatcgatctcgagcatctgatctgattttgtttcgattgggggtagttagagcgatagtagccagcccatcttgatcgaatttattccatatgcatcgatctaaaatatatattcatatcattatgtgaaatgtggggtctttaagatag

SEQ ID NO: 107877 - DNA, 721 bp, Oryza sativa
atgaaagtgcgatgcgattgactatagggcgaattcgagctcggtacccaattgatttttggattcatttacatgtttgctttgtcacttttattgcatagatatctttttatgattgctaacaagataatatttttttaaaaaaaatctaccaaaaattattttttaaaactttttaactttaaaattactctgttttataaatcggttgaaggagaacaagcagggcctaattaatacattttttacggatggttatttttggagaaacacatcaaatggtatgcaaataaattgagattaatgcttgctccaaaaggttaattatttcaaccatttcatcctagaccaaaattcgattttcttaaacgatttctatggtcaaaagacttaaaaattttgtctgagtgacataacaaaatagtggatataatttcgtggtatttgaatcttctgaagataaagattaagtgttttacacaaaacgatgtggtaataacttgtgattaattgagttctaattattacaaacttgaaaaatggattaatctgatattttagaacaactttcatatagaaaattttcacacaaaacacatcgtttagcagttttgaaaacgtgctatttttatctaaaaagttattcaacttttgttagagaaaaaataggatctaaagtctgttctttttaataaaaaaaggaatcaaggttttgttccaa

SEQ ID NO: 107878 - DNA, 774 bp, Oryza sativa
attcttagtattaaaaagttgaagaggtgagttgtaaaatttgcaatgaaattaggtggaatggcagattcgctcccaccacaaattactgattttaaaggagtatagatcatgcattttaactaggccttaattaatgtgtgctaaaccaaattactatagcaaataagagtaggtgctatgtcagtactttctccatctaaaagtcttaagcattttttttctatttgtttcaaatgagatagttatatttatagtctccatgcacccaatacttaggcccctgttagtttctaactaagatatatattttaccatagttttcattagcatgttattcaaactaccatgcgagaaagagcaggtgatgagtttgtgagcaggagagagagaggagctgaggatataagtatgggtgacttattaacttttaaaaatattgagagggaagagaggacgagaggttgaccttgcagctaggcgggcctcttaataggttcacctgagaaaaagaattttcataattggtctttatattactgggaaccaaaaaaaaatttttagccccgcctggcacctacgaaaaaaaaggttgtccatgataatctcttttactagtgaaaaacagagaccagatcctccggtcagtataagtaattatatgcaggcatctctctcattaatattgtatgtcgttgcatcagacgtaaagaaattattcgttcgagaggacaacgaattaattcctgaacgacgccgagcgacagtataata

SEQ ID NO: 107879 - DNA, 731 bp, Oryza sativa
  unsure (1)..(731): unsure at all n locations
gtggtcntgcnttttgatgaccacttcgattactacanggcgaattctagctcggtacccagctgatccagatcagatccattcccgtttacccgagcataagcaaaattcgtactctgcatcagttaagaaagataagggcaaaggaaaaattcatgtaaaagactctggatgcagcatgaggtcacctttgcttgattgcagcttatgtggagcaacagtgagaatatgggatttcagatcggtgcctcgtccttctcatcttagtatcaataatattgacgcacctgatatgcggaagggggtgctgacacgtggaattagtgctacaagtggcatcaatggatgggttgctgaaggaacagaaagagagaatgttgaaggacgtggtgaggcaggtaccgatgagggaaaatcactgtcaaatgctcaggttgacctaaatcttacaatggcaggtggtttgccatctacgcattctgtgatgccctctatgcatgatcatttcaatgatggagggatgggaagagatctgatgattgggcagcctacttgaagtgagctaggtggcttttgcagctcatttgagtctaggggttcctagtcaagaaagccgcatcttgaggaaagtgggagcacaacttgataagccgttaataagcttcattctgctgacagcataagaagaacttgtattgaccgtgaccgtgattaagttgatgatgggcacc

SEQ ID NO: 107880 - DNA, 2506 bp, Oryza sativa
  unsure (1)..(2506): unsure at all n locations
agaatcggttaaatgccttaaaaatgctccaaatgatccaaaagagaaaaaccatatcctaaatttatgttttaagtttaaggtttaagctataagcattggtctagcgtggcggccttggccaaaaacaagctgccatacatagtctgctcctcgtactctagggctacctaggggaggacaggaggagtacgtggtgggatcctctgtgcagttgagtcacttacatgtggaccatagtaaaatgggacccacatatcagttgactcaactgcatatgcagtaagtcagaagatctgctttcgaaggagtactagcagcagctataggccacctccccccacccatccaaaaaaataaaaataaaatcggccgtatctacaggtactgctagtctactactactccaactagttccatgcatatacagactagtatccatactctaccagcttgttagtagtagtatgttctctctcttttttttttcttttttcccaattagtttcatacccttaactttagtctagatttacaaattaattagtatttcctccgtttcatattataagactttctagcattgtccatattctatagatgttaattaatctagacataacatctatatgaatatggacaatgctagaaagttctagacataacatctatatgaatatggccaatgctagaaagtcttataatatanacggagggagtactgcttaattaattgcacatgcatagatttccccgttcctctacttgaatcttcgtgtacctccccaaacggagacaaccattattattattattattactaggtgattccccgtgctttactgcaggaattactaaccatttctcaatatattttttcaacaatcaagctagaagtaaaaaggaaaaaaataaatattagggtttttccatacatatcatgaaacaaacaaatgatacccgttctttaatgtgaagcatattgataattatatgttaaatattatagaaataaaaaataaatttgttaaaatattgtgcaaatgatatgaggggtgatgattggatatacttgcatgttaatttgtagaattgaataaattgtagatgatgttgtatgcttgcatgaggttaaatatgtaattattgctagtagatgatgatgtggcatggttgcatgttgagctttagagatgattgggtatgcttgcatgttgatttgtagaattgaataaattgtagatgatgtatgtttgcatgaggttaaatatgtaattattgctagtgggttatgatgtggcatggttgcatgttaagctttggacttagcgggctatagctttatagaaagtgttataaaaccagccccgaaattaacatcggtagctaaacgtggaagaagcgccataggagatccaaacacaatgacgacaccgaggcacgatatttggtaatggagttcaaccaaggcctacatctctggggcactggttacgagcgctcctccccgatcagcatatacaacgtatcagagttacaatgactcacggctggacgctgccagcagccgctccctctcgctatactaagtcgccatgcggttacaataggcacccctctctatttaagagagaccctaggagagagtccgactcttactctagtcctaatacctattacaactccaagtcctaaactgtagctgactttgtacacatattcgacacaaactctaacaaactccaccttggcgaatatgccatgccaacctgaatttgttccttgcgcgaacctccgtgtacccggacttgagtcgatcctttttcgccactcacccatttctaccccgacaagcctctaccaggctcaccgtaaacaagagacttcactatccttgcgatttcttccttttgactccacctgcaacagtgctccaccttctctcgtatcaccacagttgtcttgccaagcgaaattgaattccttcctagctttcacatcatagacttcttaaagaccatgttcaactccatctaccgtcttaaatttgacttgatctaatccatggccagataacccacgtcaccaccaaatagataaatcaaactcaccagacttgaagagaaccctttcttccttgtcgtcttatgaaccgagctaataaatctaacatccatgctttcccgcatccgtagactgaattcctaataatctgggaaaatcaccgttgctttgaatcatccgaagaaattaccaccatagcgctcactcttcctcttcagcgacgcatatttcatatatccccatcatgcaaaccccacagatcctggatatatcctgtactgccaaacagtccgttgatacccttaacgttttcacccgttgttgtccaggatttttccttcacacacctttgccacactcctgccccaccacagccttgccttcgaatcataatgcagaagccctgatgcacagttattttgttggcaatccatgacctcaa

SEQ ID NO: 107881 - DNA, 1037 bp, Oryza sativa
aacacaagaatatttgaggtaatgacgctggatggttcgcacgaaataaactttgttttcctttgaaatgaaagggtaggaaattaaactatttcataagctttatcaagcttaggcccatattatttaccgaattattacatcggattatctatttgataatagagataaattatatatttttgtaaataaatttgtatagtatagaaaaattaatcccaacgatacggtagagaaagtttttttttctaagaaaacatatttctagaactgtggataaaatataatccgacgaaatatatagaaagaacagggcattattcttctagtccaaaagagcgtgcatgcaagtataaaatccttgtgaactccaataatctaaagttttcatgagaaatcctccaaatccaaattaaggaacagctagaacgagcttcgctactagtattcgtaatttcgtacgaaatctattgctagttcctatagtcatgacgcattggagcatggcgagccacatagtagagtagactctaaggagtaagggtgtgttcacttttattcggcttaaagtttttagatatatggacacatatttaaattattaaacgtagactaataatacaaattacagattcgcctgtaaactgtgagacaaatttattaagcctagttaatccgttattagcaaatgtttactgtagcattacattatcaaatcattgcgtaattactaattaggctcaaaagattcgtctcgtaatttacatgtaaactgtgcaattgattttttctcacatttattatcctatgtatatgtctaaatatttgatgtgatgtttttgagaaatttttttttatataaacaaggcctcactagcgcgatagatttttacacgaattgctgcttgctcgctctcggagtagagtgactagcaataggcatatgcttgggcagggctagggcatggtgtaaatcaatcatccgaccgaagcaagcaagcaacaactcccaaggagctatatgccactgtggcccc

SEQ ID NO: 107882 - DNA, 709 bp, Oryza sativa
ccgcctttgaaatcgactactataggcgaattcgagctcggtacccataacatgttctgctccaggcattacaataactgcaacataaattaatagacgatcggcatggcgattctcatcatggtaaagctcactcatttatcaattcaatgacagcatataaaacgtcggtagggtctgcagatattacaattttgtaagaggaattatggtaaagtcatgtttgtgtagattcgaaccaaattagtcaaatggtgaccatatggccataggaactgggcgggtggctctctgatagctacaagatgcatttctctctgtacattggaaatatgggatctttgtgccacttttcaagccatctcctccctgctatggccataaatatgcaccacggtggggacttcttttagttcgtgtcttgcttgcttagtaattcgagtgaaaccctgaccctttcccatgaacaagacaagctttcctgttgatacagctgcccttcgttcagacactcaatatattccctaggccctcacattgaggagagagtggtagatagacaaagagggagagagctgagtgaaaagcagtgactgctttcagttcggtttcaaccatgaagagaaagcagttgatcatgcacagccttttgattgggtaccgagctcgaattcgcctatagtagtcgttgccaaccaagtcaaggcgg

SEQ ID NO: 107883 - DNA, 504 bp, Oryza sativa
cgagctcggtacccaataaaacacatatctcctacaaattaaacagtgtcgcgtagcgcaagtctgaaaatataaacaatactctagcacaagattgattgtcttttggttagttttgcatgctactcagataatagacaaaatgcccttgaatgcccatgatttatcaggtacacaaaatatagattgggcattctgcctgttaggatggaaacatcactaaaaatcatcagtattaacaccaaaaactgggtaccttttggagggggaaaaaagagacagatggtaccttttggagatcctttttccataatgttacaatctcagggactttgctcggaagataagatctcgacatcaatgctgattgtggtatactaatactttatagagaatataacgtgatcaccataaaataaaaaatacattttctgaataagcattgtactattaaataagatagtcttgccaaatggcaatacctttcgattaacaattgaagac

SEQ ID NO: 107884 - DNA, 683 bp, Oryza sativa
ctctcactctcctcagacccttctggggtgtattcacgcacggatcgatcggtttggcatggaacgtactactactactgctactcatcctgtaggctgtagcaaatcatgcaaaatgatccactgctactggcccctactgtagcaagtagtagtagtaccaattaacctcttgtcaagacttgtagtatctacctcaggaggccattttactttactgatattttttattcgcccttttctttttaaaaaaatacttattttgtcctaaaatataacaatctattactttctttacttcaaaatataggatgtaaccatcttttttttcataataaaaagacatgcatgtatacaattaactaatacatccaatttctctagattcatcttttttttattatagaaaaaccatctaccctcaacatccctaatcatattgagtgcatccattatatttattatggtaatccaaatgaggaattatatttatctttttatatggctgaatctctctttagtccgaatgtaactcaaattaatatcccgatcatacgaacccgttatttaatttgtttttcaagtgttgttcataatcaacgtggagtttactggagatcattgtcgtgtcccctgttgtttctatgcatcataaaacttacaataaggccaagcgtgattca

SEQ ID NO: 107885 - DNA, 538 bp, Oryza sativa
gagctcggtaccctctcgctctttgactctaaatattctacaaatgcctctaaactgctacgtggtgctattaaattaaataaaatgctagaaaatcttaaaaaaagaacaaaacattggctattgatttgttagttttttaataagaaaaaaaccccaaacctctctctctccctccccacccctatgcggtgttaaaatccattaaacattttataaacacctctaagctactatatcacatactccttagaattttcaaaaaaaagataattatatataaaagttcattaaatatcttaaaaatacttttaattcgccaagtggtaccttacgaacgctcctaggtcgccaagtggcactctaatccaaccatcgatttttatttaaatcggtgatctattatttttatcttagaaggttagattttttttaaaaaaaagcacgcattccgaaccttccgtcacgtacttaccaacgagctatgttcataagaaattataatcaaaattatttttacattaaaaaaatcacaaag

SEQ ID NO: 107886 - DNA, 622 bp, Oryza sativa
ccatcagaaagaggtgaagtagccaagctggaccctcaatgacatacacctacttaatgcactctctgcggaatcaagagaagtacactgaagcatgtcacatttggcagtgcttgctaattataaattattactcttagcagttctcacatgaagatatatttatatacttgcatgccatgagctatcagtttttacttattacttaatttgatgctagatgtctagcttctaaacctaaagtaatttaggtagagcaagaccttgagcctcttgagaaaccaatagaaacaaggaatcaaacaacagcagctagcttcaccagatgaggaagaaagacttccataactcacttgcctgaggcgcgaaagaactgagatcttcaacgaaagccccccaatttcattgacccttacttaatgaccagtgatggcgatttatgcttttattgcctcccaaacttatcattcttactcaagcttaagaccaggacagaatagttggagtataaataaataaagttatcatacgagtcttggacatatgcaagttgtgtgtgtgttttgccaaggagtgcatatgccatatagttcaacaagtatcttgggtaccgagctcgaat

SEQ ID NO: 107887 - DNA, 776 bp, Oryza sativa
tctactcccccttcgtagatggtctaccctgtttctccttttgtttttgccgtacaaaccgatcgccgatcagttattttggtgttcagtttgccttttgatcacaggtgttcgctagcaggaacagcagctaggggagagtacaagagagtgaaaaatcagttcgccggcttacacattagcccttgtttagtttccaacttttccttcaaactttcaactttttcatcacattaaaacttttctacacatataaacattcaacttttttcttcgaattttcaattttaatcaaactttcaattttggcgtggaactaaacacacccttagttagcttggaccaagggtccttagcctgtaccttttctctttcttttcgccatgtacagttctcttttttctatttaataaaaatcaatgaaccccctccaaatatagatgctgagatttgtaacctgcgtattcttttgtacttaatgaaatgataggagagatgtgcacgcttcgcaagaaacatgcatgaattttcctatatataaatttccaagaaacatattaaatccattgttaatttatttcatttatttgtactctcgaataattgctaaaaattattcaactattcatccattcaaccattcggcacataagagtattaattccaacacatccaaattgcatgctgtagttctcaggcccacactttttccttttgttttgatcatcacgatatctggcaacattgtcgctgttcatggacgtgataatctacat

SEQ ID NO: 107888 - DNA, 740 bp, Oryza sativa
acaacagggagtagtttccgcggattgagaagccagatattcagggcgagtggtggcgggccggaggcggaggcggtcggatctgggagagggggagcaacgaagggcgaagacagtaggggtctttgtgatgaaaatcaggtggttctagggtttctgtaaggggtcccttgggccggtattgttatgggcccgatggctcatccttagcctttcttgcaactggacggcacaaaaaaaggaaaaagcggcgaaaaaaaagaaacagacgaaaataactactggaaaccttacgtattttttgattaggtatagaaatgaatggctattgcaacaagagtgaaatcaaggaatacttacctttattggagcatcaaatgacttggcaacactgaccataactggagtgaagaagacccagaaaatatcatagaaaaagagtccgctctgaattaaaagggaataccacgatacacaaaagttacaaattaaaaatgctttacacaatacggtggtgtatacaaatatggactttaatttcgcaagcaaaagaaaggcaaccataaattatagcatatcagaaaattcaaattatcattgccatgctccactagtaatgattttgatggctgaaataataaaaggtgctttgacaagtaccaccagaaaatataagttttagttcatacaaacaattcataccaagagaatagcaccacgtttgaatgatacaagtgata

SEQ ID NO: 107889 - DNA, 3722 bp, Oryza sativa
gcaaaaatttactatgtgaaagttgctttaaaaattcatattaatctatttttttaaaaaaattagctaaatacttaattaattatacgctaatgagtcgctctattttacatgcaatacagattagttcccatcagtagcaacgaacgcagaaggggacggccattcgctgccagtgtaagataactataattttgtgttaacgaaaaataccagcgaagatagaaaaccccggtaattttgattgtttgggagatgcatggattaccggtgaaaatatgtattttccaaaaaaaaacagagagagagatcatgatagctacctagcaggaaaagagaactcaaaattgatcaatttgtcaaagcgtcagaaataataatcaaaatagatcaacaagtggaagggcgaacgaacaccagtagacgccgtggaagtgggaagagtggagtgctcattgatcggccttgttggctgaggactcctgggtgtgggctcaatgggagtttctccctcggttttaattttttttaataagacgtatggtcaaacgttgtgcgaaaagttaaaatggaggggtactatttttctacgcctaatgggccttctccaatagatttttatctaaaaactggctcatccaagcacatattgtgttggttcatcttgaaatattacatggtggtatttttcacctgttttgtgcaaaatattgagctttagtgcagaccctaaagttttttttttcttaaaaaagtatcatgcaggttccaagtcggtagacagttagattaatttttatttagataaagcccatgtttgactcttagcctctaaactagagtataatgcgcgttgggatagtatttctgataaaccttttttgtccccctaaagcacaagagaattgcgcttcatttcttttagaagagaagaagaataaagaggggaaaatgatcccaccctaagagcatctccaacagatgtacaaaattaaaaccccacatatcctatattggggacagaaaaaaaaatatttgacccaaaatacactcctttaaaagatgcctaaaatattggttcccaaaattttaaaatttaccacatcatcattagtgggccttctcaactaattttctaggcgctcgctaaaatcgcgcgcgagcgcgtggtggaggagatcgcaatgcgcgtggaggactggacctggtcgatcgtgatcctagtcgcgcgggagatcacgtgtgagcaagtataaaccagggaacgacggcgagtgagagatactcaaagcaggcaacggcagtgagctgcaaggattggtgacagtcacaagcacttgtgcgtttaaaccattctagcacaggttgcaaaattttgctaacaattctttgttatatttcctttttctcacgtttctgatctgacaatgtatttatggaaaaatcttgatttgatatgatgaataaatatttagaaaaacgaaatttctagctgatcattctacatgacagtgtcattaatctgcaggttagaattataggcaaccctcatgttaggattttcttctatcaatcatgtcttttttatatatattttgatctgacaatgtcgctaggtgaaaacttatttagttgtgatgattaatggttggccagttgatttgatccgtgatgagtcgtcctcgctcctcagatcaacggcttgtggatgaatcatccgacatgatgattttttttggggggcgcaacacaaaacctgcatagctattggcactttgacaatgcaccaaaacatggtgggtctgtgatgggacatgaagtggttgatcacaacagagaagcacgtcacttgagattataccaatactatttttctgataatcctacctatggcccagttttattcagacgcaggtttgtattaagcctattttatttgatcgacctttattatatgaatagccaaccatttatgtctgcgcaggaatagaatgagcagacataaataatgaggcataagtaatggagaaaaaaacagagacatgctcattctattcctgcgcagacataaataataaggcatacgtatctattcatataataaagatagatcaaattaaattggcttaatacaaacctgtgcctgaataaaactgggctataggtaggattatcagaaaaatggtcttggtataatctcaattgacgtgcttcttcttttgcgatcaaccacttcatgtcccatcatagacacacagtgttttggtgcatcatcaaagtgtcaatagcgatgcaggatttgtgttgcgccccaaaagaaaatcatcatcgtcggacgatgattcatccacaagccgttgatacgaggagcgaggacgactcatcacggatcaaatcaactggccaaccattaaacatcacaactaaataagttctcacctagcgatattgtcagatcaaaatataaaaaaaaaacgtgattgatagaagaaaatcctaacatgatggtcgtctataattttaacctgcagattgatgacactgccatgtagaggatcagctagacttttcgtttttttccaaatatttattcatcatatcaaattaagtttttttccataaaaacattgtcagatcagaaacataaaaaaatgaaatacaacaaagcattgttagcaaaattttgctacctgtgctagaatggttcaaacgcacaagggcttgtgcctgtcaccaatccttgctgctcgctgccgttgcctgcttgactatctcactcgctgttgctgactggttaatttgtacttgctaactcgtgatctcccgcgcgactaggatcacgatcgaccaagtagtccaggtccagtcctccgtgcgcattgcgatcgccccctccgcgctcgcaggcaattttaacgagcgggtagaaaattagttgaaaaggcccactaatgatgatgtggcaaattttaaaattttgagaaccaatattttaggcatctcttggagaaggattgtattttgggccttttttattttgggctgtccccaaaataggatttttatgtttctaattttatatatctgttggagatgctctaagaggcagaaaataaattccatgttaaaaagtctaacgaccatacagaaccaaatggacgaactaagcatcttgggcgactgaccggacaagaaagaccaacacagttatttctggtaaacattgtacgctcccggtgcatacaactcgaatggaggtgatatgggcatacaacccaacacagttatagagaaaaccaaaaatcccagattccatcagcccaaccaggtcgatcggcccaggaagagctcaacgcgtacggcggcctgtgactccgtcaccctgtagtatatccgagaactatggcctgttaaactttgctctaggatcacctaggttagatctaggtcaggtggttctatttgggttgatgtttgaacaatagagattgaaaagggagagggtttagatagaccgaccggttgaggtgttggaggatgaagaagcgtcggccatcgtcgtcgtcgtcgcgtggttgtcgcggatgcggcgccggtgaggttgacggcgatgatggctgcggtagtggcggtcgtagatgtcccggcgatgaggcgtggcgcggcggtggcgtttcccgtcactggctgcgccccctctcgatcagttagggtttgtgggg

SEQ ID NO: 107890 - DNA, 5284 bp, Oryza sativa
cgccccggcctccacccctttcatatggcgcagtgtgatgggggcccaccagccattgggcttggcgcccccgaccacggcgcggtcaaggtccgttgtgccgttgggcccgacggatgggagatctatctaacatggccaccacggtcgccagcgcaacacctcagtcacctgccactcagccggtcggctacctcaacgccggtcacaagtggccgggcttctcatcagcagtcagctccttcctcggcttcttcaatttcaggttcaaatataggacccccgtttgatcgatcgggctccaacttctaaatttaactctaagagttgattccggaatagagtcatggagctgtctaacttcacgtctagttcatttttaaagagcacatcactcaatttcactctcattttggatggagtttaaaccgtttggttgggattccgtctaagaggaaatagagctgacgctgtgccaaacgggccttcaaaaaccactttgtgcgttgtccgtacttcaaaagggctctagttgactagttcagccctagtactcttaggggtagatgtgtacgtagtgtgcttcttgaaaaatggctcagttctttatggcctacgttgccagtaatgaatatcagaaaaatcactggacaaatccgtgcatgtgtcagttatacttgtttcgttgtaagtaatataatgctatttttatccggtctcaaacactagtaccacttgttattttcagagagaggcttgatggagatcattagttagtttagcagcaactggtacccacaagtcagcaactcgatcagcgacggccaacaagaaatcaagtcaactcatactttttttttcctcgaatacacaggaatcaacttacatttcatactttagcactccgtaaaacgttgttatatttaactccgggagggaaaatatctcgtgtggtaatatattcttcaggttgttttcagctggtgctgctcggtgtgacactgtcctatctgaagattaaattttgtgttttgaaatttaagctgcacaagtggtagggcagtttcactgtcaactcaggttactgatctgcaattaacttgtatatgtgctgtctgggtttgatttggccctgatgttggggatcaggtaatctactagaaagtagacgcgtccgtgggcgcgcgtgctattataatctgtcttatttaatgatttttttttcgggcttacgaaaaaatctaatataaattgcttcctgctgataaatggatgaagataatattagcaagaattactttagatattaagtgttcaatggaaaagaatgcgagcaggttgatattggtattatggaaaaggtcgtcaccgcaattctaccacacccatctacacagcatggtccttcataaatttaatctatcttttttgcatcataaatttaatttatttcctagattttcattaataaacttgcaaaagcctaaattattgagtacttaacacgggtgatatagagagaattagatgttatatgtcattaatatgtgcgtgtgtacatccatagggtcacacattgctatacgatatttatctaaaaaatatatgcttttgattttattttctcacgttggttaattgatttgtacagttttttcgaaggtttgtttctccatgttattcagaattgtaataattcttcttttttttcatcacggtaaagctagctacatatagttttttttaggttattcctaaatgatctacatatttgtgttcatttatttattcgttatttgggcattagagtaaatggacattgatgcatgcatccatgcacacaagtatttataacccatatgcaatatcttgatttgctattggctagaaaatattggggatggtgcatgcattaaatttattgctatagtaaatataatatgagagagttattattttttttcttggtgtagctattaatttggaatggagggagtaactggttagtttggtgggctgcatcgcgtgaggccttggcccaggtgtgcttgtacgtgcgcgtgattgatttatcgcttaatccagaacagccgcgtcactgccatgtacatgacgaaaaagaaacgcaacaatccagtagtagttatttcaccgtttttcatccacgtgtcgctagttagttggcgatcaatcgaccaatcagctgacgcgaacgcagccagcattaccgagatttagatactctcgtgcgcgggagtatcctcgaaccatgccgcgccacgtggcgttggtgttcggccgggaacgcgcatggaattcggtattagagatatcaaaccttccttctaatggaattgcattcaactctctgcatgttctgaagagacaaaatgtatcactagtggcagtttaatagtacatgcagactactgactacggattttgatctctctgtctaaacctctgctttgctttgctttgcttctctgatgcttgattgaacacaaccatgcacagcaagctaaaactgaagtgccaagagataatccattgtaagccaaacaagttgataagaaactgtagtttctttgaagcatagacctgaatacttccattatattaaaaaaatgttgatacgaaatcctttgaatgagacatagcagaggagtacgatcttgatttggcaccggtcatgcaaccttcactgaaacagtttttgcataatttctgtcccattataaatatgtcattttcgtcctaatttggattgtcttagccttatcctgatacggtatcaatatgtcttagcgatacaaaattttactagcgttcttccttgtactatatgtagaacatctttgtggtccagcaaagagtaccggccggtactggtaccgctcggtaccagtacacatctggccgttcattcctgtatgggtaggatggggaatagaaattcgctcggcgctcgctcggtccttctccttccacagccgcgcctgcgccctcaatccatcgtccccacgcgctttcttccgcccccacacactttcctccgcagcccaacgccggaaattgattaatgttcgaattgctatggagagatttctttagtaaaattgatttctccttctccgccggtgcccaacgccgcccaaccctaaccccccatatcatcgtctgcgtcgtccttcgtcgctcctcggcgcaagggttcaactcgaactcgcggcgcaggagcatgtacacggcgacagcagcgcagaggataacggcggcggtggcggcagagcaacatgggagtgaaaggcaaggagagcaaatactagggttcgagcgagctgccagccccgatccatccctcctgatccatccagcagcaacgcgaagttacaataatacccttccaaccaatttgtctaggcggtaccgcatcagggacattcttggtaccgggcgttaccaaacaatcccagccgttggatcaggccagatccaatggccaacattcagtaccgccttggtaccgcccggtaccgttggacggtaaaaaatctcctatatgtaagatactttttgtgaagaaaaaagagacatacaatgtgaattttctttgcctgtacatggacattttgattttttttttcataatgtatatatatttacaaactattacgatgcaaacaggtcggcaatgccaccaagtaaccgctgtaaattataactttttttttcactggaacgcttgtctgctgtcccctactgaaactgaaagtgatctccctaattcaaaattgcagatattttcctgcaaaagatcagcgcatatcaacagcttgatatcaatcacccaccctcataaaaacaattcaacccctccaaatctgcatctcgatcatgctgacattaataaataaaccagcaactagagtgcatgcaatgtcgaacattgcttattacagttagcacgtagtactatatagtacacgtcgcgtcatcgtcgatcatggcacatataaaacttgacacaagatggtgatagccaatttcttgaagtcagtttagttatctgtattgaaaaaaaacatatattgcaagtggtttattccaaggtcgttggtgcttatccatgttgcatactaaaatatcttgatcacgcaagctaaacctactttggcatcagctatatagtttgagctttgaagctcagggatatgtaattgttgcaaacaatgcgacaatatgaacgagtctttcaagcttaatttccaaaatagaattttctgaaaatacaacccgcagtcgtataattgtcattgttgtctgaaattactctagtgctgtgagcacagagttttaagaaaaaaacgtattggatgtcatattcatatgaaatctgtatgatgttcgtttcgaaaaagaaatatgtactatgtctcaccaaattggaatttgttgacaaagatgattccacagtgttgttgactttgtttctgcatgaagcacgagaaccgtaaaataatactatttggatgggaatttcaactgctggatggtggaagtaatatgtacaatgtcctatataagtgattttgacatgactaacgttaattaattgtgtcctttaatattaagaggaagcaaatagatttttaaaataatgggtccaccaatttaaatgaaaatcaatggtgagattataaaatgccacgtggcgatctaggagcgtttgtaggagcgccacatggcggtttaggagcgtttataagaagattaatggacttttagtatataactaggaaggtagccagcacattcacgtgggcatgtattgtacagaggattaaacttttcggtttagccaatttgatcgggtatctccaaaattttcgaaattttggtccgaaattttggacaaaatttagttgaatttgaacaaatattaccaaaattcatgaaaaaaaaatttcggcagaaataatatcgtatcggaggggtctgaaatgaccgaattttccgaccatgattgtacattgcgtttgaaatatatatataaacaaaatataaatcggctgacacctcccatgtttaaaagtacttttgttatttgaatacgacacatcaggtgaagcctacgctgttcttcggcattttgctttgataatttttccaagatgtttgttaggttttaaaaatatatcatatttaatacatctgtataaataattatctatgatctctttattaatatagaagagaagttcgatttagtttggtttggaaa

SEQ ID NO: 107891 - DNA, 607 bp, Oryza sativa
atagggcgaattcgagctcggtaccccgactccgtccaaatcgatgtttatcataaccttttgaaagatcgggaaccctagtgcacatcacaccctaattcgatgatgaagctggtgccctccacgctcaagctgtcattgtcctcaacgtcaaagggctggtgcggtctcttcctcgtcgtcttcggcaagtacgcgctcacggatcacgtcctcgctgacaactctcacctcaaccacgtggattgggcacagatggactgcgtcgtcctcggctagctataaggcacgatctccgccgacttgcttcaggaagtcatgttggccacggctacggctcgctctgtttggtgtgatctcacccatcaattcctcggcaaccaagaatgttgcaccatcaatgtcaacgccgaattccgcaacttctctcaaggcgagctctccgtcaccgactactgtcgttgcctcaagtccatggctgacacgcttagcgacctcagcaaacccgtctccgatggtgcactcattctccacctaatcaccgggcttaatccccgttttggcaacatgcattcacttttgtccatgtaaaaaccattcccatcgt

SEQ ID NO: 107892 - DNA, 522 bp, Oryza sativa
agctcggtacccccacatgccccccaccacggcaccgggggcagctgggccatattcacccggtatttcttcccctacacctacgacatgacaagtgtacaggagaggagcagcattctcagcaagattttggactgtgtacgtccgtgtgcagtatatggtcctttctttatctccaaccaaagttagatgaagattacacgcttttcaaactactaaatggtgtgtttcgtgtaaaaaaactttctatatgaaagttgctctataatatcatattaatctatttttcaagtttgtgaaaattaaaactcaatcaatcatacgttaataccacatcgttttgcgtaaaaaacttaaaacctcattttcatttcatcttcatcttcaggagaaaagaacgtgcgatatgtgttcagatcagcctgttcacggtttgggctcaaaccgttcaacccgtgaaaccaaaccaacccaaaccgtttttccatttattcacgggctggtttgggaccagcttaaccc

SEQ ID NO: 107893 - DNA, 693 bp, Oryza sativa
cccgctatgccgtacgtgtcagcgcgtgacaatgccgcggaatcaaccggaagagacgctccgcatgcattggcggctagctttgcgaaggctatttgcagcttaaaatgtctttcagaattgcctagaccttactaattagtagtgtatcaaattaaaagtatgatgctaattgagagcgtctgttgagcggttaaaatggtggtgggaacgcgcaccgagccgggcgaggcgtggattctatctcccttgattttggctctccgccgttagacacctccattcatatggttgtaagctgcacttaggttctccccgatcctgagcacttgcgcacacaagtattcggacgagcaggtcttaactccatccaccagagtacctgcaagggcaggtggtgattaaatttttggggagcgcatccttcatgcgactgctctgcgtcaaactgacgctacttcatctacaccgagccatctctacttcctctgcatcaacctccggaccatgttgattagtaccggaaacagagacaatggcggcaatgaccactggggcgactacaccaacaccaccgtctctggattcagattattcttctgtacattacgcaccctttttattttagtgttaaacatgttactatgatgatattaatattattagcactatcattgaatcatctattacttt

SEQ ID NO: 107894 - DNA, 589 bp, Oryza sativa
tcgagctcggtaccctggaccaaatgatgtactttcagtaaacaacatgcagatgaaaaggaggaaaaggcttatactatgagagtctttgaatctgattttgaggcaaaagctgcccctgaatttgggaacaccctgccaaaatcaagtaataataatagcatgctaaatagtgaacagagctctgatccacctgctggaaacaatggtcctgttttgcaatgtactgctgaaaacttgatgcacgtgactgatgctgcaaatgctgatcaattaaagtctgagaacagctccccgctagtccctcagtcaacagagagtgaaattggagatgaaggtaccatttagaaactttgtttttttaatttacaacatatgcctctgttattactttctgaatatgtattgagccctgagcatggttaatatgatgcaggtaactcgcgagtggatcacaaagagtgtagaacaccacataataatgcaatagtcttggaagaagtgaatgtggataaaagctgcattattttagcttcagatggagctgattcttcgatagtcagcttcctggacaaagaagaaaatgcaa

SEQ ID NO: 107895 - DNA, 852 bp, Oryza sativa
tactttgaaatataaacatgtccttataaacttaattatcgtgaaattcattagttgtttgttcccatcggaggtcgatacagcgaaaaagaagggggagggctaatgggcgggtgatcgtccacagcaatcgcccccgtccctccctctaacacgcacgttactttctttccctactgcaccgtaaatttcccaaaaaaaactagttacaaaaaaataaaaaaaatagaaaaatctaatacccttaaaaatatattcatgtgcataaactttacacttataaatatataccgtaaacttcgtacgtataaacttttatgtatagaaatattctatatagaaaatatttaaatccaaatttaaatttgaatcgggtatataaacttttaacctataaattttaggtgcgtaaactttagatgcataaactttaggtacatcttatcttaactaattaaaagattcatattttccgatcgtcacctcgtccgtgcactttttcgtccgtcccccacccccaaaaaaaaaatcccagaacacaaatacgagtctgcatcaaatttggatccaaatcctagagaaaacacaactataagaacacaagaacaagaacaacattaacacaagaacacaagaagaaaaggggagggtgtgccaccgtcgcagggacgcatgaacgctggcccgccggcggcttccctcccactggatcctgtggaggggaggacgccgccgccgggccgccaatgcctcccctccccttccgccatatccgggatgccggaactggcacaccgggttgccgccgcctcctttcctgctggatccgacggaggggagggcaccgccgcc

SEQ ID NO: 107896 - DNA, 1370 bp, Oryza sativa
atatatatcggtttcttataaaagattttccagtttttattaagaaccagtatatatagatatttatagggtcggtttttgagtttataaatacatttatatttgtatttttaatataaatatagatgtcggattttaaaaaatcatgatctactactcctagaaaaacaaaactcaatggactttttatttttgaaccattttaatgcacgaggagttttttatgtctcagcaagaagagaaacaaatctaccatctgaatagccgatacatataacaacataacaaacgatatgcataatctgcacaccattttgtacacctatcgaaaaagcattcatcgataacccataaaatgtttgaggcgattttcaatctcatcgactaggtgtgaacggagaaaacatgtgcaatcagaatctataaaatgcaatggatgcatggttctaagtgggttgatggtctggttaatgataggaaatgttaaataatatagctagggcacttggccctgtttttcctagactaatataatttgtgagcacacttttaaacaccttgatcggatacgatccatttgaatggttgtactctagctttacaattaaatcagaccaaccattagagaaccctcttaagcatagcatatactcctataaataggatatttatatatgttgatcagtatgttatataggagtatgaatagaatatggaaattctaatttatattaatgaaacagaggcatccgtttaggattaatgaatcagatttcatatgtgggctaaaaacgttttttcaattcctaactaatttcagttgttttttcatttacattattagttttagcactattttatccactaaaatttttttattgtaacttataattttctctatattagattatttatagctaaatttaaaaatgggattaaattacataactttattatcgttccggacaaagttatttatttgtagttgaaaaagtacgagttaccccctgaagtattgggtgagtatgaattacccccctaaacctgaaaaccagtcatttttcaccctcaactatcgatacggatgaaaacccccccagcagttttgtaagcggtttttgtctacgtggcagtccagtcagcaagttttttattaaataaaggatagggcccacctgtcatgacataatattctctctctctctttccctctcacccctctctctcctctctcccgttagatgccagcggttgcggctcgcgcgccggcggcagagcggcggggcgaagcagcggtggcagagcgggcggagtggcggtggccgaagcatgccggcaatagcggggcgggcagagaggaaggaggtgag

SEQ ID NO: 107897 - DNA, 1178 bp, Oryza sativa
gccccggccccaccactccccgccgctctcgcggccccgctcaccgcccgtccgcgcgtcgccgccgccacgacaggagggcacgggcgccgtcatgcccgccggccaccggccgcctctccaccacgtccgctgcgcccccaacccgcccgccgcttgccccggccccaccattccctgcagcgcccgtcgccgcgctcgccgcccgtttgcgtgccgctgccgtcgcgcactgcccgttgacgcacgcctgagagagaggagggggagggggaagactgaagagaggtaatgacaggtgggcccttgtgtgtgtgtgtttttttttgctgattggatttccacgtcgacggtacgtgtatgccacgtaggagcaaaaccgcttagtattgagtcgggggggggtgtaattcagccggtatcaatagtttgaggtgtaatatatccggttttatggttcggggggtaattcgtactgtcagaatagttcagggggtaaaacgtaatttttcctttgtagttcaatattgttgtttatacgtttatactttcttcatcatttatgcccaactatagaatatcctttaggattttaatttatgccaatgaatattatttagcactcgttgcaacgtacggatattatgctactaaacttaaaaaagataaactatatggagaaaaaaaaaagaagaaaatagtgggaaaaaatcgatcgccccatgcgagcgctaattagcgatctcgaaaagaagcgcacgcacacatatgccacgcattgacgcatggcacgggacattgacaactgatgccgtcccggagaccgggcgcgtcgatacagctaatacccgaccgcaacgtggcgcgctgacgctaaaaaaaggttgcgtgaaaacgggaacgcatttgctttcacagtggcgctacgctactgtacgcgcaatcccgttcccttcctattgataagataggaaggaatcgtcatcttcattagcgtcctcagtagtactccccaccatcaccgcagcacagcaagaggcgtagttgcgccagccattcccccttccattattcatcctccacctcagtacaactccggaattctccatccaaatctcaaccattccacctcgcgtagtcgcgccgcatctcgcatcggggaggggggagggagggga

SEQ ID NO: 107898 - DNA, 692 bp, Oryza sativa
agacatggtcgctaaggcttgatcatgctacatgtatttaatacaggatcagtgcctttttagttgaattaatgctgctttcacacttttctgtaaagaattagtaaacaagttttactattcaaatatgttaccatttctttttctgaaataggttttgtcctctgcgtgaatgagtggatcaagatccacactcacgcatgcacaatactgataataatggaattcctttaagcctcttgaatcttgtgaattatacttccgtccctgcttgcattgcttgcccttttttttttgtttatgtatttcatgaggcctcataactacttcaatcatccttccttttctgcccttttatattgctattctcaaacagtttgcatgttccagagtagactggtagcatgtgattataatgctttagtttagtatcttgtggagtcatggtttgagaaatgtttgattacctctactacttaaaaagtggagtttgtgttgtgattgtgtggtctatgcataacattgaaaatctatcttggatggatctatgttggtacatgtgtcatccatagtccataggatggtcaatggccagttgatgtggtttgaattatgtttgcagttttgaaggcatgaacataattgcttttccccatctctgtgtttataatttgttttatatttatttgaga

SEQ ID NO: 107899 - DNA, 675 bp, Oryza sativa
atttttagttgaagtttttggtaggggttagttgcgaaataatgtcacgcccggaatttctatccaaaattctaaacgcttacatgtgtgtgaaccctcgtccaggaatcagccgaggcacacaataacaaattgataatagagtacaattattattctaattaataagcgaataaaatgtcattacagaggtagatagttcctctcaaacaataaagatctaagcagcggaaaataagataaacggcgcagacggctccactccacaggcagcttgaccaaggctactcctaatcctccactccatcagcctcattggagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttcagaatttaacaaaacagttaagtaatttaacaatattaatccaacgctatacaacataccctgttgtataggcccaaccattctgaacaaccatcccggctgcacagttctatcttcaaaccaggaatgtaccattccataccaggagctatcaaattatttccaattatagcatcatttactatggtgagaagtgtgaaactaatcacgaaag

SEQ ID NO: 107900 - DNA, 537 bp, Oryza sativa
attcttactcttcttgcctttggcgtgcttagtacgtgaccccacgtggtacgaaaggctaggaggaaagcaattcccgggattcaatggattctcttcattgggctctctgctttgcacactaggctgcaagcttgacttggtgcgaggaggctggtttagcgatgcctgccctgctaaaccaaaggaaggagcttctttggtatatacccatggacaattcagggcatagtgtccttgctctctacaatcctgacaaaaggggacatcctcttctggcattggaagctcattgacctgggtggcaaatgctcgatcaaacacatactgattttggtcttgacttcccaccaatggtagctgtgaaccaagcagcatgcttggaatggaccaagggtgtacccttgttaactctcttgaggctagtggtggatggagttgaaaacttgagttactggaggcatgcctgctgacattctttcctttttctctgttaaacatctgttacaaggattgaggtgagagaggaaacaagcc

SEQ ID NO: 107901 - DNA, 735 bp, Oryza sativa
ttgattagctcctggtatggaatggtacattcctggtttggagatagaactgtgcagctgggatggttgttcagaatggttgggcctatacaacagggtatgttgtatagcgttggattaatattgttaaattacttaactgttttgttaaattctgaaatgtttgctaaatgctgcttttgcaaatgaaaccctattatgccatcctttgttatcctgtgcacttgcatatttgctacgtggcttgctgagtatgtcatatactcaccttgcaatcattcatcagaggaagagttctacaatgaggctgatggagtggaggattaggagtagccttggtcaagctgcctgtggagtggagccgtctgcgccgtttatcttattttccgctgcttagatctttattgtttgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgcccaatggttacccatagaagccctttaaaaatattggaaaaggaaaactgttctccttcctttctcttttaattaaacccaactaatggcgacatgcaattcataatcttttttaatgggtttt

SEQ ID NO: 107902 - DNA, 2318 bp, Oryza sativa
  unsure (1)..(2318): unsure at all n locations
acgggtggaaccgccggtcccaccctgtcggcgaaggaagaaaagaagggacgcaaaacagacttttgcaagcgggccaaggaagaagggacccggcccaaaaaggaagaaggcgcgcggnccgcgggaaagaaagaagggggaggaatttgggccgagcccgaaaggaaggaaggggaagtttattttgttttctttttatttaaattgattcaatgatctttgtgctattaaaactatttctcgagctccgaaaattcacggaaaattccggagagtacattagggcacaaagaatattacaaaatattcccggccattgatttttaagggaaaatttcaagttctcccattatttcacttgattaaattgatttatcttttatttaatttctagaaaatgtattattaatgatttttaatcccgaacgaaaatcggggcgttacaaatctaccccccttacaggaatctcgtcccgagattctgggatggctagaaagaaagctggtgctggtgggcggtttgactgatctgcacattgaactgccacattctgcttcgaactgattgattgactggttgatcaaacctgcacgattgaactggctggattcgacctttctgttcctttgctttgcgaaaactggaccgactggttctgcatgaactgacctagactagaactgtggctgctcacgaaacttacttatcttgatctgaactgttgatactggcagtttgataacctgacaattcaccaggctggctagagaagggtgaagttgttcctaagacttgcatctggcatttgtaactcattgatcctacgtccgcttgaacgggtcctggctcgaatgacacgtaattccaggaaacctgcttgacctgtcttttgtctgaactgcaaccgtccctgatgctgcctctcaaatctaagctattgacctggcctcaccggtgtacctcagaattcaatcagatttcttgagatcggtgtaactctgctgacaccttgcaactggcttcttcaagtactacccggattgttgcactgggttgaaccttcaactaaaacagcgatgaggtgagccaaaactcatctccgagacctaccccccttacagtgggtagtcttactttctcctgactgagaacctttgaactgttgtccttgaaaaataaccaacacttctctgatttgccaagagccctgactttgaaaactgaaaacttcatcggtccatcaaattgaagcaatggcgatgcactttcaccccgacaagatttggaacttaacccttagttgatgataggaaattccacataaaagtgactctcatttagctcatgaacacactgactcttgactaactttcccataagttctaactactggcatgactgtcctgcttctatcttgacttcggtgtcgagtttcaaaaactgaactaaccgactctgcattggaactgacacaactcgaggagttggggtgtcgctaacaaagctcttgatgtgatgacgctgacgccttactgtggaacaaccctctgagaggtgccctgtcatacatcttccatggatagttggacactttgcaaaaactgcgcttgaaaaccataaccacaataggtagcatatattactcctgggattggtggtggcttagctgtgctgatttgctgaggacttggtggcgtactatctgaggttgcgggtgcttcctctttgaaaacaaactgactatcgctctgatcctgattccggcttgcatctgagcttgtacttgttgttggagacactgttgttgcatctgttgcatcggactttgcatctcccgcatcaatacatccatcatctaatcttggacaccaaatgttgatcacgagcagggttcttctggcactgggataccttgtagctttcaactgaaccattgattggtgactttaatacaccgtcgttgctcttctctctaacactgactatcttctgccagggcggaagagaggaggaagagaggggttgctaaagataaggtactaagccacttgcctactgatctgttgggagtagatttttatttttcaagttgcttaagcaaacaacctagtatggtcgcatccccaccaatgatgcaaaccatacccctacacacaagcaaacaacacacgatctagaagctaacgaaactactcttcagggaaggattgggtttaggtcatctccgggaaaactccacttgatcttcgcggaacgacgactccgggctgaacttttgctcctactgcacgaagcttgaggcttgaattgactt

SEQ ID NO: 107903 - DNA, 1139 bp, Oryza sativa
cccaaggattgccaactcagtgtgttgttgaccaagaccgcagaaatccaacgaacaaccctacgattgtctcatcagctagtcagctccaacagcaacctcgacgatatcatccacagcaccaatgctcctcctgctgcacctgactctgcaataaatcatagcaataataccttcagcaccaaccattctctgcactgacagcctcagcaatgaattgtcgtcgatggaagaagttgtttctctccccgacctactccaggccgagcgaagggaaatcaacctcaggagggtgataccaagcagaagaccattatccacttcaaccagcaatcagaaggaatttttctcctgtgaatgatagcaatatgcagtcctatcacatcatcacagaaccaatcaaggatgatgcagtaactaggacaatgccatctatatctctccagaatcagaatgagtaaccatgtttgtgattttcagttcgctacttatcactgtaatcgaaagtttgcagcaatcatgtaataaataaatatattcatgtctagaaacagtgagcttgctatgtttatggatgattcatgttgaggatgcaatgtaccgatgttaagcaccttccctttttgtttaaggcagtgcctcgtattcatgtaatatgggagaaaggtgtaataaaaacaagttctatgaggactctttcagaagatgtcgatatgagattatgtgtataattgtttactgtcaaaggagacctagggtctcatttcagaggaaccatgttctaacctcgagctaataaccaacctgaggatggaaaagaaaatcaagtgattaaccaaagagacatttgtttggactaagagtttcagacgtgtctttttcggatcaaaggcaatgacagtcagtatagcttttggcgaaacacttcaaggtttcactgaaaggtagcagaccaaagtaccacatcgtcaccagaagcatccacaactctcggagtgaagagtacttagtgacaaaggtcaaaagatgactgataggaggtatcgaaaaagatgtttattaccaggcaaagaagtaggtcgaaaggtgattgataagagaaatcgggaaagaacacatcaaggtcaaaggtgtaaagg

SEQ ID NO: 107904 - DNA, 688 bp, Oryza sativa
tgtgaatcaaaacaagattaaggcaatgtattgtttatagatatcaagtgagaaattgtcaaaaataacatttctgatggagaaattctacgatacatggataatcaatatgtatcagatagagtaaattccctatgtacccatgaaaactcacttaatccctttcatacccctgaaatttacccgatccattctatgcccctgaaattttagcttgatctcttccatgcccctgctgttacattttccttcttttcattgttatgtttggttgcaaatgtctgttgtgcccttgatgattaatttagatttgaatataagcttgaaaaacgattaaagtttttgtttgagtgcacagtatgtgaattttatgaaactaatgagactatattattagagcaaaaaattttgaaaataaaacaaatgttataaattaaaaattgtgtttgaaattttaataggataatggattttttttgatcgggagtattcataaaaacaatatcgtgagcattggtagtcatatctctgtatgaatgctcctcattttttatgttttttttaaaaataaataaataaatattttttatttcattatctaaaaataaattgtcataaataatgtatcgcacagtaaactcataactatagtaatctcatgtggcaaacatttacatttttaataatg

SEQ ID NO: 107905 - DNA, 1513 bp, Oryza sativa
tacacatgcatttatctaaataaagtggtcatatactagaggttctcttatcggatggatttaggatcaatcaaattattacagtgaatcatttgtatcattattttattgatggaggttttactttaattatgaacatatttttcttgtcacaacgaattatgaaaggataataattatccatgctttgaatgttagagttgtttaggttaatcatattatggttacagattatcccttaatgaacaatcctaatttacagttgaactataattataattatatgaggtcaagatttataactagtatttatctaatatacatgtttgtcatatactccctctaatttaatatatgcaacacgcaaattataatactataccgtacagctataatgggatgtatagtatatgtgtaagcaacaatatcttaatattgaatcatttatttgaatagctgctatttactttaagctacatagtacatgtgattttaagtggatttattagtgagttactgcctatacaacttaagggtcgatttccaacctaaacatatactagtgtataggaaatgtcgttaattaatttcatattggtgatttaatcatacaagctctgctattatctctcataaacaagttaaagactcatcaacgtgtgttcatattttagtcacaaaatctgaggctaaactttatgtaaataatttataagtcatggatttagttatatttggacatagaccaataaatggcactaatattttcctatacacccattaatttgaaggatttattataactactttatgtggttgctacagtgacaaaacatattaaagataattatactactgtacaatatccatttttatttattagcacactatttaggttaactattatctaatcatttgatattaattaattaataattataaatatattttattaaatagtgaattatatacaattggaaagcttatgaatttagatgaatttaggttcaagtttcactcaaatccgagttaaaatgaataagttatgctagtgtaaagattcaaatttgaattaatccgagaaattgcgaaaagctactgtttataaacgatttatttttaatacaagacatatccacagccttgtaccaactgacaagtgggaccccgagtttattcctttttcctaccgaattatttttcaatgcaaaattgcacaggtgggcccggcctatcagtggctcgaatggaggtcgtcttcaacctccagccgggcagaggcagccgcgccatgcgcgctgggcgcagccgggatggcacgaggccggcacggcggcggccggggaaggtgcgacaaggttccggcgacctcccaccaccgtcagcgacgtgcggcggagcgagggcgagcggcgcagcatggccaccatggctgagctcgggttacaagtggctaggtcaaaagagagggtttctgaccaatttgatgggagcatgagcatctacggcgcat

SEQ ID NO: 107906 - DNA, 877 bp, Oryza sativa
ggcgccttttcccgctctccccgcgcgcgccccagctccgccgctcctcggcgaactccagccgcgccgcgccgccgctctcgttcaccccgcactgcgccgtcgccctccccggcatcgcagccgccgtgcgcaccccgtccaccgctccatttcccctctccaccttcgaagcgccgcagccacgcgcaccacccctttccgccgccgccgccggctccagccgcctcttctcgcagcttcagccaccgccgtgccgtgccgtcgccaccgtcggcatcgccgcgccgagctccaccccgtcctacacctcttttccccaaatctcccaccaaaattccacctccgctgtccacccgagccacctcaactataccgcctccagccgccgcctctcgccgctctagccgtcgtcgcgcagcgtcgccgcgctccaccgcaccctggctgccactccactccgtccagaaccccacgggagccgcttttccaaagtcaaggtcttgccggccctcggccgcggctccgttgtggccgggcgtcgtcggaacgttgttcccgtcgcctcccatcccagccgccgccatcctttccgccgccggtcgtcgccgaggccgcccgcgccgtcttcccgagaaggcgtcaccgccgcccgttgtcgtcgtcgtccttcccgcgtcggtgagcatctccctccgcctcccctccctttctttttctctctttgcccgccggccgccgcatgcgtgtcgccgtcgcgccgcgccgcgccgccgccggtgtcgccgccggtggccgtccggctgcgcgccgccgtctggtcgggttggtcggcgagccaacccacccctccgccttgcacctctaccgtggactc

SEQ ID NO: 107907 - DNA, 746 bp, Oryza sativa
ttcgaatagccgtgcccgcggttatgggcgggtcgaacaatgtctttcgtgattagtttcacacttctcaccatagtaaatgatgctataattggaaataatttgattagctcctggtatggaatggtacattcctggtttggagatagaactgtgcagctgggatggttgttcagaatggttgggcctatacaacagggtatgttgtatagcgttggattaatattgttaaattacttaactgttttgttaaattctgaaatgtttgctaaatgctgcttttgcaaatgaaaccctattatgccatcctttgttatcctgtgcacttgcatatttgctacgtggcttgctgagtatgtcatatactcaccttgcaatcattcatcagaggaagagttctacaatgaggctgatggagtggaggattaggagtagccttggtcaagctgcctgtggagtggagccgtctgcgccgtttatcttattttccgctgcttagatctttattgtttgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacccatagaagccctctaaaaata

SEQ ID NO: 107908 - DNA, 1080 bp, Oryza sativa
cgggtgggccccacccgtcagcgagggtggcgggcggcccctcccgtcagcggcgcgtgcgcgggaaggagaccgaatggcccgcggggaagagaagagagaggaagagagatgggccgagccggcccaagagggggaggggttgaaaaaaagactttttagggcttctctttttataaaacctttttaactttgtttatttcttaataattattatttgtgctctgaaaattccactaaaatttatttacgcattttaggcttttatgaaatatacaaaaatcctccaagccatatttgacttttaactttgcacattttaattgttggaggctttcacatggattttaattattctaggcataatttcgaggatgtattttagagtcgttttgggacgcgacaccgaacccagcctaaaaccattttgagggttttgaatagaggggaaggtgtgcatccaattccacaataatccaatcattccataatatccaagtgatatgaatattcccaaagtctagagttataaaaccacctaatgttgcctaattaaacagcgaagcatctacctaaattcatactagtggaaccacgaatagagtacccactagttggggttttgtttattctagggtgaacaaggtaataataaaaataacaataataataaggtcataacaaaggtaaataggcatggctaaataaaacagtgataacgcgggaatttaaataaagcgataatgcaataatttagatcaaaataattttataaactaggattcaatatgttcaaggatgatgtgagttgccttgctcactttcccaaacgtcggcttcaacctccacgaagagcggatcttccgaagctgcagcgtctacacgaccaacggaaaagaaaaaggcttttactctaataaactccatataacaagtaggaacaaagcacaaaaatgggttcttgacttcttaaggaaaaattagagacttgaacggtccaattccgagttcaattggccaagttatggccatttgaagtttatatgctctttaaataaatatttaagaatttcttcattt

SEQ ID NO: 107909 - DNA, 686 bp, Oryza sativa
ctagagaaagatctatccggaactcaatctctcggttgggcggcacaccgggtagttcttccggaaacacatctccgaactcactgacgatggggatttttgacagctgtcacgaccggaattaacccaacgggcgttccttacgtgcgtgtattattccttgtcccaggaggcaaggtacaccaaaagttgatacattccagagtttatcaagcggaagcgtaaatagttaatttattacatgggcggcgaaggcccagcacacacaaagacaaacgggaaacggcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgtagaataaatgcaagggagtacaagagggttatagtataaagggttagggtttgcagtaaacagcattacaagacacttagttgctcaaagctattttgtaaatatgattctagagctatacatattattaatcaaggccgtgaacccacacgagcctgccttaacccaagggctacgatgatttagatcgaactggcaactcgaccctgggtcccagctcgtcccaagccaacccaggccaaccatt

SEQ ID NO: 107910 - DNA, 589 bp, Oryza sativa
aaacaagcctactaccatacgagtatatatggatccatcctctttacaaaattatgctcactaaacaggagtaatgtgatgtttggatccagtactaagggtgtgtttagttaacgttaaaattaaaagtttggttgaaattggaaaaatgcgacggaaaaattgaaagtttatgtgtgtaggaaagttttaatgtgatgaaaaagttggaagtttgaagaaaaattttggaactaaactcagcctaaaatttaaattttaaaatttaaattttaagttcctgtcacatcgaatttcagatctttttccttccctatctgctctacttctatttattttcactgtctatatctagatatttgacctcaaatgcaattgataaatggaaaaaatattttctctaatataattttgaattttaatttaatttttaaaacataagtttaaagttttctttatgtagtttggttttcagcattgttttttaattcactaagaacacatatataaatgttttatctgtaaaatatattttgatcgctaataaatcattatagctataatcaaatttgggctcccaatgaggaca

SEQ ID NO: 107911 - DNA, 609 bp, Oryza sativa
ttagggcctgtttagattccacccgaaattttacaccctgtcacatcgaacgtttgaacacctgcatgaagtattagatataggctaacaagaactaattacacagattgtgactactttggagacgaatcttttaagcataatttttccatgatttgataatatggtgctatagtaaacatgtgtcaataatggattaattaggcttaataaatttgtctcacggtttactgacggatactataattagatttttttattagtacccgaacaccccataaaacacctatataatacccgatatgacacgccaaaactttacaaccctatatctaaaaaccccttaatggttgattgcaagaaacaggtcaattagctaggtagcgattccaacgtcatcacacaagctaattaattaaatgattcatgcatgcatgtacgtacagaggtggcctgacatttggtcgggtagatgtgccgtttttttttgacaaattgaaccttttcaaaaacttatttcgaaactaacccctaccaaaaacttcaaccaaaaataggccgttcgctcagcgccatgcgcattgggtaccgagctcgaattcgcctata

SEQ ID NO: 107912 - DNA, 574 bp, Oryza sativa
gatggcgaaagccaccgagtccgcaaaaaggcatgccaaactctccgccttgccctttccgacatgggtgcgagggtgcgaggagtccctgccaaagatgcctctatctttgacttttcggagtggacgcaataggccggtggtgcggtttcggactacgccactgcgtacggtgattcctgtgcacatgtatcggcggcgttcactatgggccttctacagtagtttggctgtgagcatgtcgccgagttccctaactatgcgaagggggactgggaggttagtgcacaggacgtttcgcctacgctccatgcgtggcagaagcagttctggcagaaggatggccgatccactgctaaggcgcgccttttggagcaactggcgaaggccgaggcggcagaccaaggcgaaggcaaggatgcggcagaaggagggggtggaggcgatgcccaggatcacccagagttgtgaggccctccgccctttccttagatttttgtagtttttcttcttgcgtttgccgtgaaaggcgaacaatgtatatttggctgatggccccttacccttcttattg

SEQ ID NO: 107913 - DNA, 904 bp, Oryza sativa
ttagttaggaattgaaaaaacgtttttagcccacatatgaaatctgattcattaatcctaaacggatgcctctgtttcattaatataaattagaatttccatattctattcatactcctatataacatactgatcaacatatataaatatcctatttataggagtatatgctatgcttaagagggttctctaatggttggtctgatttaattgtaaagctagagtacaaccattcaaatggatcgtatccgatcaaggtgtttaaaagtgtgctcacaaattatattagtctaggaaaaacagggccaagtgccctagctatattatttaacatttcctatcattaaccagaccatcaacccacttagaaccatgcatccattgcattttatagattctgattgcacatgttttctccgttcacacctagtcgatgagattgaaaaatcgcctcaaacattttatgggttatcgatgaatgctttttcgataggtgtacaaaatggtgtgcagattatgcatatcgtttgttatgttgttatatgtatcggctattcagatggtagatttgtttctcttcttgctgagacataaaaaactcctcgtgcattaaaatggttcaaaaataaaaagtccattgagttttgtttttctaggagtagtagatcatgattttttaaaatccgacatctatatttatattaaaaatacaaatataaatgtatttataaactcaaaaaccgaccctataaatatctatatatactggttcttaataaaaactggaaaatcttttataagaaaccgatatatatagtaagttatgagtgtttttttaaataaacgctcatcaaccgagaaaggacgcgaatcgtctgacatatatatatatatatatatatat

SEQ ID NO: 107914 - DNA, 1567 bp, Oryza sativa
ttttatattatggttggtgctttgtgttggcttgagaacacacttaggctgagtttgtttgttgcagtcggaactaatttatttgaaggtatcacttcacttaatttagtggcactgtcgaacattgcattgttccctacttgaaatttaaacatagtaggggtgggacttgttatatgattatgtttaatgtaggctgatatggtaactataagctttggaaaacaccactgaagctaaactcaaatgaacggattaatgttgatccatgccttagccttttgatttgtttaattatggtcaaaccaccttttaatagtttttaatatacttttttcacttctctgcagcccaagtgaagcaggacattcaaagtggaatatgctagagcatattgttttgctaaataggtctgaagcatgtggttgctatatatttcaatttttcctgttcctaactattttcaacctttgtaagttataatatttgtagatatctaagtaagttccttaattatggatttttcaaattgatgtttgacatgggtcccatttatatgaattggcgttcaagttcaagaagcatttgtagatatctaagtaagttccttaattatggatttttcaaattgatgtttgacatgggtcccatttatatgaattggcgttcaagttcaagaagcattcagttcaaactaaagaattcaaagcatttgatcaatttaaagtgatcttgatgaacttttgtttggagtcatatgaaataatcattgatttataattttatattctcattagtttcgaaactcattagtctcattcaaatttcactcggttgtaaggtcgtactccctccatccatatttcgttttctgatttttttttttcaaataggatgggaatatttgtattcttcatacatctaagacttaaatgtcctagaacctgggcaaccatcttattacttattggttgcatgtatccatacaatttttttttgtctctctacacagaatgaattgatttgtccttggtttcgctgaaaaaagtaatatgccttagagggtgtttttttttttaatttcatcgccgcattagaattccatgtgcacttgtgttttggttgtaatgagtgaatatctttttaatcttcattttgtatggaaataaaatgaggtttaatttcttctttgttttagtgatttatttactgttagttgtattattagttgaatgcaataatatgttgtatttttctttttcatttcgacttagaatggaaataaaatgaagctggataactttatttcatcactaaatgaaaatgaatatcctgcatatgtatggagaccataaaatgtaacgttgatgttagatgtgacatggaaaacgtgcattgcacgtgcatgattactagttattgtttaattagattcattaatcctcgattagaatcagcaagcaaataataatgaggccaggaaggcaggaaccacatgcgggaaatatcctccgtcagatgagacggacggtggatatggcctgaaagtcacactgtgatttttaca

SEQ ID NO: 107915 - DNA, 823 bp, Oryza sativa
tctcttatattatgggacggagggagtaactgtattatatatggcttttacctatactttcgaaatgtgcacgtcgatcggttggtaatctttatgttattggatctcgtcttctgaatgaggtcactctgcgttcgcaaaaatgaatgaggtcactctgtcgtcgatgaattcaagtaatcttccgtgtatggattcacggatccggcgaatccgggccatccgagcatctctcgatgtgatttgggatcgatgggaatcaccactggcggcagtaggggcccgtgcctccctctctcactcgtgttcttgatcttttcctaggacaaactttgcctgaacgaacggaccagaaaaaacggaactgatgaatgagagcctgacttcgattgatcgggtaggtcgggacttgtgccattagctagcatactactgtagttgctaataaagcttatttggtttgaagcccaatttatatcatatcaaaatgtcggtagtgttaaaaaagctagagaagtattgatactatcaaatttattagagtacaatttataaatttgatatcaaatcaaacatccataaaatatattagtaatgaagttatcaaagaattggttaggcatagattggcctcaatcaaacaagcccatagatctctctgtaccttgtctcatgagagacagggaagactagttaaatggagtactccctatgtgctataatataagaaaatttgagttattacttgcatcatttgaccactcgtcttattaaaaaaaagtggaagtattactttattttttatgacttactttattatcca

SEQ ID NO: 107916 - DNA, 691 bp, Oryza sativa
agccctatttagattggactaaaactttcaagttactatcatatcggatatttggacactaactataaatattaaacgtagactattaataaaacccatccataatcttggactaattcgagcgacgaatctattgagtctaattaatccataattagcctatatgatgctacagtaaacattctctaattatagattaattaggcttaaaaaatttgtctcacgaattagctttcatttatgtaattagttttgtaggtagtctatatctaatactctaaattagtgtctaaatatatggactaaagctaagttcatggatccaaacaccacctgagcaacgcctttttggctgggttccatctggctggctgcagatgttcgggatggagtccgtagcttcaagaacatcgcacacagatcatgtgttctgcagattaaaaatggggcatatggtttttctggtggtgtgacttgtgaggataggaacattttgggggggctaagtcggagtgtgcgacaatgtggatactgttgtctgctactgctcacgaggtcagattaatattgtgctttctggtgtcaataatggagttctctatgtcgaatatggcggcgtggccttacctgaccaaagacaccttgctctcatgactcatgttaacgtatagagccttgctctgactttgcc

SEQ ID NO: 107917 - DNA, 578 bp, Oryza sativa
ggctcaccgccgaccagaagtccggcgtcaagcggctgctggggcagtagatcgagctactgcaccgatgtagtatcaaagccttttcttgtgttggtggtgttgaactggtgatcatccggcagccgcgacgaatttctcgttgagagctttttcaggtcatgtgacacgatgcaaaaaggcaatgcggccttagatgtgtgagatactgatgagaactagtagaaacgttatacacagcttttgtggtgcatagaggaggaattcctttgtacaatctctttcaggttggtagtctgattcacattgctttggagtaaaaaactaaaaatgcctaggtgtagatgttgttgtacctattgcacgaaattttgatggtacaaaatgttcattctgaaatggactgggaagttgtacccgtaatccgtaattgttgacaagtcaagatagttttgggttagaggtagggttgcaagcgggcttgtccgcgaacccacttatagataaaattagtgggtaacccgcgagttaaattagtgggtaacccgcgggttacctaataatttgacctaaaaatg

SEQ ID NO: 107918 - DNA, 1484 bp, Oryza sativa
ccatccgcgcaactgtcgctggcagcagctgcgcagcgccggtgtcgtctttcccaccatccacgcaggcgccgccggcatcatttggcctgccagtcgttgcagtcatcgccaccgccttgctcgcagtcgccatccgctgctgtcgccatcagggggagaaaagaggaagaggagggagaaaatgaggaagaagaagatgggtaatagtacattgtgatagacttgaaatagagcatatagatggagatgcgttgaagtgagtaacgagtttggttatccaaatcaattggagagctggttatatgggtatttagagaatctaattttgaccattatattgtgcgacctctactgttgcagtagtagtactagactactagtagtactttagggcatctacaatatagtctaaaagtggtccataagcaatacaatatgtgattcagctacctagcaacattgtggaactaattcatagcagcaaagaaataacaaaagctacctataagcatatgggttggccatagagaataaaagatattatttgtctctacctcttctttcctcctaatactatttgctatccatatacattgtgaatattacagtagttaaagtttatatatgtgggtcatatctatatgtactacttttgctatatacattattgttgcccttagtactagtatccaccgatatctcccgctggggcatttaactttttgttatatttagatttagcatttaagtattatcaccatgacacgtaaatccaaacgtgtttatgatatatgagtatctaactatggttagtttagttcctaactttttttaaaaaaaacttttaactttttcatcgtatcacacgagcgtcggcctgtaccactccaccataaataaagtaactggagtagtggagtagtactgtagtactaccttctctcagtcttcttcacttgttctttggactacaatatggagtactactccagctccagtactggttccccttcccatcctcccactcccaccgatggagggtcggaccgtcgggatcgccatcgccaccgtcttccccgccgcttcctcaccacccaaccttttctgctcgcggccaacgcggcccgccggcgtcgacgagccttaggaaggtggcaatatcccttttctcatcgctccgccgcttcctgcattttttgtactcctactgagtttcttttatttccgcctagatgaactatatgtgttgctttcaagcaaaatatggttcattacggcatgcatcattcacaaaaaaaaaagccctccttctaagagcaagtttaatagtatagcccactactagcttcaattcatctatagccaatctaatagctaattcatacaatagttgctctactatactattaatatatggtcttacatgtcatacacacattgcgtcttagattccgcgcaacagctggctacagatctgtagc

SEQ ID NO: 107919 - DNA, 671 bp, Oryza sativa
tgccgccagcggcggccctcctcgtcgccgagccgacgttgcccctccgccgccgctcctcccgccgccccctgttgccgctcctcggtggcgcagtgacctgctgcttgccattttttttctttttttttgtttttctggtagacataaatttgcaccatgtatttgtgtttagacaatatacactgataagtgtaataaaaaactttgataaactgggttaaattcataagggtataaatggaacttttgtgttgagttaacaccgtcatcttgccttcacggaatagggccaagttccatcttcgtttcaaaaaaagagggtcaaatgagtaaacttgaaaaaacatggtcaaataggtagttagtctttaaaatagggtaaaaacgcaattgccccaagttactgctcaccaccagatgtttgcactccctctaggttggacaatgacacggtctcttaaaaaataaatttgaccaatattttctattacgatatatacagaaatacctacaaatatttaataattgtctttatacagaatgctatgcagtctgtcatacttttgtgggggcaataggaatctattcagtgtacaaccatttggatttggaagatgaagtccaatcatgacacatctataacacaatgacacctatgtcgcagtatt

SEQ ID NO: 107920 - DNA, 703 bp, Oryza sativa
ctggtttcttgaaagaattttctatataaaagttgcttcaaaatacgaaataaatttatttttcaatcttctaataattattaaaacccaattaacatacattaatgatttttttcctaactttaatctacggggccatgaccggagttgggtgcaaaagcactgataagcctactaccattctttaacccactcctaaattaaaccctctaactaaggatgcaaacggaccgacccacgaatttacttataggtcaaatactagatgataaccgcatctaaatatgcaagtgggtcaatatatactcatttttaggtcaaattattaggtaacccgcgggttacccactaatttaactcgcgggttacccactaattttatctataagtgggttcgcggacaagcccgcttgcaaccctacctctaacccaaaactatcttgacttgtcaacaattacggattacgggtacaacttcccagtccatttcagaatgaacattttgtaccatcaaaatttcgtgcaataggtacaacaacatctacacctaggcatttttaggtttttactccaaagcaatgtgaatcagactaccaacctgaaagagattgtacaaagggaattcctcctctatgcaccacaaaagctgggtataacgtttctactagttctcatcagtatctcacacatctaaagccgcatt

SEQ ID NO: 107921 - DNA, 502 bp, Oryza sativa
taaaatggaggtcatgggaacaaattctttcacatatgtgtgtgctatgatttgttttctttctcaccaaaacaaatcttgtaatagatccaacgattcaaaattatgtgaaacttacatataagttacactgtagttacatgcaagttacagtgtaattacatataagttacagtgtaattacactacgattgtactataattacatctgtcaaatttttggggaaaaatttgtcgacaaatgtataggtagtcccctctggcatagaagctggtaatggtaaggctgtaactaatcgagaattgagataagttattagtgtataattaatttagtattagttattgtaaatttaaaattatatttattgtattttgtaaaaaagtttatatacacattattttataaatgcatagtttatcagtttgagaaatatgctatcgagaaacaggaaaattattaaaaatttagcccaaaatgaaaaggccctaagctcattgt

SEQ ID NO: 107922 - DNA, 832 bp, Oryza sativa
accagaagttagctgcataataatacccctttcctatcacaaattccagggccggaaaagaacgaaaaattaataaagggagaaacaaaatcattggtaaatacagggaacttctcaattgtactgtttgttagcctttctttatacatgtagaagacttaatttgatacaggaatatctacgaacaatagcactataatctgtactctcaaataacatgcaaacaaagtcacacattgttaattaggattccaaaagatggatgcatgctaactcatgccattcactcgaccacagattagaatggaccaagaaagtaataatccattccatagaacacaacacaatgacacgcagagtcctaatcagcgtgtggtggtccaatgctccaagctactgagactacgagagatgtggtggactccagtggttgccttgcatacttagcttgccttccctagtctagactctagactagtgatcatcgaggtcgtagtcttgtaaacgatggttactactcattctgttttttttcttagtactccctccgtcctatattttaatattttgcttgcactatttaactattcatcttattttaaaaattttgaaattattatttttttacttactttattatccaaagtaatttaagcataactttttgttttttatatttacataatttttttaataagatgaatagtcaaaagtgtaagtaaaatgtcaaaatcccttatgttgtatacagagggagtaatagtcagtgttgactgctagtagtgttttaactttgatcataattatcaacatgtaattgatttacaatact

SEQ ID NO: 107923 - DNA, 833 bp, Oryza sativa
caattgttatggctttaaaggcacttcattttaaggatgaaaaatatagtaatatgtttacaaaaataatagacctgatactcgaatttatgatagtgcttttgttaggttcaccctttatctgatatggcagtgtgaaatctaatttcacccctcgtagttttatatctttgtaaagagtagtgcttggtatttaagccgaaatcagtgtacctctctgtacgaaaaactgaaataccttgtaacgcacttccacattctcaaattcaggatgagaaaaaatagaataggttatgcaatcattatctacagcctacttgctgctaggtcatcaaaaatactttctttggtttggatcgaatagtcacactatgggttatcttggtgtgttatgacaattttgttcactcatgttacctagtattcagtgacaatttcttctaggtgacaattttaaaccaaaaggcatgacaccccagacccaacttttattaaaaagagccagcaaagttcttagcattttacagcgcgcatacaaaacacttcacctcacatgatcactacacaaacatctctggctgcataatataggggatctaaagttttgtctgcccttttacaggaatgctgagacaatttcctagtgaaattgtgagattgaaggtgccattttcaataaaaccatggacaagctctgaagataatattggaaaccttttgatggtactttcttgttatgaattttcttctattcaaagtgcattatatgctagaagcctatagagttgttgtaagttgtaaaaattgctgctgtttaatgatatccacaggtg

SEQ ID NO: 107924 - DNA, 630 bp, Oryza sativa
gacaatattcaggtacttatattggtcagtattaattttcagttccgtggtcgatactttcattgatgtgatagcttttcttttgttgtaaggtgggtatgggatatggtagctaaagattatctcgtcccaatcctggagataattatcctgaagataatgggtaggggagataatatgcaaggatcgactgataaaattaatgtatggatcgatacacagatggacaaaaccaacctctcaaaccttctccttgatagagttcgttcatttctaccttcttgtcttctctcgatccacaaaatcaagaaataatatgcatcacccccctcctttatgtaccaacttcacatcgcgtactagtatattctaattaagtgagtcatattgattgtcggcacccggggatgcaattcccgaatactcggagcgtacaacgtactactcccagaatcagtggctagtacatgcatccacaaccttatcatcacatccacacataatacacatacaaatagatagcatggttcacataatttagcgagtgcacaagtcatacaatatagatagggctgaccggccaaatgtaagagtggggatcctacagagtcgacctgcaggcatgcaagc

SEQ ID NO: 107925 - DNA, 1230 bp, Oryza sativa
ccattgacgccgatgatgatgatgatgccctggcacttgctcgcattctcttcctcgtctctgccaatgttgctactgcgaaaacggaagggaattgatgaggatttaaagcgtgcaaacgcatgcacgcacgaggcgtggtggcggtcgagcgaagccggcctgcgcgtttgcggatggttggcacttggcttgcaaggaaaaacaaccaaaaatcgaagcaaatcgggcagtttttccgttgttgcttgcaagtgatcgctggagcctggagacgaggtgtggtttctggcgcttcggcgttgagttaactttcggggttgccgcacacggttgagtaacggaatggcattgcaaatttgcagtgccggccttcgtccagctacgttttttttggtcgtgagcgtttttggtgcaaggattgatggatcaaaactaaaaaggcagctttggcacggagcggattaggtgagtttgttggtgatacctctactgtggcttgggccggtagtggatttgccttgtggagatggctaaagtacgtgtcatgtagtcgactaagcattattgggcaagtgtggtatctcgcttttgtgtgtgtgtttttttaaagataaacgtatgcgatcataacacgtgcatactcattctacaaatacaccgctttacctctataagcatattcgaaaagattgtgctgtcatttgttgagattcatgaaatcatcgtagatatcttgctggtatttttaaaatcttttgtgttcttttctttttggtgatggctgataagtgatcacgaattgttgtgttgccgttgcttgagctgataggctgataggctgcctgttgcttgtgctggctgctagagatgttcggttggaggctggggatttagcctatgaaaaaagcccatagagatggacaggtccagtagcctgcaaaattacaggtagcccaatctaatcccaagctgatacaagaaaggcccagatgcccaatgcaaacttacatgagtcaggctctgatatgttcgccgtcattctgaagcagctataccagcctagctatcacagagacacagacgcaatgcaatcaaaagtagcataacatgaacaggatagcttgggcaagataagaataagcttttgggtgccaagacaaaaacctcctgatgcagtggtccaaatacatgcatgctcctttaacctctgccagtactccatggcct

SEQ ID NO: 107926 - DNA, 637 bp, Oryza sativa
tgtattctgattggttggtttcagaaatcgccaccattaaatgcatcttaatagcccctactgatcaagcccatgtgtagcagtagtagactcgtagtgtagtagcagttcacctcacctaaaagctccagtatgcgcagatatgtctgtggctcaaacctgaagaatgcaacagattgatcgagttggtgcaatccaattcttgccacacacacgcgagccaacaccaccacgtaccaaacttctataagctatctagcatgattaatccttttctgacatgatgcacacgtaagctctgaaaaggctatcgcgtatgtgaccaaaactgtaacacataactgttggtttaacttaagcttcaagccgcatcaattgacaatttagttttttttttgaaaaacttgttttaagaatgtgctgtgcaaaaaacatatttctaaaataacccgtgatcttacaccaattttattattccaaaggtccaaatccgttttacaagaaaaaagattgggccttgaaacccccaccgtagactagttggaggcacgacataaccgcatccggaagccaaggatttggggatcctttaaaattgacctggaaggaatccaagcataagtattctatagggtca

SEQ ID NO: 107927 - DNA, 730 bp, Oryza sativa
ggacagccctgcttaatattggatttgttattatgggcttattagaaactgttaaagacccttttttaagatttattttggggttatttcttatattgcacttaaaggaacatcggtctgagataaagtttggatcatcgcatggtaaatcgtgtactgcatgattattaagtagggatcaccatctgcttatttctattgaaacaatggatatagtaacgttttttaagaggaatatagtattggttgtgtatgtatgtagtatctcattagctggttttaaaattattatatttctactcattctatcttactttggtctatataaatgtaatttattattacgtatacatgatacacaatatcgagacaaatatgtattgtaaggactaaaattcataagacacatgtatagtccattataccaaattaccaaccgcacataaattatcctgttttggccttgctaagacccactattttagtaaatttagtctatttttagctttgctagcaccctattatatcaataaatgtaagatgtacagtacattacacaaagcaagccttacttaacctagtacagtacgcaaacaccctaatccatccaactccaacccaaggttttgcgctcaccaaccataagaaaatggcaaagagaaccatgatttagcatcaacaagaagcgaagggggttaactgcaaattacacgcaacgaaaaccctccat

SEQ ID NO: 107928 - DNA, 517 bp, Oryza sativa
gccacccctgcgcctgcgacgagagcgccgaccaggagaggttccacggcttcgtcaccaccatgctcctcaggcgccgcccgttcgcccccatcaaggcgctccggctgtgctggagccacgacggcgacgccaacaactggatcgctcatgctgtcaggcgtggggccgaagaaatcgatttctccgcgaggcatcaccaagatgatccgaaaccggagctagagtacacgagcttcatttctcacaagatcaagatcttgaagctgacgcgtgtccggatgggcatcaagtttatcacgcagatctgctataggtgcacttttttggaagaattagagctcaagaatgttaattcacttgaagggcagattcaatcgacctcgctgaagcgcttgtctatcatcaactgccttatctctgatggatttttggttgatgctccgaaccttatctcgctctgcttcttcagacctctcagcgggtagaggcacccaggcgcccatcccttggttgg

SEQ ID NO: 107929 - DNA, 950 bp, Oryza sativa
ggggtgtgtgggtgtgaccggatcggagacgtgccgccgttgaatgagtttgaccgggtaaccggcgaaagcagcgttggctggcgaggaggaggtttgggataaagacagggcgcggcacggcacggcaacccaacccaccggggtccggagaccggacggggcggaatacggtggcggccgcgcgaaattacgcggctgcccacgctgcgctgcgcgcggtgtgtgtcaggcgggcgtgggattgcgggtgcgctgaggtggtcgccgttggtcggctttgcgttgcgtctcgtactctcgtctcgttcgttcggcttgggcgccgaaagaggaggagagagagagactgagacaccgaggagggagaaggccgcgaagagggggtgggtgggtgaggtggtgtgggccccaccggcgcgctggggaggcgggcaattattgttgtctccatcgagcggtggcgagacctgcccggaaaagtggacggggtgacggacggacggcagcggcgtgcaccccaaggccggctactacttctcctcgttccgttcgtagctgacacaagattggacgagcgagcacctctcgcctttggcgaggtcgtcgtcgtcgcggcgaacgaacaatcgttgaaatcaaggtactatagctgtacaggaaacgcgagggaaaaaaacgagcagcacgtcgtggtggtgggggtggcttggccggagtcaagtagagcggccgtgtgcgtacgcacgcacgtcggtacgccacatcagatccccgtccgtccgtcctcccgtgttcgcgcgcggggtcgcgtcgcggccgtggacggcagggcaaccgcgtgttcgcagggtcgtgaccacgacgtggcgctctcctctcctctctcctgccgcgcccgcgacgcgccccggtggccaggctaggccatgcgacgcgcattgaattgg

SEQ ID NO: 107930 - DNA, 674 bp, Oryza sativa
tgcatcccggaaatgcttgggaggaagaaaggatcgtcgtccaggttgagtgatcccatcaacacgactgtcactactgataacggccaggaaatggctgcttcgcatttcatctcgcagcaggcttcacagctcggtaggttcaaacccccgcttcaaactttcaatggacgtttacattgttcccggcgtaagttgagcgataagagagactcatagttcttctctcctctttgtcagatgaggctgcgaggaagagactgcaaagaatgaacgagaggctgaagttgctggagatgcagatggaaacactggaggctggcgtcgcgaaggcgagcaatgactcctacgagtagagatgtttagcaatctttgttatagacaccaggtttggtgacatgcaagcaaaattagatgatagcttgagtagttttacctgaacttgcagcaaatcaccgtcacctcgttgtagaattccggatctgtttcaggtttcagcgcttcagttttgttctttcactacgagccaataagctttagtgcagatgtcattcaagttttctgccagaaggaatttacagaatttgacccatacaagcgccccgcaggcatacaagcttgggtatttgtcaatttgacccacagcacaacccatgatggactttcgcggggtc

SEQ ID NO: 107931 - DNA, 623 bp, Oryza sativa
gaccccatttatatcatatacaagtctcttaaatatataaaatgttccgccatgtttaaggaaaagtaggcggtattaaaccaaaattaattatggttcttttttaattattccgattatttaataccattatcctttgtttacgtatgggtcatgtaacgctctctcaaatacacgaccttgttaacttgtagacatacgttcaattgctcacgctattcaaaactttaaaatatgtagaatataaatcatgctcaaattgttttcaatgataaaataagtcatcatatgttaaaaaacagagcgagtacattgccattgcaatgctacttcgtcggatagagactcttggaattttccaaaaaaaaccaaggaaatgactgggctgctacctccctgggaggctgggacgaagaactcatgccccgctgcactggataaatactccattcgtcctcgtaaagaaagtcgttatggacagcgacacggtctccaaaacacaactttgatttcatgcttctataaaaatatttattaaaaagtgatatatgtatacttccatgaaagtatttttcaagacaaatttattcatatattttttatatttttaaacttaataattt

SEQ ID NO: 107932 - DNA, 683 bp, Oryza sativa
cataacggataagggcgtgtgtgctcgatctatttctccaagtggcaacagaatattactgcatgccagccatagcggcatagcaacaagtggagtttgtaccatgctaacgatgcgttttgtacgtcgtgcatgcatcgcccgcggcccttttgtttcccatgaattaatccatcagttcgcaagctggtactggcgactcgtacaactcacctgtacacgtacggctgtaatgagattattttgcctcttttgagataggttactgcgtgttccattgggagtccgtgttccattcgaatctctatcccttccggtctactctctctccctcttgtcccaaatactatatgagtattcaaattgttccttatcttacaccaagcattaattctcccattttcgatcaactcacacttaatgacacgctataaatctataattttttcgtgaaccttaattctcctaaatgacgtacaaatgcttatagataaaaacagagggagtaagatttatgtcgtggcatcatcctagaggtggtaattaccaagcgagcatcgatcctaaggtctgattttagataggtgtggacggcggtcaagcatagcgtgttgtgctggatggcttcgcgacactaggccgcgtcggccaacgggaagttcgacggtttgcggaagacggtg

SEQ ID NO: 107933 - DNA, 661 bp, Oryza sativa
ctctagaggatccccacatataaatcgtatttaaattatttttttttattaaataacccacaacaaaatagagtataattacgtaacctttttataataggacgaatcgtcaaacacgtgacaaaaagtcaatagcacgatttattaaaatacagaggcgcatataaatatatatgtgtattcttttttttttgaaacgaaccgcacaagatagtgcgagtttcatgtatttataaagcaggagaaaaatacaatctatagtcatggaagagcacataccagaaaaagaaaatacaaccacaccgcgatatacgtgtattcttagttagagcagagaaaattatatttactttattaaaaagagagaaaatcagagtgtatatgagccaggactagagcccagcgccgtacctaaattgttagggacccctggtaacacaaaatgaggtctcagcaacgacaaatgggtcctgatgcaatttattcgatttctttacttaaacacaaaataaactcattctagccaaatcagtagaacgagatacattggtttgaagtaaaacatggaaaatttaaggttccaaatttttagggttgtgctatcgcgcaccttcgttacatgttaaatcgacacggcccttaatcttaaaagatttttcat

SEQ ID NO: 107934 - DNA, 711 bp, Oryza sativa
agctataacttattttttaaaattacacagtacaacatatacattcacaacacacgcgcactcatctctataaacgcacgcaggcaaacccatctattttcaccatgtatgcatcactcttaatataaatttagacactcgtatcatcttaaacttgatataaagtagagtaaattaaacaagtggcacctcactttatttcgttctagctccgctagagaaaaaggcaaaacggtatatttacaaatgaaaaataaacacttgtggatataacttttacatacgtgttctcaatgatctaatagtggagactaaaaaataaactatgatgaaaaatttctaaaatcaactttaaaattaaagttaaaaacttaaattttaactgataagtataagtataaatgaaaagatgatgcggttcagtttcatggggacgataccgacgtcacgatgaattggattcttggagctaagagaaaaatgaaaatgatatggccggatcgaagcttaagtttggtgaattgctgacgggtcacgcgccgtccctgccacacgaaatctgtggccgtgcttaattaaatcgggacaaaaaaaatagtactaacaaattaagtggctggtaatgtcccccttgatcgatccctttctgtcaccattggccgcacccgtccaaaacgccggaaaatgacacggaattgaaatgacaggatt

SEQ ID NO: 107935 - DNA, 676 bp, Oryza sativa
attgtataatcaaatttttaattcaaaaaatattattaataattattgaaactatatcaaattatgaaagatagtctaggaagatcgcaaagtatttaaaggaaaatcttagcgttctcatttaccattcaatttttttttcgttcatcatcaatcaaaacatgggactataaggattttttttatctttggatggattttgatgtataagaacccgaataaatttagaacaaggggaggcagataaagaaataaataattcaaaaggaaaaatcatattcactttcaaaatttcgaattgagtttgaggaatttctggaaaagttcaaagtacggatctattgtttatcaaaattttagtttgttctgttgcaacgcacatgcattttttctagttagtatttaaaacgtagcaatttcgagaatcaatccacacctattaagtaagtactccctccattcctaaatatttacgacgttgacttttttaaaaatgtttgaccattcgttttatttaaaaaattaagtaagtattaattcttttcctatcatttgattcattgttaaatatatttttatgtatacatatagttttacatatttcataaaagtttttgaacaagacaaacggtcaaacatgtttaaaaaagtcaataacgttaaatatttagggacg

SEQ ID NO: 107936 - DNA, 746 bp, Oryza sativa
agttttgtgatagattgatcaaagtatctgtagttttgtgaaatttactctattaagaaatatgggtgaccggtgaggaccttaacttgttcgtgtctcgcagggcatcaatgtcgcgcctgaggatgcagtcgctgtctatgtacaaggcctccaggagagggcagctctggatgatcgccgagattccttccttgcttacatggtcgcatttgacgaggcgaatgctcctcaggtatggtgcgctgcaaacgttcaaggttttgttgttgaaatgatcagtaattcagtacttatattcagtagtagttcagtcacagtactccctgaagaacaatctatatatatgtatgaaattattgatcatacgagttgggtttcaaccatgataatataaatgttttataatgaatgattttgggcatatatacatatgaaaatgacgtaactaagaaaatttttcatgggcatgtcaagttaatttgtgtttagttttcacttgtgtcaaggagccaaaatctgttccaagtatttttcatggtagtaaacttgtatatatattttcactcgtgtcaaagattcaagctagctgccaaattatgaatttatgttttttttacatttaatatgattgttagaaatatcattatatattttattctattcttttattaaccccatcttatcatgcacctaactgattattcatgccgatcatcactcatcaggatatataattaatctgt

SEQ ID NO: 107937 - DNA, 902 bp, Oryza sativa
agaacctacgaccagagtcagaactgtattcgttttcaacatttatattgggtgcccaatacgtgaaatatctaaaagtctggtccgaaattattttagtttttcaacaaaatttggtcaaatttgaataaatattgtcaaattcaaaaaaaaaattgaccaaaataataatgtattggagggtccaatagaaccgaaatgaaattttgaaccttgcctacgaggaagaaagatgcttgtgctcaggatcagttttcaggccattcggcatgttatactacaagcgcttagcgattgtgccgtataaactacaattaacatgcatagagggtaaggaaatgtgtaaatctcagaaaattcctgcaaaaatgcacccatggacaaagtgaacatgaaaaatataaatgtttatggtgggttcaacatttctttctttctttcaaatcattcgactatgctgattcttttacatgtataagcaaagtcaacaagcacgatcatcttaatgtaccaattacccacgcagcagaatccctgagcataagctaagagcaggtttaataggtggagtaagcaccggctctaatttacatccatgtcattcaaagcatcttgacaggaccattcttagggaaactattctaatccctcgaggggatgttccctcgtttgctcaaaaaccatttaaacggttatgaaaaattctgcaaaaatttgacaacattcatacaacacatatatacaacttcacaaaatcttaagtccaaactcaactcacacgtcgagatataaaaaagacaaattcagcgtatgaatagtagcgtactgtttatatctaaatttgtcttttttgtttctcgatgtgtagatcgaatttgaacatgaattttggtggactagta

SEQ ID NO: 107938 - DNA, 954 bp, Oryza sativa
tgccccttgcaagctaggttcaacatattaaaaagattattatagagaatgttacaatgatcttagcagcaatcaccttcttaaatgagtatacgtgtgctcacaattaattgtatttgtcttttgagtaaggggggtcctttaacttgtttagacgtgtcatgtaggtcactctacttttaaaatacacatccagatcactaatttaaattaagtgggtcattttttcatctaactatccatatgaacctaccatataggtatagcatgccacctaaaattaaaaaaaaatgctttttggacatgtgcagaaaactgcatgtctatctgttcctttctcacagcactagcagttagtaaaacaggaaattacgggaaccaaatcatttcacttttgcctattttgataagttctagttcttagtcctctcttttcactgccatcgaaccttggtagcgacaagaccgacggtagcgacagtgacaaactatgaatataaacagcggtggaggtgaaattctagaagacaacagtttgcggatgtacaaatgcatttctttcaatgctatgtggcatgtcatgtgtataaagtattctcacatgaatagttacatgggcaaatgacacagttaactcacattagtgacctgcagatatgcattttaaaaataaagtgacctatatgatacacctaaacaagttgaatgaccttcatacattttacttttgtcttttttggggcatcttataaaatttgcatttaatttgcagtgatatattacatattaatttatcatctcatgttttttgaattttttaaataattttggatggcgcacaagaaataagggacttcctctggagggattaaaagagtttcctttttttaaatgtgacaaaaaaaaggacccaaaccctccagtcacaaatggttgctacgtttttaggacagc

SEQ ID NO: 107939 - DNA, 825 bp, Oryza sativa
tgcttttgaaaaattaaaggtattccaaattttatttggcttggaatggctgtccaaataagcacacgttctgttgggggcctacttcctccgtcattaaaaaacaaatttagtcccggatgtgacatatactgggtgggttttttatggggacggggagagtagcacagtacattcgcacttgtgacttgtactatagaataccgaatagtactattaggcaataattattacagtaataagactgtgtgaactcacaccaaaattagaagtttggttaaaattgaaacgatgtgacggaaaaattggaagtttgtgtgtgtaggaaagttttgatctgatggaaaagttagaagttgaagaaaaactttgaaactaaacacggtgtaaatcccagtgggtgcttgtcgtaaatttcgttcatattcaaacctgtctatttacatggaaacaaaagacacgattagatcattccaaattccaattagacattttgggcaattgatcgtgataaattgggtagccttctcgtttacgtgaattgatttccgcaaccgccgccttctccgtcgctccggcgaacctctcggtaagtccgatccgtctcatctccctccttcccatctctgtactctatccctgacacgcaataatgctgtggaagttcagcgggaggtggagcgcaggccacctgttcgacggaatgcatagccctggagaggcggcgcgcggcggcggcggaggcgagtatgacctcctcagcgccctcccggacgcgctgctgcaccacgtcatgtcgttcatgcgggcgtgggaggtggcgcg

SEQ ID NO: 107940 - DNA, 1113 bp, Oryza sativa
tccccgtgcaacagcgactgcgtcttcctccgtcgtcttcctctcccctatgcagcggccatccgattccaccaacacaaaaggttctccactcgtgcctccctctcctctcctctactctcatgtcccgtgaggtggagaaggatgcgcgggggctagatccggcagcccccgagctcggcaccaccacgacggcgaggaggaggactggcgaagagtggcgatggtgataggcttggccttcggtgagcaactaatggccgcgatagcctcggtggactatgattcggtttttgtagttaaccttttgtgttgaatgttgatattctatatatcattcggtgattattctaatttgtgatggattaggattaaatttttgcgttggatttgtaattggattgggattaagtccttggctcaaaacatgtgctcaattcgagccgaagccgatgcgtcgagccacattattttttcatttctagaacctcaaaggtgcaccaacatctatgattctccacatcagtgtcggttacgaagtctagtatctatgtgggattctcaaatggcacccattaggtattctatagtaatgaggtggtttgttgttaaatatagtttctcagtataagaactattagcaatactaaaaaagagagatgcaaaatgcatgagccaataaaacttgcatccgagtctcaactgttcggctgctcagcttcttcatgacatacttgaggcttcatcggttggtgagtgggtcatgactatagatggccataaggcccgcccggcctaggcacggctagacacggcccaccagctatcggaccagcatggcccggtcggcacttcgtgccgggccgtgctggcccatgggctacacctccagccctgccacggccccgtgtcgtgtcggtccgaagacacgggtggtctatcgtgcctttttttaaataagtctattttctctccctcctcgtgggctgtgacatatgtatatatatagctaaaataagtccatttttcctccctcctctttgggctgacatattatatatatatatatatatatatatatatatatatatatatatatatatatatatatat

SEQ ID NO: 107941 - DNA, 662 bp, Oryza sativa
ttatgttcctacctgaacttctagtgcattagtattcaatcatttctctctatggtgtattgaacttcaaatttatttcatggctgacttgttaccgtgcctttactagaactcgcaattagcagttcttttttatttgtctctggccaaaggaagttatatatttgtctctgaccaagctagtatgttagttacattttttttacataatggaagtacatctcacaaatatttcacaactcacttgagcaaaaccttgggttcatctcataccaggacaaattttggttgccattctggaacatttgttggtagtgcaacatgtgtactaactgattactaaaagtggcagaactttcaaggctagtttaatattcatctgatgattgcaaacctgtgatttttttcctataatcttgtccatgtaccacttttgatttgtcaatgcacatatcttttgatttatttgggtcactgaatcatttggtatctatggaaatgtgcagctgcttctgaggagggaattggaaaatttccccatgttcattaacctgaatactctgtcccttggtgaatggtgtatggttcctgacttcagtgctttgtcaaccatacttgagaaatcacctaatgtagaaaggctttatattcaccttgacatg

SEQ ID NO: 107942 - DNA, 821 bp, Oryza sativa
cgcgggttagccacttacacccctaaatcccaccacctattgcccttcccatccgctgcctgtagaccttctcgtgtcctccctcctgccttccgttgcgtcttctcttcgaatcaattcgttctttcccccgctgacctttctagtccttcacctgccaccgccgacggccagctcttgtcccggcagttgccttggtaattgcaatgtcaaatactccctccttccaaaaatatgagacctatttcttgttgcatcaatactaagaagcaattaactcacttgtcatatggcaaaaccaatgaacatgcaaccaataagtagtacttatggctacttggtttccgatccacaatttaatttagtatatagcgactacaaataggacttagatttttggaaaacccaaataatgaaatagatctcagactttaaagagaacatttattaattactttgaagagaatattccatgtactacatagtactagttcataaaattcatcaactaacatgagtgcagaacgaacttacatgaatctaaagggagaaaatattcccagaaaaaaatagttgaactccaacataaattccactcgcattgatcaaatcatgcagttcttcatttcagaaacgtcctcatgcacctgggaagcgcgttatcatacttgtcaagatcttcctcgtagcgggaaggaccggaataatcatcatcatcatcatcaaattcctcagacgtccattcatccgagtacatggaatattccggatcagaatacaccgaataataccgcacaaaaccgggggagatggggagcctc

SEQ ID NO: 107943 - DNA, 1264 bp, Oryza sativa
tggaatgatctaatcgtgtcttttgtttccatgtaaatagacaggtttgaatatgaacgaaatttacgacaagcacccactgggatttacaccgtgtttagtttcaaagtttttcttcaaacttctaacttttccatcagatcaaaactttcctacacacacaaacttccaatttttccgtcacatcgtttcaattttaaccaaacttctaattttggtgtgagttcacacagtcttattactgtaataattattgcctaatagtactattcggtattctatagtacaagtcacaagtgcgaatgtactgtgctactctccccgtcccataaaaaaccaacccagtatatgtcacatccggtactaaattcgttttttatgcgacggaggaagtaggcaccaaacagaacgtgtgactaatttgaacagcattacaatgcaaattaaaatctgcataacttttatttttcaaaagcaatttcatatctaaaaggcagggccatcatcccataatataaggcacgatcaaatttgggacattctccaaaactaatctttgtgttataatttctcatatattatagcaacaaaattataaccatatcaaagtaaatccaaatgtcaatccaataatattattttcagcaaataaaatttaatttatattatactaatggttagtcaaatgttttaaaagttgaatttcgaaatacgtgaggaagtattatgggattgaggaagtattatgctagtgcaaaggtgattgcaacccatcgagacattcaagcaaagaacatttgtacgtttaaggtatataaacaaactccaaaacatttgaatgttaactcattccactggataagagcatttcagtatttggatagccatacatagttcattcaatattaccccaaagaggaataaccgatctgtcacggccctgctatgcgtgcttaatgcgtcgtgccgtcagattctttctaagtacatatagaagacgattgcaatccgaacataagaactaaatacgatagaagatatgatgaacgatagatgatcgacgttgcatcagaattccaaatccgaatccccgaactccggatctggaccacagtactcataatctgaaccccagaactcatctgacccccagaactccagttcttgcttggctagatctctcatcaccttctcgctgcggagacctggtagcaatatcagaaagcagataagaacacatgtgaagatcacacagaaaatcaaa

SEQ ID NO: 107944 - DNA, 593 bp, Oryza sativa
gtccgccacccatgcgcttgcgacgagagcgccgaccaggagaggttccacggcttcgtcaccaccatgctcctcaggcgccgcccgttcgcccccatcaaggcgctccggctgtgctggagccacgacggcgacgccaacaactggatcgctcatgctgtcaggcgtggggccgaagaaatcgatttctccgcgaggcatcaccaagatgatccgaaaccggagctagagtacacgagcttcatttctcacaagatcaagatcttgaagctgacgcgtgtccggatgggcatcaagtttatcacgcagatctgctataggtgcacttttttggaagaattagagctcaagaatgttaattcacttgaagggcagattcaatcgacctcgctgaagcgcttgtctatcatcaactgccttatctctgatggatttttggttgatgctccgaaccttatctcgctctgcttcttcagacctctcagcggtaagagcacggagggagccaatcactcgtctgataataggagttggccattctcagcgtcagtgtgggagtttgatgacgatggatctgatcatgatgatgattt

SEQ ID NO: 107945 - DNA, 866 bp, Oryza sativa
agccgggcaataaaaagcacgctctctaaaaaaatttatatgaatgcaaaatttacatacatgaagagcgtggagaaaattcttcccagaaaagaaaaggttggactcacattgataacacattgaccaaatcgtgctgaaggttcttcatttcaggaaactacgcataccccggggaagcatcttaatatcttatcatatttgtcaagatcatcctcgtagcgggaataataataataataataataataataataataataataataataataataataataatcgtagtcctctaattcctcaaagtagaatggattcctaatcatagtccaaactgatacaatcgacaagagaaggcgtgccttcttatggacaatataatgtctgctccggagcccgctgcttggtagcgtgcgaaaaggtctgccaacctaaagatcgcggagggctgggaataaaggatctcaggttgcagaatgacgtactgctgatctaagaggttgttccatacgcatagctcaaattcgtcatggtctacgtggctctggcaggaagctagggacaaatcgttggcggatgacctgaaccttggaccccactggcgcttcctccaaaactctcataacatccaaactctaaatgtcgtgtagaactgcctttgtaacccttcttttattaattaaatttaaatacgatgggataagaattaaccctaattaaaaattcaaataaattatataaaaataaaatatgagtaatattaatctagggtgaattcattagttgagataacacaaatattgagtaaaatgcatatatgcaaaatttagaattgtggaatcaaatttatatgggaaatacac

SEQ ID NO: 107946 - DNA, 955 bp, Oryza sativa
caggcgcggggccgaagaaatcgaactctccacgaggcatcaccaaggttctctggaaccggagccggagttcacgagcttcatttctcccaagatcaagatcttgaagctgatgcgtgtcggcatggacatcaggtctatcacgcaaatctgctctaggtgcacttctttggaagaattagagctcgaggatgttcgcctacttgaagggcagattcaatcggcctcgctgaagcgcttgtctatcatcaaatgctatatcgatgatggctttttggttgatgctccgaaccttgtctcgctctgctcatcagacctctcggcattgagagaaaggggggatccaattcctcgtctgatagactttggtggccagtgtggctgaatgacgacgatggatatgatcatgatgatgatttctttgcaaatgctagtgctgtacaatctgacgataagagaggcagtaaatctgatcaagatgatcttgaaggttgcaatgatgatgattgtactgtggcctatgatgagattgcagatgagtactccagtaatggtggtcctggtgatgaacatggaggatattctgagagcgatgattctacaatttgtggtccctatggtttatttaatgttcttgtaaagacatctctgatcatgatagcccgggaaggagaggtagtgtttaatcaccctgctacgtttgatcatgtcattctacatattatgttctctcttatttgtatgctttctttttccgggatgtacgcattacttttgcacaattctttgcaagcaaatatgtcactgtatgagaaaggaactagttaccggtgcattaacagaactgtcttcataaacttaatgtgtagaagaaagtttggtcagttctgcttgttacgagatttctcaaattagtatggttaactcagtttatagtacaaagagtgctcatatt

SEQ ID NO: 107947 - DNA, 1058 bp, Oryza sativa
cttttggacctggttggaacgggtgcccattgggcctaattcctctgattggaaaaaaggccttcctttactaaaggcaatctttggttctaaaaaacggaaggtttatggttttcagttccacgaaaaagtcaagatcaaactattttcttggtctcattgtacgaaaatctatgtaaaattctagagtccgtttggttggagagagtgattgggaatttagagggatgaggttattaattattttatttggtggggaacatgggagtttgggtgggacgggggatgggaattgagaaaggaactccatcctttttcaatacttgagtagggatggtaattgagagtgaattcatcctttattttgtctaaacaaatcttaaccatcaatatcaattttcatttaagatctaatctccaactaaactccatatcaattcccaccacctctaccaaacaagagattgggactaaaaatcaaatcctcatgttatggtgtgtttagttcacgtcaaaattggaagtttgattgaaattggaacgatgtgacgggaaagttggaagtttgtgtgtgtatgaaagttttgatgtgatggaaaagttggaaatttgaagaaaaagttgggaactaaaccaggccttaatcacaccattaattctctagtctaaacctccaatcctcttcacttgtatcaaacatgaagctacattttgaatgaggcctcgtttgaatggaaatttgaaaagaatttccggcccatataagtgggtgggccaggacttcagcccatccaaatgtggcgttgtagcctccgtgtactagcacggagtaattgccgcccaccgcccgcgtctgctcagctggtttaaatttgaatccggcgagcaaaccaataactcttccctcttcagtcttcgctcagactcctcgccatttgagccatcttccgttgagacgtgtaagctcgaatctttcatcttcccatctgatttcgccaagttgtttctacaaagatttgcttgcgatttcttttgtcttggcagattcgaatccgggg

SEQ ID NO: 107948 - DNA, 755 bp, Oryza sativa
tatagggcgaattcgagctcgtacctctttgctcacactttgtttaacccaaggaattaatacttttcacccttggggcaagttcatggaaattcatttcaaaaaaagctttcactttttttcggaatgcgctcagaggtacgttaatttttttttgctcttaaagtttgaaattctatgaattatcctcacttaatgtgaaaagcagatatttggagacgtaatgtgtatggattcacttgttagtaacccatctcattaactgtttgcagagtggatctaagagttcaggtgatggtggaccaactcagagggcatcagcattggctgctctttcatctgcattcaacccatcttcccaaaagaataaggtattgttaacactcccaatgcacagcagaaaaaatataaaatttgttgatcttacaaactataagcaatgttgtgttctttttagggtaatgataggcctaaaagctctgatggtggacccactcagcgcgcttcagcaatggctgccttaacatcagcgttcaatccatcagcaaaacccaaaacccaccacaacgtgcaggtcaaggttctcagcgagcagctgctgttgctgcgctgtctatgttttgactgctgagggttcatctcaaagcccacgcataggtaggtcttccccaatggcaggtatgacttgtggcctactatttccttcccctgcatatattttaagggtaacaatatcaatttccttcatgtggtgc

SEQ ID NO: 107949 - DNA, 612 bp, Oryza sativa
catgttctcactggataaccagatatctggtgaaagggaaaaggtttctttggaaaaagtcagaaaaatatcattatgttcaaaagggctggatattgaagaaaacaaaatacatatacaacataatgaaaagactatacctctccagcaccagctaagagttccaaacttctaacatttgaaaggctgtgaatcacattttggccaccaaatgtttcagcattgtcatattcgccatctttactggaattatgaccatcaccattgttaccatactgaagctcaccacactcatttgcaatctcactatattcataggtgttgtcatcactctcaatatcactaccatagccataaccatcctcgtttccaccaaacacaaatccttttttagcgtaattaatcctataccctgccttatcattcttctgataaccaaaatcatcatcatcagtggtttcatcaatgtcatcttcatcactaatgtgctgataatcatcacccaagaaaaggtcatcaagtatgatagagcatgtcaccagcgactccaagttcttgaacgatggaactcggatgtaaggtgtgactatgttcagaaaaacaaggtttgga

SEQ ID NO: 107950 - DNA, 632 bp, Oryza sativa
  unsure (1)..(632): unsure at all n locations
atttgattcgagctttctagaatgtaaagttcccttagatgagcgagagagagagagagagaagatcacgcatcctattggactgagccagcccaagtaacctattgggtaaggaaacagacgcagcttctgctaatttatatgcatggcccatcataagcaacatcactggttgctgtatgttaacaatttagactccaaaaagaatttgaaaatgtgcttcagagtttaaattgcgtctgtcatactaccttaaaaaccttttgccagatagcttcctgcccggtaaatgctaaaggcaaattaattccttgaagtgccatccagtcaatttctttctcccatcttttccaatcccaccagacaaatgagtctatagagatgctacatgaactttgtcagagataaacagttggaaaccaagtaaagaagagtaaaagtagccagattgggagatntnntttgaagactaaaaatgtgtggtttgatcttgaaaagaacaaaaggtagatctttgaaacaggtagaatacagaaattaaaaaaaaaacttttggcagaatcgcaggactgaaatgcttagaccaaataaaagaacttcaatttgacacgcacagcggcaataatagattt

SEQ ID NO: 107951 - DNA, 686 bp, Oryza sativa
tttcgaaattcaacttttaaaacatttgactaaccattagtataatataaattaaattttatttgctgaaaataatattattggattgacatttggatttactttgatatggttataattttgttgctataatatatgagaaattataacacaaagattagttttggagaatgtcccaaatttgatcgtgccttatattatgggatgatggccctgccttttagatatgaaattgcttttgaaaaataaaagttatgcagattttaatttgcattgtaatgctgttcaaattagtcacacgttctgtttggtgcctacttcctccgtcgcataaaaaacgaatttagtaccggatgtgacatatactgggttggttttttatgggacggggagagtagcacagtacattcgcacttgtgacttgtactatagaataccgaatagtactattaggcaataattattacagtaataagactgtgtgactcacaccaaaattagaagtttggttaaaattgaaacgatgtgacggaaaaattggaagtttgtgtgtgtaggaaagttttgatctgatggaaaagttagaagtttgaagaaaaactttgaaactaaacacggtgtaaatcccagtgggtgcttgtcgtaaatttcgttcatattcaaacctgtctatttacatggaaaca

SEQ ID NO: 107952 - DNA, 1149 bp, Oryza sativa
gatccggcggcgggctagggtttagggttttttggattttttttttgtttgccgaatttattttacggcggcgatggcgtccagcgccagctccacccagtccctcgcctcctccatctccatctccaccgctgagccacggccgccgcgacggcctccgcggcggcgagcggaggagggcattatgcggttggtggtgagattgagaggaggaaaagctacacgcacgggattggtgtccggctccgatggagtagtagaagtagcttcttgcagaagccaagctaaaaactggactagccaaactgtatagtcgactgtccagtttgatctagagcagtcaaaactgacgttagagcaaaggttaataaatgggcgcgcccacagtcaacactatagctaagccaatactagtgctccctcacggttttataattctcgaagttttggataatgacacagtttttaaaatatatctttgatcttattttttatatatataataaataaatgaatgtttacttttatcatagaattttaaagacaaattcatatacgttgttctagttattttaaactaaatacttttaaaattattgatagtcaagttataaaagtttgattacaaccttatccaaaacgtcaagaattataaaaccgggtgaagtaattatagaacttgagtagttttgtgagcggttttggtcctacatgacagtttagtcaacaattttcttttaagaaaatatgggacccacctttcagattctatctactgatctgtatctttttcccctctcacctctctctctatctctctatccctggctgaggagtcgcgacggctacgagcctactcttgcgcatgctagcggaggcccagtaggagcggcgatgactacggggctcctcgcgcaagtgccggcagagactgagaaggagaagtgtgagtcctcgcgcatgcgccggaggaggctgagaaggagtggcacaggctacggggcatcttgcgcacgcgctggcagaggccaaggaggagcggaggtggctacaagcatcctcacacacgacagtgtcggtgtgcgtggtggtggagatgacctggccacaagcagctctagtcatgaagctcggcgagacgtgctacgg

SEQ ID NO: 107953 - DNA, 979 bp, Oryza sativa
ttcaggtgatttgaaataatacagattggaacatggtttgcattttgggataaaattaaataaaattccgatggatatttggtgatactttcgaacaaaaattctcagacaaaattttaaataaatttatactgaatgcatgcatgcctgaattcaaacaagtattttttatatatatatcgcgttgaaaagtttaatacacctggtttttctttcttttgattacaatatatatatatatctgacaagtgatgattgccagaaagatttaattgcagagaacctacgagcagagttcagtactgtatttcgttttcaacatttatattggggtgccaatacggtgaaatttcaaaaattctggtccgaaattattttagtttttcaacaaaatttggtcaaatttgaataaatattgtcaaattcaaaaaaaaaattgaccaaaataataatgtattggagggtccaatagaaccgaaatgaaattttgaaccttgcctacgaggaagaaagatgcttgtgctcaggatcagttttcaggccattcggcatgttatactacaagcgcttagcgattgtgccgtataaactacaattaacatgcatagagggtaaggaaatgtgtaaatctcagaaaattcctgcaaaaatgcacccatggacaaagtgaacatgaaaaatataaatgtttatggtgggttcaacatttctttctttctttcaaatcattcgactatgctgattcttttacatgtataagcaaagtcaacaagcacgatcatcttaatgtaccaattacccacgcagcagaatccctgagcataagctaagagcaggtttaataggtggagtaagcaccggctctaatttacatccatgtcattcaaagcatcttgacaggaccattcttagggaaactattctaatccctcgaggggatgttccctcgtttgctcaaaaaccatttaaacggttatga

SEQ ID NO: 107954 - DNA, 552 bp, Oryza sativa
ccaggagccgggtaatccgtttttgcaaggtccagtggagcaaccacgccgaggaagaagctacttgggagcgtgaagacgagctgaaggcagcccatcccgatctcttcgccagtccttctgaatctcggggtcgagattccgtttaagggggtaggtttgtcgcgtcccaaatcgactctaaaatacatcctcgaaattgtgcatagaattagtaaaatccatgtgaaagcctccaacaattaaaatgtgcaaagttaaaagtcaaataaggcttggaggatttttgtatatttcctaaaagcctaaaatgtgtaaataaattttagtggaattttcagagcacaaataataattaagaagaaataaacaaagttaaaaaggttttataaaaagaaaaatcctaaaaagtctttccccccctttttcccttcttgggccggctcggcccagctccctccctctctctcctctcccccccgcggcccatccggccggcccccgcacgcgcgccgctgacgggcgggcccgaccgccaccctcgctgacggg

SEQ ID NO: 107955 - DNA, 709 bp, Oryza sativa
tccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatttattttcgaatgtcattgggtggaattaacatattctttgttatggcccttttgtacttgattactacattccttgataccttgggttattacaatttaactagttgagctttatttatattagttcaactagatattagatataattgcttagcttgcttagaaacattagtacacattcgggataacttatgactcactattatttaatgatggcttaatgatagttcacgatggtcaatcgtgattagttaattaattaatgtgccaactaaaacctggtaatggtgggttgtgagcacatggttttgatggtcgtgctcatgacaattaaggaccggttcacaagtttcggttgtgaaacattaaccatgccaaccacaagccagcatgggcaacggctttatcttttgtatagcatggttcattgcggggcgccagactgaaatgtggcggagataagcccacgggggtcgctggggagtccatgccttgtttataagggggtgattatgatccaggaaggtgcgctgcagtggattgtgttatgcgaggggtattgtca

SEQ ID NO: 107956 - DNA, 527 bp, Oryza sativa
caactttttaccaactatggatggagattcacaaataggcttcaataaatgtgtactccttatcctattttggttattttacttcttaaattggtgtcctatttttttttttgaactttacttgttttagagtgttagtttgtaataattggttgtagctcttttgagcaaaggccgggatgatctattccattatctaaaaaaaatcctctttagttggatagttatcgggctctaactcatttggaatcaacagtagatttcgaatatgcatttgcatggaattaaaataaatacggtggataatattgttttggccaaagatccttgctatatatgtccgcgcggctgggacgcgcgtgtgcatacaaatacaaggaaatgctctctttgcgccacagtcgattggaaagtgatcgcacatcaatggatctctgatacggccggatcgccactataaaacaggccattttctttacggcggggggaggcagcaaaaagagtacagaggcacgagccgagggcct

SEQ ID NO: 107957 - DNA, 874 bp, Oryza sativa
atagagggggaggtgtgaatccaatttcacaataatccaaccattccatagtgtccatgtgatatgaatatcctaaaggctagagttgtaaaaccacctaatgttgcctaattaaccagcgaagcatctacctaaaatcatactagtggtaccatgagtagagtgtgcactagttggggttttgtttattctagggtgaacaaggaaataataacaataacaataataagatcataacaaaggtaaataggcatggctatataaaacagtgataacgcgggaatttaaataaagcgataatgcaataatttaaatcaacataattttataaactgggtgtcacgtcccaaaacgactctaaaatacatcctctaaattatgcctagaatcattaaaatccgtgggaaagcctccaacaaataaaaggtgcaaagttaaaagtcaaataaggcttggaggatttttgtatatttcctaaaagcgtaaaatgcgtaaataaattttggtggaattttcagagcacaaataataattattaagaaataaacaaagttaaaatggttttataaaaagaaaagctctaaaaagtccttttttccctcctctaccccttgggccggctcggcccatctccttccccctccctctcctctcctcgcggcccattcggcctcctctccttgctgacgggtagggcccacccgtcatccccttcctcccgccgctcccgccgccccgcccacgccctagcgccgccgccgccggaaatcccgccgcccccgtgtcacgcccagaaatttagcccaaatttccagactattttgtgtattaaatccctgtccaggaccagccagggtacacaaaacgacaagta

SEQ ID NO: 107958 - DNA, 757 bp, Oryza sativa
agagagaggacgacggcgcgagctcgattccgacggggagagaaagcggcaagggtcggaaacggaggagggaggcacggggagtgcttaaatagtgttgggagtgagagagggcggccggaggggaaggaaaccggcgcggcgatctcggctccatcaatgacgccggcgaagtttgcgggaggatttccaaacgaatccgagagagagagagggaaaagtggggggaaagaggcagggaatcacggggagtgatttcccccctctttattgcgcgcggggccggcgggatgcggcggaatccgcggcggcggcggcgctagggcacgggcgaggcggcgggcgcggcacgaggtaggggatgacgggtgggccccacccgtcagcgagggtggcgggcgggcccgctagtcagcgacgcgcgcgcgggggaaggccgatgggcctcaggggagaggagagagagggagggagctgggccgagccggcccaatagaggaagggggaaaaaggacttttagggatttttctttttataaaaccactttaactttgtttatttcttcttaattattatttgtgctctgaaaattccactaaaatttatttacgcattttaggcttttaggaaatatacaaaaatcctccaagccttatttgacttttagctttgcacattttaattgttggaggctttcacatggattttacttattctttgcataatttcgaggatgtattttagagtcgatttggg

SEQ ID NO: 107959 - DNA, 1893 bp, Oryza sativa
tacctcattccttcaaccaaacaaaagaattgggattgtcccatcctacaaaccaaacaagtaaatggaatcatcccaactaaatcaggaatggtttcatcccatcccacctagtcccaaaaccaaacacatgctaagaaaatgctattacatacttgccataaaaacggttggagcccaacatatctgccaccaaaaaggttggaatccaacatatctgccattagattctaaggcttgaaataacaccgttaggagttgagttctcatccaaatcaggacaaggatgtccctgcccacgaaattgcaggattaacgttctttggcatcaatatacaagaaaaatatcaacatgatagcaacaagaatacagtcaattatcaatgctgctagctgtcgctacctcccaagccacgtgctgttgctgtcgccaaaacctataaatgcgtctttagtactggttgataacatcaactcgtgctaaatatacttttagtactgataccttcagagttagttcataagaaaaacatctctattcaagttagatatgtggagtaggtgggatgataatgcgcgtgaaaactgaggtgagaaatcttgagtttgaacctcacattcccaatttttttttacttagtatgcatctttagtaccgattccttcaaccggtacttaaaaatcaagaactttcgtcttagtttacttgtctcatttactacaaccggtacgaaagaggatttagaaccggcactaaagatcatttttttactagtgtgtcgatctcacaaaaatcgatctccatgagttctctcattgccgtctctagatctaagttcattacaacctttttttaagttgatttactctttgatttgaaatggatcagagaatttgggaatttaggattgctgcaaggagaggggaggggatcggttcttgcttcgtatgcagtaagtcgggagagaggggcagggaggagataattttagtcaagggcaaatcagtcttattatgttgccttgtttcttcgcttagttttatgaagtaatttttgttcttttagttacactagtttaaatggtaatggcaaagagaagcacctcaaaccaacttcagtggcaaatttacaattcgtgttttttttaatgtttgtacagagttaggggtgaaagtagtgatatatttgtaattcttcctacattcaatttctagtagtttcttcatggtttgtgagttttcttccttcgttagtaaaaattgaaaataactttgctacataaagctagcaaacctatgctatacaatattcccaacttccgaaattcttgggtacttttcaatcatacttaaatcaataggttcaacacaaaaattcatcaactgaataaaaacagtttgatgccaattatttcaaatcaaagaaagttcaatccatacaagttgaagtaacagtgatgtataattgtgcattgcaccgtcaatgtatcggtcagtatcattatatctaaaaaagctactttagaattatgaatacccatcctacaaatcctagatctgtcactgccatcagtaaaccgcgcttaccatggaggctcgggaagggcaactagcataatgatttagcaaatttcacccgaatccaaatttgagaaaaaaatataaaactcatggaagcggtacttgaattgtataactagttaaaccctatatctatatccaagccctgaacgagtggttcgggtgcatagatatctaaatcgaacggctgaagatggtgacagccggatctgcagcgaattataaacaaacagttttaagtttccaaataaaattgtaaaggaataagttcgctttagttccctcatattaacatagagtttgaattacatt

SEQ ID NO: 107960 - DNA, 555 bp, Oryza sativa
aaaaattgagaccgcctatacatttgtgattgtagtacaatcatgatgtatttacaaacgtgacttttacacaatttaaaaaaaaagtccctttgttgcatgctatttccatgaaagtgagagtaaatcctctcacatgtgttcacatgtgtgcgctgtgattttttccatcctctcacattgtgcaacaaaatctaacggttcaaaactacgcggaagttaaattatagttatatgcaagttacaatgtagttacatcatgttacatctgttaaatttttagaaaacaaattgttgaaaatatatagaaaaacttaaaaaaaaagtacacatgacacaaaatctattctctcaatcctaaaatacaacttctctaccaatattctcttcccaactaatcacaaccctccattagtaaattcttttacctatcttcacttttcattcaatcacaacctttttcttatttcattttatctactgtcttaatataataattgtattatgtaaaaataaaagtctatatattctgtgacggaggtataataagctcta

SEQ ID NO: 107961 - DNA, 768 bp, Oryza sativa
gttttgccgggctttacaaccaatagtccaacgtcgaggatagtaaaccacacgaacgtccccgtggaaggcgtaaagttccaaccggcagcttttcagtggctaatgggtattttggggtaaaagaaaatatttgcaaaaggcaaatataaattcaaatgatatttgaataaattcaaataaaattataaaatagcaattaggcatcaaaatgaagcatttgaatttatatgaatttaggtccaagtttcactggaatcggatctacggtttaggagatatgggcttttaaagaataggatttgaattaaatctagaaaatatgaaaggttactattcatggggcccacctgtcagcctttctattctttttcttttctttctctctcctcctcttcttcctcccgtcactttctttcttctcctccttccagcccggtaacagaggggagagagagaatagggcgccgatgcactgatgatggaacggcctcgacggcggtggtaaagtgtgttcccgaacattgagaactcggggaggtatgtggaaggaagaggggaagaggtgagtggctggaacggcggcgacaaaagctcggccgcggcagtaaatagagtagcggtggtggtttgattcaaaagaaaagggaagggggaaaggggcaaaatggaatcacctcgacggggcggatttagtggcgcgaggatttggccgacaacgctccggtaagggagatcggtggacggccggccatggctagagagaga

SEQ ID NO: 107962 - DNA, 884 bp, Oryza sativa
tttcgtcaaaattaagaatttcggctaaacagccgaaatcaatctacactgtcatcgtttcatcgagttgaggcaactttcggccgtgtggccgaaattgattgcaatagtactgatctgcagcagcccgccgccatcgacgccatctgcttgtcggctacagctgcgatctgcatcgacgtgtctcatctgccgcttagtgcttagggtcatcaagtcgtagcaacgtcgtatacaggtgcatgcgcgtgtaccctgaccgaggagaagcagtagcagggccggcagagttttgctgtgcacggccagaaattttgagtatcaaatctattcggtttgctgtgtaaaagaagagaagaaaaaaaaggatcaggctatcacagccgatctattactgctcacgtacccaaaaaaaaaaaacatagcagccgatctaatctaagatcggttgatctttggtatattttggtacagtaccgaagttactgttacgtccagaaaaatcaacaaaggctagttttaataaaattggctaaacacagtaacatatcaagaccatatattaatctattcggtcaaatatttcggctatgagctatatggccggatttaatcaaggaatttcttcatcaaccatgatgagcgggaacgagatcatgtcggtcacattggatgatttcgaaggagaagaccgcaagtccatggaggagtacatcaaggagatcacacaggaggcgttgatgagggcgtgcactaggactcgtcaaggcgtgatcatcaagcccgggccttcctaagctcgctcccgatttggtaagcaatgacgaggtaatacaatctatccaacaacaagtagcatctacaatgggtaccgagctcgaatt

SEQ ID NO: 107963 - DNA, 1405 bp, Oryza sativa
ataggggtctttcggctagctccatattgtggtgggctagatgatatgggttcgaagtctcacttcttcaaattatttgatattagattcttccctaaaattcgcgttttgaatacccatgaattacattgcatctttccctgaccggggtattgcaaacctcgacacaaactcaatgcgtactactcaacttgtcgcatacatgttttttctatgttatatatgagttgtatataaattgtaactactatgttatagtaaaaaacattatcaaaatgttgtaatctgattatattatagttatacataaatgttttttaaaaacattaccatatgttgtataactactccctactccctagagtatgcaatatacatagcgtaagcgcgatgcaacgtggaactatggatgtctggcattttggttcgaatcgagacatgaccagtcgggacagatagatggtttaatgagcaggttgggagtcgtgacattaatgtgcctatttgatttgtcactggcatgatgatgtattggctttgtttagttccaaagttttttttccaaacttttaactttttcaatcacatcaatctgtcctacacacacaaattttcaatcacatcgttccaattttcaatcaaactttcaactttgacgtgaactaaacacagccattgattggagataggaaaacagagaggcacctgtgattaattagagaagggcgagaccaactacgtggaactcgctcacaatcggctgagtgatgaggagtgatgacgtgatgtagcatactccctccgttttataatataagatattttatcttttctattagttccataatataaaaaattttgctatattacttgtcacatctatcaattctaattcaaatttctatctattttaacctccaactatccaatcaccacaactaaaatcacatctagtaggggtattgtagtcttttattttcatccttaatctttcccaaaagagaataatcccttatattatgggatggagggagtatgcagcaagttttgtagccccttcgttctcattttaagaaaattcaaactcggttacttttaaataataatcatgctaatcatatttatgctaatattatacatgttatatcactagattcatattttaaaatagttttatgcgatgctaatttcatattcgttggaaacaaaacatggaataagtcaatggtcaaaacatatcattaataactgtatgaacaaaatataggccttatatatagtttgggactaggcccctttatatcggtggcgcatctataataagaaggatgggttgtcaaaatgaccgatgttcgtcgctctcagggccgcgcacaggggcgtgtggcccgtgcgaccgtacatg

SEQ ID NO: 107964 - DNA, 1321 bp, Oryza sativa
ttatattatgggatggagggagtatgcagcaagttttgtagccccttcgttctcattttaagaaaattcaaactcggttacttttaaataataatcatgctaatcatatttatgctaaatattatacatgttatatcactagattcatattttaaaatagttttatgcgatgctaatttcatattcgttggaaacaaaacatggaataagtcaatggtcaaaacatatcattaataactgtatgaacaaaatataggccttatatatagtttgggactaggcccctttatatcggtggcgcatctataatttgaggtttgggttgtcaaatttaccgatgttcgtcgctctcagggccgtgcacaggggcgtgtggcccgtgcgaccgtacatggcctccaaatttacagggcctcaaaaaattagcccaaccgaagaaggcccatgtattcgtgtgaggccagagcgccagaaccctgttcgagtccgcgcgtatctccgcgcggcgacttcgcgtgcgtggcgcttcgtattctcaaccccaagccccgaggccccacggcgttttgtattctctttcgttttcatatctgtaacttattcaattcatctcgagtttcgacgtctcgtctcctccgagcaccaggctgctagccggctcatccaatttcacattttcattcaaccagcgaatagcaacttagcaagcaaccaacaagcaaggcgctaggcagcaagctagcaacaacaacgaacattctccgttttcagtttgacagtttctaattatacaaaacaggagttaaaaaatatactattcatgatatatcgcatttgctctgcagtatatatattattttagctatatttggtacttgatttatgtctcacttagagtcttgtacagggcctacaaatttgacggcatggccctggtcgcccttgtgacattgctatctgctggctgccacagaggcgtggacgccgtgtcacgacgtttgccctttccggtttgctgacatgtcggcttgactacttgataacctcccatccttgccgtgccagtttgctgcctccatctcggacttctagttttcgtctggcgtgatgactggtgcaatgacatcgcaatgcatccttgccgtgctagtttgtttccctggccctgtctcggactcatagttgccatctggcatgatgactactgctatgacaacacgatatagtgaggaagctaaaaaaagaacacgacatgacatcgagacgaccacacttcaacttcgcgcttcacattacatgagttctttcttactatattttt

SEQ ID NO: 107965 - DNA, 1376 bp, Oryza sativa
ctagcatatctggtttgctatgttcaggttatgcatttgaaatcatgtatgactaatgcatagaacagagatatagaatatagggtagttatgctcaaaggagaggaataataacttgccttgctccaacgcaaataaatccgagatgggcaacctgattatccgatctttgaaataccacaggttgccatctaaaatataacagactctactaaagaaaaggaagaaccaaattcaataaaagccataaaatagcaagaaagagataagcagtacagagggctagggtttagggtataacctatctcctttatagggtataaggattattaggctaatattttatacgcgggttctaaagagttggtggttggggtggagagggaataagtggctacggtcacctatattttatgtgcaggctctgattggttggtggatagggagtatagtggataattgaacaggttgagcagatatgtgactggtattggctgatagtaggtttgggtagcattatacttagggtttagtcatatttaagccgattgtggagtgggacaatatatcgggcaggctctatattttatgtatatgttctaggtaggtggagggtaaatggttgagattatagctggcggggagtctggttaataagctaactatggtttcaattgtttaagccgatattgaggtaagataaatatcggctagagtttgagtgttctctagtcgtcgctaaagcatgacgactaggtttggtatcttctctagctggtgtcgatagacaatataacggctagagggatgggaggtttgtgcaagtttagcgaggcggaagtgttactccgacaaccgtggatggcggcggagcggctaggattacacagagctcgagatctaactgcgcgacgtactgtggaggtcgagggaatagtgaagctccgaccgctgtacgcatcgaggcgtggggtgccaggagcagcacttcgaccttaggtttggttttgccgggctttacaaccaatagtccaacgtcgaggatagtaaaccacacgaacgtccccgtggaaggcgtaaagttccaaccggcagcttttcagtggctaatgggtattttggggtaaaagaaaatatttgcaaaaggcaaatataaattcaaatgatatttgaataaattcaaataaaattataaaatagcaattaggcatcaaaatgaagcatttgaatttatatgaatttaggtccaagtttcactggaatcggatctacggtttaggagatatgggcttttaaagaataggatttgaattaaatctagaaaatatgaaaggttactattcatggggcccacctgtcagcctttctattctttt

SEQ ID NO: 107966 - DNA, 1191 bp, Oryza sativa
aaaacaaatcaatctactacgacatataataaaccaacattggctgccatggatatatggatgaagttagagcttattatacctccgtcacagaatatatagacttttatttttacataatacaattattatattaagacagtagataaaatgaaataagaaaaaggttgtgattgaatgaaaagtgaagataggtaaaagaatttactaatggagggttgtgattagttgggaagagaatattggtagagaagttgtattttaggattgagagaatagattttgtgtcatgtgtactttttttttaagtttttctatatattttcaacaatttgttttctaaaaatttaacagatgtaacatgatgtaactacattgtaacttgcatataactataatttaacttccgcgtagttttgaaccgttagattttgttgcacaatgtgagaggatggaaaaaatcacagcgcacacatgtgaacacatgtgagaggatttactctcactttcatggaaatagcatgcaacaaagggactttttttttaaattgtgtaaaagtcacgtttgtaaatacatcatgattgtactacaatcacaaatgtataggcggtctcaattttttgggaaaaaacgaaccatttagcagtttagaaaatgtactaacagaaaacaagaaagttgtactccctccatccacaaaagttacacctattacttttgtcaccaagactaatgtcacgcccggaatttctatccaaaattccaaacgcttaaatgtgtgtgaaccctcgtccaggaatcagccgaggcacacaataacaaattgataatagagtacaattattactctaattaataagcgaataaaatgtcattacagaggtagatagttcctctcaatcaataaggatctaagcagcggaaaataaataaacggcgcagacggctctactccacaggcagcttgaccaaagctacacctattcctccactccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtaattaaacaatattaa

SEQ ID NO: 107967 - DNA, 1606 bp, Oryza sativa
aaacatgtgagaaaaaattaacggcgtcatctattaaaaaacggaggtagtatgattcaattttaacttatcgcacatcaatcttattactgtaattttacattatcatactcacgtattttcctcatcgtctcatatttataatgcagcccctcgcaacgaagtagacggtgttaataagcagtagcagcccaaggatgatatatgtaagattcttgtcttgtgttgtcacctcaataacctgaaacattgtaagggctcggtttgggaaaactggtagaaatgacgcttgacgggttgaggtagccttaggccccgtttagaccctcgggactaaacagttttaagtccgtgtcacatcggatgtttgaaaattaattataaatattaaacgtagactattaataaaacccatccataatcttggactaattcgcgagacgaatctattgagcctaattaatccataattagcctatgtgatgctatagtaaacattctctaattatagattaattaggcttaaaaaatttgtcacgcgaattagctttcatttatgtaattagttttgtaagtactctatatttaatactctaaattagtgtctaaatagagggactaaagttaagtccatggatccaaacaccaccttagttcccaattttttttccaaaaaacatcacatcaaatctttagacacatgcatggaacattaaatatagataaaataaaaaactaattgcacagttgggaggaaatcgcgaggcaaatcttttgagcctaattagtctatgattagccataagtgctacagtaacccacatgtgctaatgacggattaattaggctcaaaagattcgtctcgcgatttccaggcgagttatgaaattaattttttcattcgtgttcgaaaaccccttccgacatttggtcaaacgtccgatgtgacatccaaaaattttcatttcacaaactaaacatgcccttagctgatcacctgctggcttatggaccaaactgacccgaacacattttttaataaaatcataatttaattgtgtaggatagggaatctataagatatactcgatcagtctgaagtccctcactttaattactactccgtattttccttagcaagcataccattaattcaatataagatctatctttcttagagttatgcctatgtataaagagggaagctatatagcgcacgcgcgccaggaaaataagttgtgcacaggccttatccactaccaaccgattcccccctccctgcattcgcatggatgagacgtctagcgctgccgctattcctcctcttcgtcgtgagcgtgcacctccatctccaacctctccatcgagacatcatcaagcccagaatcggttcctctttctttcacactgggggagacaccatctttgatcggtcgcccaaaatccacaatagtcccggttcgaataaaaaccaggactaaagatgatttttagtcccggttaaaaactttttgacctaccaaccgggactaaagatcatttttagtcccggtttaaaaagttgtcgggtcgagttaggccccaactcatttttagtcccggttgg

SEQ ID NO: 107968 - DNA, 2310 bp, Oryza sativa
gacctgggagcaccacatcggaatagtcgccgctccgcgttgcaaccaagctcgccgcttgatccgccgcggcaaggacgacaggaatcgcgccgttctgtgatgccagctcccttcacctcggcttctccagcgcgcactgccttgttggagtcgccgccgccatgagcggagaaggtggaagaggagaacgacaccgacggtggaggtagggagagtggcgttagccggcgattgggtgcggaggtagaggtggagcccgcttgccgaagatgggagaagccaacgcggcaagaggagaggggcggcctcgaccgaggaggggtggatctggccggtcctctccggcgccgccgccccctgctccgcagccgcagcgcgctgccgatgctgccgctgcttcggggatggagaggaagggtggatctggccggccagctgccgtcatcgccctagtgccgcctcgctgacgctgccccagtgccgtgtctatgcgatggagaaaggaggaaaggagagagaaagggagataaaaagtgaaaaaaaaatactagtgggacccactatcggtaacatgcattgtggagtacgtggcaaatggggttcttcatctagctggtatcccaagttcgccaaaatcacacggggcactgcaattgcccttagagtcatgcgcatgactgaattggtcgtgtaaagttgagctcgtcgtgcgtgattcgttcggacgggagcgcgtcactcgggcacggtcatgacgcttgggatggcattcgccgctaccatcctgatccaaaatccgatatggcaatgccatcggaacactttacatagcataacaatctgacatgagcagctatacgacagtcctacagaatgctgatatgtggggccttctcattttttttctatttcttatttttactctttttctttatttttcctcttccactctctctctccctttccttctctctggtggatcggtggtggtggttctggcagcgattccagtcgatcagcagcgatagcgcctccctccgacccatcacaactcctcttctcgccaccaccagccattggcaccaccccaagtctgaggacaacaaccagtttccaacaccgaagaggccaggcgtgatagccaaccagttctcctttactggctcgtggtaaatatgcctcgcctaacacaccttggcataagagcatttggccttggcacatgcactactaaaaaacccttatagggaccggctcataggtgccggttcattaaaaccggcacctaaagagcttttcccacctcccactacttgtagtcttgtacccccttctcgaataagcctcccatccccgtttctctctcccatccccgtctctctctcgtctcgatctccctcccggcactctctcgtctctctccctccccggctcagatctggcgtgagggggcgggaggcagtgggtagcggaggcggtagccggcggtggcagctgcagaggcggaggcggaggcggctgccggcggtggcagatgcggtgcaccacggcggcggcggcggccccctcctcctccacctcaccctcctccgtcctcccctcccccttcccctccccggcgctctctctcgtctaactccctccccggctcagatttagcgtgagggggcgggaggcattgggtggcggaggcggtagccggcgatggcagctgcggaggaggaggtggctaccggcggtggcagctgcggcgcaccacggatgttcatatgtgtatgttcatgttcatgtttatgttctcttgttcatatgtgtgtgttcatgttcacgtttctcttcttcatgtgtaccgagaacgaattgttgttgttattgacgtgattttgcttttgaatgtggggatattgatgtgtaccaagaaggaattgtcgttgttattgatgtgattttgattttggatgtgggatattgttctggatctgagggattatgggatgtggaggggttctggatttggctcgggattcagctcaattcgagccgaagttttttttttggctcaggtagacatgataggtgccggtttcatgtatttgtgccgaccaattggaactgttcgggaaaccggcacctattgtcactttccaaccgacacctatggcatgttctgtaccagtgatgctagatctctgctcgtcgcctcgtcctacccattgcatgcgctgatccgcggtccggtcctgaccacgctggcggggagagaagggaggagtgacgaagtgagagtggaaatgaaaaataaaaaca

SEQ ID NO: 107969 - DNA, 2498 bp, Oryza sativa
tattgtacgtgctctcggcaataaatagggcttgctggctagctcgggggaaattaggccatgtttattagttcccacacaaaaacttttcatcttgttacatcgaatgattggacacatgaaaggagtactaaatatagataaaacactaattacatatattgcgtgtaaattgcgagacgaatcttttaagcctaattccatgatttaacaatgtgatgatacagtaaatatttgctaataatagattaattagtcttaataaattcgactcgcagtttataggaaaatgctgtgtatacgatttttacttaagatactggtacgatcaaacagtaaacagcggacggagcggacggggtggacggcacgggcctccgggcatctaacgggtgcgcacgctcatgcgccctgaagcccagacccatcgtcatgggagtattagtatttgagactattatatgaccgtactgatctaccagtaacaggtgctattcaatctaactaaatttatcatctgaaaattgtttttcttaaaatgtaatcagttgaatgaataatccaatttttgtaaataacatcaagttaattctattatattaaaaccaatatttaatatattttgattaaatatttatcttgtgcttaaatattgctatatttttctataaacttgatcaaaccaaaacaagtttgattaaaaagaatccaaacgacttataatatggaacggaaaacggagatagcactacataaaataaaatcgattatgacgattagaaataaaattactccgtgtagctgtgtgaggaggcttataagatagcaagccaaaacaagattagcttgggctttggatatttcaacggtggaagagagattttagtgtgtgggatccaaactacatatgtataggggttagcttgggctttggatatggtctaacgggtgcgcatcgaaccaaatcggatggtacagtactacagtaggtagctgcggtggcacccgttagtgtgggatccaaactacatatccaaacggtagaagttaattaggatacaatcattccatcgtacaaacatcgtaacaatattgtcgtatgtatagcggagctcgcagtttataggcgaaatctgtaatttgttttgttattagactatgtttaatacttcaaatgtgtgcccgtatattcgatgtgacacgttaaaacttttcacctcttaaagtaaacatggccttgtgtttaattcacgtcaaaattgaaagtttggttgaaattggaatgatgtaacggaaaagttgaaagtttgtgtgtaggaaagttttgatgtgatagaaaagtcgaaagtttgtccaaaaaatttggaactaagggcaaaggagagatccatagttggaaggaaagcgtagcaagtaccttcatctgcacgccggagaagcagctaggacgtcacaagctcacagaagacaagaaagagagaactgatcaaacaggaaccactagttccaactaccaactgacagtgactgacccttaacataaactcaagagggaccaacattatatatataactatacaaatagtatccaagagcagggaacaaaagctattctaactgcaggacatctatttcattgtaaaccttctaaaagtgtaaatctataatataattttaagccaaattagctgagccagccagaaaccataaacaatgttagggtttattttcattggcttgtccaaattttctataaatttacacaaattttagattttttttaatgaaatttacatggagtctataaacctaggcataggacttgagccctagctactctaggcctagatccgcccctgagccgattcaattttctttccacccctgttggcaattaagttggcaatgccaaactcttacagtaaatcaaataattaattgttactggttctattttgaattaattttcgtttggtagttgttttcttaagagcaataaacaaacagcccgacgctacaacttcatttccaagcaatggtgcctcagagtacgtgaagttaaagcttaaatcttaaattcaataatgtataaaaatattatttatatatatcctacatatatatatatatatatatatatatatatatatatatatatatatatgtgtgtgtgtgtgtgtgtgtgggggggggggtaatagtaaatactccggtgtaaacatgcatattggaaaatgacacgcatgtataagggatgcgatttttttttactatgatcttggtataaatatgtactccctctgtcctaaattataaattatatatatttttacacagtatttaataacatacttttacctgtattttattctattatgtggtcccaacaaatatgaaactagtgtcatatgaaagtacttcaaaatataaatatagcgatataacatacataatacttagtataaatatagttagtatgattgttagttaaaagctag

SEQ ID NO: 107970 - DNA, 701 bp, Oryza sativa
tatttggaggaacaaaagaagaaatgggggatacaagtttctagtaacacagaaaggaggaggaggaggaagaagagaagtagatcgacaagggatgcccaccggccgcccaggtcgccgtcgtcgccgtgagcctcagctcgccaaattgatcaatcgatgcccccatgttttctgttgctgctcatatatgctggtagtgctgcttgcttaggcctaggctggaacatgactaaccgagcccatggtgcagcccagtagaggcccgacacttgggcacgtagtacatcggcaatgagcagcaccttgcgcaacttgatgttgtaatgcatgatccagtgctggaactcctcgtgcaggtacctcactggccttgcacaccatgccaccgccgctgccatgctcgaacatgacgcagtcaagcgagccgttctcgaggtacttgtaaacaagtgccttggtggtggtgccttgatgtggtaatatagctgctcctcggtgcggcggtccagtgtgcggtgcagggtcttgacagccacctgtacaccgttggaaaacttgccgtagtacaccatgccgaagccgctccaccaagctactacgctccgcgtagcccccggtgaacttgcgcagattctccggcgtgaaccaggcgggcttctcccggagtatgtcatccaggaagggttccacccagggtt

SEQ ID NO: 107971 - DNA, 634 bp, Oryza sativa
tacctgctggaggccattcggtgctggtaatagtcatcttacgtacttcttcttcagttcgcatcggtgcttttctcttctgagtcttactcttcttgcctttggcttgcttagtacgtgaccccacgtggtacgaagggctaggaggaaagcaattcccgggattcaatggattctctccattgggctctctactttgcacactaggctgcaagcttgacttggtgcgaggaggctggtttagcgatgtctgccctattaaaccaaaggaaggggcttctttggcatatacccatggacaattcagggcatagtgtccttgttctctacaatcgtgacaaaaggggacatcttcttctggcattggaagctcattgacctgggtggcaaacgctcgatcaaacacatactgattttggtcttgacttccaactaatggtagctgtgaactaagcagcatgcttggaatggaccgagggtgtgcccttgttaactctcttgaggccagtggcggattgagttgaaaacttgagttactggaggcatacccgctgacattctttcctttttctctgttaaacatctgttacagggattgaggtgagagaggaaaccaaccaggaaagaatagacc

SEQ ID NO: 107972 - DNA, 834 bp, Oryza sativa
taacaaaaattctccgggccacatttgaatttttcttgtacgtattttagggtttgccaatttcttttcgaattttaattaattctattattccttttagcgaatgatttttaatttcgggatgaatttatcaggacgtgacaaatccaccccccttacaagaatctcgtccccgagattcgaggaggctagcaagaagataggttgggcggtcttttcttcttgtctgacttcttccgctccgtcttctataacaaacttgcctaacaaaacttctccactctggactgcttggctcgatctcctgttgcagatggaatcttctcttcacctgacttttccctggttgtacctctagctgacttcgactgggatgcggcattggaagatggggcttcagttccataacttcttataactcgtatctttggagtcaacctcatacaagttaccacttcatgtcatgcgtcaacactagcttgtcattactaggataccatgtttgtcatcataagaatgtcatgcttatcatttacttctaacttgccactgaatgctttggagtatgatgtcacgcttatccagcataccatgtttgacaacttgtcactaactgcatcatattagctttcctagcctccgggtgctagatactactgctattcgatgcaagggtcgataacttttgcctttgaattacgtttctcaaaagaaccaacttatcacacttgacatgctttgacatcttcctaaataactttactactgaacttgttattgtctgaccgttttcctgccaaatctgaagctttgttgttagatgcgattttaatc

SEQ ID NO: 107973 - DNA, 739 bp, Oryza sativa
aaaaaaataaattaccgtttgtacttatatcatcctttaaccattcttttcatttacactacagctaactttacattttcgttacaatttggaccaccccattttatccatctccaaatccgatgactccaccgcagctccacctccaaatccaatgactctacaaccactctgcacactaactctttctctccttttacgtttttttcctccaatatttgggaaaccaccatatctagcaaggaggagcccggatctaacatcttcgctctatgtcaggtcggctcctacctccccgagtccctgcaaacccgacaccccgacctcaactacgaccataacaatagcatacatgctggcaggagaggagaaaaaacatatcggtcactagtgggtgcggctatatatgcgaaggtggagagaaggaacgatgttggctcatgaagaaagagcggtggtgacagtgcgtggaacgacagctagtggttgtcggtgctccgagaagtttaccatcaatacaatcccaactgagtttattgtatttttttttgagtgtagtacattggcggtccttaaacttgtgtaggtgtgtcatctaggtccctgaactcctaaaatgcatttttaggtccctaaacttgtcatgtgtgtcatataggtcctaaccggttcaaaccggctccatgcgctgacgtggcattgccacggtggcacctacgtgtcattggaatccacatgt

SEQ ID NO: 107974 - DNA, 2021 bp, Oryza sativa
ttagttcgatatgtgcttgtaattaattccacgttctcgtatatgcgaaaaaatatcctgttttcggatatactctctccgtccctaaatatttgacaccgttggcttttttaaatatgtttgaccgttcatattattcaaaaacttttgtgaaatatgtaaaactatatttaacaatgaatcaaatgataggaaacgaattaataattacttaagttttttaaataagacgaacagtcaaacatgtttaaaaaagccgacagcggtcaaatatctagggacggagggagtaacaaagttaatataatgtagtactactaatgtatatatatgtaggtgggtgtgtttaaattttgagagagataaccgaatagatggatggatggggctgagctcggtttcctgaactcgacgcaacagcgactgtacaaagacatgcttcttgtatttatgcacatttacattattacatactccctcctttcaaaatattcgacaccgttgactttttagcatatgtttgactgttcgtcttattaaaaaaaagttgtgaaatatgtaaaactatatgtgtacatgaaagtatatttaacaatgaatcaaatgatataaaaagaataaataattacttaaattttttgaataagacgaatggtcaaacacgtatttaaaaagtcaacggtgtcaaacattttgaaacggagagagtatatgtatatatatggatatgagatttaacctgtcagggaacagaacacgccagtaggccacatcattcacacacagcagaatcaacatacatatacatatatgtatatatgatctcttcaggaagacaccaacgcactgtgacagcaaagttcagacaacatatacattatacatgctcgctgtatccgaatcctactaatcattcacacagcggctaattagttaccagcaaagggaacagctaaatcaaattaagcttaatttctgacactggaacacgtatggtatattcagaatattataccagtatgacatcatgcagatcatggcaggtgaggcaaagaaaaataaataaaagaatcaagcgtataaatacacacgtatagtattagtaaactagtaacgaaatggagatgattgcaggcggggcgtggaccgggagcggaatatgctcggggatcccggtcggattccctcatccccacctccgttgttttctcgatcgagacgcggcgtcgtggtcaaacccggccggatgacgtcgctgcgccgtccgccagagacccggccggccgccaccgccaccggcgacgacgactacttcgccaatcgccgtcaatggccgcgagcagccggcgactagggagtagggacttgctgcatctgcggctctgggctgcttctgggcttggctgctctgggccatgatgccatgatgggccgctgcaagtaaccggcgagtaagtagccgtgaaggcccatctagaaaaaataaaaatgaaactggtttacaattggaataagttcacttaggtccctgataattcacgttgagtttgaattacattcttcaaccgcaatgccagatataacgtgtcccttttcttttaaaactggtacaaatatagttccaaggcagtattgtaggctattttgactgacgtagcacgggaagcaaaaataaatgatgaaaaaccttgtgggcctcacatgtcagtgaaacatcttcctcctctctctctcctcatgtcccctctcttcctcatctctgttcaagtctccagcgtgctgtatcagaggggtgaagggcagtgtcgctacgaacgagcggcgcacaacacgcatggcctcggtcacagcgcctcattatcatcacaatgtccgcgttgagatggggtcggtggacccagtgattgcaattttggttcgaaattttggaaatttcagaccccaccggcaaatcaatatatcgaccgaaatttttgggttttatcaaatttttgtttaacttggtcaaatttattcaaatt

SEQ ID NO: 107975 - DNA, 772 bp, Oryza sativa
aggtacctgcacgaggagttccagcactggatcatgcattacaacatcaagttgcgcaaggtgctgctcattgccgatgtactacgtgcccaagtgtcgggcctctactgggctgcaccatgggctcggttagtcatgttccagcctaggcctaagcaagcagcactaccagcatatatgagcagcaacagaaaacatgggggcatcgattgatcaatttggcgagctgaggctcacggcgacgacggcgacctgggcggccggtgggcatcccttgtcgatctacttctcttcttcctcctcctcctcctttctgtgttactagaaacttgtatcccccatttcttcttttgttcctccaaatatttgagtgttgaagcatatatggttgctatttgaattggagcaaagggtgctaacaatttggtatcagagctgtcgattcatgggatttctagcatggagttgatgggagagtactgcagcaacgccccatgcaagtggttgttagatttgggcaagggtgctgctcatgacaccgacacccacaacctgttcgatggaatgcctagccaatctgagatgcccaaggaaaatcagaggatatctaagcctgtccccatcaattctaccgtgaacaaaaaggagaaatggctagacaaagctctagatcggatattggagaagtttgaacaaatggaggccatgcgcatgcaagaggagaagatcaattagatatttcaaaagttggagaagataaaggtttgtagga

SEQ ID NO: 107976 - DNA, 1680 bp, Oryza sativa
gaaagagagggaggagagagagacttcgggctgggcttggcccaaaggaggaagaggagaattatttttaggtttttctttttattaaactttgataattgtttttgttgcttaataattatttccggtgctctgaaaattcaagtaaaatttgagggctccttttagaccaaggagaatttaacaaaaattctccgggccacatttgaatttttcttgtacgtattttagggtttgccaatttcttttcgaattttaattaattctattattccttttagcgaatgatttttaatttcgggatgaatttatcaggacgtgacaccaactccatataaacctccggttgtgatgctatggtatccatatccaatgtcactatatggttatccttttatgtattacatgccttggatgcatcaaccacctatgccgtattaccaagagtggaaggaatcacctaggtcagtgccaaatcattcatctaactcaagacaagaccgtttcccacaaaagaatcggtctggtggatcaaaggtgaagaaggtgaagaaggtgtgggtgaggaaagaagccaaagctccggaggtcgttgctatcaatgaggaatctcaagatgttcatgtacctactggagatgcggtggaaaccacgcaggcaaaggagatcgaagccgacgccgtgactgccaacattgaaggtctaatcgagacaactggtcggtttaaccgccagactacggccggtctgactgaccctcctagccggtctgaccgacggcttgtggccggtctgaccgggcccagaggccggtatgaccggggggcattggagaagagtgggaaaattaagagcaacataggagcttccacttcgaccaaaaatatgaagaatcattgcttagctcctggaaaacaaccacagctgaagtggataccttctggcttatctcgctctcaaaagaggaggctacaacgtcttcgagccataggtcaaaaagaaaaggaggccggagatgtagagaacaaaacaagtaataatttagagcctcgaatagcaacctaggaaagtgtggagacccaatgaggtaaaagttaagagaccggtgatttcccattgtagagataaatccaatttgatgatagaagaatcatcggtcattagagataagtctccttcacatgatgctatgggtgttagggcagtatccgtcttgccttcgaaatcacgcaatctagaaagccgtttttgcttagagggcaagacattaatatgctcatgaggaaaccaagagaagatgaacggtgatggatacaacatcacatctttgagtcgccgtttattggatgctaaggcaaggtattagtttattgtgtttactattatattatatgcctatgccatgttattagaacattgcttgctatctagcacatgtgtgtttttgcttatcaaattaatattatacatacatgttgcaaatgccagttctaggtagtagaattggtaggttggcatataatttgtttgaagtatgatttggctcatgactctttgatatttatttaaagccaaatcatatgtgtttttatggatcaccatataagatatagatttcatatttattgtaccatgaaagttttgcttactagtaattcggctaatgtcaatggtcgatgt

SEQ ID NO: 107977 - DNA, 1299 bp, Oryza sativa
aatacaacggtgtgatcggattgtagattggataagtaatttaagagaaaaattgttttgaatatcgttaaaggtatatgtgtataggcttgataggatgtgtgtcagagtcagtccatccgatttttctccttcagtcggacgtgcgaggagaagcattttcgaaaagtttccggtcagtccatgtctctgaattttaccttgtcctttacatacagtttaaaaaatatttgtaataaagcatagggatagaatattttcccgtcagcccattttatgtctctaaattttacctcatcgcttacatgtcgtaaaaaatatatttgtaataaagcatggggatagaatactttcaccataaattaaatgaaaatttaatttttagaacaaaaactaaatgaaatttgtacatcattttcaacaaaatttaaaccaaaataaaaaatattttttggttttcactttctatgtgaaaatattttatggatttaatcttttaattttttttgaaaaaagtagctcgaaaatttaaaagtatttttcaaatttggtaccaaataattgtcccaattcatttaaatctttggtttttcatgaattatgtttctcacatttagatttatgtttcttaagtaagctaagtacgtgagcacgagatatggggcgatacagccttttgaaaaaaaaaaattaaaattgtcaacacacagtgaactaacaaagttaagttctatatagaggggatcaaaatataaaatataaatgcaagggcatgtagggaatgtggaaaaattcaggatacataaggactgagaaaaatttatagacacgtaaacaatttttctcttaaattgaaatggttttataaatgtttttaaaaattttagtatagtgacatctattaaagaaaatccgactcaaatttgatgtacacatcgagggaaaaaaacaaatttgggtgcaaatagtgtgaatattgttcatacataatactctcctttatctcaaaatatgataatctattattggattagacacacaatctagtactacgattcgggtgtaaatagacacaggattgttcatacactgtgagtaattgctttttttatttctcgatgtttgagttgatttagacacaggattttatgaaagggtatatattcagccttttacactaggtttggttattgcgtttcgaccctctacttcgaaacacaataaccatgcctaccgtagaaagactgaatggtaggaataaaaaaccaagtattttgtggaataaaaataaaccctcaa

SEQ ID NO: 107978 - DNA, 701 bp, Oryza sativa
aaaatgcacaaaatctcgtccaacacaaggtaaagggttcttgcacctgagatgtgtgcataaccgaagcactcgcttgagttggcgtgatcaaagtgccttcctccaccacaacccgcatcaagacggaggagagatcgacaatcacatgtgatcatgctaccgctccagagatttcaacatatgcatcatgccggcggtaaggtatacaaaagacagcaaatgattcaccatttcttttacacatacttgtctttagatgagtttggcttgatcatacctggttatgcgtcctcagtccattttcgtatgctatggtttgggtggtcgtcgacattcataggctttttaaaattaagcatgatgcttaggataaatagccttctttaattaaagttgacgtggtgtcaagtttgcttaaatgaaccgtaagtccagtactttcatggacttcggatgtatatccttcgtgaactaacccctgcagggaatttttcaaattgacgagcgagtcctcaagcacgagtcacactggaggtaagacagagctaggagaaaaatcagttgctaacataaaaaggagaaacatatcacctatcaaggggtacggtgcgcatatttctaattgctccttaacatgttcatgcaaatttaccttacccctgtttgagttttgcttaaatgaaaatttggtgaacaat

SEQ ID NO: 107979 - DNA, 765 bp, Oryza sativa
acgttagacgtgggtgtagaggtggtgacagcgctcaagagcacttaagtcctccctgtgcgggtacatagtagagcgacatctaggaacagcgagttgctagtgcctgaagtatcgcgttaggattaaaattaagctttccttggacactttttctcactaagaaatcctctctgccctgtgcccatatttatcttatgtccttgatgaaccggaggaagagataatcacacacgttcccttggattcgatacccttgaaatactccgtagggaaagtgctacatcggtatatccatgcgcttgcggattctatctgtgatcgtaagaaataccaacaactggcatcccgccatgcctcttgaacgatgctgacctcgatcttgtcggtgatcaggagatgcaagcctactacatgctaaaggatcagatatttgctcacacgcgggcatacgatccggagctactaaaaaagataggtatggatgttaattctcataccatttggaaagttgttggatggcagagatttgcggtggcagatgagcctggttctcgtttgcttactttacaatttcggtacactttgaaagaaatagaagatggaatttcctttcgctttttccgtaaagaatttacacttacatggaaatgattaagtacacttttttgttttcacgatgactataaaaccgtttttcggaatttctgggttcgagaaaaacagattttgggaaaaaatttttggtggtcccatttgcaagaa

SEQ ID NO: 107980 - DNA, 714 bp, Oryza sativa
catccaaaatttgaccaaaaacttgaaatatgatatttcataatttttatacaaattttgaaaccttttctcccaggggtattttggtcatttcgacaaatttgtacagtactaacggagactaaccggacggcgatggtaaattttagaagttaagcaaaagtcgatggcatattgtagaacatgataaagtcagtggcaaatcgtagacgtgtgacaaagtcagtggtatataatggattctctcaataaaataattaagtgaagcacccactagaagtgaaataaaataattaagcaagtataaccattggaaataaaaaaattaaattagtataaaaatgaagtgcaattactactgttagtgaaataaaataattaagtataccaaaaatatgcagtgtatgtggaaatatgttaaggaaaataaaagaactaagtgaaataaaataaaataaaattgctgtaggcaaactcacctgtgacgggctctatctgtggggccatcacaggtgacctcacctgtgatggcccaaagtgttgggcccgtcacaggtggcctcacctgtgacggctccacagttggcgcccgtcacaggtgaggccacctgtgatggccccatagttggcgcccatcacaggtgagtttgactagggttggacatcttctagatcgatccagatctggcacccactatcactcactcactctct

SEQ ID NO: 107981 - DNA, 1485 bp, Oryza sativa
atcgtgtttacaaaatagcttggagcaactaatgtcttaaatgctgtttactgcacccctaaccctttatagtataattcccttgtactcccttgcatttattctgcactgccgggtgtgtcttgttgagtacggtggttgtactcagtcttgctcaatttttcccaaccccagaagagaagttccttgaagatgaaggctttggtgtctagttcgtgcctgctgtcaagcgcctgtggtcgtcgccctagtcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacacgagcttcctctcaccacggcgcacctcttggcgatgacggcaagcgacggcgacggcggagacggcgcggcgacgacgccgaagacgggcggcggcggcggcggacttggaacacgtcgcggcggcgctaggaggcacgggagagctcgggagagggggcaaacggaagaggacaacgagaggaagctatatatggcattggattgaagagatcgagctccaaacgagaggaatcgattcgggaagaattcaaactcggttttagggataaaatcaaaacgaactcgattcggagagaatactcaacgattcgctttgattcttgggggaaaagaaagaggagaacgagaggaacaaaacccctcaaaaacccggaggaatcgggctcggatttgggcggaatcggaggtggaagacggcggctcgggctcggtctcggcggcggccggaggttgaagaagggcctgacatgtgggccccacatgtcagtgtcccgagagagaaggggcgcggccggcggcggcttgggccggcatgggccgcgcgcggggagagagagaaagagagagttaggccgaaatcggcccaacggcctaggagggggatttttgaacttttttgaataaaacaatttgtgaaatgttgtttcaattattaaaaatacttcccttgctcaaataattcccagaaaactctagaaaatagaggagcaagcatagtatttaataaaattttatctagctcatttttatgttggaaattttcctagaaaattagggtttagcttgtaggcttttaaaacaatttctaaaaatgatttaaaatatgcatttttaatttagtcgatttttagggcgtgacaactaaagatcctcagccccctcacaggctactgacaggggatgaaccatgactaaagatgatctttagtcccggtttaaaaccccacagccattctacgatctttagtcccggttggtaacaacaatggggactaaagatcatctttagtccaagtttatcccctgtcagtagtctgtcaggggg

SEQ ID NO: 107982 - DNA, 1122 bp, Oryza sativa
atttcatcagttcgtatacgtatgtaagtgccatcaagtgtgttttccttttaatggtgtgtgtccttttttttttatttagaaaacgaactgaggcaactgtgcctcagagatgctcgggcctctcctatgcactatgcatgcttgcatagcttatagccgtatattggctatgtataggttggtgtgtccctgttagtgattatctgtttgtttcggttttatgcggcttgttgctttgcatttttgcttcatgttcttagaaattatatacgtgtaggtggataatgtgcaagataaagtgtatccatcatgtatgtgcccttagacgatatcgatttgtaaaatgaccttcacgtgcttaggtctcctctgcttgaatcgtcttagaaggaggtgggattattttatcccgacgtgccctcatttcgtgtatatcgactaaaacatcgtttttttttcaaaaagaaataaattgacgaaatagataaatatgtaataatataataactagttgggtggcccgcgcaattgcgcggctagcacgcaaacaaaatcatatatttttccgtatgacatttacttaaaatttattaaatagctatcttattgtcttaagactttgaaagaccaaaccttatcattccggtatttctaattatatagtttttaaaattcacaccagctgctaccccttacttctgtcatatccttctttatttgcttgctcgatctgccattatttctattcattctccttgaaacctctaaaaaatggatcttatagtttttagagtttattgtctcgttaggttttgtttttataatttctataagttccgtcaaacgctgccattatactcctctacggcccatccactgtgttttctctttattgtcattgcgattttaaaaatcgaatataattattgttcgggttcaattttttactttctagaagtcccgccaaaccgtcagcggctttactattatatttctttatggcttgcccactgcctccattctttattgtcattgagattttaaaatcaaacatgattatcattggttttttttactttttagaagttctgaacctttaaaaattggatcttgtagttt

SEQ ID NO: 107983 - DNA, 668 bp, Oryza sativa
caagttcagacgtagaaaaactaacaaaatttttttactgtgaatagttagcgcatactatttacaattaaatttgtttttctcctaaccagtcgtgtaaatcgaatgtgaacttatatatttacctttttagataatgtaaatggataacatatccgatctctgcccgtaagcacacatcaaaaagtatcggaagtaaaaaaaaaggaattaaaaaaaggcgtgatgggacaaacccccaacttctgtcaataaaataatctaccaaaataacattttcaaaatcacatagattctattacaaaattttataggcactatgctatccaaatagaaataaaagttcattggctatcaatgccgagcgtgtagcatcattgcatatagtatcatgttgtttctgtgaaagcatcatacaccaagactgaagccagtcctgcataatgtttaacatttttttatgttcaaaaattgcatcattacggcaacgttagattgaccaacgtagagtactatctttaaataaaatcattttttaaggtataagcacttttattagtcagttaaaaaaattattttacactgtggggagggggatattaaggtaaagaaaatacattgacatgtaaaaaaataatttatagagtgatatattatatattgatcta

SEQ ID NO: 107984 - DNA, 2918 bp, Oryza sativa
tatagggcgaattcgagctcggtacccaaagatggaactaagtttaggcagctccacaactccacttcaaacttaaatcctaaaaataaatttaggaatcggagatctaccaaacatttccatatttccatagtagtgcaatatggtatatgaatcaaggttacactgtatatggatcccacttccccatgacgccatgttacatttggctggggcagctcttatttcactcatttgggattctgcgtaaagcaaactgtcggtctattatttatcactagaagagccgctggtcattttaagggcatgtttagttcctaaaaacttttctcaaaaacatcacatcgaatctttaaatacatatatggagcattaaatatagataaaaagaaaaactaattgcacagtgtgcatgtaaatagcgagacgaatcttttgagcctaattagtccatgattagctataagtgctacagtaacccacatgtgataatgattgattaattaggctcaaaagattcgtctcgcggtttccagacgagttatgaaattagtttttttttcattcgtgtccgaaaaccccttccgatatccagtcaaatgtccgatgtgacacccaaaaatttttatttcaccaactaaacaggccctaaaagtgtgagttgaatctataaagctcatactccatgccagttcttaattatcaactgttttttttataagagggtccatatttctttattatctgtaaccgttcataatcattactaccatgagtacaaagtatagtaacctttagttataaatataccgatatgtgctactatacactacatgaatatacttcatacaaagtatatgtcaaattttaaattacatgtttgtaatatcacatattaaactgctcaaactactagatgttaaaggttcaacttcatgtacacaagcctaggaaatatgagatatttaactatttatcactcttagatgtgacgattaattatttgtcacatgaaactaaatgttgtagacatatgaggtccatatgttaatgacatatgagtggtaaatagttcaacgccctggaaatggttatcagaaaaaaaaacttggatatcatttttgctcggtatatattctggtaacagccccagaatattggaatttctgcgtcgtgtttgaaaaccttgaacagtatacacgacgattaactgtttaaatcggtgtggaatataggtgaccgaccgacacctcagaatttgggtgagcgatcaggccggctgtggaagcacagcagaacgtacccgaggcctgaaatgaagcgcgacaggtggggagggagtattccctccgtccaaaaaaagaatcaatctagaaggggagtattccctcgttgctttaggagggatgtgataaattaagtttttttgacggagcgtcccgaaacaaacgaatctagaactggatgtgacatattcatttggatatagatatgtctatattcgtagtactatgatgtattatatttagtactaaattatttttttatgggacggagggattaattcgatagctgatggttgttgttgcacgacgcacgatttgcacgggacgggagacgggatggagcattacccaagtccgctgggtacacgtcaactcagggtctccaaatgatacgggagacgggacggcctctcaattgatgggacttgggtgtgtccggaactctggatgatttcttccagatcaaaccagcggccggcagcctaaccccacacaagtagccggcgaaacgaaaccgactcggccctgcccagcgcaaagacgacgatcacacacaagcaggcagcaacctggtaggacgcggattcccgaatcggtccaggtgaccgagagctggggcgggtgtagcggcgtagcccaagttgaggcccgtctgttagtttggctcggcctggcccaacgttgttccacgcgactctgcccgtgctgaggttggcaatcagcccagcggcagcggggtcttcatcatgtggatgtggtggtgtaagaaaagccaagagataatgaaagggattttcaaggtggatgagagtcaagtgtggaagtgtgataatgaagtctttggagctacctgatcaacaacagtcacatgatatcagctaactgtgtcctaatcttccttgatgcaatccaaaatatataataacaacagccaaagtccaatgattgtgacggcgactatttgggagccttcgcggtgtaaataaagccaagaagatatactgtatatttcttttcaagagcaaattaagagatttttaatgtacagtcaggagatcgcggctctcgtgcgtgtcattggactgctgctgctgcgtacgtactacttcctccttttcatattataagattttttttagtattgtccatattcatatagatattaatggatctagacatatatatctatctatattcattaacgtatatatgaatatagacaatgctaaaaagtcttataactggagatagttctatagtacagtacactaaaatccatcacgccaaagcccaaaccgccgatccatacacaaccacacgttcgcacgcacgccatccgctgctgtacacgcgggcgacaaggacactcgaccacaccgcgctagcttgctcttggcgaaagccgacccagcactgcactactgcttggcccggcctgcatatgccgccgtctagctctagcagcgaaagacccacgccgcctaacctgctagctagcaaacagcgcaattttttggcccaatctgcgtgcccgtttgctccggtggcgatggtgagcaagcagacgccaagttttgggtgttgacatcgccacatcgggctgctaaaatttagcaatcaacgttgatgcgc

SEQ ID NO: 107985 - DNA, 638 bp, Oryza sativa
tgacggagcgtcccgaaacaacgaatctagaactggatgtgacatattcatttggatatagatatgtctatattcgtagtactatgatgtattatatttagtactaaattatttttttatgggacggagggattaattcgatagctgatggttgttgttgcacgacgcacgatttgcacggcacgggagacgggatggagcattacccaagtccgctgggtacacgtcaactcagggtctccaaatgatacgggagacgggacggcctctcaattgatgggacttgggtgtgtccggaactctggatgatttcttccagatcaaaccagcggccggcagcctaaccccacacaagtagccggcgaaacgaaaccgactcggccctgcccagcgcaaagacgacgatcacacacaagcaggcagcaacctggtaggacgcggattcccgaatcggtccaggtgaccgagagctggggcgggtgtagcggcgtagcccaagttgaggcccgtctgttagtttggctcggcctggcccaacgttgttccacgcgactctgcccgtgctgaggttggcaatcagcccagcggcagcggggtcttcatcatgtggatgtggtggtgtaagaaaagccaagaga

SEQ ID NO: 107986 - DNA, 584 bp, Oryza sativa
cattgtagcatttcacccgagagtattccaagggtatcgtatttattttatcccgtggaaagatcatgtagagagaacttgactaataatttatatattacttgtgataatcatattctaagtagggattaagataatccaagggtagagtgacacacaagcattaacttctcattctcataatatatcatctaaactaagtgggaagaaaagataaagaaaatctattcctatacttctaatatacatagtatacatacattctagttaaccgatatactacctaataccctctatctgatgccctcctagtactttgtcacaccctgaagttcttttccccaagactaaattgaatttataattgatctcgagaaaataccagtgaaaccctaataaattaatgccaataataatcggaattggcatgtggaatttttcttgagttctacatgtcgaaatgtgctaacaagatttttagtggaattttttcagagctctagaaataattttaaccaattaaaattgagcacaagcaatgtttaatccctagaagttcatttctttctttttctttttctttt

SEQ ID NO: 107987 - DNA, 754 bp, Oryza sativa
taagcactgatcgcgattaaagaaatacacacgttgtgtatggtatggcattttgaaaggggatggggattgtgtgtggtcgtgaatgtattattagtgcatatattgcccaaggagtaaaaatgactgaaaaattgtttctttccttaatatatttccattgttttaacttatcaattatgttattataaaccttacttgcatacataatgctgaaatgcaactagtgtcagttaaacatctaattttgaaaagagtagtgttatgcatgcttaaaaaactctttgcaaacttcttgccaacaaagatctcaactgtttgatttaattagttgaagttataaaaatcaagattcgatcacagtgtgacacatcaatgtagaatgacttgtacttatctcaaaatgataagtaatgtacaatagatgagatggcgtataagatagcatatgctggtttataaatttgtgtttgcatttttcttttgcctaatttctctaaatgctactacctccgctcgaggttataagactttctagcattgcccatattcatatatacgtctagattcattaacatctatatgattgtgggtaatgctagaaagtcttataatatgaaacggaggaagtatattttatatactctaggatcctttcctacagcttcaattaaaaaaaaaagcaagcagaaggcaaattcaataaaagtttcacataagcacatgcagatgcagttacctatacataagggaa

SEQ ID NO: 107988 - DNA, 560 bp, Oryza sativa
tttcggagactacaatcagaacttgtggaatgtgcccagtcttttaagatgttcatagaggtagagtttgcgtgcgtggtttcataggggtgagtgtgtgtgcgttgtaaatgtttgcattgtgctatgtaattctaataaaaaaggattgtgctctaagaccttacccaagatgaagaagggatgaaggactttagtggtccaaggcttaaatcatagagatttaggctgataatttattagttgttgcctatagtgggggttgttttcccttttctagattttttttcttttttttcacctattctaaacagtttgttctcaccttaatataaagttggcatgatgaacaatattgttgtcggcaaagctgacttgggagacctaggccccggcgaaatgcaagatgttcagctgatttgcgatgcgaaatcgagtgtggggagcaaagcggcagatatgttgcaagttagagggtggccaaacaactatttctatcaattatattttcgaaacctcaagaccatcaaccatttgttgtttgaatgcccaatcttaaa

SEQ ID NO: 107989 - DNA, 638 bp, Oryza sativa
actaatcgatctgccagataatcgaagatctttgttatgctgtcgagcttgcaatcagctagcaataatttgtgatagcgtgtggtgttctgttttatccagtttgctgggaccgtctttcagttcatgtttagatctcattggctgcacccgtgctttatacttgtacctacaaaaattattcgtgcgttgcaacgggtgaatgttattttaatcttattattgttatacggtttaacaaggatgaaattcactgtgggaattcgcttttagaaaatcatgagctagaattaggagcctgactttcatctcaagttagcgtgcaagattttttttttaaaaaattcttatacaacatcttttgtattttcaaaagcaaacgaatttaaaatctgactcatacacggatttgtatttccaaaagcgaacaaagcatgcaagttttttaaaagaaatttttcatacgacctcttttgtatttccaaaagcgaaacaaactaaaaaatcgacccaaatacatatgacgtaccaaaataccggtaaaaacatcttcaatttttataatagtagagatatatacatctgctctatatttgtacgcatgcttataagttaaatttttttattttaaaaattaa

SEQ ID NO: 107990 - DNA, 1001 bp, Oryza sativa
tagctgcaccaagcagatattggtttttgtcccacattgaaaaattatgatgaaagagcacgatttaaaatgttagggctatcatcactcatcagactatattttatgttgtgtagatccatcacctaaagttatggctctagttgagtctaaggtggagcaagcctaaggttggtgggtaggactgtgcgctctaattacatgtattaaagcataggtttgcactctaataagccctggatttttcacattttggttcttttgaaaaacttatttcgcaaatagacccctagaaaaacttattccagaaatggtcctttttggggcgttagagtggctggcgccgtcgttcaacgggacggcgccagccgccgacctcctgccactgtggcacactcgaaccgacgtggtaggaggagggcgcctgtatggctggcgccgccccagggaggagggcgcgtcatcccccaacccacccctcgcctctattcctgtttctctgtatgaagttgcaacggtgtcatttttgttttattttttgaatgttttttcacacttaggatcacgatacaaccaaccacaaaaaaaatttaaactcgaactaccacttagctaagtctgaatatagctagcataccacttagcctaatttgcaccttcaccaaaattagaccataactcctttagtaaaaccctttgatcagcatgttaaacataatgcactctaccactatatgaaattacttaatctaattcaaaatataaccacatgaaatgatagctataagtttataagttaaacagtacagagagatgcaatttttttatttttattttatttttttgatatttttttcatacttaggagaacatagaaaccaaccatagaaaaaataaactcaaacggacaaaatatgtgacatgtagaattttccaaagctctagcgaaacggacaaaatatatcatttattaaaataggcgtaactttctcatacggact

SEQ ID NO: 107991 - DNA, 658 bp, Oryza sativa
gcaatttctgaacaccaatgccagattagaaagtaattgaaaaataggcatggagtcaaggactttgggtaaattgcaataaaatgccaaaacgaaatggaatcagcatttgtaccacgtaacaaaattttgcccatcgatcatggaagaaacgtgcatacgattttgtggctggccaataaactacaaaacaactgaaattattgacaactatgaagagagaatgccatgttacttctttcttatggaacatcccctcttgctcaaaacaaagtcgtggaagaaacatgcacactgcagctggtgcagaaatgtttatacacacaaaatgcttggtatcagtaggatctaaccatgaaaggaatctctcttattcctaatggaaacaaccaatgattgttgccagcgataatattgtaccatctcatcagcaataagctaataacagcacacaattaatactttctccgtaagatcatctcgtacactccacccaggcacccataaatatagtacttttgtagtatcagaactctgaatgctttcctccagtagaaacaaaagagagcaagctagtactaagtgtacttcattgcttaaaatgcactgctgaaactgaaagcaagtagcctactgaagcattagatgttggattcta

SEQ ID NO: 107992 - DNA, 667 bp, Oryza sativa
cgacgaaggatttatttaccatcaaatgcagaggatttgatggtaattctgacgttgccactcatcccaatgatccaatctgctctggtagatggtgtgttacttcaggcttcagcagatcgcctaaacttatccgtttctaggtcctacactacacctgaagactactatttaatcaagtagtactaaattatagcagtttgtgttaggtaagaaactaatcatttcttctttcatctctcttgaataggggaaacttgttcctttcttgtcttggcggcatttttgtgttcctttcgttttctttcttgttgctggagtgatgcaagagaaggaggaattattggttatgcagtgatgatatttctacgtaagtatgtactatttcaaaccaaaggttggtggccaaatgaaaagaatatgacatgagtgtcatagtttcgccgacatatcatttcatcatttttccatggataattagcccattttgcaggagctcgcctctgggcagacgaaaaatagaagaaccaaacaactggaaaaaggattggtccaacatcgcagtcaataccagtgcactgttccatgatttccggcaaaaatgaattgcattaatactctgacgatataattatctggacagagcaagaacagaccgaaacaacct

SEQ ID NO: 107993 - DNA, 571 bp, Oryza sativa
catgcttgcttgaagcagctcattgtcccgttcgagccgtcgtcgttcaccctaggaggagcgccgtcgccgagccgttccacaagtcaccgctgccgccaagacctcgacaaccctagctcgacccacggtgagcatcctgaaggctagaagaccacatgcatgcatccttttcgttaggaatcgacttccatgcacacatgcacttttaccccaagaaccaccgccgctcacactcgccatcggcactacttcgatgtcctctaaccaagaaaactagaggaatggaatcgcgagagcttgctcttcattttatctcttgacctcaacctgacacgagccaccgtttgccgctgccgagctcgagatcgagctcagccatggctagctctgctctagacagagcagagggatgacttccgtgaattagattaagtgcagggatccgtttacaagtgtagaaacacactgacatatgggcctaggactgcgggttgattcctagaaacctcaagggcctttgtgcatattggtccctcaagccatgtggaccccatcctttaaaatctga

SEQ ID NO: 107994 - DNA, 696 bp, Oryza sativa
ccttgcttctgcaaacctctgttcatgcaaggttaccttctgtgcaagatgtgataaactatcaaagtcctgggacgagaatttctccttgatcagagctatcataccctgaaaaaccaaatcggctaactgggcatcagtcaagctcaaactgtagcacttattcctcatctccctgaatctctgaatataatcttgcacaggctcatcatgcctttgcctaatcgctgttaaatcagacaatttcatctcatgaactccgctataaaagtaactatggaattgcttctccaaatcggcccaactgttgatcgaaccatacgacaaagaagagaaccaagtaaagccgatccggacaaagacaagggaaacagcctgaccctcaaggcgtcaacagccgatgcttcatcacactgagctaaaaatcggctgacatgttcataggttgagacactgtcctgcgctgagaattttgaaaaatctagaaccttgaatcggttaggcaatggaaccctctcaaaccactcagggtatggatgccaatacaagtttcttaaatcaagtgattgggatagatcggtcgccatgccgagacagtataaatcacttagatcgaaatatatattaacagcaagactatatatgttcatagcatagccgatcagatagatctagggtaccgagctcgaattcgcc

SEQ ID NO: 107995 - DNA, 1552 bp, Oryza sativa
ctcgttaatttttggacaggactaataattggctgcccgatttgatactaaaactcagacggttgaatgatttagttgaccatcaatgaaacatcaagcgataagctgtgatacataaagtttagtcatttgaactttgaaaacaaaagcctcccgccattctaaaatatagtcattttaaaaaacgcatggaaatacttatatttggaacaaacatagtatataagaaactagtgcacaacgaaacaatataacatatgtaacatcttaatttgggaagtggactgaaatatataaaaaaatacataaaacaatcaaatatttcagttcacacataaaaacatagttttaaccactaaaacatcaaaaagaaaaaaaaatggtagttcagatgagacttctctactcctcccggtcaccactcaccacatctaacctccatatatagaatgcacgtgggtcagtgaaatgggagagctggctccggagtccgggaggtgccgctgagcaaggtggacattgccggtgacgaggttgacctctacggtagggtgcatttctcagatatttaaatatttatcacttttaaaatatgatgtttaactatttgtcacttgtagtctatgacatataggctgaatgataaattcttaattatcatttgtatcatttgtaagagcggaaaatagttaaacatttatacattttttgcgactacacccgatatatttgcatgtaaactgaccaattttctcactccgggctgctttttgttgctcataccaccgatacaaagagcgtcacatgtgtactacaacgggccgcggtgcttgaagaaaggagaggctaaggatatgttcagaaaaacttaagattttaagagatagcttattgatctaccttatgaggatctaaataagatggatttcttatagcttttaacttttactccatccacttcaggttataagatgttttaactttagtcgaagtcaaactttttcaagtttgactaagtttagagacatatataataatatttataatactaaattagtttcatcaaatcaataattgaatatatttttataataaatttgtcttgggttgaaatgttactacttttttctacaaacttgatcaaacttaaagcagtttggctttgatcaaagtcaaaacgtcttaaaacctgaaacggagggagtacattatttttgaattatataatcataacttcttataatgtagaataaaagctactacattcgtcctaaaatataacaatctataattgaatggaaaatataatagtagagtatttgaaagagcatctcatttttaaaaaagaaggggcggtgggccatcaacgttgcagtagcgaagtcagtcattggtcggaagtcttgagttgaccgacgacgatatatttccgtgcatcggacatctgacaaagaaccatgcctcatattatcagtttcgaaatagagatatcgtcgtgcacagtggtaattaaggatgtgtcgttttagcgtgttgattcatgccgagctca

SEQ ID NO: 107996 - DNA, 959 bp, Oryza sativa
ccgctctccccaggtgcttgctactgcccatcgatggttttctcccgctctagtgttccattccggaggttttgatgcgatggtttggggggtcacgggcgtgagctttttgggctgcttgcgtagaactagtcctaggtgctgcacggcgatgggggaaggtggcggtcgtcgggagtggcggaggggcagaaggcgaggaggttgggcaggctggacgggtgggacagctgaggaggcggggagacctgagagctggggtcgccggcgaggagttgttaggcgacggcgtgggcgcccccaaaagttgcgcgtgagagaatgggttaaggaagaggagaaatgcgtgagagaatgagttaaggatgaggataaatgacctaggttagatcgaatttgcgacttctgtacgtgctagtgggaaatttcatcccaaattgaacggcaacaccctaacaccagcccgcttttaggttgttgggtagcttgggtttctcctggaatcagttccaaggttgtctgtttctttgatggcaatcaaactgggccttagcactagaatgacttgctgtttatattgagatgattagggatgcgctgcatttgcttaacttcacaaaaaagttggtagtgttgttgttgagtgctactgctacagcaccgtcatccagcgctatttgcaaaaagaggaacttgtacctgatcattgtctgttctcagtctgatctaacaaggtttaggtggtcaaactggaggtttgctgttcttgatgacatcttgtgttctttgttgggttagttctggtgcaaaacaatttgacatctcgaagtcttcatgtttgttaaaaatgtatgatgcgccgttcaatatagttgtggatgagtatgactcttctttaagacttatgcatacctaaatgcacatgccctttcttgccgttattaattatgaggttgcat

SEQ ID NO: 107997 - DNA, 527 bp, Oryza sativa
tgttgccttcaccatcaccactacgaattttttaagtattattaaagataaaaatatagtgctacagggaaacaaaatatattgagagtggatggggttgaagatgtcaaagattataaccaatacgatagtatgccactttatagtcagtttgtacagaagattaagaatgtcgagacatctactcagaagaccgtgaagccttacatacgcacggacggtgtgggcaaaaatgttaaagggtaatgattgttgagtggcatgtaagcatctaacaagttagtagttatgtaatggtggtatgtaaggtgatgtgtgatcatatcgcaaaatgacgaacaattgtactcaagatcaattagtttatgtgcaattaccatttgtagtgtaacatttacagatttttatattttaaaagtttttttaaaagaggtttcaaaatttagtagcaattttttatgtgcacttaccattgtttcaaaatttgttaaaaaattttaagtactatgtacatttaagtaagaatt

SEQ ID NO: 107998 - DNA, 647 bp, Oryza sativa
tatgcttttggtcctaaaatcaaattggtttttggtgttcatactcatagggttagccgatgaggttacatctaatccagtgatcatggtgatgtcgatcagagttggggtcatcagcccttggttgaacaaaaaagcattaatggtattggaccagaaataagtagcggcagccatcagaggttcatctttagcttaattggctatggtaagggcaagcacttggctgattccgatctcgtcccagtgaactttcttgctagccgatacgcacttgtaccatgtaatccaacttttctcgggtggagttttctcgagagatggccaagatttgaaggtgtttttccagtgacctagatctgggttggctaatctgaaaggaatcctatttgtttcaccaatgatgaactcggtaggatcaaggttgccgattggaccaagaaagtaatgattttcatgcgataagatgggaattgcaactaggttggagaggtgctgcggatccaaaagaaccgagaagaagaaagcaagatgaggaaaggggaaatcaatctgatgagagaaaaggggatctagccgatgagaactcacctcagcatactcggctgacggcgcggtagacgggctagcggaggacgaaatcgcca

SEQ ID NO: 107999 - DNA, 666 bp, Oryza sativa
cacccacatagtagtgccatatattacatcatgggtttgcactaacccctactttatacttcacactgccatcccctatatggtagtggcagcatatatcataagtatataacagtaacatgggtttatcaaaatgcattgctccctaaccaaaatgtcaccacctggcaaatgattcacagagtgacatagccaccatcggtagcacatttgcgcccaaagtaatctataacccaagcttggaaactttcatcacttgcaactcgcagataagaacgaaagcattcttgttctggcttggtgagaaagattgcaagttcaattttgtcacttgctgggatggtgaggtcttctatgcgcttccaaatacttgcatttggatctcctacagagggcacttcaacagatgcaacagactgtgcagatgcaagagagttagcaagcctaaggatactagctatcagctcatcctcctctgctttgtggcggctcgttttatgcttcacaatcttcttggtaggtgatttcacaaacttacgcttctgccctgaaaaagtggcatcagttgcggactatagcgaggtattgtgtcggaatcattgcccccatcttgcagtggaaatgtatattcttccaactccttgatgcaaccactgccatccctat

SEQ ID NO: 108000 - DNA, 644 bp, Oryza sativa
tcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctactcctattaggtgcatctagtcggtgcatctgactttattttccagccctccacagtcttcagatttggtaaaagtactcgggagaccatgacaaagatgattgaagcactcggctttggagtaatctggttcgagagaagattatcttttcgactgcgaaggtctcaagggctactgtggatattatgggtaccccatacccatacggcatggttatccgactagtcataagggataacttatatctatggaatatgtaatagatcatgactcgggtattac

SEQ ID NO: 108001 - DNA, 714 bp, Oryza sativa
aaagcatgtcataaatatgtgttgatgtaaaaacacgaggcctgggagatctgcttaactccagtgcaggtccaaaacttgcctttgggtgtgtgagcatgccagttgatttgatcctgccatcaacaagaaacaaagacaaagaaacccggttaaatccataaacgatagccaatcggctagttgccgatgatatatcatttatctttgggccgatgtcatatgtagatcgatcggcagtcatgaataagtaagaaagaactaaatttactcgattggttgcagatattaacgatatgtaatccctatgtccatatatacttaaatcaagtgattgggatagatcggtcgccatgccgagacagtataaatcacttagatcgaaatatatattaacagcaagactatatatgttcatagcacagccgatcagatagtctagcgtgaatcggctaatactccaataccactctatattaagatatcaaaacaagtaaaatataccaaacaaaagcctaatatacttaaatgtaacaagatcttaatataaagggcagatttaacatgtcaatcaagcatataagataaatgtagttaaatcaggtaagatcagctgaaaccccgatgctaccctaatcggcaaccaaaggcaggctagagattgaattctaatcacgactcataagatcaaagggtaccgagctcgaattcgcc

SEQ ID NO: 108002 - DNA, 1501 bp, Oryza sativa
cccatggtaggctttatctcagattaacaaaggttcaattagctcgtacaattaacaagactgtaaccccggaattgcaaagttacttaataatcgacattcccatgtaaaaagaagttaaataattgacaatttatgtggtcactcctttggagcacgtgaatgtttcctgattcctatcaaatttctgcaaaaaatctatgaacctcctacattacaaatggggcctcaagtcccaactgggctgatgccacggattacacatgttagagaatacacaaagtctaggaatgggaatgttgtcccatgtaggaaattttcctctgtcatccacatagtagcgcgaggattataaatttctgacagtactgtttatcagcgcagtcaatctctttaaagttcgaccatacaatcaaaattttcctgctatcttgtaccactaaaccaccttcaggctggagatgtgatcatatcatagttctggttggctgttaatcagattgggatggagcttgaagcccagaagagactaatctattatgtcatacatccactagaaagaaaaacacagacagaaacactaaacatttaaaaacccctttgagtagcagagtacatcttcagttgtaggccaggttgtgcaattccagatagcgcaataattatgtcacttgatcaatgttttgttatggtatgtacatgtgactaaatcaacatgtccagctgcccagttgactgtacatatgtaacatgtcaacctgcattacttgctttaagtaccacttcttttgagctacatttaataatggttttggggggtatcagattgtcaatcatgtattgttaattaacatgtgcagcttcacatgcgccagtaatgttcagttaaactaaataagtaaaatttaataaccatctagaataactaaactcaaatgatcatagcctggcaataaatccagaaatcgcaaaagatataccaccaccatttgattagaaaagctactgctttttttcatcacaccgatgggcaaagatttctaaactaaagttcacatacaacatcaacaaataacccttttatgtccaaactaaacagtgcagacttttccttaacaggtaaagaggcctgtagttaataatgccagtccagcactagaaaatgcagcatattccaactattaattcatttgcgttgttccctccttacatgcttatttcagtatataatttcatctggaattctggatatgccaccatcgactatccttgacagttgacattgaaataagaacattaaggcgtaaatgccaatcataggtcagtcctctaagaggtcctatgcaatcatttcatataaaggttttcatcaatgtacaatggtgaatagatatcatctctatgataatgtacttggctcctttttacttaaataatttgaagaccacgcctacaattataaaatgctagtaaactggtcacaataagcttaagctaattt

SEQ ID NO: 108003 - DNA, 572 bp, Oryza sativa
atatttaatattttatacatgtgtttaaagattttatcaaacgtttttgggaaaaaaaaaaactaaacaaggcttaaagcgtaacctgctgtggttggtcgcacactgtgacacgaatgagcgagacttttctgctcgtgacgtgggaggagacaaaaaagaacgacagtgtttataaaaaaagtagtagagaaattttgagtcgtactgtcgtagcaagaaaaatacatgtcatgcatcagggtttaattcattttgctctgcatgtccatttgtagtcaaatgattaacgctgtatactgatatagcttctcgctgtgtctctctatatatcagcattgcaggagatcgatgctttacttgagagcagcatagcgtctagccggcgacgtacggtcccctgaaaaaagtagggacgaactgcgggcctatgactgttccgtgcatatgcatgagccacgggccaccgccgatctatcggccgaccgtctcatcaaggcagttattcgcatctgcaatgttgtttcctcggcgcatgcagatccagtcatccaaacattaatcaattattt

SEQ ID NO: 108004 - DNA, 661 bp, Oryza sativa
atctcttctggagattgatattttggatatatgaattagctagatcgatcaactttgttaaggttttagctagaaaatgacatgtttgcattagtaatagataataacatgtgtttgttcagagtcatttgtagagcaagtatattctagggtcccatcgtttggcttttcttttaataagccaaaacggcttattagagtaaaaataaatttgtaggtaaaatttttatatatgtgttctcggggacttaaaagccaatgctgaaaaaaaaactacgttgaaaatatctcaaaatcaatgtcaaaattaagtttgaaaattcaaaatttggctttttctttgtctgaataggccatccgatgggagccctagtcagtatatgctgagtttgcatatctgaaaagaaaatcattctttttcttgtttgaataagaacaaaaagatctttctttccatgtacttgtttgtaaagtgtctccatttgcttcttgcaacatgaatagcatgatgataggtggtcagcctcttttcatttctctttgtagcctggtgagctcacaatgctctttttttgtgttcttttgcattgattttaatatttttctgaggtcacaattgctcatcattttcttccttccaagtcatggagctactattatt

SEQ ID NO: 108005 - DNA, 665 bp, Oryza sativa
  unsure (1)..(665): unsure at all n locations
ttctccctctatggatttacgcctccacacctttgtaggcggtggtcgcaactcgttgaaccttctatccctccgctctttggcttctctctgttttaattcttgggcccgaagacgttgcaacctcctcttttggatagtcgtcaaatacttaggcatccaccttggtttcggctccgttccaggaggtaaataatgtcccctgttgattctacccgaagacaatgaagcccccgagctaccctttgtaaacctctcatcaaaccagcgctggagcccggtcagaccggctagaaggcccggtcagacaggcttgagaccggccgtagggctgcggtccgaccggccagagggcctagtcagactggccgactgcgacaagctggtcctggcttcggatttgttactcgaagactccccaacttcatctccagatggtactggcacatcatgagatcccactttaatagttatcaccttcaaagtcctcgtctccaccttaacgcgctttccttccctctttccttcattgacccgatttttaacataaaactggcccattgttggtgaagacaaatgctcacaaagctgcctncttggtccctcccatcctaggttgtatttgcatggaggcatatgattgaacaatgggcggtgttgccccc

SEQ ID NO: 108006 - DNA, 764 bp, Oryza sativa
ctgttagaggaatttattaaacaagtaaacaacaaacgagccaactcgatttgtgtgtgtttttttcttgtagttgatgccaaccaaaaatagctttccaatttggacaaatacttcagcacggatattgtgaatcttttgtgtctcaaatgatgagcacttaatagccattgtgtccacctattagctgctcatcactccacatgctatattaagtgttattttgtcacgcccggaatttctatctaaaattctaaacgcttacacgtatagaaacccttgtccagaaatcagccgaggtacataataacaaattgataatagagtacaattattactctaattaataagagaataaaatgtcattacagaggtagatagttcctctcaatcaataaagttctaagcaacggaaaataaaagaaacaacgcaggcgactcctctccacatgcagcttgaccagggctacgcctaatcatccactccatcggcatcactgtagaactcctcctctgataaatgattgcaaggtgagtatatgacatactcagcaagccacgcagcaaatatgcaagtgcacaggataacaaaggatggcataatattgtctcatttgcataaacaacatttaataaatatttcagaatttaataaaatagttaaataatatttcaacaatattaatccaacgctatacaacacaccctgttgcataggcccaaccatactgaacaaccaacctcggctgtacagttcaatctcc

SEQ ID NO: 108007 - DNA, 1166 bp, Oryza sativa
gaaataattcgtcttttggcacgtttctagtttatatatactctagatctagatcaatgtcattcgcgttcatgcccctaccaccattggagaggagatcaatcgatgcatgtttgtgggctggaatgcacggtacaaaacagtatgggaagcttctagggtgaacagttgaagataacagagcatatttgattcaggatactgactgcatattctattgctactgctgtgctagcttgcaaaggatgtcctgcagatggttcaaagaaacagtatatacattgtcacacacctttatcagatcgcgatatctacacagtgacagtgtgatggtcaatgacctctgccatgcttttgggcataattaaggacccatgacaaagaaagtttgtacctctttgttgacttgcttatgtagttggcgacatacctacatctagctaattaaatttagcttgccttcgtcttatataacatgaggccatagaatgctcaagtcatcaacagaatagcagacaaatatactctttcttttccaaaacagcgacacggtctccaaaacacaacttgacttattgtttgtataaaaatatttattgaaaagtgatatatgtatacttttattaaagtattttttaagacaaatctattcatataatttttatattttcaaactcaataacttgagagttattcatgatttatattcccaaggtttgatttaaacattgtcctaaacgattttctttacgagtacggagggagtatatctatatccggatttattttactgggatgtatcgtattctagtacgagattgttttttttatgaatgaagtatgccattgataattaattaagactgagtttgggtaactccacctttccgtactgaaaacggtattaccaattaacacataattaattaagtattaacctaaaaacatgaaaaatgaattcatatgatcttaaaagcaacttaatttcttgtagaatttttttaaaaaaatataccgtttaaaagtttgaaaagcgtacacgtaaaaaacaaaggatgtgagttgagaaagaagaagaagaacacaacctaaccgtataccgcgtcgtgcgcaaggtcgtcttaatcgatattaatattgggtgtgtttagttcacgctaaaattg

SEQ ID NO: 108008 - DNA, 643 bp, Oryza sativa
tatcacaaatatttgaatgatttctcttgtgctaagaaacttatttccaatcccttttattcaaaatccaacttcctttagccacaaatatttcaccgagaatccataccacatattttggaggctaaaatcctagttatttacctccatctatttttgctatcatcccaaaatttatccaaagttagtagataaatcttttgtgtcaagttttatatttggtccttattaaattctttaaattggagcatctttatttttatccttttaaaatttatatttcaaaataaatatctttaattttgttttaaaaatatttcaaacctattttattataaaaattccatatttagattctttgtcaaaattcaaaagagtccacaaacaaactcccttgggtttcatatcctagaaatcctatttaaattttttttccaaacttctaaaaagccccccaacatatttcttaagatccatttcctagaaatcctaattgaattccttgtccaaaattcaaaaggtccacaaatattcatcccttagattttcatctcctttgatttccatttaaaaaccctctacacaaaataatcaagttcctcctcttttgggccaaaaccccctttcttttgacccattcctt

SEQ ID NO: 108009 - DNA, 778 bp, Oryza sativa
atcatctcaaaacatttagtttcaaaagcttttaggctgcgttcgtttgcgtgatatagggtgagaaagcacctcgttttccgcgcgcacgcttcccaaactactaaatggtgcgctttttgcaaaaaaaaatttataggaaagttgatttcaaaaataatattaatctatttttgaaatttaaaatagttaatactcaattaatcatatgctaatggctcacctcgttttacgtatcttcccaatctccttctcctcaaactcacccttagaaatcatgagattatacccatagcacatcattatgtcgctcatgactgtgagcacagctaatcgattagtttttagaactctgcagagtttgtacagctttacccacatgatatgaacactctagtttgttttgagtttgcaagactccaccacactcttcatgttgaatgtggtctagaggtcataacgagtctttaacattaagtattgtctaatcttgcatgagcaagatacgtgttcctctatcctaggccatatgccatacacgttatatgacctagaaccgttaagtggcgggcccacgctttaaacttaacgccgtggtgacggacacaacgggaacccaccatgtggcacaatatcgttgtattggacacacttagacgcccatgctgtgaggcggaacagtacactcgtccctcacggaaatcacacacgtagggaatttatcatcctacgatcacacatttaggaacagtacactcgtcctaggttcaacatacac

SEQ ID NO: 108010 - DNA, 648 bp, Oryza sativa
acttattaatcctattagagcatcttcagcagagaccctaaacaaagctatcaaataacttttaggaggaaagagagaatctaggttcaatagaacccctactaaaacccctagaataggaaggcccccagatctcatagatctcatcccacagtcctcattcctgggggctcgggcatagcccccatcgatgtttcttcagtgcgggaggaatttttgcttcgtgcgcgtgcatctcctccccccgcaggctgccctgactttcaaactctgatttactcgcacatatactccgtatgtacgcattgcagatagaaaagtgcagggcatctgaacatttgtttacttacaaatctatatatagttctgaacgtctgcaagcgtccgtttatctgaatgcaattagaaaagaacgtggttgattttctgaacatacctgtaagtaaagattttcttgaatgtttagttcccaaaaactttttcccaaaaacatcacatcaaatctttggacacatgcatagagtattaaatatagataaatttaaaaatcaattgcacagttatgggagaaatcacgagacgaattttttgagcctaattagtccatgattagtcataagtgctacagtaacccacatgtgctaatga

SEQ ID NO: 108011 - DNA, 1043 bp, Oryza sativa
cctcgagcgttatcagtaccactgtatcaaaatttaatttctgaattttccatttgaaaagtgttacactgaagttcatgccagggatatcaattagttctccctctacatatacccaaattaaaatataaaaactgaaatcggaaacgaagttcaaataaagatttggcatttagaaaattcaaaagttttttacactatcaatgattacgaatggtagcaatccaatgtggggctttccattcggccattgacttagcttctccataatatatatgggcttctattcggcccaaatttcttgctcaatcaattgagcccatcagtaccggatcgcactaccacaggtagggatccaattttggctgtcactaatggctgtgttccgtccggtagtggcagctctgcaggcctgcaggctcagcaacaggatctaccaagcaaatcccttctttctataaagttaaaaccaaaaactgaaaccccgtgcttccacatcattatcaaattatgaaccattggatgaatgtatttagattgcttctcagacattggatggaatgcagcatagagcctaacccattagtcaccgatcgggtgagtctcttggcctcctcagtgccaaatatagctcacatgaacacattggcccatctccacatacatctacatatatcagcccgtcaatccgtataaaagagctttatggctgaacgctccttcagttgatatgtgctacctaaattatctataaatttttgataaggctgctaaaaagaatttctccaagaaagctattcgtttcttctatttcttcttaatattataccttttatctaacaaattgatgttaaccaagtcccgcagcaacgcgctgggcatcctctatttatactaaaagagccgcagcactgctgctgtacagtcaccatctaacttaaccgaatagacccaatgttctccaagaaaagttgtagcgcccgttccgccgtcgtggcgcctagcgggaaaattatctctaaaaaaaaccctaattgcgaaat

SEQ ID NO: 108012 - DNA, 903 bp, Oryza sativa
ttaaaagtttatgtgtgtaaaaaagttttgatgtgatggaaaagttgaaagtttaaagaaaaagttgagaactaaaccaggcctcaatcgcacttgtgagtttttttaaaaaatttctttgaaatttctatgttcggtcattgataagctattgaccatatgaattgtcgtacgttgataaaccgacaaacgcaaggcctacggagaatttggatcaagttcggccgtcctatggacaaacaactgcacgcaaatttggccgttcatttgtgtgattaacgggatagattcaaagctacagtaaccacataaacagtactccatgctacagtatttattgctacagtgctatgaatagtcagtgcgcgatctaggccgtccatcttatgttcaatgatgcatattgctactggttaagttcctgatccaaatcccctacggaatgccgcagtacaaatgttcctttcgttttcaagaccacgtctagagtaattttgggacggtcgaccgaatcatatttcactagctaaattctatattgaccaataaccatgtatacaagtattctctaccttttaaatgcatgatgtagtttatttttggatataatgtttgactctaaacatgatttatatttttttatagttgcattaaactttttattaagaaaatgactaaacgatatgtcaaaaaatcaatatcatcacctattaaaaataaagatagaacttgttcatgacgtgttaaaaatcgtagttcctttatttatcttcttgttcttaaaatgatatatgagtgcacgacccacatgtgcattaagtcaagcaataaaccatttgagtgtaaccaacacaacttaagaattttctaacaattgacaagcacaccgataatgatcctatt

SEQ ID NO: 108013 - DNA, 1086 bp, Oryza sativa
aaataaccgtctcgtcatcttttttcttgaaggcaaatcatctcatcatcctaattaattactgacgtgtaacaatgttaatgctcgtttgctttggagtggcggggcggataacggttcctgtcgaatttatagtaagatcgagctagggaaggcgaccatgtatgccgtgtgctaaagagcagttagttaagtataaaagtggcacgcacaacatgtgttctcattccaaacaaactgtactgtttgagccagacgtggcagggccctcgagctttcgtccgtgcatcgatcagcacaactatatatctagctttgtgaatagttcctttttattttttaagatggtgagtaggtaattgctaaatttgaattgaaactatatatctcaatctagcttaaataatcgtcttgtcatcttttctgaaagggaaatcatctcgtcatcttaattaattcctgacgtgcagcaatatttgctttggaggggcggctaacggttaccatcgaatttattttgggatcgagctagggaaggcgaccatacatatcaatgcagtacgtgtgcgaaagagcagttcaatcggtcagtacaaaagtggtggcacgcacaacatgcgttcttaattcttattcaacaaaagtgtactgtttgaggcagtcaggcagacgtggcaggaccctcgatcttttgtccgcgtgcatcagcacaactctgcaaggcttgtggacccggccggcctcccagaacggcgaaagctacgtggagtggagttgtggaaacgatctagctagcacacgacacacacatagcgggtggtaggctagtagccacgaaatgattggggggcgctgcctgtgtagtatttcctccgtttcatcgttcaatcatttcacacattcgtatattcattaacgttaatacgaatgtgagaaatactagaatgacttatattgtggaacggagggagtaccattttcagtctggtccgaaataaataacggttttgctattttacttacaacatatttttaacctcctgtcttttaattattttcagaatcttgtttctctagatccaaatt

SEQ ID NO: 108014 - DNA, 884 bp, Oryza sativa
tcgttaagactgtttccttcagcaatctgaacttatctcccaataaaagcttcttaacaagccaaagtaggattacaaattcataatagaatataatagcttctcgacaggtatatactagaaagattacaaattcatagtagtgcataagtcataataggattactactttataatagaccggtgtgtataacaccataagaaacattacaatatcatgtgtcaatgacttgacagaacatagagcatcaattaacatcaaaagtagcccaccggaagttcccaacatatgttccatctaaaagctctaatatctaaatattacttatactactaacacagcgtacttcaaatttcaactgtcacaaaatatttactccactattggcaatgacagtacgccaatgtgaaacctccaagcactttcttcaaactaattgttgatgctatgctatatgcctgcattaatgtttcgtaaagttaaatctgaaaccatgtgcaaagattataggtaatgtttcatcagtgatgaggaattgatatggtagcaatagataatttatataacctcaaacatatacctgacaaacgagtctaattgctgcccacaaccgaatttgcagttgaagcttgatttgggacaaggataatagaattagtatcatcctcctagtatgcaacaaacaagtaaacacagattattagattgtgtatctctattaattggttagaaacatgaaaatataagaacttactaaatctgtgcttttgtggcggcctcctctaatccaactagatgtacacaccaaagcttgtactgtgatgggagtaaagagctgcgataaacactaatcactcgaccccctgtgctgaaagctgattca

SEQ ID NO: 108015 - DNA, 667 bp, Oryza sativa
caaccaaccaggataagttacggagttatgcaagcaatagccaaagcgaaacgaataaaaaggagcacagaatgagtacgtaccgtatggccgtggatggtgtggcgataggcgagtgcattgatgaggtgttcgaggcaagtgaactggataaacgcgaagccgtggtgccggccggtgtggcgatcgatgggcatgtggacgctggccacgtacccgaacagctggaaatggcggcggaggtcctcatcgccggtgtaagggccaatgccaccgactaacatcttgcacagcgtgggcagagccatcgtcgttaccggtagcgtcgaaacaagatttcgacaataataaaaggggtggaggaaatggataggttcagagacaaggaattttatacaggtttaagacttcctattcaagaagtaataccctactcctgtacggagataatttcgtcgagtgtgttattgattgtgtaaactagtaaaaagaattgtgccccaagaggcacacggaccctccttatataggggaaggaatccgctttacaaaatacagtccatatcctaacggaatatgagattatagataaaatacaatcgtaatcgactaggatctcgggtattttcttgacatacaagttaaaaactaacccgagtgctcataa

SEQ ID NO: 108016 - DNA, 859 bp, Oryza sativa
tttaaaaaaagttagcatgattttgacgcttctaaaaaaaaactcatataaaaagaagagcttccgtgtaaacgaccgcaagcagtttgagattatttccattgctcgatgcgagctcagcatggcttgcaagctctgtcgtgacacactctagtaacactagaaatcctcactcgaattgacctgcaggttccatttcatcgtagtaaattaatctggatccatagctcgaaagttgatgaatgcatggtatgcagatcgaacgtactcagattcgttatatcaggagaagtcacattttttgctaggttagatttttttcttatccatataaatacttctatatatcctcaccctacaccgtatcgggacaaacagattgtcaccgacgaggcgatgatcacggagtagctagctggagtagtacatactccactacagcaagcgagagagcgagctatcaaatcgaatcaatcattcatggttcgtccgtttgctatgtctggtgatacatcttgttctcccttgcatggccttcgacaccattaccttacatttttgtaactatcccaaaaaatgcactagtacacgacttctaaatgtagagtatcttaacggtgctatctggtaggtagcattctactacaaacatcaccataaaagtaatctcaataactgatttgtttttttaaagataatagaatatttcattagggcatgtacaaaagtagagtcagatatgagctctatgttatctagagactagcattctacaacagttagagacaatatggtttctaatcattaatgcatcaaaatactttttcttacttttctttcctttctttcaccaccatgc

SEQ ID NO: 108017 - DNA, 1157 bp, Oryza sativa
cttgctcaggataatccttattattgattaatcttgatcaaccttcacctcctggaagttgcagacgttgcctcacgactaaccgatacacaaggtctataatacgcgagaaaaaccaatattcaaacaacaatcaaatatgcgcaacaaaatgtactattcgtgtttgctaatggatcccaaccacgctaggggctaaggtttcttaatctttctattgtcaacgtggcctatttaggagttaaccatcatagcatttatgggatacatatatatttggctaatcggtggtttagtctatcaaatggcttatggaaggattatggctaagcatgcatctatctaaataggacagtcatatactagaggttatgttgttagatggatttaggatcaatcaaataattacagtgaatcatttgtattatttattttattgatggaagctttactttgattatgaacatattttacttgtcacaataaattataaaaggttaataattatccatgctctatatgttaaattcgggaagtttataatattatagttacatattatctcttaatgaacaatccggagttacaattgaactatgaacatatgaggtactattcatgtttgttatatactccccagtttaatatatgaaaaagataaattaattgtgtaactataatgggatgtacaatatatgtgtgcaacaacgtataaggttttggtcgcctactgtacatgagcttatttagaaagtgtactacccaatgctccaagtgattcctgaatatattgtagtttaattatacattagctagtttctatgagtgatattgtatatgtgatgcgacaagtttaagcactggttctattgggttactaataagtggtaatcaatttaggcatatataagctattctatatggtattgcgtcgattaatttacttagtgattcctccacatctagctctattattattctcctaaacaggttaaagattcatctatgtgtgtttatattttagttgcataatcataaggctacacttgatttaaataacctataagccatggatttaattatatggccatcgaatattaaataagtactagtattttcctatacatccattcatttgatacatcacataaaattag

SEQ ID NO: 108018 - DNA, 975 bp, Oryza sativa
tgtatgagtcggttttaagttcgttcacttttggaaatacatatccgtatttgaatcgagttttaagttcattcgcttttggtaacacataaggaatcgtataagaaatctctttaaaaaacttgcatgctaacttgaggtgatcgaactcattggactcctaactgcagctcatgattttctaaatatatatctaaacaaatacccacagtgaatttcaccttaactaaaccatatctcttctctactacttaaaaaataagagatgcttccatcatccgtcaaaaaaaaccgccaaaaaaccgggcgaaagagaaaaaaactggacaaaaaaaccatgattgtccgattaaaaaaagggcgaaaaaaaataatccgatcccctggaaaaaagggcgacaaaaaaccggctaaaaaaaccagacaagcgagaaaaaaaaaccgtaactgtccgataaaaaaaaggggcaaaaaaaataatccgattcagtgccaaaaaaagggcgaaaaaaatctccgttaaaacaaaaaaatagcgaaaaaaataaaaaaagtccgactcctatctgattccctctcagaaatgaaaaaaagtccgactatagatccgattcccccgaaaaataaaaggtgccactccttttgagtccgaataccagccaccgctcctcggttttaatctataccgtgatatctctcacatcttggtgaaacaaaatgatgtgccggattgaagatctgtttacaaaaacggaacctacaggtcgagagcatttcatttttatattattttaatttttaggtttgtacttttgcatttgagtccctgtaatttttatatttacatttgagtccctataatcttacaataaggtacttaatgtcatttttgataaaaataataataaaagagagaccaaaagcataaatgtgcataaaaaaacaacaacaacaaaagttctgtttcccctaagt

SEQ ID NO: 108019 - DNA, 707 bp, Oryza sativa
ccggacaccttggttcctgtattactctaacctgtcagagctggacgggagggccctctcctgtcgctggtacactcctcgagtcttgacttgtatgctagctagcttttgacactgcatgattggagatcgcgtgatagatcgattgcctttctcaggaagcggcacccgtaacgttcttcgccgtctgccaatcgctaccactcgatcgatcgctagtggccacattattcctgaaggtgaaattaagctagatatagctaggttttttgtttgaatgttgactacgaaaaagaagaaagatacgttgtactcctacgtacctacactgtcgtgcttggactactccagcttaattgtcgtttcctcgccggggtacacgttatttgggatcgaattaggacgtactactacatgcacttgtcttttttcttctcaatacatcagtgcatctttgctacaagtagaagtagaactgaccgatcaatcagcgaactaattaagcgtggcgaacacacgcaaaaacatcgcgtcgatcgatcgaatcgaaccatgtgctgtgtcaacagctgtcgactgacaggagaaaaaattagagaacgagagcgtaaaaactgtgatgtttttgcacgtatatgcacacattgtacgtagtactactacatgtattattgagacgagtctatatgttttggcgacgcaaatct

SEQ ID NO: 108020 - DNA, 655 bp, Oryza sativa
ctcaaataattccaacaactcatcttgaaatctggaaaacagcataccatttagcctattttacaccttcaccaaaattcaaccataacctatctagctaaaccacttggtcagaatgctaatcatagtgttctctaccgcctggtgcaatggcttaattaaattcgaaatgtaaccacatgaaataaggccacaagttgcttaaacaatatttagactgcagtcaacatcgtaacttagacctctttactaaatcaccatggtaactcaaaaagtaattaaatcttggaacttggcacattgaaccatcaaatccttgtccaccttgcagcaaccttgtctccccaaaattctaaattaaatggaagagaggagagggattaaaaccacatgatatagtttcaacacttagaaaatttagagctttgtttctccttctacacatctctctcttacatgtggggactatgctcttgtgggacccatgtgtcatacactcacagccaacacatcatctacacacctttcatttaattattcatttgttaatccaaaagtgagagagtgagataaaaatcaatttatacctaaactactactctacctctcacatacacctaggatacatcaacttggacccatttatcatccaatc

SEQ ID NO: 108021 - DNA, 626 bp, Oryza sativa
agcataaagtcgaagaaaatattaatgagaaaagacggtaaataatcctattgggcatatgttcggtgcagcttgctacagcgtcggtacttcatgcaagcaaaaagtgagggctgccccatgaaaacacgcccattacaacgaaatgaatgtatgtgtgactgaacaggatgatccatccccacccatccccaccgttgcaacttgaaagcaacacaagagagttcttcaaccatgcatgatgcatccttccggtcctctcgagtagtttttagctatggagggcagcaaatgacgccctaagttctcttctgtaactaacctcgagccacatctttttttggtatgtattcctatcgccacccattctcaactaagtgtcggttcatgctgtttacccagaaatgttattttctgtaagtttttctgcaaacatatagagctgtaagagaaaataacaccaaaaggtaattatgatgtaccgcctctactcgttttaggctgttttcaatattagagatacaactatgtctatcatcactggtggagaaaccatctttcgtcggtcgggctaattccacaatagtcccggttgcaacaaaaaccgggactaaagatgatcttta

SEQ ID NO: 108022 - DNA, 717 bp, Oryza sativa
ttttgggtctaaaaccagcacatttctcttacacaggttttaggtgtcggttttatttaaaaaatgacacatatttggacattaaggtaccggttttaaatatttggcgagtggggctaggtacatgggtggaaaatacattatactattataggtgtcggttttagattttccggcacctatagtgacgacacatatttatcttttttaatagtgattttggccagccagcgaggtcgggtgttggtgcgctggagtgctggatgtaggagggtgcagcggcacactaggcgagatctagagaacttcaatgaaatcgatgtgcatcggtcggtgggggtgagagcataaggtggaatcactaagcaacacagatcttaaagtaactagcatggtggtcagcgtagatttcgcggctagcatcattatattttctctcatataatagcatatatgttttctcattatattattaatatatattaaaatgacaacataattttaaattttgcaataactttacaaaactactaaagtgtaatattcatattgtattttatatacgtgttagttattaattatttttaatatcaaattttagttatttgtaaattatatatattcctatatggactctagacttgtctttaaatttttgtttaattccgaattttctgtaaattgtatttctatatagactttaggctcttcttccaa

SEQ ID NO: 108023 - DNA, 504 bp, Oryza sativa
caaagaaaatactaccattttttttgctgagtccaagttatggtttagcactggagacacattattaattttcttcttgcaatatgtattcagcgtgtgggttgataatttagagagctctaaaacgatagcggaaaatcaaacaaaaatcttactaggcgcaagtgctaaataatgacaggtatttccaaagagatgcaagattggtctaaatgggttgaggcaaagtcatgtttctagggacatgcaaaattgcaattgatgcatacttttttcccttacaacaaaattgtgacaaaattattgtttgtgctttattaaggtttttgttacaataaacttatacgcaatgattacttaacatattttcacctggtgtgatttgaaattaatagatatctttttccccgttacaacgcacgggcacctaactagtctttcttcaaatttgaagggtctttcacataaaacacttgtaccacgtgattggcgagtacccaaggg

SEQ ID NO: 108024 - DNA, 581 bp, Oryza sativa
tctatctaattatgttgatatcatgccatgattattatgccttacacattgctaaaatgcgttgcttaaattacgttgcaaatgttttgtgaactaaaatttactttatgctgaaaattgaaaccacatatagcctttctttgacttagagctttcatgtatataggtttgatagtgctcttaccagtacattatgaatgtactgagtctagccatgttttgtctaatttatgttttgtaggaatagacttagtttagtttgagtgatgtgggtttcgactgcttcttttaggatttgtacttaatggggtaaacctctagttggtgtgcttgaggattgggtagtcaagcttctgctgctctctgatatagatatatttggccggtcggcctatgtatctatttagtagttgtaatctgaattttatttgctttagatgtaatttgctatgtatattcatgcttaaaatgaaagtgtgaatctagtgcatattctgggaactagattcacatgagtatgagttaggaatatttcagatgttgtatatctttaactatttttatcaagtcttctgaatgtg

SEQ ID NO: 108025 - DNA, 578 bp, Oryza sativa
atatgggagataagaagagctcgatatgaatcaatccaatcctaatttctctccaacttgttttctttatctttaatgtctctccaactatactctaacaaaatcataacgtgcgtaacaacatcacaatctctctaaataaaaagttccactgaaagagaagtgatgatgcctgaaagttccgtatcagcatgcttttgtaatttgcatgttaccgacatgccagttttccatcgaaaggaactgggataaatctatcagtgaagccaaaaataatgcttgccgcaaaaacaaaatcagggggtcaaagataatgattcttcattggcccagtgcgctcatccactataccaagttacaaccatatccaataatttgcgaatggtcccgtaggaactcactaaaacatgaaccataccttgtagaaatggacaagatcttaggttttccaagtcaatcaacttggcgacattcgacggcatcgtcgatgataagtaggctgtgtttagatccaaactttcaactttttccatcacatcaacatgtcatacacacaacttttcagtcacatcgtacca

SEQ ID NO: 108026 - DNA, 628 bp, Oryza sativa
aacttatcaaagatgtggttaatcttacctagtgaaaagtaaatttcaaaatgctattaggatgagccacatcatcagataaacaataaccattgaatcgagaaaaagacaaaatagagagaagctaaagagttcagccattgattatagagggaaaaaaagacgatgaactaccgaagcattccagcaattcagaaatgagagagagaaagagcaaacaagaaaagtagctttgtaagagagtgggggcgttggctggcgtatggcatgtgatataattttgcactatacgcactcagtaaaaattattttacaaataatcattcaaaattatttatattatatgtatatacaatccttacaaccgactaattccaaattactactgtaactttaatgtcacaaaatttattatcacataaacatatcaataaatttttctatgattttaatgttttactttggttcacctctttagtgtaaaagttaataggttggccttaagagtgagtgtttcatctacctatatgccctatatgcttgcaggtcatggctgatcaattacacttctcccaagcacatacttaacagaataaaacattgtttactgatgccaatttaaattaca

SEQ ID NO: 108027 - DNA, 658 bp, Oryza sativa
ttgagatcagttggtatttctggaagtagttgaacagctttgcttttccatgtcaagaagaagctcagctgctcagttggtgcggccgttcatagaaagattcgagattcaggtaggttgtatagttcacgggagcaatcagcagtgtggaaatttttatcacgaaactaccagacatcaagagtcatattctgttttccaggttgtaaagaaatgatattaatttttctgtcgacttatcagcataagcgcaccagtggtctagtggtagaatagtaccctgccacggtacagacccgggttcgattcccggctggtgcaattttcgtttttgtcacctgaacacattgatcattttgctggtttaaacatcatgggctaactttcgatcaaaccgatttaccacgtttcattccttttgtgatgttaccacactaggcttctagtacctgtgaaatttactttggttccattttttttgtaaaatcttatcaacagttcaacatactggccaaatacgaaatattcagtcgtagcaatctcatttgtctttaaccctacggatattcagcgaaattcccaaattttagaactacggcttcacctcggaatgggtttcatgggctctttccttccgaatgctcatccatatgtatgg

SEQ ID NO: 108028 - DNA, 952 bp, Oryza sativa
ctgctagttgctatgcattgtgagcttagcaatgtacatgctgcctgctggctagcaggcaggaggcagcacagctcttatttataaatgacttgccaatctgaaacacactgacaggaagtcatatgttcttctgataccttcaagtctatgctttgatgataacttgtttctttatctttctgttcagaaccaaggctagagttggaatgatctgtttagtaatgtttcgtttcgttgaatattctgtgttcgtgttttctggatatcatattcagctctatttctggttttatggatgatgccgttaatggtttattacttctcttttgagaccaatgtgatgcgtaattgatttagattttactacctgcagcacaaatgtgcttttgtacatggcatttacatatgttcatatggggaggataaccaggtaacagagtactattccacttccttttgctgacttgctgagttcaaaaatcagaagttcaatgtgaaaactggccagactaagatctgtgagctttctgctgaatttctgcatcaactgcgaatttgtcattctggataaattccaccatgcaactgtgaatgtgcattttctatatggccaatgtgttgtcagcttgagtgaaaaaaaatggaacagttgacaatgaggggatcatgctactgaactgaggctatgatttatcctcttggtgacaaacaagctatcggtagtgtgctatggtaatttgtgctatttgcagtgaaagggtagttttcttacgtatacattgtagtctcatggatcatgtcgttattttttttctcctttttggccgttcagaacttgagaagtttaggccgtgtttagtttcaaatcttcaaacttccaacttttccatcacatcaaaactttcctacacacataaactttcaacttttccgtcacaccgttccaatt

SEQ ID NO: 108029 - DNA, 680 bp, Oryza sativa
aaaaaaaggtaaaaatcagaaaaagtgagaataaattttgaaaatgtttaaaaatccgggaaaatttaggaaaatgtgggaaaaattataaaatggtggaaaatataaggaaaaatcggaaataatttttttaaaaaggaaaaaacaggtgcatgaccattacataccgacaaataacaacatatcacatggacaaaacaagggcatgaccattgcacccatagtaacaagttcatatcaaaccatacaagttcatatcaaaccatacatgaccattgcatccatagcaacaagttcatagcaacaagttcatagcaccaagttcacagcaacaagttcactagttttcatcacactaagtccacacataaaaagtagtagttcactagttttcatcacaccaaaccatacatgtcttaaattacatcaaaagtagtagttcctccacataatttattcaagctggagtttcttcttgcttctagtattagaagctgggctggatgggttagccacttcaataggagccctccttggtgtacacttcttgacggcttgcttcttccttggtgtgtccactgtctgtggagagacttcataggatgcaatgtcatcatgaacaactggagggtgctcaatttggagagcaaaggggttattggatccagttatagaccttg

SEQ ID NO: 108030 - DNA, 772 bp, Oryza sativa
acataagctcccaacaagtccaaaatttctcaaatcggagttggaatgaaggcgctaggtgtgtttgaagtcagtgttgcctcaaaggccgaactgaattcctaaactcattggacttgaatatattgtagatcctccattcgtccgatgtattctttggcaatgttttatatttctcatgtttggttgtatgcctatacttaatggtcacaacacttaatgagatgcatcaccatctttttcatctaatttcaccctcaactatcctcccacctctaaccgcccctcattttaatgaagtactctctctgttttgtattatgacagtttgacttttttatgttaaatttctttaattttgattaaattcatagaaaaatttagcaacacttacaacgccaaattagtttattaaatctaacattgaatatatttttatagcatacatgttttgtgttaaaaatgttaatatacctttttttttatataaacttggtcaaacttatttaagtttgaaatacatcttataatgttttcataagtttttttgtggggaatgttttcataagtttgactagagaaaagtgaaaatgtcatatactatgaaatgaagaaagtacttttgtttcttcaccttactcttaaaaaaatacttagaaatactcaaatacagatggagagagttggtatgtagtattactcataagtcgtaagtagctatatgcgtgggatttttctccatttttttctctctcttttttcgtggttacca

SEQ ID NO: 108031 - DNA, 631 bp, Oryza sativa
agtcaattgctaggagtcgcaccaattccgtagtgaataatgtcatactaagtctaatgtgcaataaaataatcttatattaaaactcaaataatattagaacactacacaatcttatatgataagtctaattacaggtctaataatcttaattaattgcatcacaaatataacaatcatttatattattacgtcacttgcctgctccaattccttctagggctagctcttccactcaggcttgacggacgactccgacaacacgtcttttctgcaagatacaaaaaaatgtattaggataaatgcgaagtaacatatatatatatatatatatatatatattgcatttcacgttaacgttcgtcctcgttcgttcgctcgttctcattcacgttcgttcgcttgttctcattcacgttcgttccctcgttctcgcttgtcttcgttcgatcgttctcgttctcgctctcgttcgttcgatcgttcttgttctcgttcacgttctcgcggcaacgtacgttgacgtgttcgttctcgctctcgttcgttcgatcgttctcgttctcgttcacgttgtcgcggcaacgtacgttgacgtgttcgttctcgctctcgttcgttcgatcgttct

SEQ ID NO: 108032 - DNA, 915 bp, Oryza sativa
tggccttttccgataaggatgtggggggcctagccccctgcctggggtggcgcgacactcctgaggaggctgcgccttcccccgcattggcgccgcgacactcatcatgccggcgctcgaaacaacctcaaaaatcacgaacgcgccccctacctggcgcgccagatatcggagaatgaactcctccaccagggaaccgggaggcccccctttgtgagttcggccgggggcagtgggtgagattcgaggattcggtgagcgaagctgtgtgatcttgagggggttcaatcccccaaagacgatgagacaaaaggggtttatatagatttgggccgctaagaagcgtaataccctactcctgtgtttgggatcatggtcgagtgtagaacacgagtgcctggggttgcgagactcaagcgccagttcgctcggaagtcccccccctccaccactaggcctgaaccttcttttatacctcaaggggttaccacatgggcccaacaacctaacctagctttggtggagaagtattataatctttgcattaaatgcatgtctttgtctcttgacttgggaagccaagcgcacgtcgtcttgattatggggcctgtcaaatcttgccgcctgatatggggggtgcccctgtcagtcaccatttaatgggtgaagacttatgggctcctattacaccgggaaacaggagccttgctttgaccagagcgggaggaccgactccggctgggataagaggatgagaacctctcaccatcattatttgatgggatatgtcgggctgcacgtcgcctgacactcgcgatggtgcgcctgacattctgggtcccatcggtcattcgactgggtcacagaccgggttgagtgcactgcacaccgcattaaatgcgacgtggcgcgacc

SEQ ID NO: 108033 - DNA, 1562 bp, Oryza sativa
aagtagcatgttctgaacctataactcaaaagtcatgaacatataaaacactatatgcctaaaacacgttgtaacttgtaaaatctataagaaaatcattataactccaaaaattgtgaaaccaaatgttttagtattagaaaacacatctccacacccctgtgaagtctaatctaataaaaatcactttacaaaagtatttcataacactacctaagactatactactataaaccgataaaacttctaaaaattcataactccctaatggaataaaataaaataaaaattatttcacctaaattcattttagatcagtaccaactcactgtgcataaatcatgtataaatcatggattttcagctctttcggtgtttaattgcatatcgtgtcctttatccagataattgcataatcggtgaaggagtggattaggtgctaacatttctctgatcaaggcaagttttctcctcccatcctttgaacacattgaatcccataatttgaggaatgaaaatatttgtttgctaagttgcatgtgaacttagattatatcagtatttgaaattgggttaaggtagttatgacctatttgctgcataccccaccttgaataattgatcctcttgctgtttgaactcctagaaatggttaaagaacactctttgtgctcaaatgggtttatatatgctctatgtgcaattacttgcttagccgtgcttagaaatatgcaaatgctcattccatctataattaaaatgtggttttgattaaaatgtggttttgatacttgaacctttgctggaataaaatgaatatgatgggtatttgcgaactaaaatatgtaaaatgtgattttatacttggacgccaagtggtgtgcatatggtgttagttgcataccgatagggggagtgtttgcccaagtccataaggaccgaacttgtgtcacccatttaaagttattagtacatccacatgtgctagtatgggatggcctaagctgattaatctatttaggactagccttgcattctggtaggccggtgtgtatgagtttgtataattcagaggagcttcctatttaccccgacgtggtagtttaggtgactaagcgtgtccaatacaacggtattgtgccacgtggtgggttcctgtcgtgtccgccaccacggcgttaagtttaaggcgtgggcccgccacttaacggttctaggtatattccaagtatgcctaggatggaggaacacgtatcgtgcttgtgcaaggctaggctctaagtagtgtaaaggcttcgttatgacctctagatcacattcaacatgaagagtgtggtggagtcttgcaaactcaaaacaaactagagagttcatatcatgtgggtaaagctgtacaaactctgcagagttctttaaactaatcgattagccgtgctcacggttatgagcgctttggtgatgtgtcatgagtatagactatgttttaaaaatgtgatcatgtgacattggtttgaaattgataaatgtgttgagttgtgtgtgtggtgatacattatgactta

SEQ ID NO: 108034 - DNA, 1497 bp, Oryza sativa
tggttcagctcctccagttcatctatccacaaatgctaaccatttgcgccatcctgcccctaactctgtcctggttcagccagtatcctctgcagcatttcagacaacacaatctcaaccagcatcctctgcagtatctcagaattctgtcagtgctgctagaccattacgagttcagacaacacaatctcagccaccatcctctgcagtatctcagaattctgtcactgctgctagaccattacggggttactcacctcagaattctttcagtgcaccagttagggttcagtcgacatcatatcatcaggttgctccaggtatatctcaaggacttcaggttcagtcaacatcataccttcaggttgatccaggcagggcggttagtgctgaactgcagctttctcagtgttcctcgcttcaaactcagggaattcaacaccagcatgatccatcggcagatatttaccaaaacatatggaaggaggcacttgctaagctggcatcagagctgggggtttctgattacaatattgatccaccagggcgtcttccaagcactcctcaacccaatcagctgcatgctcaaatgaggcctggtcatcaacctactcaagcaacggcaaggcagggagttcaagctaatggtggtcatgttgcagcagcatcacagaaaaggacttccaatggccaccacttgccaaatcacaaacaattcaaccctggtgccaattgaactcacagagcagtcgtactccaagtgaatcttatctgagcaattttgtagccccgccttgattcctcctggccaccagggtcctagaattggattctttgtgccaccattttcacctagacatggcaactgcaccatgttttgtgctcctcttaggctctgttcgtttcctggagttcccaactcccccatctcattttccgcgcgcacgcttttcaaactgctaaacggtgtgttttttgcaaaaagtttatatacgaaagttgcttaaaaaaattatattgatccatttttgaaaaaaaattagcaaataattaattaatcacgtgctaatggactgcttcgttttccgtaccggagggatgggttcccaactcaaccaaaagaacagagcctagacaattagtataaagaggaggtgttcttacttctttagtcttggcaaatgttagcattagttttcttagcctaccttacaacagtacaaactacaaagctatctcaggagagtagaacagggcacccggcactccattaggatatagtgttttagtgctgatctttctgatgtaatggctcatagttcctacaaagaaaatgtaatggcttaaagctctgaattaatggtcgatttttcagtagaaaatatgatggtagccatttgtttgatctatatgtcatgtacgagtagtatatttttccttcaagcataccacaggtgagttggatgttcacttgttgctagtttgggtcgagtgttt

SEQ ID NO: 108035 - DNA, 671 bp, Oryza sativa
cttcaatcatcaaagattcagaacgcaccgagtttatatcgatcatgtgatggtagttgatagactagattttggtctctcgaggagatattctctcgctatttgcatgtcacttacatagttataaaaaaattaaaaaaaaattaaaaagatgtattaacatgtgatatatcactccacaaacatgcaggttcaaatttaatttatacatccacaacgaaaaaaacaattaaactacagctagttaacgtatattaacagtcaaatttgttttttcattgcgagatgtataagttgaatttgaacttgtttatggagttaatacatcttctaatttttttcataaccatttgagtgacatgcaaacaacgaggggatatcctctcaaaagatcaaaatagtttccctccaaatagtacttctttctcacaattcacttctattttcctaccagtccacgtatgacagtgataacacactgtggtcctggggtcttgaggcactgatgatagtgcagtagtgcacagccttgcgggagtttctctcttcgttgagactgcagagaaatagccaaatagccaaaccccttttcagtgtcaaaccgctccgatagtgttatatttgccgtgccaatgtcgatagtgtgatcgaatggtctaactctataaaca

SEQ ID NO: 108036 - DNA, 637 bp, Oryza sativa
caaaatgggtcaaaaattaaacctttcggtatctttcccttctcctttctacatgctgtacgcctgtacccagtggtatagtagctttcttagggctctgaccaaaaactccacgtcaaggccattgtttatcaccagttcttcctccattgcaaggttagctacatttgcagtacctcctgaacagagatggcttgagtctgctggagtgagcttatgtatacatcactgttaggggtacgcagaagccagcaaaattgacacactacagctcttgctacacatgcatagagcaacagactccacatggtgcaagatgtgccggagattaagcttcacggtatttacattattgaacatatgcaagtgtccaagtattcatcatcagagtcatccgtatcgctgcaaaatattaaaacgaggatccatagttagagggaaaaatagatgcactgcagcaaagataaacttgaattctcaaatcgattttgaaatatagtcaaagatcggcacaattctgatacttcaaatggagtaattaaaggcagggcgctatttcaaaatgcatatcatttacagagacaaaactaacgtccaagtctataccatccaaccccatacaaacacccagaaagaa

SEQ ID NO: 108037 - DNA, 502 bp, Oryza sativa
tgctgaatattgatagtaggaattttgcttcattgggttgcattttttttccaatagattttgatgatgataatgataatataaatatgacacctccactcagaattactgtgtttctgcatttcctcaatgcttccccgtgtttgaaaattttgaatttgaatttatactgtggtatttgaaaatatgaatttgaatatggtatttctatgtgttaaaaatattcatgtttgtattattgtgatactaaagtaggtgtaaatataaagtgtacgttgacatgaaagagaaaaagaaataggggctaagaaacgagagttgttgctggagttggaggcatttttaggatcataaggaaatgagggcagagcctatttaccctttgagggctttaaaatgggagggctattgctggagacgctcttacaaatttaaaaattagatttattttattttttaaaaaatcctatatactttttttttaaaaaagtactgattagca

SEQ ID NO: 108038 - DNA, 695 bp, Oryza sativa
ccttttggggtcacccaaaggtgaagtgctacagcggtattccgtgcgcttgcggaattatctgtgatcataagaaataccaacaacctcatgtaataatgcttgaaggcattgagttatgtcttgccttgcgccttaagatttctcgcggcttcagcgtagctatttgggtccacgtcagctccttggattcgatagtcgaacttgctgtacggtctaacgtacgaatacgaaaaagatagcaaataaagcctataagcaaattgctacaaagaaacgataaaaccaaggaataaataaaattggagcaaggagaggggaaaaaaggaatgggttcaaaataattttttgtttgaaaaacaaaagagaggttttggtatctcaaggctgagaatcaaacaaaaacaaagaaaggataaaatgggtaggcagggtttattcggtggatttggttttctagtcggtgctatagagtaaggcaacacgacggctagatatttggatttgttagccgatgctaagatgggcagcatagcggctaaatatttggctcgtctagtcgatgctacagttaagcagcacaatggctagagagttgggaagtttgtacgggtttgaaaagtgttactctacagtcatgagtgacagcagagcgggtaggagcgcacatagctcaaggactagtgtgcggcggt

SEQ ID NO: 108039 - DNA, 978 bp, Oryza sativa
aatttcgttgtctcacatccaaaatattaatatacaccgaatacatccaagtttctgaaaacatcatgaactccccaactatgttatattttgtgcatgattgttggatatgtgaaaagaactgttgttaccattattgtcctccatgaagacatgaaagggagaaatttcattgtctcacatcctaaatattaatatacaccgaatacatccaagtttctgaaacatcatgaactccccaactatgttttattttgtgcttgattgttgcatatgtgaaaaaactgtggttaccattattgtcctccatgaagacatgaaagggagaaatttcattctcacatcctaaatattaatatacacagaatacatccaagtttctgaaacatcatgaaccccccaactatgttatattttgtgcttaattgttgcataggaatgaaaccgatttaagtacaggagctaacccagccaatcatttcattgagcagtagggaagcatagacacaaagcaatgtacttgttgtcaaactgcatgctccagcgcacctgagccctgaggagctagcatttcaagcttcagtgaggagtagagattccatggtaaggtagggaaaaatgattaccaacggaaatcatttgtatgatcaccccaatgcatcagctatcaatctagaccataagattcagcaatctgaaagttgaattagggaaaccattattgatgaacctataacaggaaaagataatctgcagcatatcattttatacccacagttttttcacatatgcattttaacaaacacaaagcgtgcacacactagatggggacagggaagcagcagtcctccacactgccaaaggagtaggcgtcgacggcggtggcggtggcgttggcggcgggggattcggcgtcggttgcagtaggcgtcggcggcggtggcgtcggcgtcggggaggagtcactgccaggggcgg

SEQ ID NO: 108040 - DNA, 596 bp, Oryza sativa
gtttagttaccttcaaacttctaacttttctgtcacatcaaatgtttggcatatgcatggagtattaaatgtggacggaaaaaaaccaattgctcagtttgcatgtaaattgcgagacaaatcttttgagcctaattacgccatgatttgacaatatggtgctacagtaaacatttgctaatgatggattaattaggcttaatagatttatctcgcagtttacatgcggaatctgtaatttgttttgttattagtctacgtttaatatatcaaatgtgtgtccgtatacgtcaatttttttttgccaaaacaactaaacacggcctgtattgtcatgatgaggacacaactagctcggatataaccatgactaccttatgtattaatcaaccaaaggtgtatatattttaaattagatttacttgttatatatttgaacaaacgttgctacacaatgagttatgtgtgttatcatttgcagagttacttgcttgggtgaaagaaaagagaccgagcataaggaatgcatggatgattgaagaagtttattggggaccaaaccaagaccttctccaagtcttctttcatctcaccac

SEQ ID NO: 108041 - DNA, 653 bp, Oryza sativa
tttcaaaaattttctattggaaaattgctttaaaaaattatattaatccatttttgaagtataaaattgttaatactcaattaatcatgcattaatagctcacctcgttttatgtatcttcccaatcttctttatctcctcctggaacacagcaacatgtatgtaacactctcttacacccccgcgtcactccgctccagggcgacacgggcggcgaacacaccagccccattgtcagcccctctccctcctttcctcagcatcgccgttagcaaagtcaggcggctgtagggatggtggtgccagagccgtcatcctttagttttgctcgtggtcacgacagttggggcactaacgagaccagggcagaaacttgcagcgggcagggcgctggtggacgctcctatctgcagatccagctcaggctgtgcgtgcactagtgagggtggcaacaaacacgtggggctggttgacaccgtgtgtagcaatggggacggccagtcttcggtacctcagccagattcatcgttcctacaccgacggcgaaggcgaccacaacaggccgtggagacagggagtggccagggaggtgaagcaagtagggcagtgtggcatggtgaagtgccaaggcagcggtagacgatcatgacatg

SEQ ID NO: 108042 - DNA, 501 bp, Oryza sativa
ccttgcggagatgccgctcgtgaagttcaaggtgtggaattagatggggatcgaggaacccgatctgcatggtggcaatgttagttagcgaaggtgaagttgaaagagttggagagtgaggaggtggaatccaaggcattgctggagggtatgtgtcactgtcgtcgccttcgttgggattctacgttagcttgaagatatcatggagtaagcaccctgcaccccttaatgcatcctctcttatttgtctctctcgtagatctcattggaatcagacagatatagatctaatcttgtcgggtatcgcttggtaatggtgtgtgtaatatttggtaccgacgaatatcagccgataccaacctgatgccatgccaccttcacctatattttcatccacaaagcccatgaccctgccatcatcgcttgatagtacgttggtatcacttcatatcactcaactactcaagtatcaaagtcgagtgaagttgatacttacatttt

SEQ ID NO: 108043 - DNA, 1948 bp, Oryza sativa
aaattagagaacgagagcgtaaaaactgtgatgtttttgcacgtatatgcacacattgtacgtagtactactacatgtattattgagacgagtctatatgttttggcgacgcaaatcttccgtacgtcccgtcgagagatcagaatctgtcacgcaagttttggatgccccggcgccgatatctctggacgatacgctgcgtgaatcgccgtgccgggtagtagtagtagattgactgcaaagcatgttactcaccaccgtacgatgctctgggttacggtcactttttatcagtagcagcatgcagcagcattggtgctcatccttaaaactgaagatttgtctgtcgagcctctaggcactgggtagctagtactaggagtagcaaaaacacagcctgacacatgaggtgacgccaaagcagcccgaccagattccgctcgcagatagctgcattgtcgcgcgtttactggtttgctaaacacaagctacagtccaacacgcagttaattagcagctggccgcctttcttccccatttgcatgcatcagccataatcacaacagtaatcaactgaagaaacagcacctagcttgcctaccataactgaaactagcagtaagcatctgaatcaaatcaacacaggtggccttgtttaggtttagttgcctgctgagctgtttgggtttgttcatcgcaccggaacggcaccaaagatagcaaagggtgaccatgctgtccctcgctaaggttctctcacccacctataaataaccggcttctgcactcgccatggttcggagacgaaatcctttaatttgacgcttattcttcctcgcggtagcttgcgaagccgctatatatacaactcgctttaaattctagcctcaattcgccaccatctcctagctagatttctattgatacacgatatctcacgcccatactacgtaacctacatcaacatacatatatatacctgaggatttgggtgttttgtgcgatgatgttcgaggcggacatggccattagagagatgatgatgttcgaggcgcatacgaacagcggaccgatgttttcagaccagctatgcattgtaatttcttcacccttgctacctgcacttcttttatttgtagagattgttatcttgatcatttctgttctttgttaatttttatggcccctggttattagccttattattttgcttccttcatcactagttgcatagttgtgcaaataactcctagtaagaaaaatacaaactataattgattaatgattactatatcatgcaatgcttgccccttatattattctagttaaaaatctatttatgcttccttgagttaccatgttcttttgcataacattttgcatggatcaactttattttgtttctgattagcaaatctgaatggaagtccttgttaggcacagcgactattgtcatcagcgcaagaacttcaatattgtgctcccctacttagtttgaatatagtgacgcataatatttgccattcggctgaacgcctgaaccttagtaaggatagaaatgatgtccatatattgcagatccgggtttttagccttaggggacatgtgtcccaacaggagcttatcaaatgctctgcaaatagttctgggaaacattagctccattaatacagcaggcactcacaccttggtgcaaaatctcatccctaaaccaactctatatatcaataagaagagcttcagttttatttacgcctaattcgattttttttatccatatatagattattttgacttgaaattgtgaaattactctcacatcatcaaaaaaatcaagttattttgttaactatttgattggtgttgacaggtaggggcaccttttttaatgatttaataccggcaacatcataccctattttataaaatctttgtttatgcataccag

SEQ ID NO: 108044 - DNA, 509 bp, Oryza sativa
cacatcgctgatgcccatttgcgaggtatgcattgcccatccgctctctcatgttacttcctattgggtatttcgcgggcattttcaatactgtggtgaccattaaaccatactactagttctcagcaagtttaatagtatagtaaactattggcttcaaatcatctatagccaatttaatagctaatctatacaatatctataaatatatactacattattaatatctggtcctacatgtcatatacacattacgtcttaaagtccgtgctgtaactggctgtaaatatgtagcctgctgctcacctatctctttttttatcttctcgatatatatttatagctggtttatagtttactattgtacttgctcttatgctcagacatcttgatttggtggtgctacagtgtcatgagacactgtctcaataggagaaatcattaattagttgtagccccgtttattgtgttggtcatagatgtgtctccgacagcaatgcatactcaca

SEQ ID NO: 108045 - DNA, 1661 bp, Oryza sativa
acatatatatatatctatctagattcattgacattactatgaatgtgggaaatgctataaatgatttacattctgaaacgaagcgagtactagttacacgctttgtatgttctcccagctgggtggaatttggggccgcccattcgttctaggtccattattagggctttaagttacactgtaaagctaattcacattgcaacattacgattccacttagacgtcatgttatatatctacttcatacagagcaactttatttaatctagaagcttgaaattttactaattaaggcatgtcttctgtgagccatattcggtaggaaatatatagctgtcatgcagctttaagtctatagtaaggcttatcgtgcttaattttcgttaattagtagggggccagacttaacgtacagtttgatgttaacgtgcaattccacgggtgtgaaatgctgtgttgtcttactctacatttctacaagtcaatgcacgagacactgtgggccccgatatgtatggattagaagaagcatgtgtcatcacaatgattggaaactttttattaacacttaggttcaacaaaagttcttattattgagcacggtctactttcaatatagataaattagatacaacttttctatcgaaataaattatggaaaatggggaatcggcaattgtgccttgtgtgaatggcctccaagcccagcacatccctagcaatatatacacatacactagttaagagagatagctataggtatcatatttatagtgcgaaatttaataattgaggttaatagagttaacaagagatactaaattttgtagtaataaatatagtatcaccccgatggactcactgttagaaaaatgcctacacatgtggatgagtcaagatttaacaagtatcaatcaaggtgttaatttcttcagtattatatatactattgtgaaatggcacgtcacgtataaataaagacgtgtgtattacgatctgattatcgtgtatcctccgctaccatttctttctgtaatgtcaaaatcgcgctacttctatctggtttttaaaatttgacaccataagcttttagacgtgtgtgtgactattcgttatatttggatctttttggtaattttcacctattttgttatgactatgcttatagtacatttaataataaaataaatcacaacacaataaaaaataattatgtttttttaataagaaggatgattaaagtttttttaacaagataacggagaggagagattcccatctgaatatattgctcaaatcgtcattgacacatagggagtacaaccgatattagcaattactccctccgttccgtaatatagcaatctagtaccggatgagacatctcatagtataatgaatctggacagatcttatagtacaatgaatctggacactacgatatgtcccatccggtactagattgctatattatggaatggagggagtagtaattacaaagcagaagagaagatgtacaaggatgattaaagttaacgatgtaaagcatggtagtatggctaccaatttgtgcaaaatcacatgctactggagatgataagttgaacgctgatgcaggggatgtgtttgctgacgctggccgtgaccattccgtcgctgaa

SEQ ID NO: 108046 - DNA, 645 bp, Oryza sativa
ggtttgcaaatagtattagctacttgtcaagttgtttgcatagacttactgactggaaattggttgatatctcagtaagaacacatcaacaagatcatgactgtaactggcactacaggatggcatctttatccaatgtgcatgcagagatgcgaagtgccgcaataggcgtctaaaagaaaacgtgctgccccaaaagaagggagctcgcactacggagtacctatttgggcaccgttcttttgccaggttcgggctaggtactcttctagatatttgcgaccatattttttaaattgttaaatattttttcgagataacgtgttatatagaagtgcctttatcaaataaaatgagctcattttccaactctccaatattaaaacataattaatcatgcttaatagtccacatcgttttgcgtgtaaccaattaactcagctaaacatcataaacaaacgggtttaaaatatcttgacaacattggcctggcgtttgaaagcaagaatttggagcacattcaagaggataaatggtataattttaggaattctaagatgccgcacatgaaaaatgaaagattccttcaatagataactttgcaatggttgttcagagaaaaattctgcaaacgataccgctgtc

SEQ ID NO: 108047 - DNA, 701 bp, Oryza sativa
caatatatgccaatattggcattgattgacaaaagttagccgcgcgaatcatgaagagagttttggtcacgaatgcacccaatacactccaatatgtccaaaaatcatgttttggtgctttttgaactttttcattccggtcaaaaacatcgcacccgtgcggtccaatatatgccaatgttggaattagttgacaaaagttcgccgcgcgaatcacgaagtgagttttggccacgaatacacccaatacacacctatatgtcccaaaatcatgttttgttgctttttgaactatttcattccggtcaaaaacatcgcacccgcgtgggccaatatatgccaatattggcactgattgacaaaagttcgccggacgaatcacgaagtgagtttttgccacgaatgcacccaatacactccaatatgtccgaaaatcgtgtttttgcgttttttgaacttttttattccggtcaaaaacatcgcacccgtgtgggccaatattggcattaatggacaaaagttcgccgtgcgaattacgaagtgagtttttggcacgaacgcacctaatacaccccaatatgtccaaaaaatcatgttttggcgttttttgaactttttcattccggtcaaaaacatcgcacccgtgtgggccaagattggcattaatggacaaaagttctccgcgcgaatcaagaagtgag

SEQ ID NO: 108048 - DNA, 1253 bp, Oryza sativa
  unsure (1)..(1253): unsure at all n locations
gcgcgaatcacgaagtgagtttntgccacgnacgcacccaattcatcccaatatgtccaaaaatcatgttttggtgctttttgaactttttcattccggtcaaaaacatcgcacccgtgtgggccaatattggcattaatggacaaaagttcgccgcgcgaatcacgaagtgagtttttgccacgaacgcacccaatacaatccaatatgtccaaaaatcatgttttggtgctttttgaactttttcattccggtcaaaaacatcgcacccgtgtgggccaatattggcattaatggacaaaagttcgccgcgcgaatcacgaagtgagtttttgccacgaacgcacccaatacactccaatatgtctaaaaatcatgttttggtgctttttgaactttttcattccggtcaaaaacatcgcacccgtgtgggccaatattggcattaatggacaaaagttcgccgcgcgaatcacgaagtgagtttttgccacgaacgcacccaatacactccaatatgtccaaaaatcatgttttggtgctttttgaactttttcattccggtcaaaaacatcgcacccgtgtgggccaagattggcattaatggacaaaagttcgccgcgcgaatcacgaagtgagtttttgccacgaacgcacccaatacaatccaatatgtccaaaaatcatgttttggtgctttttgaactttttcattccggtcaaaaacatcgcacccgtgtgggccaatattggcattaatggacaaaagttcgccgcgcgaatcacgaagtgagtttttgccacgaacgcacccaatacattccaatatgtccaaaaatcatgttttggtgctttttgaactttttcattccggtcaaaaacatcgcacccgtgtgggccaatattggcattaatggacaaaagttcgccgcgcgaatcacgaagtgagtttttgccacggacgcacccaattcaatccaatatgtccaaaaatcatgttttggtgctttttgaactttttcattccggtcaaaaacatcgcacccgtgtgggccaatattggcattaatggacaaaagttcgccgcgcgaatcacgaagtgagtttttgccacgaacgcacccaatacaattcaatatgttcaaaaatcatgttttggtgctttttgaactttttcattccggtcaaaaacatcgcacccgtgtgggccaatatttgcattaatggacaaaagttgctgcgcgaatcacgaa

SEQ ID NO: 108049 - DNA, 791 bp, Oryza sativa
ccatgccgagacggtataaaccacttagattgaaatatatattagcaacaagattatatatgttcatagcataaccgatcagatagatctagcatgtatcggctaatactccgataccagtttatactaagatattaaagcaagtaaaatatatcaaacagtagtgtaatatacctagatgcaacaagattttaatataaagggcaaatctagcatgtcgattaagcacatgaaatataaggcaaaattaggtaaggtcggctgaaaccccgagactactctcatcaacaaccaagaagcaggctagagactgagattctaatcatgacttataaggtcaaactcaattgatgcagctataagtatgaaaagaagaacaatatctagacaatcaagccgttggatgtttcatagagtggtggatatcctgtacaatctaagtcaacatagatatttgacttaatcggctgccttccaataatagacatttagccgattgaagactagataacgatattgtcgaagattatacagaatatatgataactcgacgaattacataaacaagattagagtatcataaagatggaagcactaatcccgagaacgcaagccgccataattagttttacctctagttgaagatcaaaaccgatgcagctcaacccgaaagcaagaactcgtcgaaacaaaacgaaagtaaagggtggcgatgcgccgagattatattgaacgtgtgttagattcattacatggggctcggggtctaattatacccgagattacaaaat

SEQ ID NO: 108050 - DNA, 686 bp, Oryza sativa
cgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtgcattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgctgctatctaaattccatttaaggtcgtaccttatcgccaagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgcaaaatcgtgcgggaaattgtaatcccattcaccagctcctacatttaattaacaagagaactattgtatttatctaacacctggattatctccacctttcatttgatccctatt

SEQ ID NO: 108051 - DNA, 1415 bp, Oryza sativa
ccctttgtagtgccgtggtggtacttcggggcatggcaacatgtgtgaaatcgtgtcttgtgggtacagtggtactcctctggccagagtaaaactcttcgaatagccgtacccgcggtcatgggcgggtctaacaatgtctttcatgattagtctcacacctctcatcataataaaagatgctttaattggtaataatttggttagctcctggtttggaatggtatattcctggtttggagatagaactgtacagccgggatggttgttcagtatggttgggcctatgcaacagggtatgttgtatagcgttggattaatattgtttaattattacttaactattttattaaattctgagatatttattaaatgctgtttatgcaaatgaaaccctactatgccatcctttgttatcctgtgcacttgcatatttgctgcgtggcttgctgagtatgtcatatactcaccttgcaatcattcatcagaggaagagttctacaatgatgctgatggtgtggaggattagatgtagccctggtcaagctgcctgtggagtggagttgtctgcgccgtttatcttattttccgctgcttagatctttattgattgagaggaactatctacctctgtaatgacattttattcgcttattaattagagtaataatggtactctattatcaatttgttattgtgtgcctcggctgattcctggacgagggtttacacacatgtaagcgttcggaattttggatagaaattccgggcgtgacaatgtattttaggacatagtaataaattttgaggtgtttcatctaatctactggacatagcaatctatttctttctaaatagagtgaggtgattattcatgtatagagacatatgacgggttaaacagtgagtggacgtggtcgctcgcagatcgctcgcgcttggcaagctggtgacaccatgctggtgtgtgtgcccttgaggcaacaccatgtcaaggcgcgtgccccacagcttggtctcacctctcctcgtggcgatgacagtgtgccagcaaggtatctcccattctcccaggtgagtcatctatatctctgtgattttttttaaaaaaaaggtatattcacatgtaatcgttcgacaaaaagtatatttatatttttttaaggcaaagcacatacacagaaaaacgatatcttccactgctcgactattcacgtaatcacatgggacccaaaaagcccaatggcgatcgatccctcctccacttggtttcccttttttttttcaccgtattactttcctattctagtaaatttatgcacctaaagtttctacacctcaagtttatacatctaaaatttatacacgtaaagtttagagacccaaagtttataagccaaaagtttatatatccg

SEQ ID NO: 108052 - DNA, 1310 bp, Oryza sativa
taagccgtgctccaggtgctttacatctcgatgctccctggctagcaatgaggttatatcttcaatcttaattagcaaacctatcacacctcagcatgtcgccatttttattccatgctcgacggtaactacctgctgctgttgcgcatgtcggcggcacacagcgtccatttgtacaagtttttgttgtgcttggctgagtcctatgtatggtcaccagcttgtggtatttgaattgtggacatgacacatgcttttttatggtcaccaacttataaattcaacatgacagaaaattatcatctatcgcacggtcacatgtttttttatggaaatttgaatgacatgtaaaatgttggagtatggtgtgcagctatgattttatgtcatgttgaatttataattttttatttccttccacaccatcgatctaatttatacttgtaaatgtttacaatgataaatttattttcaatttcttacaatgttccactgatatttggttggcatgcaaagaatagggttctactctttcccttttttaatatatcgctccgttgaccttttgatatatgtttgaccattcttcttattaaaaatttatttaattatcatttattttgtatgacttaatttatcgtcaaattttcttcaagcataacttcaattttttatatttacacaaaaaaatttaaataaaatgaatggtcaaacatttataaaaaagtcaacagtatcatacactatctcggtcccaaaataagtgcagccgtgggtctccaacgtttgaccgttcatcatagtcacacataaagtattattcatgttttatcatctaataacattgaaaatactaatcataaaaaaaattcaaataagacgaatggtcaaacgttggatatgaaccgtgcaaagcagcacttattttgggatggacggagtattaaaaaacggaggtattatgtccaaatgacatatttccatatatagcatatattatcagtaatattgatattatagtgtttcgttgtatttgattatcatgcaaagaataggtgttatccaggtgacgtatttttgtatttatcataatatgagtaatattgatcccatattattggtttaataataaatttaataatagttccaataaattcgaaaacggagatattgcttaaaagttatggcagtagaactatctaattctacacatgtaacactggtggagaaaccctttgtagtcctggttcgtaaccctcctttagtcccggtttccaaaccgggagtaccaatccgggactaaagatcga

SEQ ID NO: 108053 - DNA, 743 bp, Oryza sativa
cgaagagacggtgacaactcggcagaggggaggcagcagctccatgaagggtaggaggggtggcgtcggctcagtgacgaggaggactgccgacgatggcgaatgggaggcggtggctgtggaggggtggcagcaaccacagatatggtaggaggagcggaggcagagggatggtgtcggctcagtgatgaggaggataggcggtgacggtgaaggggcggcggcacggtgacgaggaggaccattggcgcccacgcacatctccgccattagcttgctaataaggtcaaataagtaagggtagaagtggtatttggggcttttgttaactccgattaatgctcttaagagaagaaggtcagagtgtagcttcggttttgaaaagaagggtcaaatgagcaaagtgaccaaaacatggtcaaatcggtagttagatatgcaaatagggtcaaatgtgcaattgctccattttatattatagattatatcattttgtatcattttataaacatacaaagccaaagacacgggtgatttacttaatctatctaaaaaaacatgtctacggtaataagaatcatagatactgaaaagacagaaaaactcaagagcatataccctaataatacctaatagtaaataaaaattatcaatggctaatccctaggacatataaaattataaagtattattttactagtttattaaatgccctaaagaaccctcctacaacgtctattaaa

SEQ ID NO: 108054 - DNA, 1012 bp, Oryza sativa
taggccatccccaaccaataaactattagtttccatacttgtcatgtcatatagacactatatgtagacactatgtattcaatggatggtgtatctatctatcttctatctatctatcttctatctatctattatctattatatactaaaagtccattaaacttcctacaaacgctctaaagccgccacgtggcactcctacaaatattcctaagtcgccgcatggcactatctaatcttaccgttgattttcacttaaatttgtggacccgttattttacaccattagattagatctattattaaaaaaataataacttccacatgtttataacatacaaacgctagctgctactgtccgtatgtatgagattgtacgatacaaacgctactgatgttctttccgtaacatacaaacgtacatgattgaaaataaaatgatcaagctttcttaaccttcgctggaagaaaaaaaaaaccatacacttgtacataaaaaagacagaaacaacatacatccataaaaatcaaccgtttttaaaatatgattttctacaatataaagataaaatatattacttcacatgtataaatatatttagttaaattaagatctataataaatatccaatcaatgttctttaaaccatcttctaaatctatctattatatactaaaattacattaaactttgtacaaactcttttactctgctatgtggctctcaaataaattagagaaatcctagaaatctattatatacttaaaagtctattaaacgtactgcaaatgcttctacattgtcacgtggcgctttaataaaattacagaaatcctagaaattcagaataaaaaaagaaaagcatccaaccttcagttttcacttaaattagtggacccattattttaaacaatggattagagctcttaaaaataccatgatgctaatctctatcctggaaaaaacataatgcgcttacgtcatacgatcgtctccctcccggaaaaaaaa

SEQ ID NO: 108055 - DNA, 730 bp, Oryza sativa
ttaccacaattatttatgatattctagcaccttattcatgaatcaattggcattcatttgcaagattaactacagaatttccaaaactgagatcaatgggtcagcgagggaagcggtactaggaaaaatgtcatgctgaataaaggctatcaagttaacgaggacaacagtatgacaccttacttgcttttctactgttatttttcatacatgctatgttcataaacacatagtacataattttgggtaattttattggtgtatatttttcattttccagtaatgtttagtggccttcaattttgtttattaatacttgctctatccggtcaacagccatatatttgagttgtaattctgttagttgcattggccaaccactgctacctggggagatactccatcatgtaatatttagttataattaccactgtatatactccatcaattatatggtaataagtagttttttcttttttcttctcaaatgttatgcacatattgcatgtttgaaagttatttattatgtccgcagcaacgcgcggggtattatctagtagtcaagaaatattatgtcattccagttatatcagtattatgtgcaatcggtttagcattccataatgaatgattaaatgggacttaacaaactaataagctcaaaatgattctcctatcgatgaccatatgcacctcttcaattaaaaaaaaagaagaaagaccatatatg

SEQ ID NO: 108056 - DNA, 733 bp, Oryza sativa
tcagtgatagaacccttcctactgtaggatggataattttgagcaaattggatacatggttacatgcggcatctatgccttctattattgatttgattttctttgacatatctactcgattgaatgtcaacttgccaacatggtcaccggcaccatctcgtgtagaagaagaagaaaagcatgaaaggcagttaccaacggtacggtgaagaacatggtggccatggagtgcctggccacgtatgctgctgtctaccaccggggtggcctcatgggtgccatgaatttggtcctggatgatgaagtactggagctcatccagcgtgtcctcagcctcgtcagccttcttgctgagaatctccaaaagcccaggcaggccagggttgctcacgtccctcctcatctgagcctcgtggagcagcccttgcgtgaacatgagatcgctcttgatctgctccatgttgaggccaagctcggtgctggccacgtaggccttcaccaagctatcggacagctgcgtcaccaccttgccgacgagccagctcgccgcaccaacggccacctccatcgatgattgatctcagccggccaagccagatggagcttgcctgccaagggcaggggttgcttaggattggctctaagctgcccaggagtggatggctctaaagctgggatgagtttctctacaagagaaactatataatgacttggctctaggcttttcctattt

SEQ ID NO: 108057 - DNA, 614 bp, Oryza sativa
tgggactcagggtcgggttgcagttcggtctgaatcatcgtaggccttgggttaaggcaggttcgtgtgggttcacggccttgattaataatattgtatagctctagaatcgtgtttgcaaaatagctttgagcaactaagtgtcttttaatgctgtttactgcaaaccctaatcctttatattataactcccttgtactcccttacatttatcctgcacttgtgggtgtgtcttgttgagtacggtggttgtactcagtcttgctcaattttttcccaaacccagaagaggagcccctggaagatgaaggctttggtgtatagctcgtgcctaccgtcaagcgcctgtggtcgtcgccctagtcttccactgtttcccgtttgtctttgtgtgtgctgggccttcgccgcccatgtaataaattaactatttacgcttccgcttgttaaactctgaactgtatcaacttttggtgtaccttgcctcctggaacaaggaataatgcacgcacgtaaggaacgcccgttgggttatttccggtcgtgacaaccttaacgcgcgcgtgtggctttccgattcctacctcatccggtcaacagggagcctccaataa

SEQ ID NO: 108058 - DNA, 4136 bp, Oryza sativa
  unsure (1)..(4136): unsure at all n locations
tttcttgttcagttttttggcctgatgaaagctgtaatcttatatcccaaactgttcatgatgaggctttagccgagtaagttatttcagttttcccccgcaaaaaaaaaaacacaaaaaaattaaatcaattcgtgttacatcccaaatacatgaattgaaaaatggcaaacgaaggaaaaaaacaatcgaacaaaaatctagccaccggacctcaccggaaacacgagtggtacgagtttgccaccgtggagctcgaagccaccgtcgtcgccttcgagctactgccactgcctcccaaggccagatctggtgaggaggaggcacggagtggccgccggtggtggcttggttgagttgtcactgccgcccgccaccgtctcccaaggttagatccggtgagcctcaagcctgatttggcgaggagcgggtagcgttggcaccccgacgaggaggaaaggggctaattgtggggagagggagagcgccggtgaggggatggcgagggggagcagtgccgcccgtgaggaaaggggagggagggggagaggcgccgccagtggagagagatggcccacggcataaagagagcggtgacgccaataggaggggacagggaagggaagcaccaaagggggagatgcggcccgtcatgagggtaggggaggggaaaaagtgaatctaggttatggttttttgcgcatcggcggttttgatggattcgggaccgattcaagccgtccatcaaaatgaacgactcgattgatcccgtgtcaggccgatctccatccccgggccgtagtgggctgtgcgcgtgaatgccctagcaagccgatggggtccaacggggtctttttctaaaaaactttttatttcttcaggaatatattttcttaaagcgctcgtatcataaataaactataccctaatatctaatatttttatatatttattataattttagttttcacgttgcaacacacgggtattttttctagtagattaaaaaatctagccctcgattttcatttaaataggtgggtccttttttcaaactgttagattagattgattgaagaatttagtgcctttgtgtcctctctctctctctcacgtacgtacgtacgtctcccactccacacgtatgaacgtagcactcaccaattttcctttccatttacccctttattttttttatttgagatacccctatctatatctatatatacctaattaaaaaataggtaaagcttcagaaacggaaaaaaaaagagagaaagctagcaagcagcccaaccaaagcagcagcaggccggcccaacaaaaagcaaacgcagcctagcagtcagcccacatagcaaagcagcagcccagtacagtactgtgcgatactgtagcaaccaggaaaaagttcactttagatcccttaatttatcatcgaatatgaaatccatccctaaatcaaaataccatgtatacctcatcctttaacttacaataccgtcaatttcaattcctcggtagtatcgtagctagttttaactgacgtggcaagtgagccccacatgggtcatatgtcagtgcacaaataataccaccttttgcctagcttgggcagcactagcttaaatagaaggcttgcccgaggctactacaccaaaaaaggttggatccacgtctaccaggaatcagataaaaataaggagcaattttattaatttaaaaaataaaaaatcacatgtattttttttaaaaaaaacatgtgatcaccaacaaaatgaattatttactacaaaataaattatttttagaaaatagaaaacaatcacatgtcttttttttaaaaaaaaatgtaatcaccaacaaaatgaatcgtgtttacatccaattttttttctattcattgtatgatttccgtcaaattttttgagtgaaaactattatgcgattggagtgcagtgaggttgatctgatagatagcgagaaacatttcttatactattgctactctttacaatatgtcaaaaaaagatggttatcaatatcaagtaccaaaaaataaccatgcattgcaaccaactcataataatacatcacaaaagtcaatactttttgggttacaaactttagtctataatacataattttattttaaagtggtattaatagttttcctataatcatccatgtcaatggatttagatcaacaaataattatgtcatgttagcgtcttacttgcaccggaaagattcgatttgctcctacacacccattactattgttcttttatgcttcacccaatgcaacgcatgggcattttgctagtataatatatgtatattacctttatttttatgttattgaattttgaatatattttttatcatttgtctgactaaacatacgtagttataacttattttgttgtgattttacattgatgacttaggttggttatgttttagtgcaaaatacattgcaatggatgacgttgacatgtaataaataattccatantatcttattaaaaataattcgcatcatatttatggtttcaaatattacttaggaaatataaaacactaattttaatctacgtatgtaaaaatgcaaacaatataattagtcgggtgatttctaaagtagatatggcataaattttaatttgggtgagattaagattcacaaatagattcctacgaatgcttctaggccgccacgtgtcccactaataaattagaaaaaatcataaaaattttaggaaaaaatacaaacatctatctaaatattttcattttaaaatcggtaggtgtaacaccctgaaaattttggttttaaatttgcaaaattaaaattcaggttaatcaaaaaagtcttttccaaaatccgtcgtgctggattttattggatttcacttcccattttctattgcgcttagaccacgaggatgaaaatctagggacaaaatttattttagattcaaatattatttgttaaaagaaccatgattatggaaaatattaattaagaaaatatttgtaaataccatttgtctttctaaaaacccttttctatgaattagaacctatttgtggtatttgttttataaagaaaaactagagtaaatttactagcaaaacgctatttatgaactaaaatcttaaaagagtttatctcaaaaattcacggaaaagtctagttttcctccttggaaggcctagcccatcccacataatgggattggtgttaattgtgtgcatttatgcgtgcccaagatcttggttaatccatccatacttgtgaatctcgactcttgtcgtatttcctccggattcaaattccgttgttcgatcctccccaatcgaacccctcccaaaccgattgttccagtgtctggaattactcgaacccagtagttcttctagaatcgcctatgagggtaaaatcccttctaggttctctcaaccctcctatacaattgctatacccccgtcctttccttgaaccgttgggataccatagttaaatcgatccacctaacatatgtcttgatccacctaaaggatgtcctcccatggacatccttcctcgtcccctctcctttctgacagttttgtcaagcgctttgatgctaagcaaatcgaagtccccaaaacccctttattttgttgcaatatcgtttctttcctcaaactcgttgaacactaaggatgaatccaaacccgcttcgtcttttcgactcggcctccctcggattcccttctcccctttttccctctactcaaaactctcgagtttggcctttagcttgaaaccttaaaaccgtttgacatatttatctgtcgtacataaattcaaatatccaccgttctctatttctacctttgaacctcaccccgttgaatggtgttgtattcaacagtgttgtatgccatacactgctcctaaacctatcgtctatagcacccctacctctgaaaccctaccgcaaccaatggattcgtatgccaagcgtcgtttcgagaaatcgtcgatatggtcgtcttttcgtccaagcggtcgcaaagaaatcttgagtcgaattcttaggtggctaaggtagtgtttggttgctgggatgggatgggatgggatg

SEQ ID NO: 108059 - DNA, 1011 bp, Oryza sativa
aggccctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattacaaccttaaaactgtcagattttttgttttttttgttacggctaaaatataatgaatttgacgttaagattttaaccctaggtataatacaattgaaagtatgggtatgattttttctatattttttggtgatattttttagttggtgtacatgtgtgtacacgtgagggcctgtgtgcataggatatgttgccaagttactcatagtcatatctaagctagtggtgtccttatcgatagtacagttggaaagatcgagatcttatcatgtttataaagatgaagataaaatcaatgcatacaaaatgagaaagccattagtgcatgattaatgaagtttcaagtattacaagattgaaaagtaaatttatttgttattttaaggtaacttatatataaaaagttctataagaaacataccgtttagtagtttgaaaaattatgcaaacgaaaaccgaggtaaaatccacatcttaaaaaactttatataagatttgtagtacattgtatgaattaaagtctataacattgattttgataaatttgatcgattttttttaaaaaaataagtagaggtaaaatccacatcttaaaaatctttatataagatttgtaatacattgtatgaattaaagtctataacattgattttgataaatttgatcgatttttttaaaaaaaaataagtagaggtaaaatccacatcttaaaaatctttatataagatttgtaatacattgtatgaattaaagtctataacattgattttgataaatttgattgagtttttttaaaaaattaagtagacttatttacattattttaaatccaccttaatttaaaa

SEQ ID NO: 108060 - DNA, 635 bp, Oryza sativa
attccaaaatggtgtatctttcgatggacacatatgtaggctgaaggaatgcaaggttggcagcatgtattggcatgtcattagctttgtattataaagctgatgcatctcattaatgcctggattatactgattagagtatggcatgaggtatgcagtatggggggctcgagacagggaggtcaagctcaggtagggcttcttttatcagaccccagccttgtctctttgctggtcacggagctggccatctctctggattatgtgtatttatgtatggacatgtcaactaaaatagtcgtcagcagccaacagcgttactgttgattgtccgtttggtcatcactaatccatttcctggctgcttcccttgtgctttagaatagagtattaagcgagaaactaaactaaactaagaaatcgaacgaattgtttggtgttgattgacgccagtgttgattgattcgcaacggcctcgcgcatgtaagtaggacgaggggggtttactcgaacggtagtcgcatagtacatggagagttgttcggtgtgagacgagcacgtacgcacgctgtcatgggtggatgggagcacgcacggttgccgttgcagttgcaggcgtgtgatgagctactgta

SEQ ID NO: 108061 - DNA, 636 bp, Oryza sativa
tattaatgtttaatcaactctataaaaaatatatttgcctttgacttataatgtttctttttccatcaatctgtaagactgtagctagatatcatttgagtttgatatatatatttgtgtatgcatcacttcactaagatcttacgtactactagctaaatgcttaatgcttgtacgtttcaacgagaataaaaaaacctaccatacactttaaagcctcatgatcgccgatgccaaattttgaatttaaaactaaattttgaagttgattttgagattttcttatcacagtttatttttcagcattgtctttgaaatatataaaaggttttacccacaatttctttttgcttataacttgtacgggggtatatagatgatccaattttaatttattcataaacacatttaagatgccactgcaaattaaagccagcctaattatatcttgtttcttttctttttcctctaagtttgtaagttgcaactatcattaaatggtaccgtgtgcacatcacacgcacagttctcgtacttaacttataaccaactccggcatgcttgtaaatcgttgcttaggtaggggccttacgcacctaataacagtatatttcatgatgcacacatatgtgacgc

SEQ ID NO: 108062 - DNA, 1390 bp, Oryza sativa
gtagagtatagagtccatatagaaatcaattaggaaatacctgaaattcagatttaaaataagaaatattagaagtagagtatagtctatatagaaatccaattagtaataatagaatttggaattaaaaataaggaatattagaagtagagtatagagtctatatataaatccaattaagaaaaaaatagaaatttggaattaaaaaataaggaatattagaagtagagtatagagtccatataggaatttaaaactaactaaaatttggaataaacataataaaattaaaagtagagtttagagtccgtataaaaatacattttacaaataactaaaattcaaaattaagaaaaacatttgaagaagagtttaaagtcaatataggaatacaatttagaagtaactgaaattcaaaattaaaaattagtttagagtccacatagaaatccaattagaaataataaaaattctgaaataaaaataaataatattggaagaagagcatagagtctatatagaaatacaatttacagaaaattcggaaattaaaaaagaaatattaaaaaacgagtcaatatatatatatatttacaaataactaaaatttgatattaaaaataattaaaaatacaatttacaaataactaaaattcgaaattaagaaaaatatgggaaaaagagtttaaagtcaatataggaatacaatttataagtaactgaaattcgaaattaaaaattagtttagagtccacatagaaatacaattagaaataataaaaattctgaaataaaaataaataatattggaagaagagcatagagtctatatagaaatacaatttacagaaaattcggaattaaaaaaatatattaaaaaatgagtcaatatatataatttacaaataactaaaatttgatattaaaaataattaataactaacacgtatataaaatacaatatggatattacatattagtagttttgtaaagttattgcaaaatttaaaattaagttgtcattttaatatatttgaataatataatgagaaaacatactattgtcagggttatggataccacatacctaatagtagttgactaaatctcggcaggacccaccacataccatgtcttatacggaaactgacttcagttatggagagagttccggataaggaaagacaacaaaagttttacatggaaacgacaaggactactcggattgtatccatattggtttccctatttctacttggacaatgggacacctatgggtataaatacaagccccctaggaggacagggggacacccaccatgacaggatcaacacagtcaccacgatcgacacagacgaccacctcaatcaacaaccaccacaatatacg

SEQ ID NO: 108063 - DNA, 1709 bp, Oryza sativa
tcagagtaatctatcgaaaagccgagccctcggatatgggcaagccgagcaatgtacccaagtcagtgttctaattcttaaaatttgctcaaacaactaaaatgtggaatggttggcctgggttggcttgggacgagctggaacccaggtcgggttgccagttcggtccaaatcatcgtaggccttgggttaaggcaggttcgtgagggttcacggccttgtttaataatactgtgtagctctaggatcgtctttacaaaatggctttgagcaactaagtgacttttaaatgctgtttactgcaaaactgaacccctgtattattatctccttgtactcccttgcattaatcatgcattctccggtgtgtcttgctgagtactgtggttgtactcattcttgctctatctttctccccccttcagtaagagaagctttggagaagatgtcttaggtggagtcctggcttataccccaattgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacaagctggtatctgagccatctcgactgtaggataagccaagtggatataacctaaggacctattttataaataaaactatttgtgaaagttccttttttctcctttcccctgtgctatctgcaaaaggtttactcccttcttccttcttcggatttcaactagtactagatggtcaggtcagtgaagaagaagacatcgtcagttgtttgtcgaaattccagaaggctgcaggatccgctagtaaagtgaaggaagcagtgaagatcttggagaacccgtcgcagaacctaagccaccctctagggtagtgtcgttagtcgtgtgtttcttgcttgtgtgtgtagcgcgtggtttgcatcggtgggttgtgatgtaaccatgctaggttgtttgcttaatcaacttgcagaataagcaaaacaaacaacacatcaacaagaagagttagttcctttaaggtcctatctctagttctggtctattctttcctagcttgtttcctctctcacctcaattcctgtaacagatgtttaacagagaaaaaggaaagaatgtcagcgggtatgtctccagtaactcaagttttcaactcaatccaccactggcctcaagagagttaaccagggcacacccttggtccattccaagcatgccgcttagttcacagctaccattggttggaagtcaagaccaaaatcagtatgtgtttgatcgagcatttgccacccaggtcaatgaacttccaatgccagaagaggatgtccccttttgtcacgattgtagagaacaaggacactatgccctgaattgtccatgggtatatgccagagaagccccttcatttggtttaacagggcagacatcgctaaaccagcctcctcgcaccaagtcaagcttgcagcctagtgtgcaaagtagagagcccaatggagagaatccattgaatcccgggaagtgctttcaacatagcctttcgtaccacgtggggtcacgtactaagcaagccaaaggcaagaa

SEQ ID NO: 108064 - DNA, 919 bp, Oryza sativa
ttgtaggagagcatcagacaatggattcatagggaagatacctcattattttggcagcatgactaatttagaagatatgtaagattaattatgtatattaacttgttaacatatcattcgctctatcctaatcagagacaaatgaaattttgcaacataaattttctgcatatatgattttcccattcgaatttgaacaatataatagcaaacatttccactcaacaaaattgcacacatctctatcacactaaatttatccagggggcatgttactacatcgagattttatgaaataaaaaaggaaaaaaaaactgttgatacacatacagcttactttaaccttactttaaataaatggtggcatgtattctttctaaagtatgagctttagtggtttcgaaggaaactcatttgaaggaccaattccagaaaatctgtctaatctgaccagattagaaaacttgtaagtatacttttttgtggtattgatctctcttgaagattgacaatgccaacgctgatgagttatttctgaaaaatacatgtgagcagacggattggagatatagtaagtggggcctcttcattggcatttatcagtaatctgacatctctgtaccaactgtatgtgatgtttttgcttcaaattaagtttacagtgtataggcaaatttgcaagttacaaaagttggatttcgttcttacacaggatattaagaaactgtaagatatcgggtgatctcagagcattagatttttccaagtttcgaacactaatatcgctgtaagtctcccaaccaccggctatggtgtcacatttcctcatgtagtgaaccatatgtactccaagtaatttatactatactgttgtggcacagggacctaagttttaacaatatcacagcccaacttcctt

SEQ ID NO: 108065 - DNA, 3305 bp, Oryza sativa
gagagagaggacgacggtgcgggcttgattccgacggggagagagagcggcgagcggcggaaacggaggagagaggctcggggagcgattatatagcgtcgggagggggagagagcggccggagaggaaggaaaccggcgcggcgatctcggctccattgatgcgccggcgaagattgcgggagtaaatccgagcgaatccgagggagagagagagggaaaagagggggaaaagagggagggaatcacggggagtgatttccccctctttatggcgcgcggggacggcgggatgcggcggattcggcggcggcggcggcgctagggcacgggcgggcggcgggcgcggcgcgaggtaggggatgacgggtgggccccacccgtcagcgagggtggcgggcgggcccgcccgtcagcggcgcgcgcgcggggaggaggccgatgggccgcgggggagaggagagagagggagggagttggaccgagccggcccaagagaggaaggggggggaaaaggacttcttttagggtttttctttttataaaacctttttaactttgtttatttcttctcaattattatttgtgctctgaaaattccactaaaatttatttacgcattttaggcttttaggaaatatacaaaaatcctccaagccttatttgacttttatatttgcacattttaattgttggaggctttcacacgaattttaattattctcggcacaatttcgaggatgtattttagagtcgttttgggacgcgacactcggtccttaactgaccagggacagcactagccttttccggacaccacccaagtaccctagccgccccggtcgaaaacagtgtttaattttgtttctcttttcacaattcatgttatccttgtcatggcaatgtggtgtccacgcctccacatgccgcatctcaactaccttccctaaggtagttgcccaagcatatagcacttgataaatatgagaatgcatgattctaattagcatgactaagcatttgttcaatatcgactaagtacacacgttagcacggtttgcaatggtcatatggataatcaatatcaaggcatggcatatttaacaagtagggcattcatattcacatatgtatagcatgcaattttatttaaatcaacataattttcgcaataggttcaacatgctcaaagattagtgatgacttgccttgatcgcagtcttgctgacccagatcttcgattaactcagcaactccttcggaatctaaatttacgtgcgaaagattgatttgaattcaattagaattcatattaaatcaccaaaaattcaacagtacaaaaataaatagcaaaagtggttccatcagaaagatcttgattttagatgaatttaggttcaagtttcattcaaatccgagctaaaatgaatgagttatgcttgtttaaagattcaaatttgaattaattcaaacaattgtgaaatggcactgtgcagccgagaggggcattattacagtggctgacatgtgggccatcccccaattttatttccggtttttttttattattattttttttaaaggaaatcctattgtgtcattgacaggtgggtccggccccctgttgactgaggtcaagccggccttttaatccccggtgcgacccgcatgtcattgagacatttacttaaaacctaatttaattagatttctaagcatccgggcctacatgtcataggttcataataatactattagtttggggattactgtgcgctaatgaaatggggtccacatgtcataacccctccctctctcgtgtcttctctctctcccgtcgtcttcaacctcgcgcgcgcggccgaacagaggagcagtgcgcggcggcgcgacggcccgagccggaacagctcggcgcacggcgaggcgagcggcggcgcatcaccggatgcccgccggtggcggcggcgaagcgcggcgaccgttcggcgcgcggcacgacggcgcgcgtcggcgccgagatcccaaactcggcggcggcacgatgaggaccaatgtgagcgcaaccggctacgattcaaccatctagggtccacatggagtatatataagcaaaatctagcctaggttgtattggaacgaagtccccccacggcgagctcaaccatggcgcagtggcggccggtgccggcacggttacggcggcgcacaccccaaatcgagggggccgggggtttctaggtgactaggcgggactactggcgcgagggcttaccacgaagtggcggaacggcgaagttcgacggcgagtggcgcggcgcggtcgaaatagggacggacggcggtcggcgacgggcgcaggtgttcgacgctcgacctccctcgcgtaacggctcccggctccctccaatagcagcaacggcaacgggcacacctcctcaacacaccccgccacccacactggccgagaagccctgtggcggcggcgcagccggcgcccaccaggtgttcgacacccggcgacggcgtgatcctgcccctcttcggtggagcaaaagttttagagagaggaagagttaatggaatgttgagttcggataagaacgagccaaggacaagcctatataagcgagagggagagcgattccttaatggataagggtgatcgatgacgcggctctgtttcgattcctcctaggttcgattcaatgccctgggccggcatgattgcctacgcggtagtatgcaggagaggtctcgctagctggagaaaggggcaccgcattacccagcggtcgcaaccgggggtgacaagatggagacgcgacggggacgtgatggcgacaagagcgacggcgatgggcagtggtaacggcttggatagggggcgccgggctatgccctagggtgacgcgggcacccgtggtggccattatcactccatcccgagggcgacgcgcgaggggacgggatgacgcgggcacccgtggcggcgcagcctttggcgcgggcttttggccgcttggtcggcggcgggcccacacagcttggcatgacgcggtgcggcgcacgggcacgactagtgtggcgcacgagtcggaaggcaggcgcgtggcacggcagcgattggcgagggtggcgccgggtgttcggttgggttaggcacagatcgaacacctggcgcgcaatgaacagtagcgccaggaaaagaaaaaggaagagaagagaaaggataagggaaaaaggaagagctaaattgcaaaatggcttggaattgagttgtaactctacatattttgaattcaa

SEQ ID NO: 108066 - DNA, 915 bp, Oryza sativa
ccggcgcgcgcgggcggctcaagccgacccggggtcatggcgtggtggcggcgcggcaccggcggcgaccggcggacggcggcggcgattcagcggacgccggtaaagcggctaagcggcggcgctaccacgggaaagagaggaggaagaaggaaggggaaatgtcctcaccgaaggggcctgaccagcgaggagagagacgacggcgaccggcgacgaggaccgacggagggagatcgacaagcggcggacggggtccgggacgacctaaggaacgaaaaggagaggattagagagggagagagggaccatagagggcgggaatgccggccgaaggcggtggccatggcggctcttacaggcgcacggcggggatggggctccggcggctaacctcgacggaggaggggtggacgaggtggacctcggccacgcaaacccaacggcggtgacggcgcggtgcggcggcgaccctagcggcggctagaggcggccggagtagcgggagaggtggcggcgggtgggtgcacggtgcgggagcgatggagagctcgggagagaccggcggaaaaaggaaaagtgaagaggaggatgcggggatggattttataggggcggagaggtcgggaactgtcacaccctgaagttctcctcctaagcataaaattgaatttataaatcaccctaagaaaataccggtgcaaatcaagagaaaaccttaataaattaatgcaaataataatcggaattggcatgtggaatttttcttgagttctacatgtcgaaataccctaacaagatttttagtggaattttcagagctctcgaaataattttaaccaattaaaattgagcacatgcaattttaaatcccagggaaaatcttttcctccttttctttttcttttccctcct

SEQ ID NO: 108067 - DNA, 723 bp, Oryza sativa
aagtaaaatttgagggctccttttagaccaaggagaatttaacaaaaattctccgggccacattcgaatttttcttgtacgtattttagtgtttgccaatttcttttcgaattttaattaattctattattccttttagagaatgatttttaattcgggatgaatttatcaggacgtgacaccgcgccattcctagccaccttccatggccaccggccgccaatcctgccgccgttccccgctcctcccgtggccggctcgttcccctccgctataaaatggaatccccttcctctgttctttcgttttagcctcctcccgtttctccccgtggccgcaccacctctccccgtcgccctcgtctctctcctgtgccgccggccacctccagccatctttgccgcctcgcccgtgtgccggtaggccattccatcgccatcctcggcgtcgtagccgcctcctcttccccggcgtgtcctccgtttcgcgcggagaccaccggatgtgcatccccgccagcgtccagtggcattgccgccactgcactgcctccagccgccccggttgccatgccagagcatcggccgatgtcgccaccacctccctcggctctgcgacgtcgtcctcatctctggcctcacctcctcctcacccgaagctcgccggagtggtctcctcgtcggcgtccagtaccttcccttctccgggtggctactgttcctc

SEQ ID NO: 108068 - DNA, 974 bp, Oryza sativa
tagcatgtgtctcacactctgcactcattgtgaagaagaccatccaccaggggagtgtctcacccgcaaggtcacatgttttctgtgcgaaggtacaaaccatgtgcccaaggattgccaactcagtgtgttgttgaccaagaccgtagaaatccaacgaacaaccctacgattgtctcatcagctagtcagctccaacagcaacatcgacgatatcatccacagcaccaatgctcctcctgctgcacctgactctgcagtaaatcatagcgataataccttcagcaccaaccattctctgcaccgacagcctcagcaaagaattgtcgtcgatggaagaagttgtgtctctccccgacctactccaggccaagcaaagggcaatcaacctcaggagggcgataccaagcagaaaaccgtcatccacttcaaacagcaatcagaaggaagcttctcctgtgaatgatagcaatacgcagtcctaccacatcatcacagaaccaatcaaggatgcagtcactagaacaatgcgagctatatctctccagaatcaaaatgagcagccacgtttgtgattttcagttcgctacttatcattgtgtaatcgggagtttgcagcaatcatgtaataaataaatacattcatgattataaacaatgagtttgttatgtttatggaagattcatgtggaggatgcaatgtaccgatgttaagcaccttccctttttgtttaaggccaggccttgcattcatgtaataagggagacatgtgtaataaaaacaagtgctatgaggattatttcggaagatgctgatatgggattatgtgtataattgtttactgacaagggagacctagggtctcatatccgtaagctcataatctatgataaatcaagtaacctagttgttgatagaaaagaaagtgaagcgacctgtgttagattaaaaagccaaagagacttttgtttgg

SEQ ID NO: 108069 - DNA, 552 bp, Oryza sativa
ttaaaatgaaagagaaaagaatgcgtaatagcctaaggccgttttggcccactgcttccaaccttgggaaggtgtatagtcggcaatataaggtttgttttttttttggttgggagagatatcgggactcgggaggtatatatgttttttccattatctgttaactaacccttaaataccaatgagagtcaaaaatcttcaatcctatttcctcttgtagaattagtttcggtacctcctccataagaaggtacagattgtatcttccaagttgtgaggagctatattggtattacccgaatttgtggccactttggctgatttttacaacattagagataaccacacaagcaatacatccctgttaaaagaaagaaagtaaatgggtagaataccttcaacaaggtgttgagcctggttttatccatgttaatgcgctcttcaagtctaaaccggacaaaatgttagttccaataataatagcaaaatttataaggataacagatgactggaaaggtaccttgcggggtaaagatgctgcgtgtaagttgg

SEQ ID NO: 108070 - DNA, 804 bp, Oryza sativa
aatatatatcaccagagatcgtcgggactgcaaatatttcttccaaatatatatagctggagttcgccgatggaatgcaaatatttcttgcaaatatatagtggcggagatcgctggcaattccgctgataatggcggcgagccggcataatatagcagtatcttatctcagacgccgccgacattatcgtgcgaaggcgtggaactatcgagcagttagatcaccgaatcgcgtgcaaaaaaaatgcatctatggaatctccgaacccccatttgaacctttttctttttcttttagtttccttttctcatcaggttggatcgaacgtgaggtgattttagacccagcagtgtgcaacgtccaaaatccactcggtgctatcaggccgtatccacagtggaaccgaccaggcctagaaattaggctagattaaaagcctataatttacgcggacacggaagttttggcccatgttaatgagtaaggtggaatcgaacccttttgaattatttttcttggttttgaaattaggagggtttggagattatggggctgtttggatgctatactaagtttgtcaccattcaccatacatttataccacacttgcctaagttgtggctttaaaaaagaaatccacactttgttgagttgatgacgtgtagggtcataatatatgagaaggagttttgccacaagtatggctatgaaccaaataatagactaactttgtcaaacttgcctaatataaagtgtggcaacctatggcaaactttgggagcaaaccaaacaacccctaaaac

SEQ ID NO: 108071 - DNA, 729 bp, Oryza sativa
gatcgacgccatcgacaacgaccggtgcccgtacaccgccgccgagctctccgacaagatccgcgagctccgggaggacagggtgaccgtcatcctccccgcgcaggctgtcatcaagacgatgatcgactcggtgcgagcagctacgcccgccgccggcggcgatggtggtactcgtcgtcgtggcgccgacgacaactccggtgccattggctgtggcccaactcaccagtcgcggacgatcagccggtagagtatgtaattaggatatatgtaacccatcgctgtcgatttaatttagccaggagtagtttcttttttcaattacatactctaccatgcaatgaagggtgtgtttagttcacaccaatatcgaaattttggttgaaattgaaatgatgtgatggaaagctgaaagtttacgtgtgtaagaaagttttgatgtgatgggaaagttggaagtttgaagaaaaagtttggaactaaacaagaccgaaatgtggcattgttgattattgatcgtgctcgatatatcaattaaacgtacggtccatgttggaatataaagtaaattgcccgtctttactcatcagcttaagcttttgggttaaactggtcgatgcatgcaacttaatatagtatcagagctaaatgtctcgagttcgaattctggctggcgtgcaattaaataaaaatttcagcatacttttattccacgctagagacttg

SEQ ID NO: 108072 - DNA, 793 bp, Oryza sativa
ggaggttggatgccccttggtccgccgctcgctcgatcagatacgcagggacactgaggcgctactagcggcggcggcggccctcgagcctcgaccatgataatggcggcggcggcggtgatgaaggcatcggcctccggcagcagcagaacgctgctcaacctcagccacgcttgtaaccaactactgaagggattgatttttttttgggttcagttttgatgtaaaatttactagcttagtcctatgtacttatgttgggacaaatagagggaaaaaagtatacaggcagtgcctgatgaattgatttacgattggacaaatagagtgaaaaaagtatacgaccatgaataatggcagcagcaggggcggcggcggcggcgacgaagccatcagtattcggctggagcagcacaatactactcaatttcagccacgcatataatcgatttctgaaggaattaaactaggttagtagtcctatgtaggaataattagagtgaataaaaagtatacaggcaatgcctgatattgtgatatgtatttgcaactggagaattgagcatatgtatatttcatttctaaactgtgtggatgatcagtcgcatcatttatcatacacacaataaccgtggaaactacagcaaattaatttcagaacacaaaattgttcaggcgcacattctacgtagttggaaatttcagcagtttgtaaacttcacggcataatggccaacacatagtaacaggaaaacaaaaaagttgacggctttctttttggcttctgagcatg

SEQ ID NO: 108073 - DNA, 739 bp, Oryza sativa
tatgggctctacatttaaatatgacctacaaaagctcataggcgactcttaacatttattaaatgatattttgttgcacgggatagagaaaaggaaagaagagtaatatatttttttggggggaatcttagcatttattaaatgatattttgttgcacgggatagagaaaaggaaagaagagtaatatatttttggggggaattaatgattaagaagttttgttgtctcaacatttttaaaaaatttaattgttgtctcaactattattataggagaatagtcactaagtgagtactccctatatcctataatacaaggtatagtcaaacttgacacggtctacaaaactaatttttatcttataatttctcatatataataaagtttgtagtaacaaaattataaccatatgaaaataaatttaaatgtcaattcaatgatataattttttagtaagtaaaattcaattcatattgtactaaatgttagtcaaaatattatgaagatgaaatcttgaaatgcatgggcgccttatattatgggatggatgaagtatttattaactaagagctcatatcagactatctcttagtcaacagctaggaaaaaaaatgaagtaacagctagcaaccgtaaagaagataactaaataacgaattctcactagatgtcagaaagaaaaaaacattctgatcgagccaccgaggtcggcggaccaaaagtccatcggatgatcgg

SEQ ID NO: 108074 - DNA, 1009 bp, Oryza sativa
ttcttgtgtcaccgtgagatcgctggggaaatgcaaatagttcttgcaaatgtatatcatcggagattgccgggaatgcaaatatatatcgccgggggaatgcaaatatttcttgcaaatatataacggcagagatcgtcggcaatgccgccgatgattgcggcgagccggcgtaatatagtagtatcttatctcagacgtcaccgacactatcgtgtaaagacatggaagtatcgagcagttagatacttagatcgtcggatctcatgcaaaaaaaagcatctgcggggttcggagataaaaactccgacccccgtttggacccctttttttcttttaatttcctttttctcatcaggttggatcggcagtgcggtgattttagtcccagtgtgcaacgtccaaaatccactcggtgctatcaggccgtatccatagtggaaccgaccaagcctagaaattgggctagattaaaagcccatagtttacacagacacgaaagttttggcccatgttgatgactaaggtggaatcgaaccctttcgaattatttttcttggttttcaaattaggagggttcggagattaaaacatcgatgctcttcagtatttttttctaccttttgccatcacggcctaataactttgggacaactttggttaatcggctcgaatattacggacgcaacaatcgttttaatatatcagcaggcttatacttgaaaaaaatcagcaattgcaagcacatacgtaattaagctcgtattaattggcttgtaatttacaaattttcccttgttttcctcaagttttgcccttttttgctgtcatcgtaatttacaagtattacgccttggcaatgcacatgaacgaatgaatgggtcgacgaattttacaagttattaattgatgattgttgtttgattaaattcaccacgcttctttgtagtggcgacaatagcggcgacggaggctgtgacgaccgacgacgcgacgatgatggtagtgt

SEQ ID NO: 108075 - DNA, 718 bp, Oryza sativa
aagatgcacacggcaatatggacttccatgatagttaagtaggtatagtttttttttttaaatcgaagccaggcaaagttggagttatattaaggaaaatagaaagtatttacaatatcaccaggaaaggtgaaagagacagaacaggggaaataaagaagaaaagcaacaaggaaaacctaaaagggagacctaagtggatattctcgtgatgttttttttgccccacacatactccaaagtttgatttcgtcttgtattttggcgagtagttgcggcatggttttctcttgattttgaaaaaccctcctgttccgttcacaccatacttcccataccaccaacatgtggattgatttgagtgctttggccttgcttttgcctccttctgatccaccattccaacagtacttcgttttcatcgtattggtgttctatatcgttgcagttcagtatactcaggaccctctcccagatatggcacacaaaagcgcaatctttaaaaagatgttgggcggtttcaaggttcctatagcatagttggcagaaatagttgtttggccattgtctgatttgtagcctatctattgtccaaactctattttgcaatagaagccatgtaaagtgtttgcatttggaaggtgcccattgcttccaaatcagttttacagctgcagagcttattctaccattaaactgcgctatgtagaatgacttt

SEQ ID NO: 108076 - DNA, 733 bp, Oryza sativa
ttcccccaataatccaagctccaaatgagacaatgtttctttggcataccaagttaggttgaaaaaaaactttgggatggatcccggtagtttgagaaacgtcagggttttctggctagctccataaagtggtggactagctagcttaggtttaaagcctcactcattctaattatttgatattaggtcttatatatagatttatagaatgaataatatgatgattatttaaaaaaatatataagatgatcaattgggaatgaagagattaagaccatttgatttgtatgaaaaatatagaaatttaggaggattttatttctatgaaaaaaaaatctacgaaaacatttgaaacaaaggatcaaatcatatcctatatttaaaattcctatctaatgggtaattctataggtactttggaggctctagattatctgtgagagcgctctaaccagtttcactctaaaatcgatttggttgggctttgactctatagaggtggaactagagttggagctttgtcaaacgaaaagtattagattagatggatagtatgaaaagtattagattagatggatagtattgtattatatccgatttgttatgttatggtaggataagattaattttcatctctatctctaaagttacttaaaatctaatccatatatatactgacattcaatacttacaacgtgtcagatgttcccagtaatcctttccctctactatc

SEQ ID NO: 108077 - DNA, 1114 bp, Oryza sativa
tatttagatttattaatatcaatatgaatgtgaaaatgctataatgacttatattgtgaaacgaaggaagtagtacggactatctatccagattcatatctaaagtagtgaaaaaactaaagtttttcatcatctcagtgcgccacatcatcaattaaatacagaccatccgatggaagaaagattcattttgaaccgttggatctggagtgtgtctgaggctcagtaaaattctattgtcgcttccatctcacgttcaagcaaagaagcacaggcttcaggaagcttcgcccatcttcctgtcactcccgtacttgccatatgtgatcagtgatcggttggttaagcagacaaggatgagtctcctctgatgtaaagtcagaggaactttgtcactgacatgtgggagtgacaaagtccctctgactttacgtcagaggagcgcgatccagcagacaaatagtctacttatatgatgtgtgttaatatgcatatgtaaaagtgtagcaagtcttcttttaagcatttttgttaagtactttctctgtcctatattaagattatttttagctcatcccatttatctcaaaataaattgatttttagtaataattatatcaaagtttataaaagtaaagaataattgcattggaagtagataaagtgataaatagttatattaggatgagataaagtagggatattttagtcttttgatgtttgtattggtatgtgtaggatgagtgaacaataaacttattttggaacatctgtattactaatatgcatttgtactaatttttttaccaggtatgcatatgtacaaattactccctttattttaaaatgtattgagatatatataaatataattaccttctcaaacaaactttccaatattatacttttaactactactgttttctttcgtttattatcaatacctacaaaatcgacgccatataaaaatagtcaaataaaaatctaacaatactactttattatataatgatataaaaatcaaataaaaagtcataacattaatcacatatccaaacctgtacttttaatccattcattagacaagtttttatgttttgatttttctcaaaat

SEQ ID NO: 108078 - DNA, 582 bp, Oryza sativa
ttcattcatgtattcctttcctttttatatgtatatctattgagttctttttccgtgttctgtcaggagttccaaacgaggtttaaggcccgtgaaaataaaatattccatgcgtacgttttcaaataatcggcagtgttcactttaaccaccgataacttttaaacggttaaaatatgatgctgaaattttttatgcttatattttaagctgcaatctactccatttcgatactatacattgacaatttttaatagtgtttatagtttctctaaaaaaaaggaagatggccggtccacgtctgaagatgaatacacattgttgattagtaattaatggagggaacacatgaataactctcctactacgtatgttctagtcaaagaacgcacgtgacaatttggttatcaacgtcaaatatttaaattggtggtggagctgatgacaacggtttttagagcacctgcaatagtaaagtaaggtgctctctatataaaacatgtacatctcagcaatagactcgattaatagtaaaccaccttaatagtatgtctatattggtatctatagctctctcatgca

SEQ ID NO: 108079 - DNA, 732 bp, Oryza sativa
tgtttgtccgttgtacagttggcgcgatctgacggttttccctttctgtcccagtaatgtttaattctttatataggatcttacctggggttcacttcttgtagagggagattcacttagttaatatgggccgcatcagtaaactaattgggatgggcatacgtgtgaaacatttcattcaggcagttaggtggctttctaaattgtatggagttctttttttctaccaactttagttaccaggttatccacgataaaactatgttatcctttctatatgtccttgtcctttctgtcattgaattgtgatattgccaaacttactagttgttgccattccttttctttttggaggtcgcttgcaaggtgattttatctgtacttctttagtttgagtcacccttccatgtcatcttgaatatttaacacaaagggttatcacattgttagtttttctaactggtaaatgtctcagcaccttcttagattatgattcctttatcaatcagtaaggtggcttgtatatagtggcagtggaaatgtgaattggatcgtctggattatcataaattgctatggagaatagaataaacaaatagaagtcatgatgccatgtcaatatgtttgttcatcattcgggtcatcaccttatgaacctgaagtctccttttcattgccttgtcatcagctaacactgcaatcaacatatttccctttgtacaatttattatg

SEQ ID NO: 108080 - DNA, 600 bp, Oryza sativa
tcccatgatccctctctgtattcagcggcatgtataaagcattttcagttgtttcataaccctcttcatcacggctgtgccgaatggcataaagaagaaggataagggctccaggtagcaaaagaacatctaaacaagctttaatggtgatctccttctctccaaccatgtagacaactgaacagcaacagatgaatgctgcacatatggtaagcaaaagcgaccagaatcgaacaaatgtagctccaagaaatcgaggtctgatgctaaaactgaaactagtaaggatcaaactgaatccttgagccaagatcacaagccaccaatgcggccggtaaatggaggtttcctgattgaagctaatccccaccatccacagtcctaggccaagattaagcaaacccaagcagccagtgaacactacagcagccaactgcagcagtgaattgaatgcgacaagctgccgcgcagatgctctactctttggaattttcatgagcaactgatgtacaagcgcaacagtgagcactgcaacaatggaaatcaccaccagatgattcacgcaagtcgaagaatccaatgtttccttcatagcacatg

SEQ ID NO: 108081 - DNA, 578 bp, Oryza sativa
atcactggactcacatgtcataggcaccatatgccatagaaaatgagtggtaaatttattatcattacatcttaaaagtgacaaatagttaaatgattagttatgagccgcatgtagtttaatcaatactaaaatgattttgtttagttgtttattaaaaattttataaattgtggaaagcgaaaatatagttcgcctgcacaagggcttattaagccatgaagacgctcacactaaaagacagttatgtgggtaatgtgaatttcattattatttgccctgagagcgtaaggacctgaagcacgcataacctagataactactctctcagattaaggtgtcaccaaactgtggattatggagtaggcttttccgtaccaacatcaaactaaggtcttgttcggcttggaaaaaaaatgagagagaataattttatatcacaataaatgttgaataaatcttcaactgaatagcaacttcctgtccatcaagttcacctgacgtcccttaactttacatcgaatctatttgaatagccatattttttttccttctcacttacatgtgggccccataac

SEQ ID NO: 108082 - DNA, 7272 bp, Oryza sativa
tgcagcccgccactcgcctctccaccgccgcccgcttcgctcgcctctccgctgccgctcgtctcgcccgcctcgtccgcgcctccgacgccttgtccgcctgtccgccgccgctcgcctcccctgccttgtccgcctgtccgccgcctcccgcctcttcgccgccgctcgcctcgcccgcctcgtacgcctgtccgccgccgcccgcctgcctctacgtcttgtcgatgccgtcgatctcgccacgggacgcgcggagtggtatgcggcgaggcacctcgtcgcccgcccccatgcgcgttgccgcgacgccgccgtccgccgcccgccccccgtgcgccatgcccgcagccgtcttcgctcacttcgccgcgacgccgccgtccgcccccgtgcgccggctttcgccgctcgccgccgctcctccgtgcctcccgccgcgccgatagagtgaagaagtgaagagtgagagagagaagagaggaagagtgagagagaggggaaagtgaagactatgacatgcgtgtcccacaattttttttattagaaaacgctgactgggatgccacgtagaccaaaaccaccgcggattggatcgagggggggtaattcgtccggtttgcatagtttggggtgaagaatgtctggttttgtggtttaggggggtaattcggatgaccgcgatagttcggggggggggggtaattcgtactttttccttgtaggtgtcggttaattaaaaaccgacacatactatatattataggtgccagtttatttttttaaaaaaccgatatctatgtgaatcaagccgagatggcatcggatgagccgaccggtggcccccacacgacgagacgagcatcggataaggttcgacgtcttgctctcatcgtctattcgtctcattccctctctctctctccctccctctctctctctcgttcgctctcttctccctcgtctcgctctcttctctctcctgcacgctgccggcggttggttggcggaggcggcagcggcgaccgcgtcctcccctcggccagatccgacgggaggggaggcggcggcatgaggggaggcggcggcaagtggcgtggctcacagccatcggcggcggcggcggcgacctcccctccgccagatccggcaacgacaaccatctcctttgcttgcggcaacgatggcggtgggctccccacgggcgacggtgagccccccaaccatctccttcgcttgcggctgcttgattctaatgtttgatgtgagatgaatgttgccaaattttgttgtgagatgaatattgcttgattcaaatgtttgattcagtgattcaaatgtgattcagtgatttattttgtgagatgaatgttgccaaattttctttcttgtggatgtgggaggagcgactgctcggctcgatgcgtcggctcaatcgagccggcttttttttattcctcgaacctaaaaggtgccggttctaaggatctggcacctttttgatttgcaatctgtgccgcctctcttgtgccggttgggaaaactggcatcgaagatggtttcccaaccggcactattccccttttctgtagtagtgatgtatccctaatcactaaaatcataaatgtttcaccacagacaacatagccaataaagtatgttttatttcgctatggtttgtgtaagtattactccctctgtcctaaattataaggcctatatttttcttacgcggtcttcaatgacatactatgacaagtattttattttatgttatgttctcaataaatatgaaattagcatcataagaaattacttcaaaatattaatctagtgatataacatgcataatacttagtttagatatatagttagtatgattattagtaaaaaaaaatacaagttcaatttttgttagaaggggaggtcttataatttgggacggagagagtatatattgtgtgtttttgtttgcgtaatcgaaataaaaggttcaccacgttaccgtcacaatttctgttgtactactcaccactgccactgcccatgttcgttaactgtaaagatcaatagaatggaggagattacaatatcattcacattcgctttctactactctgttcgtttcaaaatggaggagtttcagctggacgacacatatactaatattacaaatatatctgtttagattgatagtaatagaatatatcctattcaactaaaactttttatattttagaacgaatggagtaacattaaacactaatatcctgtttggagaactagcacaaagttattttgagagctattttttaacataaggaaatagccctcaaataaaatagtaggcctatattgtttagattcaaaggttattttgagagttatttgatatttaatacacgaaaaagcctctcaatgctgctgtgggaggggcaccgcccgcaacttctcccaattaacctacgcacgcacgcacgcgcgcgggaacccacccacccctccagtctcagccaagccggccccacaccccggcaatccgacgtgggccaggtcaatcggatgacgctggctaggtggagcggtggtacccaaaaaaaaaaaggaaacagagaagaagaagaagaaaaagagaagacagcctcggtggacgtgcgtgatatgcgagtgcgcttctcactcgcaagcgttctcgcgtggcgcccgcgtccccgctgccgcagccagccgccactggtgtcgggcgcgaggcgccctggcggtgggacccacacacggtggtggtggtggcccccactggacagtgacagtgacctggctctctcgctcgatgcgacgcgacacgacggtggcgatgcggaagctttttttttttttttcactttttcaccgccccacgtcgccgcacgaggtggtcggtctcggccggggactgagcaagcatctggttgttttattatgggggcgtttttgcctgtattttttctttttttacagtgatccgacgacggcgacgcggtggcggaattcggcgggatcgggtttggacgtttgctcgccggagtttattcgcgcggcggcggtgggtggttaacgtcccggattcgtacgtgtcggggcttacgtatatagatgatcgaacatctactaagctatatactactatggtactactacttcaacggtcttaagaaaaggttgtggatcttctgtcatgcacgatcaacgctgatagagaaacaaattaatagtatagcacactactagatctaaattatctattgtcaatataatagccagttcacacaatacttgcttactatactattaatacctggtctcacctgtcatacacacattatgtatgagagtccgtgctatagctggctacagatctgtagtccgctgctcttctctcttcctttatctctttaaaatatgtttatagctggcttatagcctgctattatacctgttctaataagatacaccctccgtaaaaataaaaactgttcctatctacgaagatacgaagattcatggctaagttgaaacttttttttgacggaagcccccatcgtttcgtttattcgtggaataagctaaaggacacatttgtaaacgaaaaataatttgtgaataaaacttttatgttcatgttcttagtgatctaaaagcaaaggccgaaaaaattcgataaaagaaatctcaaaatcagctctaaatttaaggttgaaaatttaaaatatggctgataagcataagcataaacgaaaagacgagattcaaagtatactccataaaaaaaagaaacatgaagtccgatattctgtatgatcttcaatatgtgtgaaaaattcattctgcggtagtgtacctgtagaattagtataaggccctgtttagtacacaccaaattttctctaaacttctaactttccatcacatcacatctaaaacttttctactcacataaactttcaactttttttttctagactactccctccgtccaaaaaaaaacctaatcctgggtttgaatcaagattgagttttttgggacggaggaagtaccaactttccctaaacttctctccaatttcagaaactaaacacagcctaagtgtacctgtagagtagtgcccatttcaattctagattgatttattttgggatgtaatgagtatattacattatattacactataaacaaaaggatatgcaaattgtcttttcttttaaatgccaaaataaaaaaagatcgggattggttagtgcatcaacatcttcacgtagcattcgtttcctatttagtgccaccgaattttggcacttttgcatggacaacttcattttccaagcaattatctctacacctttcttctccaactaatgtatatagtattaaaaaaaataatatcttcatatatatatatatatatatatatatatatatatatacatcagaaaaatcacaattataccatgatatcagtggagctttgtagatataaagcttttgatatgatattctacacaactctaccaacaaggagtcaccaaaataccaatttgtagatataaagcttttgatatgatattctacacaactctaccaacaaggagtcaccaaaataccaaagcatatctcttccggccattgacaatgaatattgattaggttccatctccttctgatgtgacctaatttggtcctacctccaatatttgttttcatgtgcccttgctagggtgaccatcctactttggttcaatgttggccgacccaccaaggtcagatgtgaccaagcattgcgtgtgcctaggtcacatacctgtatgtttattagtaatatttttttaggctttagaacgtccaagttttatgtacgtatatctcaatgtactgattaatgtagtgccataacaaacacattgttgagtgtttgccattttcttctatttttgttattgctagttgatttgtaacatactaccaatttagagtgacatataactataatagtataatgttattaaaagaaacacttctagttcagctcgtttgtgcggaaaaagggatattttgggtaaaacaagagaacatggaatcatgttaggcatagaaaaatttaggacgtactactttagaacaccgaagaactctatttcttctaatatattgacgtgcaatttttttgcgtattaaaaaaaaactttagaacacaaaagaatggtttttacgttctgcgaggatcaaactgattcatgtaaaatttacactccagattgccttgatatgcaaagtgcttatacaatttaggattattgtcacggattatgtgcaccatatcttgaaaaatatatttatctgaaaaaactttcttctactgcattgattaaattacttgttttgaactatttgataagtttatttttataatatttattctatctctataattaagttgaaattcgtggcaataatcaagtgaaaaatttgtttcatggccttaccttaccttacagtgtacagtgctatcacaatttttttaagaagggtctccaatcttgagaaccactgactttgggtgcgaaatttgtctgcatccactggctgtgccaactgccaagtaagcctcaatgtcttaaatgtgcacacgttttctatagtcaggttgctgcacattttggtcatcagtcatcacatcttcatgtacgtaatgcatactacaaaatagatttatttagtagtgcccctttctagtgctcatgatgattagcagatgaaggtagtatccggcctcacctacatctggggcagaacagtgtaaagcaatcttaaattaagtactccgacttaatttaatgaacatcaactaatcatcaaagaatgaggacaaaggtgtttgcctcaaagcatggcccaaaaaagttctccctttgaataaaacagtggaaaacgatgcaaaatccaaatggcatatattcttggttaattcaaatgcatgggtgagatgccttagttctcaaacaatataaagatactgacacacttggttacaaatacattaaagagggtatttctattcagagatgtcatgactttgtatttgcccatactccatagcgaggcttctattctttgggctgtgtgcatactaagttggtgcagaagttatttcattacttgatgaaatatccattatattaaaaataggattatcatttttaatttcatgtttttttttgaaagtagccctgagatttgatagagatgttctttcaaaccactgcttgttaacagttggatctgtcaatgtttttctcaaggacacatcataagatacctacaaacaaccgatgaaggatacatcaactgacttagaggcatcacccctttggaatatatggcactcttgattcgcatttttttcatgtcccttagctaatggaattgagtgcagtgtatcaggcggatgagaaatgcgttgatctgttcttgcacagctggggtgaacatttttctaactgcgatctgatagtagtcttctagaggatcaagcccaggtgaacaatgttttatgatgtttgattgcgacaatatttgtaaaaaataattcagagcaatacaaatggacaaaaagaaaactattacttaatgggaactgtccatgcatctacctaatttcctgcaccatctaactaatttaagtggctatttccactatttaattaggcccctttagaacacacaggaaaagtaaaagaaaggaataggaacaatacattattttgatagaaatatatatgaaaaaaaagaattacataccattttgaaacctgcaggagaaacatagaaatttaatgagagatagactcaaagaaattttttctaaaaaattatagctcttgttaattttcctctgaaatctatacgcattgagcgtaaggggtttcatatgatttggaaagctcaataatcctttgtttcaaagtgataaataggaaaattttctataggattagaatgctacaaaatttttgcataaattctttgtttcaaaggaggccttaacttcaacggcctaaatacatttttcactatttccacagagattttaattcctacaagaacaataaaagggaagaaataaagaacatcatattttcttttgaggaatacgcaaaaggtattcgtatcattgcatcaagacttattctgctactatatttatttatttagcatagcagttggcaatgcaggtgcag

SEQ ID NO: 108083 - DNA, 597 bp, Oryza sativa
tccatatcagtacattcatttatacataaaagatatagtaatgaaaatcttatagtatgatattattctacataagatgtttcattctatttaagcatgtcgatgcttggcagaggaacaaaactaatatttcgtcctacttttgaaatggagaaaggtagtataaaaattgcgatgctttatgtttatcttgttagtgtgataataggcggttgtttcacctatattaatgaggtaaaatgatattgacttaatttgttaagctcaatgcgttaaattctatgataataatggaaattgagtgaaacatggcgtacaagcatgtctagtttatattggtgtgtagaaaatatagattggatgaacattagcgacggtttcgtgttaattaattagcgcaacaatgcgcgagagtacatatatatgcgtatagaaacagatcacccgggatcctaaatacaaggaataacaacttatctctaatctaccgggaatccataaccatatgcataagataagattacaattagttgtagtttctaacactccccctcaatctaaacttcggatgttgagattgtgcttgaactcttcaaa

SEQ ID NO: 108084 - DNA, 698 bp, Oryza sativa
ctgataatttccacattcaaggaaaataattaaaatgatccaactttaattagtatcaactgaatgtttgtagacttggagttctttggaacatctgttactgtagaacattgcataatgtaattcatcattcatttatcctttttgattttttcaggagttttcaattgttcatcatttatcttttctatactaatattttccttttgagtttcagtttaaaagttttttttcttccgaattctacttatttagaaattttctatctttgtttttccttttttcttcaattatagatttttcccttctgttgttttttcccataaaatggtttttctttgtcgagtttggtttcaaaaggcagggagagtggtgcaccgatgccgcaacgatgagcttatttggtttgtaaccatggaaaaatatttgcaatatgggtaagtttatgtcaatgccaacattttgacaatatttatgtggtattggtaagtattgttagcaaatcttaattgcatccatgccattgtaactttcacaattttgatatataccattactgtccggggattcctaacgctggcccatcgttaacatgtgattagcactaatgatgattttgaagtcaaaatttgaaatctttcaactcaaactttaaaaaatttcaactggaaatttaaatttgcaagataaattttgaa

SEQ ID NO: 108085 - DNA, 678 bp, Oryza sativa
ccaaatgggagcttcttgattatcttcactggagaggcgggtggctggaattcaatacctccggttgggaagattggcaacgggctgagacgaaacgatcgtgactcggagtcgtcatcatcggtacggaatgaacacaactcggagctcttcgcggacacaaaagtctccatgtcactctgaccaccacctctgttgtcaatgacagcattgctattggcagcttcagaacgtgatctgaagaacaccttagagatgtggtgtttctgccccagcgatgacagaagcttctttatcctcctcttgatctccttcctcgatgcacaaacttatagtccaaatgtttagatgttttaccagtgaaagtcaatacttcattctaaaatcaaaagcatgacagaaaacccaccatatacactggcctgctccttcagtatggaagatcgttgtcctccacccgcctgcagcgcagccccctcacatccttcctccaaaatacatcttcatcgtctccatcaccatcaccgtcaccatagtcgctgctctccttaccttcccttacatgtccatccctgcctcgtcgctcgccgcctccaaatcttcccttgagagcacgtaacactttcttaatgatcatcttcgactttgacttatcaaccaacctatgcatcaactttt

SEQ ID NO: 108086 - DNA, 1066 bp, Oryza sativa
tttcaaacatttgtattcaggtaaatatcggttttgtggtaatatatgagtaaattggacatttcaaccagcctaatgaaagatggctaacagttttgtaatggcaatggtacaaaaggaagaaaaaacaagtttctcgatggtatatagaagaatggggtgttcatctatgtatatcattggcttctttctctcataaaatttggcaaattttaaaagggagtatgattcactgttaaaaaggaatacaaagtatggtaaagtaaaggaagaacaagcaagagaaaccagcagatactatttttttaatagcaatgacaatttaaataagtgatacaaaataaaatgttacaataaatgtcaaaatatcaagtacaatgtccatagcaattctaatataaatcaaaaatattgttgttgtaaaatttgtatatactataatctacagcgtcactattagttaagtcgagctgccttctaaaatagaacattaactagtttaaattcagctatatctggataaagtgttcgatatctcattgctacattgtcttgctactaccaacctttacaagaaatacgcatgagaaatataactaatatatacagtttaagaacaaatatgttgaccatttttttcctacatactggacaatgttggagaaatctacacttgaactacatgctagtcagtttaaacctactgatttactacaaatcacaggctcattgtgcgtctccctaattatgcgtatgaagtagaatttcagctatcccagatcttacagagaaactcattagtggagcgtgcagaatcgagttactggaagtacgagaaatgtgcatactggaaacaaaacgccaataaacctctgaaatcgctcgctccaatcaattaatttcctaccaggacaacaatgccaatggaacactgatcgcgttgcggctaagctatttcacccagcggaatgacaatgacgagcagcgagatctcgcgccgaggagcaggagcgacgggcaacaagcggttagatgaaaagctcacctcgccgtgggcaccgagcgg

SEQ ID NO: 108087 - DNA, 938 bp, Oryza sativa
gtccttatattttagggcggaggagtatatctcaaatgtgtgtaacagttagcatccgactaattgctaattcatttcctctgtttacctcaaagtatggctaatccatgtttttagcaataatcacattacttgatgtggtacagagttttttttggcaattattgataacaaaaaataatcatcaatgagaaatcattctgctaaactattacatttcaaacatcaccatttttagggctgtgctttgttaagatatacttcattggccaatatttcccaatctttttatactatttcagggctcagccgttttattgccaaaattaatattagcctttgttgtttatcttgtcattcattcttgtatatctcaccatttattgtttccatatcaaacaagaactcaaacatatctgccaagataatatctattaatagcctaaaaaaattttctatttcccttggctttatcctcatcgtttcctccacctacatgtacatctcaccatattctccccaatttccacaaaacaatttagagagaaaaatacagatcagaagaatgcttcaagttcaaggctctcttcgtgtccacactttctcctctgctgccatcgtccatgccgttgaaacctctgatgaagattctgatccatcccacttctgcgccgtgccgcagaacggtaagaaggcatcgaggaaggagatcaagaggaggataaagaagcttctgtcatcgctggggcagaaacaccacatctctaaggtgttcttcagatcacgttctgaagctgccaatagcaatgctgtcattgacaacagaggtggtggtcagagtgacatggagacttttgtgtccgcgaagagctccgagttgtgttcattccgtaccgatgatgacgactccgagtcacgatcgtttcgtctaagcccgt

SEQ ID NO: 108088 - DNA, 580 bp, Oryza sativa
cgatgcttcaccgcactgagcaaggaatcggctgatgtgctcataagtcgacacgccctcttgtcccgaaaacttagagaaatctggaactttaaaccgattggggagagggactctttcaaaccactcaggataaggctgccgatacaagtttccattctcttttagtttaagcccaaattgttctctcattacatcagcaatcacatcggcccacggtcgttgctgagctgctccttgtggctgttgttgcataggctcgaactgaccatattgagatgcgaactggggctgagccaatccccctaattaatatggggcttgcggggaaggaggctgatattgatagctcaagttactgtcacaccctaaaaatcctaaatatataaattgttgtttaattggaattattagaatttattttaaaagtctagaagagaagatctaatttttaattaataaattccaatataaaatggggccagataaaatttcattaaatactttgcttaattctataattcctagatttttctgggatttatttgagctaaggaagtatttttaataaatgaaattg

SEQ ID NO: 108089 - DNA, 565 bp, Oryza sativa
cttaattatacttctcagagtgcttcccaatttttttttgtatgcatatctaagctgcatttactcatgtctattgagtctagcgctctgctggcggagtacgcaagtgctgttcttggagttctctcagctgctttatatggaaggaaagttaacatatggaagaaggtaaattgttggtattctatgagaaactagtattgtacatttgtttttgctatttttatttactgaaatttatcacttattaggaactaagaactgatttgtacaaaaatgcactttggcattgagtatcgtctaagcactggtatgataaaccctttttgtgataaaatatatggagatgactgagtttgtatgtaagcacaagttctagcactttgttatatgccacttggccattaagggtgcatttgcctggctgaaggagcgagtctgtccctactgatgcaaaaatgaggcacatgcgtagctcagcagaaatgattctcaattaagtttcattgaaacctgaccagggcgagtgtgcatttgcccacatgggactgcaatgcatgagctt

SEQ ID NO: 108090 - DNA, 520 bp, Oryza sativa
tacagatttatggtgggtgtgggaagaacggatggacgaaacttcctcttcttaaatggctgagaacaaattaaaagcaatgtgattatgcatattgtgttccactttcaccattgtatgataatgttttggtaggatgttagacataatcaggggcagagatacagtgtattcatcgtggtcatatgacctcgatgacctctagagaaatctattgataaattgctaagccaatgaagataaaactatgtattaagtgagattggcatatgatgacaccaatgataccgatgaactggatctgtccttgcacttaactattaccaatcgtagcaacttagttacagagatcacttcaataaaaaaaatgtaggaagaagactacttacaatctaataaaattaagaacacaaataactaccacgattaatataaatcgtttagagtgactgaatactcaacaatgaaagctgggaaatttaactatttgccactattaggttcggtaattattcaaatg

SEQ ID NO: 108091 - DNA, 539 bp, Oryza sativa
ctgcagcccctcaagaagagtttaaacgccgagcatattgtaaatggcatgattctcattctcattctactaatgattgcaatgtgtttcgacgacaggttcaatcggccatagatgaaggacgattgaagttcactgatggctccaagatgaagcttgatcatgatcctttttcggtgaatacaattaatttcaatgataaaaaggtgttaattcggccggagcaagcagaatctactaaaggaaaaggagtggtcattggcgagccaaggcctaagatgatagtgacaaagaaaccggaagttagtgtttggaaggagaataagagtggcgcttcaacttctaaagcccctaggaagaccaaagtgacttttggtatgcttttggagaagtatgagaagcaaggtggtgagagggttcacaacaaggggaaaagaccaagatcacctcctagggagcgatttggtcattcaccaagacggtcgcattcacctccatatcattatccacaagacatgtcatggggttcttatcgaatg

SEQ ID NO: 108092 - DNA, 630 bp, Oryza sativa
cctctctagtctctcccctatatataaggggaagtgaatgactgaatgtacaagggggacaccttacattgtacagggctatttttatgagttctgtcactactgttggaatgattgccaccaatcttttcaggacaatgaagaaaaaaagggaaatagtgtatatacttctaatattatcttttttttatttgggtttttctagaagtaaactttgcatgcatcttaggcattcctagaacccagagatcaaatcgtatgagatcttgtcatgcaatgcactttgacaaaaccaaccatgtatgtgccattgccagccaatgcatgaacatagtttccagtgttagatatgcatatcttaaggtgaagcctccatagtggtccttggtttgcgactttcatgagtacattcaaccaatcacttctctgttttctggaaggaggggcgaatcagctagctagtctatcaatggtatatactgataatgctttcatacccattaattctacagaacatgttacgatgttaatcataattttttttttctatttgggcaacaatagcatggatctaagtatgcatctctacgaacactgttttgtaatgactaatgaagagagcaagagaca

SEQ ID NO: 108093 - DNA, 1029 bp, Oryza sativa
tacaggtaccaggaagtaaaatattttctaatataaaatttagtacctcctggcattaggtatatggagatataccaaaatttttaatgtaaaattttaagtacatttttttcatgtactagctacctccgtcccaaaagaaaaactcacttcaaggcttaaatctggatatatgcaaaccctaaagtgtttttttaagcaaaattcatgcgaaattcctgggaaccattgagccacttctgagcacacggcgacacatgtaggttatatacagtggtgacaaatgattagagcactctactcggttgaactttctatactcatcatcatccaagttatccatggatggataaagcgcacaaaaagcactacactacaagaggccaacgagttgcatgaagaagatatagatatctaattatctatcagcatcaccaatgattaatcatgcaagagaccatatacagttgcaccgtctagtcacgatcgattagtatcatagtacgtacacctccattcctaatataagtatctataacttatttctacaattttaaaattgaagatatttttgcctgtagtttggtacgtcattcgtgtataaattggtttttaagtttgttcacttttaaaaatacatattcgtatttgagtcgggttataagttcgttcgtttttagaaatacagaaggagttgcataagaaatttatttaaaaaaactcacatactaacttaagatgattggacttctaattgtagctcatgattttctagacaaatatatatccaaacaaattctcatagtgaatttcatcttaactaaaccgtataacaataataggattaaaatagtctttacccgttgcaatgcacgggttttttttatagcttagtaaaacataaaagtataaagaagcaatatctctcggtcatctcattggttaaatctcaaattttaaattgtttagatttcggtcttatgtacttgattgactgaaaagatgtttagattgtgtgcactggaatca

SEQ ID NO: 108094 - DNA, 536 bp, Oryza sativa
ccctcttccctcatcgccgccgccgtcctccctgatcagcaccgtcgtcttcctgccccatcgcagtcgtcgtcttcctccctcgtcgtctccaccgtctcccccccccaccatcaccacggtccgcccgtcgcaggctgcccccatgcactcgccgcccatcgccgccgagcatgagcgccatccggctcaacctccccctctctttcctcttcctctctatccacagccataggtattttggtcttaaaatcccccaaagtggcaaagtatcctaaaagtaacctattaagtggcattttatcctttacaatacatgtattgggtggcatttcgtcgaaaccccccaatggagtggcatatcgtcctttttctcgtgtagtatgccctatctgctgagaaaataatggattatctgtttttttatactagctatgtgaggatataaacaaataaattaactactataaaatttttaaaaaaaagtttttgcaaaaatcttatatagataaaaacttccgtacgttaaacttata

SEQ ID NO: 108095 - DNA, 750 bp, Oryza sativa
taagatccattgctgaaggataagattcttcatattcaaagggatataaaaattgttggtgattcttgtttagatttgtcaacaatttttgagcttcaggaataatagaaagcatgtgtgtggaaagaagattcagttttatgcactgtttcgttgagaccagtgtaactattttttgttcaaaagaagcctagatacaagctcgcggaggtataaattgttttaatcctccaataaatttataaaaatataaaattaatctttaggacaaatatagtacactaatgtataatatccttgcttggttatttgtattttaagatagtttaacatttattttgccaaagtatatattttataattatataatttgcattactaaatatcgccgtagcgttagcacgtgcatattactagtatatagtaatagtagtacgcgtttactagctagaacggattaatttcctatcctaatactacgggaagaaatacactaataggatacggagtaatacggaaagaaataagaaaagtctaattttaaccgtgccatatttagagctcgttcactttgctaccattttcaaccttactaagttttggcattgccaaattttggtaattggcaagatttcttatgtatttactaaaatttagcaacaaactaaatatagctacttttttttaataactttgtcaaaaaaaatgtaaggttgaaaatgatagcaaagtgaacaagcccttatatat

SEQ ID NO: 108096 - DNA, 514 bp, Oryza sativa
acatcgttctaatttcaaccaaatttttaattttagcgtgaactaaacaagccctcatgctagcagccgtaagaaaatttttacaggagaatacaaaggctgtgtttagttcagcgcaaagtttggattttggttaaaattgaaaatgatgtgactgaaaagttgtgtttatatgacaggttgatgtgatgaaaggattgaagtttagatctaaactttggatctaaacacaaagcaaagttcggaggccgaatgcatgcatgttgcatgacatggtagcctggtcgagtattttggaggcgtgctactctagcggtggccatgagtgagttcaattctgctttttcatcttttacaaaaaagcaagtactgtagcagatcggtcggtgcttaagagcaatattgtcagagccatgtggtaccaagtgtgtacttggccctctctaaccgatgaaattatcgaggagagaaagctatactaggagcaggtcatgaaggattacgtctccgatgt

SEQ ID NO: 108097 - DNA, 562 bp, Oryza sativa
aatttcaaatcttatcatttccatgtttctaattttatattttttattaaaagtcacaccagttgctatctgttacttctgttatatccttctttatttgcttgtccgatctggcactgtttctattcattctatttggagcctttcaaaattagatcttatggtttttagagtttattgtcccgttgggtttcgattttataatttttagaagtcccgtcaaacgctaccattatactcctatacggctcatccactacctcttcttttttattgtcgttgttattttcaaaatagaacataattatcgcttgggttcattttttactttctaagaagttccgccaaaacgtcagcagctttgtcaatgtgctcctctatggctcgcccgttgccttccttctttattgtcattgagattttaaaatcaaacatgaatatcattgaagtttttttttactttttagaagaccgaacttttaaagttggaccttatagtttttataatttattgtctcgttagaattcattttttataattttttgaaatcacgtcaaacga

SEQ ID NO: 108098 - DNA, 1360 bp, Oryza sativa
acgagtacatgttcatttgaacaacgattgatcaaaccattatttaaaaaaaccaaaaacaaatcatgaataaaacttttatatttatgttactagcggtttcaaagctaatgctagaaagtggactagcataaatttaattttggttactactgataagctaacaaacggacaaaggcagtggcgttcctagagtatactatctggggttctaggcaaggtttaatttctcgttttcggtgtttctatcgggcggtgccgatatagcgaaatttcagaaatttcaatccgaaatttctaaaatttgaatattaccaaaattcatgaaaaaataaaaaaattgaaaattttgatcaaaataatattgtatcggaggggtcagagaaatttcagtccgaaatgtcaaaccctggtcctaggatctcggctagaattttaatatttagttgttttaacctatatgaactatattattaggtaattaaaaattattgtattatatgtgttatgatatgtatagaatcgccggtaaattttgtcctaggttggccactagacaaaggctaagaactaccaaaataatttacatcagagatatggtagtacagtaaaatcattcaaatatgacatttctttgtaatatttaaaggtcgatacataaaacctctagtcaagagtagagcagctagggctgaagccctattcctaactcaaaataaaaataaatattgcaactgcactatagaattttaaaacttaaaacataaaaaataaaattatgtaaattatactaattgagcttttgtcttggaaacgtaacgtacgttctggttccgtcactgcgtgagcaaattaaatacagtgaatgcaataaggaggacaaaaaaaacgtgtccgtggcaacgtcacgtgtgtagagcaaaacatacatacatgggcgttcttttccctttttcccgtaatcccgtgtagcacccgtgcacggctgcatcatcatgcatgcatatccggtggccgggtttgccatataatgccccctaccctgcgcgcacgccgtgtggcccacggctcgacggatatcgcggcctcgatcggcagggccacgcgagcgcaacggtggcgcgaggagggcggtgtacgtcctcctcctcgcctcccgctccgtcgtcccctgcgtggtagcgcgaagcggacggataacgatcggtaaccgcgcgcgcgagcgccccgcgggcggccatgtgacccggccgacgacgtcttacgatcgatcgagtgagtagtagcgcgcgtgcgcgtgtgtgctgtacgcaaatactatcgctgaacggaacgaacgatagacaagaaaatctgagat

SEQ ID NO: 108099 - DNA, 505 bp, Oryza sativa
aagttcttttttttaaccaaatgaataaagttcagactggtgttcaaacccgccgtagttttcctcaaaaaaagtttgtcataaaaatatcaaatcacatcttcatgtttagtgcacaggggcggagctaaacgaaatggagggggtgccacttgtttaatttactctactttatatcgagtttaagttgatacgggtgcctaaatttatattgaggatggtgcacacatggtgaaaataggtaaagtttagttacatatttttttcaccgggttcctggaacccctaatgactttagctccacccctgttactacctgaaatggagggagtaattaataaaacatatgcatcaactggaggatatatttttttctattattgttaatcccttgtagagaacgcatgacttttggtatgcatggtaacttgttaagacgaacgtaacacacttaaaaaaaaggtgctttaacggtttatattgtccactactacaaaaaccatat

SEQ ID NO: 108100 - DNA, 572 bp, Oryza sativa
tattccaacgatgcacatagatgatccatatatataccacatatatatatgattaattagattatcaccaagatcagattcgtctttcgatgcttccatggtactatttgattcagaaatagcaatttgcaatacaaaatgtgtggctacgctggctgtacatgttagcctacatacgagaatctgaaagtacatacatgatcagaacataaacattaattactactgctgctaattaatttggttggacttagcagtactgaattttcacacctgtggtactgtgtgagaatagacccagagatcatctgttgtaatgtggatgaacaatatagctacaacctacaaggaaaataagtttacaacagtgtttgaatgcgctttgctgtagcaaattcagtgcagcaacaatgaccaattctaaggcacatcgaaaatattgaggccttcaatattagatctatactaacattcaatctcaatctttacagctaacaaagtgaaattaatgaacattgatcactaactaagtattaaccaaacctagcaactctcgtgagtctgcaggatga

SEQ ID NO: 108101 - DNA, 822 bp, Oryza sativa
ctcaggtttgacccctgcattgcacagacaggctagctctcaacgctggcggctcgcacctcacctcttcacacattagcttttcccaaatccaagctgttctaggctagctagctctggctacttcttctcttcccatgaaattattaacgactttgacacatgcatgtgcgtactatatacctctaattaaacaattcataacattgtatatatatctgctcacatatatatggagattcgatcatgataacagtcgttttccagggacctattttaaactctccggagcatctcgattgttaaatgtgatttcaaatagttaattaataaaaaaatctggaaaattaggtaatgtgggttatagtgacatataagtatgcaaggttaaatacgatctatacgccttttttttatccaaattgcttgtgtttagtttgaatttgacctggcatgtttttacctgttagaggcacatgtgacaatatataatatgcctagtctagctagtttttttttaaaaaaaaatttacataaatgtttagagagactatatatacaaaaaaaacaagggcatatggacttgagggtttaaaatccacttcctttaccaccttttgggctcaaatatgctatgattatcgagcgtgcaccagtgaaaccaagtgtcgatggcgattctgtgtttgccttcatagctttgtttgcgcgcaattttttcagacattgactgtgcttatggtgggacgatgcacacaggactggacaaggagacatgcaaagtctttgacacataagtaattttggtgtcttggaatcttg

SEQ ID NO: 108102 - DNA, 554 bp, Oryza sativa
atcacccatcacaagttgcagttattgagccgctgagggagttaaaaaatagtgttaaccctgtcgcaaaacaaaaaattgaaagttgttatctcttggtgggcactgcagagcattagcagctgctttgtctgcttctaccaaccggaatctccaacccagagatgcagagcacgctccctggccctatccactacaccatcaccttttgttcagccaacaaatcaataattaactaacaattaacaacagtaattaaagagacgtgtagtcttcagagaaacaatattcagagacataaaattgttcacatgatcatttttagtcccggttctttttaagtaccagaactattgtggttttgggttgaccgaacaaagatagttttccagtagtgtgatgtagttcatttgaagaaataatttaggaacttcagagagactgaatttgtggatgtgcacaggtaggtataggaaggcgttagttcgcatggcagtagttagtactcgattacacgatcggagatacgttagttgtgggcatgaatcggatcg

SEQ ID NO: 108103 - DNA, 857 bp, Oryza sativa
cactctcgtgccctccccagcagatttactccaaaatttctaccccatttgatcagctcttatgggtttgattgtttgagaagatgactatggatggcaagatgggctcctgtgtcttctagctcgggattggaggagctataggttgtggcctgtggctagagaagatgatgagcggtaggtggatgccaataaatgagaatatctgcttgtgtactactgtgcagcttggatatggagcgtcatccgagcccgcgcaagagtttaaatttcacgcctacgttttggctcttgtcaatggcgtgacctattgttttgcataggccagccaatatttggatccaaaccaaaattatactttgtactgttaatgtggcccaaacattggtaaggccattttaggctatgaaccaaaccggccctaaataataggatccaatgtgttttttgaactgtcatataagggcaagtacaaaggtagagaccggtgtagtctctacgttaattagagactatcacgttacaatagttaatacaatatggtctctaaccattaatgcaccaaaatactttcttactagtcatctttcctttattactcaatgcaacaaaaaaaattcctaataaatgctaagagtcgactctatgccgctgtcatacgtagcaaccatctttctctttccttcttcctctctcttctacatcactaaatatgctcgcatgacaataaagagagaccgctaataaagaccattgtacattccctaatagcaatgtttgtcaatcaaggaagaagtacctgataggtgggatttcattctttgtaagaactgtcacataccacctaccgtgaacct

SEQ ID NO: 108104 - DNA, 1300 bp, Oryza sativa
aaagcttttccaaaattcatgatttagccttacaccagcacgatacgtgttactccatcataagccatactcgatatatgacctagaatcgttaagtggcgggcccacgccttaaacttaacgccgtggtggcggacacaacgggaacccaccacgtggcacagtaccgttgtattggacacgcttagtcacctaaactaccacgtcggggtaaataggaagctcctctgaattatacgaactcatacacaccggcctaccagaatgtaagactaaaccataaataatttactaagcttgggctatcccatactagcacatgtggttgtactgtatacgaaatgaactgacattgagtgaagtcgttaagtcggtttgggcgcacactcctcctatcgatacataactaatcaccatatgtgcaccacttgaggcccaaacctaaaatcgatgttttccaccattttatttatcaaaatcacaagtattaaagttctatctagattatttaaaaatcaattttcatgtttgtaatgagcccataataacaaggaagaccattctaagcatggctaagcattatagtaacctagtgtcaccaaaactcatatataaaatggtatagtcatattgttcctaaggttagaaatgagggatatggatatatgtggagttaaggtgataatgcaagtagtaggagtttatctaacaagtttaacaaaattttaatttattagtgtacaatcgacatgcaagatttgcaaatattttcaataacctccaaaacataggttcaaagtgatcaaagagagggaggtgggacttgccttgtaactggaaaaagtcagcaactaaatcacttcttcaccgtttaggcaatcatctatacaatgtacacgttatgcaattaaaacaccgaaatatgcgaaaaatccaaaatgctctaaaatgcatgatttgtgcacattggataggtactggtctaaaatgaatttatgtgaaagaatttctattttatctcatttcatttgagagttatgaattttagaagtttcgtcggtatagtgtaggatttacttaggtactattgtgaactgctgtcgtaaggtgattcttattaagttcatgtttgttggggtgaatatatgtgttgtctaagactaacacatttgatttcataatttcataatttcataagttttaacgtgttctagtcatatagtccctatacgtacatggctttggagattgaggtccagaacttgctctaacttgctattgttgtataaaatgagtattt

SEQ ID NO: 108105 - DNA, 941 bp, Oryza sativa
aaaccaacacagcgtcggccggtcagaccgcgggcctggccggtctgaccgcacacatatctccggtctgactggcagctccacccggtcggaccagtcacataaaataagagtgaatccgatcatcagctgaaaattgattatctccaaaaccacttcaacgataatctccaaatatcaaaaccaataatcacagatgccaattgttcatcacagaataagaatcaaaacacacattgatcttacatgatcatgaatatctagcgcccattcttgattctagaatttattggcgatcaatttacctattcattatacaatgtgtcagttcactacccttttcttccatttcctttttgtaagattttttttgacaacactaaactagattagtggcatgtttatatatctcaccttgtaatttattataagaactcatataaaattatctcactatgactctgaacttgccttcatatatatattctaggatgaaattttttcataaagatcttaagtgttgtgctattgtacctaagaaagattcatatcatccctggaacatcgcttatcctgccatgaaattgagaaaagcaatagttacataattttgtttcagaggataatcaatatgtaatatatagtactttaagatggtagggaagaaagtgcttagtttttaagatgttgcagaaagtatttagaattttatataagacagaggggataaaaatgacattgcgatttatagatagagactgtaggtcaatcatattccaatttaaggagactacttagagataaagaaatccttaatacatgtagtagaaatgtatgtaattcataacctaatattgtcgaggagaccacatgattgcttgaggatcctcgtcaatccttaatattaattcgaggagaccaaaggtgcctcttctgatctt

SEQ ID NO: 108106 - DNA, 2451 bp, Oryza sativa
aaacctccctaatcgtcaagctaacattgccacttgtaaggataaaaattaagtctgagaatcagagttccaaagccaataaacatgcccaaaaacctaccaaatggccagcttggtagtataacctgaaacatgtcaaaactctccatctcatattcagattgccatagttaagatataacaccagaatagaacaaactgaagtaaatgaagtcctgctagatagatgccatatcacactgcgatgagcaaaagcatgctaagacctaaacatatggggtcctagcaattaaaaaatatagaaagcttcagccatggtagtattcacatgctgggataaattggtatagaatatgttcacacatactgcaatttcatgctagctataatgtacacagcaacctaatatacgtagtagttaacacataggtttcgatccatttcctacagcatggatgtaatttcataagcaaatttacatgacacaaatatggctatatgattgtataatgtacagagatgatcatagagactcaccagtcaaaagtagtgatacattgagtgaactacttcgatttctgcttagagtccttgtctccttgacttatgagcagagccaacaacatcacttctaatttacagaaagatcaactaaatcaaatattgtcacaaataataatgtgtgcaatcgatcatacgcactaatgcgacgggggaactttagtaaaaaaatcctttgtttagcttgaccatcttatactttttttctcatcaacgtggttcacatggaatagataatcaaagttgcatctaacagccaatgaaaatttcattagcatattttacagacataagaaaaaccattatattgtctgagatcacataaagtttaactcatgagctttcaaacctaggaaattaactattttattttcatatatcacaccttatattgccacggaaagccagtgctggaaacaatgtacgcatgttgaaagccactgagacacatcatgctgattttgtttgatatcacagaatgattaagaggaaaaacttcagcatgtcagttcagaactacaatagagtcaattatttgaaggtaatataccctaaagatatgaccatctagcccagttagaactgtaaaatagctagcaattgtgtgtcatttttttgacacaattttgttacaaacaaatacaattataacaagaaaataatattctaaattgtgctgcgcaaaagctggctgaagacttgatttccaagccaatgtgtcgctggtaaacagagtagaatgacagcaaccctttcaattggaccaactcaactaaaccacactaactttgtcaagcaatagaaccaagtgaaaatttcaagtgcccatattattctgccaatattctaattgcaaatagaaaactctgatactggcagttgtttcaaagataaaatgcattgtagatcctggaaagcaaatatcatgataattcaaatatggttgaaatttaattgaaaccatggatgtctgcataacaaaaactataatatatcatattgggcgtgtgagggcactgataagcaaaacatgacaaatatagatgaaaatattaatttaaaccaaattgtatataaagaaatattgcaatggaaggaatgttgtgaatataagcaactaatagagttgggatcaacttatcgtttggggtaaaaagaattgttttacttaagtgtatagatcgatttctagaaagacaaaaggcccagcttcccatgaatacattcaacatctcctggggctggggatacctcatcattaaaataaaagaaaacattagaaaataagagggaaaatttcatgagcagcacataagacaaaatatacgttatgcgttagtaacacaatgaaattacaaatatgtaaatttttcaataagacaaatggtcaaccgtgtgtctacaagttaacggcatcatgtattaaaaaacagaggtagtatgaattgtttctgtgccaaaaaacatagaaatactatggtagttagcaacttcgtattaatgtttagggccaagatcattttagttacaatagaaacaaaacaatcttaatctttaacaaagatggcttctcattgtcatatcttgagtcgaatcaggggccgaggtcaattatcagtggcatgtggcgattgagaattagtaaatgtgagttgacgttgaggcataccttgtaggtcggcgttagaaggatcagcagtgatgacttcatcagctccagtcagggatgcctgctgcccttgtagatgctattcccagttgcagctcaaaagtcgccaccttgccctccccttcttccaacaccacaagtggcatgggatggatcagacgagagtcctccccctcctgatcactctattcaacagatgtggtgggtggagggaggaggtt

SEQ ID NO: 108107 - DNA, 1005 bp, Oryza sativa
taaagaccgatctttaatcccggttggtattaccaaccgggagtatagatccgggagtatagatcaatcgatctttaatcccggttggtaccaccaaccgggactaaagtggtaaccgggactaaagatcctcgaccccctggacatacatctgacaggggatgaaccgggactaaaaatcatctttagtcctggccggttagtgttaccaaccgggactaaagatcaaaattttttaaaccgggactaaaaatcgtttttagtcccggtttttaatggaaccgggactattgtaaaatttggtcgaccgattaaagatggtttctccatcagtgggggtggataatgtggatattcgggtatctcaccatcgcactgaataaggctatgggtcggtgcaaaagacatcgacaccgtggctttggacctcaacgccaactattctggcctaaggcagggtccaaatctagaatatgtttttttaaaatgggggtctaattgtgaaacaaagtttttataaagggctacaatataaaagatctagtaaaatccaagccccttgaatctaatataaaagaaacatactctctatcgagatggtagttaattgctaaaaggggtgaattcaacattggtgctaaaggggggcattgagagaaggaggagagggaagaggactaaaagtaggggtgctgaaagagaaagaaggagatgagccccccctcctcctctgattgcttcgtagatccaccctcggttcaacctcggtagaggaaacctgaacatgtgtaaattgagagaatcctaacagttggtccgaatcattgaacagattgaaccgataaaaaagactaggatgggaaaaaaaacattcaacggaattctagcaattcctgcatggttcactactatcatcttgattgatagatggtccaactccatcaaactatccaagtgtcacgaacccacgatatgccggtgtcacgccaagactagattgggagc

SEQ ID NO: 108108 - DNA, 2814 bp, Oryza sativa
cccccacctccacctccaccaccccacacctccggtgcttcctcgaggtcagcctccccttaccccttcacccccaatcccttcctaaaaaatcagggaagtgttcaagagcctctaagcaaggtaaaattgtttggtgcttttctctattatagtatagttatgtataatgtggtagcaggagggaaaaaaacaaactatttactaatttcttttgcatggaacaatgtacagttatatgggtattgaatgattgaagaccacgggtgttcgcatgcagcaagacaacatcatttgaaaggaagacatcaagaattgtaagttagtgttcaatttctcaattttgctgtgatggctgtttgtccaaatagagtcctgtgtggaatggcgatctgtgtatgctgtgatgttcttttgtgaaatagagccatgtgtgaaatgactatatgtgcatgctggcagaacaatattaaataaaatcttgcagcgacgttgtgaatttggttatattatgcaatatgtaacatataacaacttctttgatatgcagttgtagttgtatttttttggtactttttaataattgtctctctccttgcaaggtttatctagacagggaaggtatttaccctattggtagtttgaattggctgaagaggatgagcaccttaacttatttcaacaggctatctagcatctgcatttgatagctatcattggctccctttctaattgctctcacgcaggactttggctgtttgtagagcccaccatgtgaagaacaagaacttgctattgggagtcatgatagtgatattgaggctgactgtgctcatttgcaagaagtgcttttcaattacaatgaaaacattgtgcacagaagagttgtacaaaggggaacttcacgatgtgtttctgtcactccaagaggccgcacaacctcttgcaatgaagatgaaagccttgtaatgtctacatccttctctatgcttatcttaggtatataattacttgtgttatattcccttttctgaactatactgtgttttaggttggcaaggatgttatactctatgctgtcacaagaaatgatgtcccagtagccaaggcaacaattgtctcaacgaacccaataacaacagtgggaggtcaagctcttggagtccaatactatgaggtggttgtgaatgtggtgttaaagagggacaccgtgcttccttgtccatttcgtattaaaactatggctgatgcgtaaatgctgtctattgcatggccaaataacaaagtaagaactgcagtatatttttgttgttttggttctcatgtatcaccttaagatactaactaatgctaatattgacagatcagggcaaacaagaggccaggtatctcccaatgcggaggtattttacatataaactttactttttttcttgcactaaaatatgatttatagaaccgctgaattctaaatattgaatattctagtgttgagttctctctgcgacgtatttagatgtgaactttactaccatgcactaaattatgatatgttcaagttcactccaacaatatcctgctgcaacatattgatgtagccctcaaagttagaagttacttaacctgtcaattcaatataacaatctgatcagaaagttcatttgaattagaaaaagccttgtatatggactccatgcttttgtttcaatctgaactggccttgtttatgctggtaacaattagtatacatactgcctatggttcagctgaaagaaacctgaaggatttatcatgtaaatttatatggtgagataaggggagttataaaagtagtattcctagttctttaatatccttgaacttagtgattgttgagtattactacttcatgattcaggttgacatgttaggtggtctaaaatatatcatttggaaaatgtagaaagtacaggttactggaggcatgtattttgcccaagtgatgggaggcaacaacagtactagcatgttttgtaattttttagttaactacattttcttaaaagtaatttgtttaactggaacataatacctttttctgtaggtggaggttctggaaggacatagaggtggaccttgtcttatgttgacaacaagctatggaggatgaccttgttttgggggcaagacaaggtcatccttttgtaatggagtttgctacagaggcgaacttgttgggaaatgccaacatactgcatgtaatggagtttgcttcaggatagatatggtggaacttggatgaaatgtaaatcttttggacacctgttgtatctatgccacatgcgtactgcatgcatgtatgcttgaattaatctgtgaatgaattaaagttagtcactattttgatttgaagtgttgtcttcagtccaatataatgaatctatggagactaatttggtgagaatattggtttgtcatttctaattgtgatgaacaagtatataatttgatatggatacattaatatgaaactggaattgtgatgttcgactgacagtgggtcagcaattctcatatctgcggcaaatagtcggtcgggaattgttgtgggtggggataaatatgttggtcggtataaataaggtcggtcggcaaatctaaccaaccaccgtctgatagtcggtcggtaaaaatatgttggtcgggaaatctctttgccaaccagacttattccgactgtgcaagttggtcgggaaaacatttaccgactgatggttggtctctaaatgtggccttcacctaccgatcctctgttggggattttgtgtcatggtg

SEQ ID NO: 108109 - DNA, 553 bp, Oryza sativa
ccaagtgaaagggggcatatgagtttcttcgcttgatatgtgctggatggtagtgagttaggcctcgggagcattttatgcagaagttctaaaagactgtcgaaactggtatcagaccatccatgtctcgcctttaacctcataagttcaagaactgaccgtaatgttgtgaactcactgtcacagcccttcgactcatcgtacagaacttccttagctgccttctataaagcttcaaagtttatttaaacctctagccgatcccatcagcacctcgggttctgcatgacgtaacatttcctctagatcgattttgtcctcaacagaaccatctagggatggcaattttacccatgggtccggatatccgcggatacccgacccgatggacatggacatgggtgtgactttttacccatgtgcactgcccgcccgagacctgaagatgttatgggtaataggcgagtttcattttttacaagtgggtaacccatgcccgacccgatacatatgtattatctaattctgactcattccttaattcttataccat

SEQ ID NO: 108110 - DNA, 1395 bp, Oryza sativa
acacaaaccaaatcaagaatgcttgttgtgtatgctttgacttggtactgctgctgtactatcaaataaaacaaagttgcttttccaaaatatattatctatgtttatccgttatttggtaatacctataaaaatattgtagcaatcggacagtaaagagataaatttaatattaatggagaaaggaaacaatagaaatagttatttttattatttcattaattacatagctgtgtgtacacatggcatccatgcatgttagcataatatatcaaatggagtataagttctattttttctgaaggtatcattggaggaacaacaagagtgttccgacggataatgttagaaatgcattaaatttccacaaaccaataaatacacccaaacttaagtaaatgatagacaaaattataatttaagttgtgcaaacaatatgttgctaacagaagtattattttcaagtttcaataaaaaaaaacctgatcacatcttcagtcaataatgaattcatcagcagccaaaatattgaattgctatagtcaaagaatgatccatgattatgatgataatgcaacacttaagaaagttgccattaagaattccatagccacgcgaataaaatatctttgatcttttgaagctatctaatcctcgatgcgtgcaacaaattcttgtatgcctatagaaatgttgtctttggcttcattttcactacagtttaatatgtctatgagaaccccagtccgcagtttattttcatcctttacacattaattttgatcattttcaaaattcattaactttgataactaaggctgtgttcggttactggggttgggaacccatctccctgcaaaaaaacagagtggtccattagcgcgtgattaattaaatattagttatttttttcaaaaatgaattaatttgaatttttaaagccactttcgtatagaaactttttgcaaaaaaaaacgcatgaaaagcgtgcgcgcggaaaacgagggagaggccggggttgggagtgggctgaaacgaacacagcctaagtagtagtagtaattaaatactggtactaacagtgcaaatagatgttaattttgcaccctcccatgagcacataaagttgaggacacataagctcgtcacttccctacaccggaaaataaaatgttacatttatctagggaaaagcaaactaattattgtgtttaggttgtaagcaactaccagtttttcgtttttggaataactcttggtatttttcgattccgtagataaatgtcatcatttcatgttggattggcttcttccatagagcgcataacattgatggctatattataaatctaatgaatatcaagtctgtgcaaacggttccaatataaagatagt

SEQ ID NO: 108111 - DNA, 1175 bp, Oryza sativa
acccggaattgctgatccatgtagtggattgtattatctagaaacaacagaagtgggttgcatgtaagaatcaaaacagccatgttgaagcagtttttgtccatcgacttatttacatctagaatatcctgaagatttatgagacttcaagaaattggatatggcttcatgctctaaatccattctttcctataaaaatcaaataactaattagctaaagcgagataatatgtaatagatatctcctatgcatataaatatgagtggaaaacttatgtactctaaagattcagccaataatcgattgacatgatatatttgcaaagtgcacccaacaactcttttctatttgttaatgttgttccaggggctagaatacatagatgtatctgattcacttggttctgccaattgattgagcagtacataattttagggtgaaataataaaatcagaataactattataaacaatcctttattgatacctaactgacatgtcagtgaggaatcatgttgacatacataaatcgaacataatatcatttgaatgacaatgtgagaataaaaataaaataaatagaaggtgtggagataattgttctatcattaacaaccatcctcttcgatatgaaataatcagttcggaggtacgttgatttaaaggtaaggaggttgagcggagaaaattgaaaagcatagcaagacataatgttgtaaataacagaaattagcattgatcatggactgaacacgcatgaaacaaacatattttgtgagtgataaaaaatatcagaagtgaaaaggatacctactgcaaagacaactcctccttgaagtttgtttttgacatgaatctatattcaagaagtgaaaggccttagcccataatattgcctaggtgaaggcatttacagattgacattggctaggtgaagcaggctatgaattttttttattgaaagcagactatgaattttggcagagttgctatattcaatttgatcttaattagcatataaatcataaaaaatctaattgatttcagcaattgcggtattcaaatgtttgaataaatatgtgcatcttgatggtactgacaacccattcgatatgatcatggaggcacagcttgtagaccatggacgtaactaatacattacatataggtagggg

SEQ ID NO: 108112 - DNA, 2987 bp, Oryza sativa
agatcaacgtggatcttttcttaatacttttatatatagaagagagatagaaaaaaagaaaattgataggggttgaatagaaagcggctccctctgaccgtctaggagtcttctagaactgatgcattgtcttaggctgtgtttagatttaaagtttggatccaaacttcagtactttttcatcacatcaacctgtcatatacacgcaacttttcagtcacatcatctccaatttcaaccaaaatttaaattttgaattcaactaaacacagcattatttttccttgtttgatcggacggtctaatgctgcttcgtttttctcttttggtttttttttccccatttgcatccagcggtgcattttctcttcatgacgtggcccattccagtgctatctttggtttcacctttcactagtaaaaatgtaaaagtctagagcgccccttaatttcaggtcattcaagctaatgtaaaagtctagagcacatggacctctttttttttttagaatggcacatggacctttcctggaacgcagatgcgcatgcttgacctgcttggtgcttgcggatgtcacgcgccgcgttgcctgaccgccttgccttctagttctatgcggacctccatgcatggtctctctgctgagctttgactgtgacgacggtcgacgatgcacatgcccgcgttgaagggaaaattaggggagtggaagacaggtgtggtactacagactacggagtactactccgttcagaaaaaaaaaagtaaatttttagatacgaacctgaacgtatacgtccaaattcgtaacttaggattgaattctttttaaacggagaggtaagagacaagctagtgcaaaaaaagaactactacggtgcatgtatcacatgataaattcacacagctactttatgcaataactgctagcaataaatattactccctctatcccataagagcggttacaatagcaagctataagccagctgtaaacatattttaagaagataaatgaggagagagaagagcagcgggctatagatttgtagccagctgtagcacggactctaagacgtaatgtgtgtatgacaggtgggactatatattaataatgtagtatgtaactattgtatgaatgagctattagattggctatagatgaattggagctagtagttggctatactattaaacttgctctaataagcatagttgtgagttttagtgtccaatgtttgacctccattttatttgagattttttcatgattaacatttttattgatattagatgatatgcgtgacttaatttttattttttttataagttttcaaataaaacggacagtcaaacgttggacacgaaaatttatggttgcacttaaaatagacggagggagtagtatataagtactacccatcctaaaataaatttatttttaacctgtccatacatattaatacaaaatcgaaaaaactataatactcttactttatcaaatctcaaatctcaatgcatttctcttttcatatactcccagtatatttattctctaatttcacaaacacaaattgcagtgacttagaaataaatttgttttgggacaaacgaaagagataaaaatgatcttcatctgagatagaggaagtatattacatatagttgaaatagcctcgtctgtagtaccgtcagtatgtcacaaacggtttctactgttttacttcctttattttaaaatatagctatttttacctataaatttagagttaaaaataagtacattttgagatggagacagtacaatgtggactttcaatgtagatgtgggccttatgacttttaaagcttattttaaagtataattgtttgtgagaagctatgtgagaggttctgctgggtcttgtttgtagcgagaaaattgacatttagcttggggtttcgccagaatgccaacgccgaatgtggtttcgttataatgccatctttaaacgcccccatcttgctacactgctattttaaccaaatttggttatttgcaaatgctttccaatgttttgcttatttggtttgacccaaatgcccttgcctcagccactccacgcaccggccaagctccttccgccgtggcgcccgctcgccgggagcatcttccacctccgtccgccaccatccaaatcggcttaactccgtggtggatttcgaagcccctcttcaatggcgagctccaccatgaccggtgtcgatctccgtccccggcgcccttctccctcccctctagcctataaaagggaggagatcaatagacatattagtgctgctgctgttgcccaatccccacgtccctggctgccagtggagtgcagtcgcactggggagatctaggtttggcggcggcagtgtcgagaagaagacgacgactggatgaggatcgaaatagtcatacaggcaaaaaagtcagataacagtggaaaaatatttgcaaataacctaatttggttgaaatggcagtatggcaaaatgggggcgtttgaaggtggcacattataatgaagccgcattcgacgatggcattctggtgaaagcccaacctgagaatggctgaatatcaattttctcgtttgtagcatgcaaccgcggtagtttctatcggaatcttcaacttttcaaaatagttcagattcttgctcagattcatagaatttgtagctatataaaatacaggaaatgaactagaagctcactgtaaaaaaagatttttttttcccaacttcacgatttatttttccctgcagactataaaatcactgtttgcaaaaacagctacagatatcataaatctagtcccgtatgtgaaaatcaattttcttttttttcttcaagcagacctctttaacaccacgcctgtgaaaataaattttcgcaagcggaatatgaagttgtcggggaatttaactatttgccccttttagattgggaagttatc

SEQ ID NO: 108113 - DNA, 520 bp, Oryza sativa
ctctagataggtgagattctgcagctctgaaggtattggaccaacacatccaacttagtcacccctcctgcataaataaacaagtattactgataagttaaaggaacacattttagcttttgaaatgcgccagggatattccaatttttaactcaaacagtttggttttcccccaagaagacgaaactcctagcatgtagcaatttaggatggactggtatggctgtcggtctaggaataatatctaaccataaatgtggaaaacatatgagataaatattggctagtaattgtggagaaaacatcctgattgaaaggggaaaaggtatctctgctactgctatctatgtggagaaaacatcctgattctgagaagcagctggttgatagccaacttctgagaatctggaaaagcttttccaacttctggcttctagtttattttcttgattctacaactacagtttctcagaatctagatgaaaaacaggaccgtttaggggagcttctgattctggaa

SEQ ID NO: 108114 - DNA, 546 bp, Oryza sativa
cctgatctctttaaatttctattgaaagcctatctgtatgtgcgtaatattcacgagcaccagaatttaaaccttggtaggtaaagtcaatcatcaatgacttcatcacttcacagcaggtgttttccaagctttgctctagttaggacgcaattgaacatgagaacctgaaccttggcttggtcgcaaactccattcaatttgccacttgtttgggtattctcccaatttcaccaatcttgtggttttatagctaaagcctgaaaaagaaaaatactccctccgtttctgaatataaaaacactgttgaatttttaaataatcattcgtcttattccaaaatttttatgaaatatgttaaactatatgtatacataaaagtatatttaaccatgaatcaaatgataggaaaagaattaataattacttaaatttttaaacaaaacgaacagtcaaacatgtttataaaaataacggcgtcaaatatttagaaacggaggggtacaaaataggatgtacaattgcacaactcgaaaaaaaaaaaaa

SEQ ID NO: 108115 - DNA, 509 bp, Oryza sativa
cggaaccctcaatgccatccaatccagtcgctggcacaaccaaacaaaacaaacaccccggaagcaaattcagaagcaagcaagcatgcgggaagccccccccccccccaacccaagacacgattcgaagagaagaagaagaaaccagcgcgtacgtgccgcaccttcgcagccgccgccggcggggaggggagggctccgcggaggcggcgcaagggcggcggcgagtcggagtcggggtcggagtcggagtcggtgcgaggcccaagccgaactaggtaaagagatttattggacggccaggatatgcacaggggcgttgatccgacggctcgaacgcctcgtcagggctaataatattgcctctcgcgagagagaagccaagccagttgagtcgaactgttgaggaatcgctcgctcgctcgctcgctcgccggcggcgcggacgaggagggggcgagatgttctccacatcgtgctggagcggaacatgcagctgcacccgcggc

SEQ ID NO: 108116 - DNA, 624 bp, Oryza sativa
cccccatcacatctttcctgccacactgtcactgatccccaccacacataacgttgcacaaattacctatatattttctaaaccctttattaaaggaattggttttattttttttcacagaaaatgtttcacctagtgtactcacaatgttcactatgtataaatctaatgtacaggaaataaaaatattctttgcacaaatcacccacatattttgaaaactctctattaagggaatttggtttacttctttttccaccaaaaatgtttcacctaatgtactcacaatgtttcactatgtatagatctaatgtagcagtgaagtgaaattttcttttgcattctttcgctatttgctgaaacattctttttatataaggtgaaacaacatccgatttaaacgagtgaaacattttcgatcaacttagtgaaacaattccgatatatctagtggaacatcgtgcaacatttaaaaataattcaataataagctaaaaaaatttcgtcggaatatatccatgtgtggtcttgttttgaagatttaattgcaacgaaattaatgttgcagtcaaattatgatttggataagtaatttaagagaaaaatcagtttaacgtagatttg

SEQ ID NO: 108117 - DNA, 924 bp, Oryza sativa
agaagacctgttttttttttaaaaaaaattggaggggagtctctggtcaagacctacatatttgtgaaattcgattttcagaaacgaacgcttaagccacttgcgacaacattttcacagacgggcgatttaagtcactcacatttggaaataaaatttgaaaaacacgtatctatacttagtttttcatataaagtttgatgaaggacaactttataataaaattgtagattttgataagatctgcaactttgtagctaggtgacaacctttcattatagagattgtttagagacccaaatattcgttacaagatctcaaatttattattataaaatctcaaatctatattgaaacgatctccaaggctccaatgaagacatactctacactatacgacccccccctactactgagtaatctaagagggattacataattttagtaaaagtgaatacatgagatatgtggagggggaattaaatttgaaaatatactgttgatttgttttttttctcaaaaatattcaggatgtaaattgtttagcagaaatatactatcagtctcgcacatccattgcgcgagagtgacgtaggcgtgtgtcacgccccgaactagccccgagtggaactagcccgtgacgctccgaattaacctgttaatcgataccagtcccaggaaacagtgctggtatcacaggaagacagaatatcacagcagcagaggtctctttattatagagtaggagtacagtcatgttgggctgcgatcagatcccgagctcacatctgcattacaaaagggaaacggaagccaagacttagaccaaacatcacaggcgtgacttgggaagtaggccgaaacctaaaactcatcgtagccgacttgctcctggaagaactcctcgtcagcgggatccgcttc

SEQ ID NO: 108118 - DNA, 521 bp, Oryza sativa
tcataaaaaaaaatgtgaactaagttatcttgtgcacatgaaaaatctgtagaatgaaaacaaactcaaattccatttcactggtaaattaaattcttgggtgttgggcaagccagaatttttaatgcaattgtgcatgaaatgtttataaactatgctggttcattatatccgctccccttggatgatttaattggtgcatcaatgccattatttcgtgaaataaattttaagcctcttcaatcatgaaaaagacaacttaaattgaaccacatcaagaggtgctaaaaaggaagggtaaactatacaaagtctaaccacgtttactattgttgcacgccgttgcctcccaccatgtaccataacagagttccatgatgcactagctaaagccgctcgacacgaaatcacaccttgaactgcagaagtagaacaaaaaacaaatcacctcacatgtacaacattatgataacagcaatgcagtatatcatatcgtagtaaacaacggcaactttttaatt

SEQ ID NO: 108119 - DNA, 631 bp, Oryza sativa
ttctagccgtcgtatccttgtgcctcgccgcgtcccttgccggagaagcaagatggggcctgccggagaaaaacgccgcatccattggatccatctgaaagcaacaacagagacgaggaacattgagtttgccactgttgccaggtttgccaggtccaccaggtataagtgtatagcttgaatgcttgagcatgatttttttacatgtacagatgaatgtggaacgcctgagccttgatgtgtttgagcacgattttctgttgatgtgcaagcatgattttagtagatgtacaacttttaagccttgagtattttttagacataccacagttaaatatgggatgataccccaggtcactgtttcccacgtgaattttacatctgaacaatattgggagattaccgttccgacggttccgtttccgatatactgacgttaccgatatcgttaccgtttccgagtataccgttccgattccattttcgagaaaataaaatgaaaatggaaatggtagagggtttttccgaccgtttccgaccgttttcatccctacgtgtaatatttttgtcaaattcaatgtaaaatggttgtaaaaatactttaaaaaaaacaacataagtacactaacat

SEQ ID NO: 108120 - DNA, 658 bp, Oryza sativa
tacagtacctcatcacatttctttatatattttattttgggaaacataagcataatggttaaggcggaaatgataagggtagcgctattgttgggatttcaaagataaggggatgtttagatcgagtggtgtcggatattatatatggtgtcgcatgaaatattcgaacactaataaaaaactaattacagaatccttcagtaaaccgcgaggggcactaataaaaaaactaattacaacgtttcttcagtaaaactatttttgaaatagcaagtcatgtactactacctccgtcccaaaataagtgtagccatagatatccgtgtttagcattttgaccgtccgtcttatttgaaaaatttatgaaaaaattaaaaagaattagccacacataaagtactactcatgttttatcatgtaatagcaataaaaatgctaattatatttttttttcaaataagacaaatggtcaaacgttagtgtggagattatggataccccatatctacatgacagttataatttagtcggatatacggtaccaaatatagatagaatatctctataaggactcgggttagattctaaacttgtatgtcaaagaaatacccgggatcttaatccgttacgaatgtattttatctataatcctatattc

SEQ ID NO: 108121 - DNA, 539 bp, Oryza sativa
aagattttacctatcagagggccagaaataaggttcacaagatgctaaacccaggccgcgtgtatcataacttcaaaggtgacttctaacagttttctggctttctgcttgaaaaaaaaggtgattatgcaactcaacagattatatttaaggatactcaaacgaaactatgttcacaagtaatcagcagaagaaagtacaccagagcaaaaccaaatacaggtatgaattgtccgatccttgagagcaagaagttttgcatgcacccaataatctgcagcaaatatgcacattcttatacatcatattagcacgccatagaagaagttttgcattcacaggcattaagcattaacggaatccagtctaatttcccccaccttatgatgaaaaaaatatcactccaatcaacaaggcaaacagctaaaaaaattaatgacattatgcagaccaacattagggaaaaggaacaactaaaaatggagagacagttcaggcttaccatctacagcttcttgactaatccctccgttccatct

SEQ ID NO: 108122 - DNA, 750 bp, Oryza sativa
  unsure (1)..(750): unsure at all n locations
tttgacaatgacagctacatgttgcaacctgcaagtatgctgtgtctgaatttcctcttccgttctatctaatgttgctttgaaggagacctactccctccgtcccaaaatataagaacctagtaccagatggaacggagggattagtcaagaagctgtagatggtaagcctgaactgtctctccatttttagttgttccttttccctaatgttggtctgcataatgtcattaatttttttagctgtttgccttgttgattggagtgatatttttttcatcataaggtgggggaaattagactggattccgttaatgcttaatgcctgtgaatgcaaaacttcttctatggcgtgctaatatgatgtataagaatgtgcatatttgctgcagattattgggtgcatgcaaaacttcttgctctcaaggatcggacaattcatacctgtatttggttttgctctggtgtactttcttctgctgattacttgtgaacatagtttcgtttgagtatccttaaatataatctgttgagttgcataatcaccttttttttcaagcagaaagccagaaaactgtttgaagtcacctttgagttatgatacacgcggcctgcgtttagcatcttgtgaaccttatttctgccctttgatagggcaaaatctggtccccggagcacaactcgagaatcactgagccactgggacgctacaatgccaatntgatttggtatcctatgcatgcgctgaca

SEQ ID NO: 108123 - DNA, 607 bp, Oryza sativa
ctgaatcgggctctttttttctttttaccaggccgcctgttcagcccatgcttgtacacattcagggatgtatcagcaggcacctcagcttgacctcaaaagaaagaaattttggttcttttgattttttttattggcattaacaaatatcgctataatgttagacagatatattactagtttataaaatacatgaagtaagtcggaaactaaacatctctccttcaaagagggtgtgagagggatcaagagtatcctaattatcgcaattaggaatggatccaattctgttgagtctgactcattgtggtcatttctcttttaacaaaccttagttataaaaggattgaacttggatccatttatggatccaattctatttagtctgactcattgtggtcatttctctttaacgaaccttggttataaaaggcttgaacaatcgggatccaattacttattacttatgatacctagttgatattaatagctcgagatttacgtcttggtcaagcgtgtgtgtgtgtgtgtgtgtgtgtgtgtgtgtatatatatatatatatatatatatatatatatatatatatatacacacacacacacacac

SEQ ID NO: 108124 - DNA, 1089 bp, Oryza sativa
  unsure (1)..(1089): unsure at all n locations
ggctaggaaagacgatgaacaatgcctgttgggtgctattgcttctttgtccaacctaaccatgctcctgaatcactcacataatattgaaaccatagtaatatgaatataataggaaaattctaatttatgttaatgaaacgggcacccgttcggaattaatggatcaaattttcatctatgagttaaagtaagctttttcaatttctagctaatttcatttgttttttcatttacaattttagttttagcactatttgatccactaaaaattatttttaacttataatttttctctgtattgaattatttatagctaaatgaaaaaaggggatttagttatataattgttttaatattaaattatcattccgaccaaacttatttgtggtttcatgtcgntatttttttattatatttctttcatcatttatgccgaattatgatatatgattttaatttatgtcaatgaaagttatctagaatctattacaatacacaaacgttatgctagtacatataaatattatatgtacgtatatgcaattttgctgtatatttatcaacaaattttctcctaaaaatttgacggatgtaattacagtacaatcgtaatgtaactagtatgtaactacaatgcaacttgtatgtaacttttacataattttgaaccgttagatttgtttcaagatttgtgcaactaaaggaggaaaaatgtcattgcgcgcatatatgcaagaggattcgttcccacgacctcttcaccgaaatagcatgttacgaagaaatttttgaaagtgatatacaagttacatataagatacggtgtaattagatcatgattatactataattatatttgtcaaatttttagaaaatttgacgaacaatgccccacgacacgcggtgtccgcgtcatcttccggaacggcaaaaatatagtcctatcacttttccggcggcaaccccaatttggcaactcccgagtctccgacacaatgccaaattgcttaatttcccttgcccggccggctgctcccacactcccacactcccacctcaccaacccacgccaccctgctacgccca

SEQ ID NO: 108125 - DNA, 665 bp, Oryza sativa
ttaagggagtgtgctgacatgattgttatggcttctctttacgattattcatctccccaacttggagcttgcggctccactcaaccaatatgctgctgatactagtagatgtctagaagaaagcagcagcatcctgtatgcaaaagctttgcatctgcttgccttctctggtttttcatttgaggcaagttgatagccccctcgtgcactcacattattaaccccagtttgcaccaaaggagaaacatggctgattagattagttttgtagggttctctaaagatgtactgataggttgctacctgctagtaactttttatgagataggagatattggtgtccccagccaagtataaaaataatcctcctactatcagatgtaagacattttagagatgagcatatgagtcaagaagaaaattgaatccattttactccctcaaacttatactatcggagcacttaacattctaaacaatttttcggctcagttttataccttaaactattcacctcactcctggtatttctctctttcgctataagtcgtattttacactaaaattatgataatgcattataacactaagaccaatttaaacatcgaggttttaccaagcatataatcataaaaaaaatactcactctatcctaaattggaggg

SEQ ID NO: 108126 - DNA, 736 bp, Oryza sativa
  unsure (1)..(736): unsure at all n locations
ttgagacaagacatgcaatgattggctggacagagacgactgccaccgatggtggcgacggggacgtccggcggaggagggagaggagatgggcacggcgaggccacactactacagaaagcgtttttgcatacgggcggaatcgatcttcacatgcggatggccggcccgcatgcgcgaaatggtctgcaaagatcaccatttgtgcatgcagccggcccagccgcatgcgaagatcgatcttcgcatgcggtcacttaagacggncgcatgcgaaaatagatctttatggtccatttaagaagccgcatgcgaagatatattttcccatgcggtcgacttaacaagaccgcatgcgaagatctattttcgcatgcggccgtcttaagtagaccggatgcgaaagcgaattttcgaatagcctaaataataattattctaccctttgagggacgtgccgctcgcaataaaattaaatgattgagggatatagtatcatacattcgtggtagtaagacaagtggcgcagtaacaaacatgtaatacataaccataaattcatcgtaatttacatacgaaatatataatacaggtgccacagttttttcatcatatgtataagtagtgtacatgtcattgcatatgttctttctcccactctctgagaggtttaaatttgttgtccattgcgagttcactctggttgtcatagaagagacctcttgtattgcagaca

SEQ ID NO: 108127 - DNA, 526 bp, Oryza sativa
caatgcagcgctgggacgatcggttcgggcagacgtccatcctgcagctccgtccgtgctactgtggctgcgtctcccggcaggttgaccggatcgccaagtcgtcggccactgtgccggcggcggtgaagacggccgtcgtggacacgctaaggacgaaccaaggaaacctgggaaacggcgtgctctcgttgcagcggaacggcgtcgccgacaagctcgcctgggcgtgccaccacgccggcgacgagagaagcgtctccgagcagatcctggtatggcatgtggcgaccaggcttctcgagatcatgcgatcagaaggcgctcacggagacacgacgacggagacggcgacggcggcggagacagcgacacggtggtcgtcgcgacacggctgtcgcggtactgcgcctacctggtggcgctgaagccggagctcctgccggaccacccggcctggacggaggagctgtacaagggcgtggtggaggaggtgtcgagggtgctcgcgcggttcgcaggggcg

SEQ ID NO: 108128 - DNA, 567 bp, Oryza sativa
agatagcggtcgcggggcgagcacgccgcgttagagcatggttaattaatagtatagtcagccagctataacaaactctattttattttacagctaatactaaagccaattagcataatagataggctcctgtgttgattgtatcttattaaccaaataatcaattcctccatacgcatattaatcaaaagtgtgttctattcttgtggctattttatggtgtgatatgaatatgagtagtttgtccatatagtactacgtataaaaagtctttgtcctctcgtcgtctgaatttttcaccaacgagcactgtccgtagatgtacatgctgtccggatgctcgaacatcacaaaaatcataaaagcttcactctatcttagccctgatcatgcccaaaatatccacgctatgcttaatgatctgacaataagaatcgacttaagaatcttaacatagtattgccaaaacaacaaataacaattaatcataaaccaattggaagagggactccgtccagaaagcatatgcatcaacagaggggaattgctggaatcaaaccccaaacc

SEQ ID NO: 108129 - DNA, 551 bp, Oryza sativa
cgctttttatttttccacctcaaatttcaatttccataggtcatatgtacagttgggcctgtcattgacccacgagccgtaacagtagtcgtgctgtgatggcccagcacaacacggtgtcttcttgagctattcttgggccgtggccttggcacataggccgacatagcatagcctgctacaggtgtcgtgcctaacgaattgtactaaagcgggttgtgttgccagtggactcatgccgcattgggccaggccacctgtttggccagctatcggttctcatatgtactccttagagttaaaaggtaaaagaagagagtaacaagaatagcttttgtttgaagcaaataaaagtgggtagttacataaatgtattatttgattctagaataaatctaagagctttttgggcaattctaatttttcaatctcttttcatgattattaagatcagctaaaagtctacctacggttattgttaaaagtcaaagtacaaaattattatatatcgtcgcaatatatagtaatgcagccatatacccatgttaagt

SEQ ID NO: 108130 - DNA, 814 bp, Oryza sativa
acaatcactcaatgaatcatccaaatctatcaacataccttttcaaaagaaaacatatcaattcgtgagttgaattaaaaaaaaaaaaactcgactggcgggggaatgacttcccatggcttttcattaagaagaagcctcaaccaaaccggtcgagaaaagccacgaaccctggccccccacacgcggactcaccccctatggatcagtccgtaacctgtgctttgaggcccctgctccctatacgagggcccgccataggtcaattcttaacacgtgtttttatgagaggccagtgagtgactttttttaactaggcctgaaattcgcttcatggggagtgaaacccaggacctacacgtgctacttgagcattattcattaggctacaggtccttccgtgagttgaataaaaaaaaactgtggaaggcatatgatgcaagtactcatttaatcaaaacattggatagctttctagaatattgatgttgtttctgtttattttatgtggtactgagaatttaatagttagtcaaagattaattgtgtcatgtgctctctttgggacagaataaatgcctccgctccagataacttgtttatatctagtcttgacatggctttaggtttcaaaccatggttatgctatgaatagcatgcgtacatggactccacttggagaacaaatattccatgttctaggcaacatatgctatgtggtcactcttttggatatgcaactgtcattagtgtgtgtattaaaattaacgtgaaatgtacagatttcaacttcaaattcactatcccctccgtc

SEQ ID NO: 108131 - DNA, 618 bp, Oryza sativa
gtgagatcaattattcagattaatttcggattatagctcttcatgtacagttttaaatattctttttgggtttattttgattgttcattgatcaggtgtgtggttcatgcattgccattttgatcgtcacgtggtgtgggggatggacactatgttcatcgtgaaggatggcaagacgccgcaggctcagatgctacctcgtcctccaaacatgccagagtgctaacgaccgtggttcaaggaaaatgcaaacacaagcaggcggaaatttgtttattttgttcattgatttagtggtttagtttattttatttccttgtttggctgaaaaggaagaaggcattttgtcatcttgtaattgttagtcatttcgttctatcatgtaagtttggaatttttgttattcaatttacgaatataactaaataatgttttttttcagtggatcgggtattacgacgtctttctttataaacacacacccttgctatcttggctattttaattcccagcgctatacattgtgttacactggattaatttttcacggttaagatgtccttcgcttattcttatacattggtggagaaatcgtttttactcctggtttgtaacccc

SEQ ID NO: 108132 - DNA, 513 bp, Oryza sativa
tatgtctgcaatgaccacaaatgaaatacatcacaaattatacatctcacatctatgcaatgatcacaaatcaaatacatcacagattatacatctcagatctatgcgatgaatcacaaattctcaaaaacgaaattatacatctcaatccatacaatgaatcacaaatccttcatctcaatccatacaatgaatcacaaattcttcaaaaaaaagaaaagaaaggacaaaagtccctgcaggagagggcgctaccggccgccggccgccgccgccctcccatccaccagctcgccctcctctcgtgcccacggcaggctcagccgctgccgactccactcctgcccggtcgccgcccgcaccggaccgccctcctcctacgatcgctcttcctgtgaagtgaagggaggaaagagataagctaagagtaagagcatctccaacagtccctctaaatctcactctccccattcgctcaccgacgacgctcgggctccgtccgacggtgcccct

SEQ ID NO: 108133 - DNA, 684 bp, Oryza sativa
atatatgcctaatgaatccaataagccatgattttttttggggcatattaaatgctctagatcacacattgttccatcagttgaaagtaaaatgaatagctcgatactcttttcaagtacacaagtcattttatgatagaccttcataattggtatggatctttatgagttctgcagccacaacttcacgagtgctatcttaccatgtcttaatctttgttgggaagatgaaagatgtgccaaggataaaatactattaagcatggaacattttgagggcgtaaaaatagcttaaacatcagaagagactgaaccatgtaggattagtaacagaagtcacaggaattaggagaatctcaactaatatgatttggcaatggtgacaatagaaatgagagtagcaggaatttggagaatctcaattactataacatggcaatggtgacaataaaatgaaagtagacatccaaaatcattaagataaatcaagctctgattctgacaagtctggagtacggtgagtcccatgtcactacctaaacaaatctaattcttagtaagaattatagattgattcttgctactttcttcaacttcatttttcacactcaaaccaagttatgtgaacgattttattttacatttctagtatatatatattcaagtaagaaacatttgctttag

SEQ ID NO: 108134 - DNA, 2217 bp, Oryza sativa
tttaatgctgttactgcaaaccctaaccccctatattatggctcccttgtactcccttgcatttattctgcacttgtgggtgtgtcttgttgagtacggtggttgtactcagtcttgctcaatttttcccaaacccagaagaggagcccctggatgatgaaggctttggtgtctagctcgtgcctgccgtcaagcgcctgtggtcgtcgccctagtcttccgctgtttttcgtttgtcttcttgtgtgctgggtcttcgccgcccatgtaataaattaattacgcttccgcttgttaaactctgaattgtatcaacttttggtgtaccttgcctcctgggacaatgagtaatgcacgcacgtaaggaatgcccgttgggttatttccggtcgtgacagatatgagcaagactcccaaaatgaaacttgtgtatgattacatgaagtatctccaggatttattgcatattttttggagctcatttccacaagttttatgttgcttcaagaacttgcttagttgtatcttattggttaaacttcaaattttaaaagtgtgtttcatttagttgaaaatttgagttgatggcttaataaaagttgtttcaagaagtgagctctatgttatgtcaatgttaaatcaattttgacctcttttggatttgttccttgcatgaactcctcttgctttcaaacacccattatttgagccaacctaaactcaaatggaattttcattgtcaacctacacattccatttattttgcttctgaaattcaagttgatccttgtctccattgctaactaccatttcctgattccaaattcacacttgcatacactgtgtatggtgttcatataaaatagtattatcctttgatcatcttgaactcggtaattgcctatcattatcactcctttgttgagattacacacttgaccaagaagctctcaagtatcattgaccaaaatcttctcattgagaaaatacttgataggtatatttcgagggaaagttcaagtgcccataatcactccctcctacaaatgaaatccattataattctccttgtctaagtgacaagactccgagagtaagggggagcatttcttaaatggatcatttctcaaattttttctttgagctttcatctatttttttttggtcttgtgaatgtttgttcttgttttgcttgagcaaaattgtttctcttcccgtccattcaaatctttttgtgattaatgccaaaagggggagaatatttgaggatcccacatttgatatgatcattaatataaaggggaaaatattctaggatcccacatttggtgcatgtcttgaaatgaagcatatcatctcttatcaaagcatccaacatgcaccatatgcacaagcatcacatgcatagatataaatcaattgtcaatttctcatatcatgtttatttatatcattactttcacgcttcatatccaaatgtgattattattaatggatttgtcatcaatcaccaaaaagggggagattgaaagttcaagtgccattaatttggttttgatgattaatgacaaatccaattatgtgagacgaatgtattttttatgagcatttctttgcctagtctcatgtggatataaaagtggagtgtgtgagaggtgattcctggacttcttatgagttgagatagaaacattcattgatggtgaacataaatcacaaggatgaaattcgtggagatcaagctgcatgtatcactctttctctccatgtacatattgatatgttcatatataatattttcatgtgaataacaatatacatgtgagactaatgttttgtttaagtcttttctcctgtttagtctcttacattgagaacatgaagatgatgaaggtatacatttattttaatgcctatatttgataaatgccttctattcttgttgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataacaattattaagaaataaacaaagttaaaatggttttataaaaagaaaaactctaaaaagtcccctttccctccctctccctc

SEQ ID NO: 108135 - DNA, 1012 bp, Oryza sativa
gtaaaatacataaagaattcatattaactccaaaaattatgaaaacaaatgtgttagtcttagaaaacacttctctatatctctgtggagtcaaacttaataaacatcactttataaaaatattttataacactacctaggtaaatgctatcctataccgagcaaacttctaaaattcataactcacaaataataaaaagagataaaatataaattccttcacctaaattcatattagactagtacatatccactgtgcacaaatcatgcattttagagcattttggatttttcgcataattcggtgtttaattgcataacgtgtactttatatagataattgcttaaacggtgaagaagtgaattaggtgctgacattttgcagtttcaaggcaagtcctacctccctctatctttgatcactttgaatctatattttggaggttattgaaaatgaggttattgaaaatgtttgcaaatcttgcatgtcgattgtacactaataaactaaaattttgttaaacttgttagacaaactcctattatttgcattatcaccttaaccccacatatatccatatccctcattcataaccttaggaatcatatcatgttactacttggaatatgagttacattatcactagtttatagccaatttttcctttactatattgcttagccaagcttagaatggttttacttatcacttgggctcatattaacatgaaaaatgattttattaatattctggacagagatgaataaatgaataatttgacaaataaaatggtggaaaacttggattttaggtttgggcctcaagtggtgcacatatggtgattagttgtgtactgatagcactacaacaaaacaaacataaaaagacgtttatctagaggcgagactttagtcgtctctgtttttggaaccctccagagaataaagacgttttaagagacgttctagatggcgtcttagattgacatttattctaattttctttttacta

SEQ ID NO: 108136 - DNA, 821 bp, Oryza sativa
ctttcaaacctaattgctccatgatttgacaatgtggtgctacaataaacatttgctaatgacggattaattaggcttaataaattcgtctcgcggtttactgacatttgctaatgacggattaattaggcttaataaattcgtctcgcggtttactgacagattatgtaattagtttttttattagtgtccgaataccccatgcaacaccctatataatatccgatgtgacacgccaaaactttactccctatatctaaacaccccttaattctactttgggatgctaaaactttactccctatatctaaacaccccttaattctactttgggatgctaggaattgactttttgtgggacggaggggtacttaacaagtagttctaaagaatatataaaaatattaggactatgttatacatccctgtcaatagatttttttcctaatatttgccaaacgtaaatacattatattttttctatagaaatacattataattgtagtataattatattaaaagtcgcatgtaactctattataatttttgcatgtaattacattataaattgcacgtaacttcgaaaaaccctgtggtagcgccctgctttcgtggagcggaggttatgggattgaatccccccacctatgctcacattgtgttttttttcttcctcgcttgcacaaaatttcggagcaaatctaacggtataaaattacatagagttacacataaatatactactccctctgtttcaggtaatatgatgctttggcttttgtcaaagtcaaactgtttcaagtttgaccaagttcatataa

SEQ ID NO: 108137 - DNA, 841 bp, Oryza sativa
agatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcatatcgcagtctaggtcatagaaacattatatggacttaaacaaggagaattatgtaacatgaagaaatagtagtacaatttgaacatgatacaactatttgcattgcagttacatagatgatattagattcgaactaggagggaggtagtgcaatagttgaacacaacgacgatgtaataatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggaatcatgtaatcaaaatattcttaccatgaaatcgtcgtcaagaatatttggacaaacaaagaaccttcgacccaatgttgtaggatttatggaacgaagaacctgacaacgatcaccacacctgtatcttggacgggcttcccatggagggagtgccgtagttagcacccgccagtcgctctgttgttcacgacatt

SEQ ID NO: 108138 - DNA, 931 bp, Oryza sativa
taaaaaagttttatgttaaaatacatgatttatttaacaaatatatcaaatacttcatcatcttgaattgtattttcaattgcactttttgtgcaagttcccatatttgtactattctttccacaaccttttcccattacgtgcacaatagcatattgacattaatggacaaacatgaaaggtaacattaaatagaaagtaaaactcaatgaagtacaatgttagtttgtcttatgtagtgtctgacttttcttttagaagtactggtgtccgccatgaccatatttttattatattcttcatcaaaatcatcatcaagcgaaattggtttgtcatttgctatcttctcacaatcagtagtatatggttcctattaatacccatcaattgtatgtaacatgtcagtaatagtttgacaaatcgttttgtatatgaaagaaaagtaagaattgtaccttatttctctgagttttcatttcagaacattttcctttcttagcctatatcatagtgccatattgaaatggtaaataatttatatgaaaactaaattgagtgaatttggaaagtaaaataaatgaagtaccttgttagatgttttaaaacgtcttgtaactcttcttttagaaggattcgtctttgtactctcctgtgtaaccttttcattgtattcttcatcaaaataatcatcaagtgattcttcacaatcatcatcgattgtgattgccttttcatttgttttcccatcaaaatcggtaatgtatggttcctataaaacatcattattagtgtagtactataaataactttacgaattgttatgtaagaaagcaattatacataccttgtttgatctttttgtacatctcatgtttgatctctctttctttgtttgcgatgattgttcatttcataatcatcactactttca

SEQ ID NO: 108139 - DNA, 909 bp, Oryza sativa
aggtttgtaccgcaaaagaaaagggaggactaggaatcaaaagtttaaagactcaaaatgaagctcttcttctcaaaagacttttcaaccttttctcagataattcctcctggactaattggatttggaaagaatttgatggaagatcactattaaaatctctaccgttaggtcaacactggagtgtctttcagaaactgctgccagagcttttcaagataactacggtgcacattggggacggctcgagaacatccttttggcatgatcgctggactggcaatatgactcttgcagcacagtttgaatctctcttctcgcattcaactgacgacttagccactgttgagcaaattttatccttcggaatttacgatattctcacccctaggctttcatctgcagcgcaaaacgacctacaagaactgcaaaccattcttcagaatttttccttgacaaatgaatcggatactcggctcaacaatcgccttggcaatttaacaaccaagacaatctatgatttaaggtctccgcctggctttccttcaccaaattggaaattcatttgggactgcagaatgccattaaagatcaagctctttgcttggcttctagtcagagatcgactgtccacaaaattgaatctcttgaaaaagaaaatagtacagacagcaacctgtgacatatgcagcaccactgatgaaacagcagatcacctcagcttcaactgcccttttgctatcagtttctggcaagcacttcatatccaaccgatcatcaatgagactaagtacctggcccaactaaaggcaccagcaactatcccaacaagacattttcagagtttcttcatgctctgctcttgggtcctgtggaaccacaggcatgatgttgtattccgaggaagac

SEQ ID NO: 108140 - DNA, 613 bp, Oryza sativa
tgagggcgactctagcgagagtactcttttattgtaacatgcagattcaatttattttcaatttttctatacatatcatgtcatgttacccttgagcgttcgctcggggggctatttcaacattgttgaagactccctgtctctacgattctataccgggatcgactaagcgagtacggcaaatgttctgagtattgatttcaggaaaatcagacatcagaacaatcaagtcagatttcaaggctttgtcgcagactctacgcctactcgattactcgagaacggttgatggggctcgacaaggaatatgaaacaaagcgatggtgtacccgccgagatggaatttcttgacttcaatccaaattctcgattacagcaaggcgggagacttagtcacatgctccatatcttctcgcttgacatcggagattaacctagacaaacctaataaagtgcctacaaagaccgatgagatctagccttatttctgaacacaccgagaacggtcaagcgagcacggcaatagttgttccaacgtcttcgatcgaaaaccttaactcgttcatttgctgatgaacccaaagttccactcgacactcaaggctgttgttgg

SEQ ID NO: 108141 - DNA, 737 bp, Oryza sativa
gtatgcagaaaatgctcaggcaagagcatgtcgatcgcttccaaatcaataatttcagaaagtaacagtctcctcacgaagacatgaagtatggaacgattatttgcatcaccatcatgcatgattgtattttgttctgaatgtttggtaaatcatgtgcagaagaactagaacaatagttttttctccatgttcattatccactttcacgaaaggatgctaattggtgcaattattctgggtattattgatcagcctgatttcactcttgacagcgggagcatagtagtctgactacaaggaattgatagacaattctcgttgctgcaagattgttaacttttctgagatgctgcaagctaagctggttttaaacaagctaattatcaggggcggatgatctatggatcagtttgtcgttaaggtaacttcaattcttcatggttcatgtcatgtctgaaatttgccatgataaattactttgatccttttatgtgttcattgagccatgtttttttttaaaaaaatatgcttgtttatctctagaagaattgagtatagtttcatgacacttgcaatttaagctcgtcatcttaggtaggtatctgtgttatcaagaatttaagatgtgtcataaaaaaaaaccggcatccgaatgtttaaactatgatggttcagctggaaatttgttgatatactttgaaattttgctaaccatgaatacaatgttcacttga

SEQ ID NO: 108142 - DNA, 951 bp, Oryza sativa
taatacattcatccttcggacccatcatttcacttattcatggaataagtcaaacggcatatttgcaaacgaaaataatttataaataaaacttatatatatatatatatatatatatatatatatatatatatgttcttagcgatctaaaagcaaaggctgaaaaataaacttctatgaaaaaaccttaaaatcagctccaaatttaatgttgaaaattcaaagtttagccgataagcataagcataagcaaaaatatgagatcttttatcagttagactcacatgtcaaccaccgctgtgggtgaaaagttacgattttctgactcaattgtttgctattgttctagttttgtgaaaatagtagcacttaacagtgaaatttggtaagcctcgaagtcatcattagtctatagtcagtatcagcttcagagtcctggaattagccgatgggaattatcaaggtgcaaatagtcggattcttaccatatctagaatagaccgagttcaagggagatgcagcatgacagtttatctattaattaggaatagtacattagtttcctgttatctttaggaaagtgtgtttagtgtctgatatgcactttatgttttccatttatccttaggaaagtttctttcttgtataaggacaagtatctatccataggtataaatatgtacatccgaggtcattgaaaattatctctcgatcaatacaactactctcggcgcatcaccaccctctttttcgaggtttttagttatcatcggcggaacatcgcacctgacgcagggctgcattggctttcgatcactacaacaaattgggcttctatgacgattacctgatgacagaacacatatctgtcataaacagaggctgtttatgacgactgttcacaggatgacaactgtttatgatcaaaccgtgtctctgtcataatcatcg

SEQ ID NO: 108143 - DNA, 646 bp, Oryza sativa
gttggtgtttggtgcatgtgagtatgagttctaattaattatatgaaaaatatgtacaatacgaatccatgtgattgttactaacaaacttcttctataggatgcaatacatggatgctaagaagaaaaaagaacctatcggcttcttggatcaggctacttaaggtttaccatttggcttgtcctaaggtcaaggtggctctgataccaacttgtcacgcccggaatttctatccaaaattccaaacgcttacatgtgcattaaatcctcgtccaggaatcagctgaggcacacaataacaaattgttaatagagtactatcaaactactaattaatattcgcaaaataataaattattacagaggtggatagttcctctcaaaagaataaaattctacgcagcagaaataaacaaaagactaaacagctatggcgactccactccacaagcaacttgacccgaacaaagtctattcctcttgatcatcaccttcagtgaagtactcctcctctgatgaatgagtattgcaagaatgagcatatgacatactcaacaagcaacacagcaaatatgcaagtgcataggataacaaaggatggcatagtatagcttatgtgcataaacaacatttaataaacatttg

SEQ ID NO: 108144 - DNA, 768 bp, Oryza sativa
tctcattttaggattttaggattgaagtcatctctagtctcattttatgaatgaaaaaaaatcaaaattatggcgtttcattttatgattgaatgaaaaaactaaaaaaaaacaaactaaaatggctataagttggtttgaacctgcattactacaagaaatatgaccttctgtgaagaattcctcgtaacatcggagttatttgttattagcacattccattttatgacaattaattagtatgagatggggaggcttagtgacaaaaacatttgctttaaaaatcatggccaaaaatatttttttaatattctacgtggtctaaattattctttgaaatttttcgtgaattttcggaggtcaataactaattttaataccacaaagttcatttaacctattaaaataaatggaaaaaaattaaaattcctctctctatccttgggcctttttcggcccaagtattactctccctctctcagcccgcagactccctctccctcctcctccctctatgggccgccggcccagcccttttaatcctccctcgccgagaagtccattttagctccctcctctgaattcaaataactttttgcgtaataaatgatttcagataaaaaagttatcaacaacaaaattgtataaattatcaagatttacaacttttattttgttcattttactatataactttgtttcaataatttgaatttgaatttcaaattatgacaaattcaaacaacattttcaaatactaaatgattt

SEQ ID NO: 108145 - DNA, 762 bp, Oryza sativa
aggaaagtttctcatccttatgtgattcctgaagccattaatactgatgctttaaaaactgaatttgaaaataattgcaaagctcgtaatattcttttgagtgggatttctcgttctgaatatgatcgtgttgcacatcttgaaactgctcatgagatttggaatgctttgagaaattttcatcaaggaacaaataacattaaagagcttcgtcgagatctttttaaaaaggagtacattaaatttgagatgaaatctggaaaggctttggataactatctttctagatttaataaaattttgagtgatcttagatctgttgattcttcttatgatgttaattatccacaatctgagatttctcgtcactttttgaatggtctcgacatgtctatttgggagatgaaagttacatctattgaggagtctgttaatatgtctactttgactttggattcactttatactaaattgaaaacacatgagatgaatattctttctcgcaaagttgattctaaatcgagtgttttggtttcttcttcttcttctttgattgttgatgcttcttcatctatgccttcttttcttgctgcttttaatgccacatccgattatcaactcgaacaaatcgaggaggaggatttggctttggttgctaacagaattgctcgagctatgaataatgtcaggaacaggaaaagaggtggtccaaatcgttgctttgaatgtggttcaattgattatcttcgttcgcattgtcct

SEQ ID NO: 108146 - DNA, 575 bp, Oryza sativa
aatggctagctggttggatgacactgatcatagcttgaactttacgtatttatttttggagcagatgttcgtatggtaaaatgccttaatggtatacgatctatttgacatcagatacaactttctgatattgattccaattccattcagggaaagagccagagtgccgtacaatttgcacacagaggtgtgtccaaaagaacttttttgcagtaaaaatgtgaaatatagggagacatgaaccattaggcatttgtcacccgtgtgcctgtgtgtgtcactcttctcatgatctcatcacaccagtaaactgcatattaacgcctgaattcattggtagtgccaaattctaggtaaactccggcactatcaaaatattgtagggtaaagttatttagctaatatttggattgctaccaatataaaaccaaactcttatagtatagaggagaaacttctagaatatgaccaaataaggtaggcactaccaaatatttggtgttagtccaaactaacacacatattattcagtttgccaacaaagtggaaaggcatgttttggtatccaaccaaaa

SEQ ID NO: 108147 - DNA, 1512 bp, Oryza sativa
tcgcctgcaaagcaaacaaatacagccataagcatgaaattcagctggcacactcataattttgaactataactaatctttctacttgttagataaatcaaaatatttatatcctatgagttacacatgttctacagctgaaattattatatggtccttttactaattcagagatgctcttgttcatattctaatggatgagaatgcaactcccaactcctacacatactagtatatgcatcacacaagaatcatgccaggatatgatttcaatttcattttaatctcctgattacctaccatgattttagagtggctgatatatggttactttctctggtcctgcagccgctcctctggacttagtttcaaggattctcctgatgagacagcttcagcctaaatcaatttgaatgtatcagtattttctgcagagtttttaagtactaatagagaacacgatactattttatcttagtcaatgcttacttaggttttcatatagtaatacgctacagcatacaggagcaaaccacccacacattgcaagaacaagtgtgcacaacatatgcatctgcagacccaaaaaaaattcttgtggaaccaatgtagagagaacacgatattgtttttatcttagtcaatgcttacttaggttttcatatagtaatacgctacagcatacaggagcaaaccaccctcacattgcaatcacaagtgtgcacaacatatgcatctgcagaccaaaaaaaaattttcttgtggaaccaatgcagacaaaatcagtcaatagaatcactattgaagaagcaatttttactacactaaatcccactacaaacatcactaagcaaaaataatctgcatctaaaatgttattctctattttcagaatatgcactgcatcacaaactaatcagccaccaaatctcacatcacatccattcattagcatcagatctaaacaaaaataagattcagtctctacctccacggctccacccacaagtctccatcccatctgccccatcagaaaagaacaagaacaaccaggtgcccatcccctttgcccccatctgcaaaaaaatgcacacaagaagaagaagcgttaggggaggggaggggaagaggaaggagagaggggcaagacaacctcgtacttctgcttccttgaaatctagaatcccaggtggaggttgatgtggtcagaagggatgatggcggcgttcctcaggggagctatgtgcaggacccgggttagatggctggagggctggaggtagcgtggatgtaccagtagagggctggaggcagcgtgatcgtggatgctagggaggagaataacaaggagcaggaggaggcgggggcggcgtcgatgaccgcagaagcagccacacccacccacccctcatcctcccagtcccagatctagcgcggcggcgagctgctgcgtgctggtggtggtgggcgagagcgtagccgaatccatggcggcgctagggtttaggcgac

SEQ ID NO: 108148 - DNA, 1364 bp, Oryza sativa
tagatcgctaagaacatatatatatatatatatatatatatatatatatatatataagttttatttataaattattttcgtttgcaaatatgccgtttgacttattccatgaataagtgaaatgatgggtccgaaggatgaatgtattacatgtgtgcctgataagtgggatatgacctttaaggtaaatagagtctataattctatgataaaatgaatttttgttgtagcaatttactgaaactcctacctacaaatttcagcaaaatgatagttttgatacaactgttgtagttttgtgaaatctagcctttcgccttgtttagttccaaaatatttcttcaaacttcgaacttttccatcacatcaaaacttttctacacacgtaaacttccaacttttccgtcacatcgttttaatttcaaccaaactttcaattttgacgtgaactaaacacagcctttattgaatgacacagacagctactgtattccaaagtagtaccaccagagccaaattaagaacaaaactagcattaaacaaacttgtttaggatggcttagctagccgatggatggcactgtgccggtttgatgcatctttcatcaaggccgccgacgaggaagacgtctggaattgcaatggcgccgccgccgagcaagtgggcagaatcgccgtgaccccagacgtaatggcgggcacgatcttcacgacgtaactgccgtcgccggagctgattcccggcgggcacgttagacgacaaccggagctggcgacgaccgcttcccgatggcaaccgcagcggcctctgaccgtgctcctggcggactgtggctcgagcgagaagaatgcctccgacgacaagaacgcactgcgcagccgtggacagtgtcgtcgtcgcggccgggtagaaccccatcgccggagtagttggaggctccaccaccagaggcggtggatgcaggagcactgcgtgcattccgtcgttgtggcggcatacagctgtgataaggaggcgccggcgaggaagcatcccccgcagacgccaacgcctcgccggagcggagggagaaggcgtgagagcatcgcaactacaaaactagctgtggcacgtctgttttggactacatgacttttttttttcaacctcggcattattatggatatagattaacgctcgatggtcgtgtcgacgctttttcgtggccaacacaagatcacctaactatttacggtgtaaacaatagagtcgccaaaatcgatatatcaaaatcggctagtgaaaccgatttcgagattaattcactttcgtggaatcacacgactaatttacaagcaaattagcaaagaggataaatatcgta

SEQ ID NO: 108149 - DNA, 2404 bp, Oryza sativa
gatgcattgagctggtttttttggctcgtgaaaacatattaggtgccggtttgaaaccccacaattggcacctatatttgttataggtgtcggttataaaccggcaccgatgactttggtcatcgtaccgtctgcggggtgcctgttgggaaattcggtacctatggcttgtttccaaccggcaccaatctgggtttctgtagtagtggtattttacaagttgacgtagatgacacataggtccaagtttgagaatgtgtataccattcattttactcttttgtaaagtttgataattgatactcgtgcatatactcgagaaagtagtcgttagcctatgtattaatagccttaattaggctactattagtgatatttaagataataattttctcactagtgtcagcttatcgttatggaataatgaattttctaccggccaattgactaacgcgaatacctagctagcgtgtggaaggtatcattctatccgtggatgtagttttttttttttatgttgagttaaaatagttgtttagagtagagtactgagagccaatatattcaacctgggcatcaatcactcttctaactaatgcccgctactaattaattaaacttgtgataaaaataaaataaggatcaatgtgtgctcgcaagatgctactagcatttatttgcgcgcccgtcatagtttgaaccggtgacatatggttccagtatatgatattgatcgaattgcttgcgtaacaatttcaacccaaagtcttaatcagatgtgaaatagacggccaatttatttacgtgactgaataacaacagaagtccgtgaaatatgaaattgttattaaattaacatgtgaaatagacggccaatttatttagcgtacatgtacaattgatgaggttagtgaaacactcgtgatgtttgtgtgtactctgtttttttgttttgcaacattaggatattaaagccagtaacaacctgcttactatcgagctatttgtacgaaataagacgtctcaacaacttgacaaacagcatattccattacgacgacgtagaaattttgtattctaatgcctaattaacaatcgtagttatgaatcatgataaataaagacttcatcacatgtataaataactccagtgtgcagtctgggaaaacaacatctgtataaaatagcatgtgagcatgcgtgtactccatccaatctaattagctaggaccccctgtttccatcttgtaagctacctgtagaagcagagcaggtatagaaaaaaatatggagaaacacactacgcaagcaataattgagttttgtttgtaagtttcaatgtatgagtttgcatacaaccaaatcaacacatcgaaaggttagaaaaaaatttcattgtactccccgaactattttgctggaacacacatgattgcttaaacattgtacacctccaattattaaaaagggttcaccttaccgccagcatatttctcttaatttattctctctaaatagtattttgcaccaaaatttggtaggatagatagatgcattacaacatacctattaatgtttattagaatttttcaatcactatttacataagtcgaaaagcactatgactgatttaaatactgaggtttataatttcgagcaaatagtcataaaaaaatttaaaatatcttataaatttgataatggtttcagtaatattcttaaaaaaaatcaagttaaatacaagcatacaaacagaaacaaagaataaatgactaaagtgaactattttaatactttacaggttaaaatgagcaagagaatagtttgaaggattaagcgatccaataaaatagtttgggtgtgtaaaatagacttttgtccaacagtttctagagacttctaaaatgtatttgcatgggcactttgggcgactggatctaacaaaaggaagatgtatttctatggatgggaatgtgccgccggtcgaaacataattcgattgctcgtggaaatcgttggcacatgcgacagacttgacttaacacaagaacctttcaaaatattttctaggcagttgacttatgcttctcagcttccaaaatatttttggatgcagtcacccgagatgatgaaagtagggctattttcacatgcaaacggtgacacggcacctggcgtactgcatgggttcctcataaaccacctgtatagttttaatagattgtttgagagaagggaaaacaagaagattgatcagaagctacgcaaaatgagctgagacattagctcatgattagttgagtattaattatttcaaatgtaaaaggtggataatatatatgatttttaaaacaacttccatatagaaaatttttacaaacaacgtaccgtttagtagttcggg

SEQ ID NO: 108150 - DNA, 764 bp, Oryza sativa
cggaaaaactgtgttaagtcagctgaaatggctgcttatctctgagttattcctattttatgtctggttattgctattggttctgacacgagaattttgtagagatacgagtcttttgtttgatatatctagtgctgacctttggtgaaatctatattgtacagattgggctgatgtatggaagatatattaagcaaaaaatacccctatttcttacaaaataaaatcttccacgtcagtagattagatgctcatcattgtacctctatatcaaaaaaaaaaaaaaataaatgtcgaaacaaataggtgatgacgaggtagcaagatatctgagcttattgttcatgagaggataaatgcatttgactaaacaatacaagaaaaaagtcagatatgttatcccttcataatattatttcgtgtgcaatgtatctgttggggatatgttagcagtccatagctaggaacatttgagattccttctccaatatctttgtctcgtgtgagtgcgtccttttctaacgtagaccagctaatatgtagtggcgggcccagctttttgaacttgtgtattcaaactgggaagaggtaaaaaaaatgttcatacgcctaaaagcctaaaaaatagcttgtgtagtataacacactaataattatatatatagcgtatataacataaaatttattataagttatgaaattaaacaaatatgataatttggtttaaactatgaacctatagtgcagtgtccactagaccacta

SEQ ID NO: 108151 - DNA, 640 bp, Oryza sativa
tccgggaagaggaggctgcacgccttgtgaagtccatatcaagtgatcaagcacatctagttaacctcagtaagaagcttcccgactatgctaccgacgcagctattcgcatcatcactggtactaggtttgagaatcaagaggttcgcgacaaattccagtactaccaagatgagggtgttcatcttgcggcaagcttctgcacagccaacctatgcccatctctccagattggaaccatctgagccgaactgctcgcaaagcagagatatatcgggaggggatgtttgcattcataggtgggattattgatgaacaccaggagaggagagcacaagatatgtatcataaggaagacttgatagatgtactcctaaggatccagcaggaaggctctcttgagtccccagttagcatggaaacaatcaagttcttaatttttgtaagatttttgccattagctacagcaaaactacatgagttttctcctcatttttctaacctaatgttttttttccaaattcaattttaggatattttggctgggggaagtgagacagtgacaacagtattacagtgggctatgacagaactaatgaggaatccaacagtgatgtccaaggcgcaagacgaagttagg

SEQ ID NO: 108152 - DNA, 646 bp, Oryza sativa
ttttggtgtttaattgcataacgtgtcctttatctagataattgcataattggtgaaggagtggattaggtgctaacatttctctgatcaaggcaagttttctcctcccatcctttgaacacattgaatcccatgatttgaggaatgaaaatatttgtttgcaaagttgcatgtgaacttagattatatcagtatttaaaattgggttaaggtagttatgacctatttgccccaccttgaataattgatcttcttgctatttgaacacttagaaatggttagagtgcactctttgtgctcaaatgggtttatatatgctctatgtgcaactacttgcttagccatacttagaactatgcaaatgctcattccatctataattaaaatgtgattttcatacatgaacctttgctggaataaaatgaatatgatgggtatttgcgaactacaatgtgtaaaatgtgattttatacttgggcggcaagtggtgtgcatatggtgttagttgcataccgatagggggagtatttgcccaagtccataaggaccgaacttgtgtcacccatttaaagatattcgtacatccacatgtgctagtatgggatggcctaagctgattaatctatttaggactagccttgcattc

SEQ ID NO: 108153 - DNA, 657 bp, Oryza sativa
ttctgacctgaaagtaaagagcaagccatgtattatgctacgtactttccctgtccctcagatactcctgtgaccatacgatgaatacctcctatacatagagacatcgaacatgctgataagctgcctttttattcgtttgcaccaagcaacaacaatatcgtcctgaaagtttctgcatcagaaaagacttgactagtgcgggtcatcgtctttgtatcgaactggagtaataattagtctgaacaaaaacatcgctttatagtcgtacattcttttcaaaataaatacagatattcaaatttaaactaaaggctgcacttattttagaatagagagagcactaagtaggtggtgtctgaaactgatgaaaataaagattaagttagagtatgtgaaataagaaagctattagcatatgtatgattaaataaattataattattacaaacttgacaaatggatatatgtgatattttaaagcaacttttatatagaatgttttcgcacagacgacggaacgcaccgtttattagtttaaaaaacgtattaacgggaaaacgaggtaaaatctagatatttgtgactgactggtcgaattattaccacggattatttacacgccttgaattgcaaccacgagttggagctgaagct

SEQ ID NO: 108154 - DNA, 570 bp, Oryza sativa
aaagaactgttgaaaacactgaacttaacgatgcatacaagaagaaaaatgacataaaaataagcctattcaactgaatttctactgtagctaccatctttttcagtacttctagtttgttcgagcaaagtgaataaattgttgttaactattccaaccaaaatctattacatttagggacggagggagtactctattcattctaaaatataaacatttttagatctaaatttataccataatataaacatctttggtagcactatgcacgaaaatatgtacatttttcagtcactgagatgtttgaaaagagaattgaagcaattcaaatcttaacaattgaagtaactaaaatagaatatttttctccaccttagttttagtgaagaatataaaaataaaacagagggagtagtgcttaccaccttcagttaaatttattgtcgttttggacacttaattttttccttataatttatttgtccaaaacatcaattaaataagtctggaggaagtagtagtaattgatgcagtgagctgcctaactctattaaaaaacactcgctttct

SEQ ID NO: 108155 - DNA, 972 bp, Oryza sativa
gaactagaggatcccccatcctcatcatctcatctcaccggccggcggcggcgcatgcatggcgtggcctgacgtccggccggagttgggtcgacgacgacgaaggaggatctcatctcaaaatctgacacgatctagcttgtcgatcgactaaacatgcatgcatatgcattcaccgatcgatcgatgctcaatggctgaggcgtacggctagcttaatatccatctgactagctaggctcctatcggatggcctaatcagccaaagaaaaaaaaaatcaaaatttgaatttttaaacttaattttaagattgattttaagatatttttaacgtagtttctttttcaacattggtttttaagtcaccaagaacatatttataaaatttttatctacaaatttagccgtttagccgaacgatagggaccctactctgttcatgcatgttgctggcccgacctgtacacgcacccacgaacgtatatttgggtggattgaataaattggatcgatgctacagacctgccacaaacacacctacgtactacttcaacagctcactaactttaagatctatttgggaaaacgtatgacagctacagtttcttttagaatcagaaactctttcaaactagtactttagctttttcgttcatatttaaaaagttattgtaatatataatttaaacataaattaaaaagtcaaaagctagaaaactcagctttttcatatttttagaaactaataatcaaccaatatgcttctcagaatctttaagctattaaaaaaaacttagggcttgttcagaatgtagccaaaataaaccttaccaagttttagcactgctaaaatttcagtaagatggtaatattatcaaaattttaacatgatttcctatgtattaaccaaatttggcaacaaactaaacatagatattttttagataactttaccaaaaaaatggtatggt

SEQ ID NO: 108156 - DNA, 645 bp, Oryza sativa
ctactacagcttagggcatcctttatggatcatctataatatgtcaatgcagccggtttatgatatggataccgaaaataaccctcacagataatctataacagatcataaccatgattcatcagagatagtatgccatctatgacgggcgtaatttgttaaatatatgtatacaagttattcaaaatatgttttgaaaaaataactttatgtaatagttatttcatttgtttctacccttaaatatcataaaaaaaatagaaaatcttatcatctattagaacattcagggcttatttggtttagagtaatatcaacccatagataaaaatagaataatagaaggaacaaaaatgcatgcacacattaataatctaggatttttaatgagatttaagtggataaaaaattttctatgcttttcgtcttacaactatataggaaacaaaaattttctatagttctcacgtacttcgttcctatatataaaccaaatgatataaaattaatactcaagaatctaaatctaaatcctttgcttttactccatctgtcctaaaatataagcatttttagtatagtgccaagtcaaataatttactttaactattaatagaaaaaataaacagatcaatcatgtaaaat

SEQ ID NO: 108157 - DNA, 1361 bp, Oryza sativa
tacgtcgcatttcgtttgatctgaaacggagggagtacgtacgtgtgcgacattataatattcttgactctgatggcattgcattgcatgcgtaagtttggtcaagaatgagtttgcttgtctatatcaacagtgactgagaaaaatcccaagaaagaaattaagatgcatacatagacatagaacgaaacgtcgtctcctaatagtcagcaaatgacaaatccagacacggaatgagacgtaatagtcatagccatattccatccacttgtcatacacttgtgtatgtagagtagactcttagccaccaaggaaatatatatgtgtgtataggagtatgtagtactccatccgttcttttatttttttaaaaaaataaaaagttttccaaccttcaaaatttattttaaaaaataatttatagtctctggcttatctactatcaattgacaaatcgatcgacaatcactaaagagtgttatcccttcgatatatcttatatatctgactagttagcaatactattttttttgttagcaagggtattttgattatttcttctcactactaaatttccatgaaatggcaaaaaattaagtctttttttgacacaatgagcatatgcgaactaattaattacttctttattctttattctaaaatataagacgcccataattttatacaagtcagcattaaactaataatatgtatgtctggtgttatgtatatgatacaaatactacaaaaattctgaagtattttcctttctaaaaaaatacctctaaaatgcatttctaatatctgtattaagctcctgtggttagttaggatggtactataagaatactgcagtctgcagaggtgctggaaaaccttgtagtaactttggcttacatttgcttttgctcaatccatgcatattaagtgcccaacagttaagccaagcaatctgataagcacacctatcttcttttcctagtaaaccttcaattaatctcacaggtcatacacagtaaataatgtactgcacagcccattttaaacttcagaaagaactcaatgacgcatgaatcatcttacatatatcaaacacagtagtgagcattgatgacttgattaattatctcaatatatccaaatgtcatcatcatcggcaaacaagattaggtgaaccgaagtagttggtgtaagtaaaagggagtgcatctgtttcttgactgcacactgaattaatttgtgtcctgtagtgcctgctgttctcagctctgaacctttgccaaacataaatgacgaccgtgtagaaccaaaatccaaattaatggagtataataagtacataaatgaccatatacaaatct

SEQ ID NO: 108158 - DNA, 581 bp, Oryza sativa
tgactccgtttcaaattttatttaaacactcagattagccatttatttattttgcaacacctagttttctacgaaaatattcaggttaaaaaaaagagaggagagacaaattaatcgccgtttgtttgcacgtcgctctacgttctccaaccatagttgtaatgtaatgtaaggcaaggcactttacagttgcaccttccatgcaaccacaaaatacagcaaaagagcaaagctcagagctgtcgtgctaacgacagatcatcaagggttcttccaagaaaggctcttaagaggtttccagcaatctcctctgaacaacaaatagcctgtttccaggacgattcaacagaataagaaagaaagcaatcttttaagaaggcaactttttcagacagacaattcattcaattcttgatgaagcagaagtcatttcaattattgatgaaaacgcaggaggtctgcgattcattcattcaattaataagaaaaagatggcaagaatgtacaagttaggctgttactacaatggattgcatctccacacacaaaacacctgggctaaattagtattacatcttatt

SEQ ID NO: 108159 - DNA, 648 bp, Oryza sativa
cttaattagaaaaagggcccatatagctattactccctccatactcataaagaaagtcgtttaggacagcgacacggtcttcaaaacataactttgacttcttgtttctatacttttatgagaccgtgttttaggacagttgtgttttgaagaccgtgtcgctatactaaacgactttctttacgagtatggagatagtacatataatttttacatttttaaactcaccaacttgagaggttatttataatttatattctcaaggtttgacttaaacattatcctaaacgacttacttataattacggagggagtactccgagctttgatgcttattatggtaattaattaaagatcgcacgcacagtgaatatacatattattaagcggccgctttgtgtgtggtctcaaacagtgacggagaaagcctaggcttgtatcctaaacatctactaaaatttatcaacacttagtgaaaattttgaaaacacaagatatataagcaagtttagcccttagcttgtttgtttttttttgtctccggacgtctctggtctcgctaactaaacttggccagacaaattgagcgacaaggtatttcgtcattgtcgagtgtcgattgaaagcgagcaggccagtagtagttat

SEQ ID NO: 108160 - DNA, 599 bp, Oryza sativa
gcgatttgatgatcgtctgattcaaagtttatttctttcgaaatagaggtacaaactgaaggattatttgtttttttttgcaaaacacaatttgtgtgtttaaggattgttttgctttgtggtgacattgttcaatttgttcattcatgctatgttcgttcgcgagacaggggagattgagtctcgtttttcgcgcgcacgcttttcaaactactaaacgatgtattttttgtaaaaaaattctataggaaagttgctttaaaaaatcatattaatccatttttaaaatttaaaatagttaatactcaattaatcatgagctaatggctcacctcgttttacgtatctttccaatctctctaatctcctactcctcaaacacaccctcaatggtccaagcatagatcgaactgatactctgatagagagcatgcttggttgaaggcccggaaaaattatactccctacttccccaattataaggtattgcactgtttgattattcgtcttattaaaaaaattaaaattattatttattttatctgtgacttattttattatccaaagtactttaagcataacttttcgttttctatatt

SEQ ID NO: 108161 - DNA, 568 bp, Oryza sativa
ttcagaaattttgaaaattgaaacttcaatcgagtatctccagaatgttcagagagcatagatttcacatgtgtactgtaccctgataatggaacttgaatggagtactccctccgtcccaaaaaaagacaaaccctgatttccgtgcccaacgtttgaccgtccgtcttatttaaaaaaattataaaaaaaattaaaaagacaagtcacgcacaaagtattaatcatgttttatcatctaacaacaataaaaatacgaattataaaaaaatttcatataagacggacagtcaaagttgaacacgaaaatttagggtttatctttttctgggacggagggagtaactcaagaatttgaagttcacaaagattcagaattttaaggcctcatttgaatcacaggaatgtaaaaaaacggaggaatagaaaaaacacatgatttaaataggaatataaaagttaaacagaagattgaaaatacagaaatatccataggaatgatcgtttaattgaaccacaggaaaaacgtatgaatcaggtgagagagatagactcaaatgattttttt

SEQ ID NO: 108162 - DNA, 901 bp, Oryza sativa
accgtgatctggatgatcgatccatggttggtggccggccatggcgaatctgccgtcagttttgggcattttttgtggggcggcggaaaactgtgtggcgctcccagttttcggctggtttttagcctcgccgacgtcactcatgctcatgcctgtcttgcactctcactctgtgggctaccacccggccttgtctgctcactagcaatgcattgctgccccactcaaagtacggatcgcttatccatttctgatgcgatctgctccatttcagtctctcccatctcaccttatcatctcctgctagatccaaccaactttgctttactgctattctactgaaaaatactccatccgctctatttataagtgcaattgttataacgcagttgtggttgtttgtgtctaatgttttaccgtttatcttatttttaaaaaatataaaaaataatcgcataaagtactatttattttttatgtaataacaataaaaatactaatcataaaacatttaaataagatggacaatcaaattttgagcacagaaacctacaactttaattaaatgtttagaatcgttatattagaatgtgtcatttaatttaatttggttttttttaacggaaagtgagtagtatgaagggttcggtactgtgcgttagttgtccatccagttgggtttgtggtgatcatcagcaggcaactggttgattagatcaatcaatcactgcccacggtatagatcagatcaccatcctcctccatgtttttcactgtatccgtggccgctgccgttaaactttttcgaacggtcgctgccgttaaacttgaacagttgatatgcatttactctctcctctctctctctctctctgcatatatttatagacggcaaaatgaa

SEQ ID NO: 108163 - DNA, 936 bp, Oryza sativa
cttgtttaacatgcggaaaccaactaatactttggtaaaagaaatacattaaaaaccagcttataattagtattcactccaataaaaaagagttttctaaaatatttaaatggacacatacatagccctattcggaaagaaaaaaaacaagtgcagatatacaattcttaactttcataaatgtaattctaatttatatggtagattttaaaagttaaattggatctgatatacaactcttagcatatgttagatagatatattgatagatagatacactatctttattaaaaaagaatgcaattttagcaatgcacgtggacaaagatatgtccaagttcatagctaaaattatattctttttcgcatggcagtaatatataaacatataaatagatggatagagagatagatagttgaaattgttttttttctagggaggggggatggaggcactagtagatagatagatacattaattccaagatactattgaattttaattcctaatatacattttttgaagggaaaaaaagaagtttgaaaatgtgacacgcccaaatgtttgtttgggtagttctttatttaggtagtagcacagcttaagaggcacatgtgtcccaaattgcgaatctttgcagcccagtaataggggggctcacctaaattaaccccccaactcgcctcttaatcctgcacgcgccgcgcccgcgccttcttcttcctctcccgcgctttctcttcccgccatctccctataaatggcgccctttctcttccttcggccaacccctcaagcagccaaggcgcctcccttcctaatcctacctcgatcgccttcttcctctcgactcgatcgccatggttgtcaacaacaaggtggacagcctcttctacgacgtcgaggcgccaccggcgcaggcgccgacgaccccg

SEQ ID NO: 108164 - DNA, 595 bp, Oryza sativa
cagaattgactaaatcgtcatctatgtgattctgggtaaaaatctttgaccacccactctgaccgcatgtgattgaagatcagttatattaatggtgaaaagaatgaaaagaaaaaggccggttatatcaggcgtgcatggagaaacatattaatcaactataggactgaacaaagatcgaactgcagatttgtaggactgaactggctgccgaagcatgcatggaaagaccaatatataactacagtacttaaagtgaaaagatgagagattatatgcttttagagatttaaagtggaatttttttgcggctaactgcatgtgtgtgtgtccggagtcaaaaggcacctcttgttagttgtgttaggatcagggcactcactctacagtttggcatgcagctactagatatacttaattaactgtaaaaaggaacataatgcaagttcagttcagttccctgtttcttctcttctttttttttcttttgagacaccagttctgttatgtttgatttaaattattatcttatattatcgatttgaataaaatgaaaaataatattttaagaaacaggattaacagatagcttaaa

SEQ ID NO: 108165 - DNA, 985 bp, Oryza sativa
tctctcccccccccaagcataccccagcataggcctatctagccgattgcgtcgtgtaacaaaatctctatttcttttaatatattgacgtgcaatccttttgcacgttaaaaaaaatcaacactatgcagcatgcatggcactgatgaagattcgaaaggtacaaatcatcaacatgcatatacatcacatatagtcatatactgagctaaaatcaatgttgcttgcaaagatgggatactacatactgacgagaaaatgttccaagatagtagtacaacacacatggattgaatcgggcttaaacctgaagctagctagtgacacacgcaaaggtgagggtgtgatgcatatcgttttcgatcgatagatctccatctctctctccccaagaatatggttctcatgagtagcttatgccagcttccaacagaacaaatgcatgctaagctagctagctctgtacaccgtcgaaatcgatcggtcccaagatccaatcggtcctagattgctagctgaacgtatctgtacgtaatcacctctccttttcttcgatatgtaccaaatataccattcgtttcgttacagacaagcaacttatacagcaactactctatcgtctgcactactgaagaatgaatgtctgatccagctaattgtcgatatatatctggagtatatatgtagtaacgtagtagctaccagtgttgtggaaaacggtgttaacggccgttaatacgttcgataatacggatacggagatcagtccgtcacgtcacgccaatgcggtcatcattagtcggtaacgaacgcataaatccgatcattaccgattaaatcgtccgtctccgtctaatcagccgtataatcggcgtgatgacaaaggtcgattccacaatccagctcattagctgtgccctttactactattgactagaagtttgctcttccgaaattctcacaaggcagcaagatgtaaaatgac

SEQ ID NO: 108166 - DNA, 696 bp, Oryza sativa
acgtatatacatacagtgccggcctgacaggtgggcccacggcaacctgacaggctataaaatatgctggtggccatacacgcagctcacagaatcgacgttgctgctgctgctgctgctgactgaaccggtttcgcccgaaaactaagagcgttttcgcggtcgcgtcgcgttcgtcagagcgaaaactgccggcaaccgagcggcacacatccacggattcagaccaaaactgacggcaaaatcacaacacaacgcgtcacgatggtcgtcgcattcgtgtgcatgaatcatgcatggttgttcacgggtgccgttcaaatgctactatacaaaattcagctgtttactgtggctggctggcttcaccctaccttgttcttcttcagagaacaaaaagtgccggttcagtacgtacacatgacggccgggtctccatatctccgaaaaatctatgaatcggatcaagtaaaacatgagtaaaaattcggcggtgtccaactcgaaccctaatgcatgcgtatgcgagtgttgaatcgatttgactaattccgtcaccaattcctatcactagcatatcagcacaaacagtccagcttctgctaaaatcaaaaactccctcatatatatagttagcttttcatccatattctcaaaagctgtagttaaaaaattcagaaaataaactagaaatag

SEQ ID NO: 108167 - DNA, 1290 bp, Oryza sativa
  unsure (1)..(1290): unsure at all n locations
ttaattaggagttgttttctacgacaaatatgattttactcacaaaggacgtactagtaggtgtgtacttgtggtgtactgagtgatggtgtgcatgtgcatttcttttttaaaaaagaagtcttattgcacccaaatcccaaccaagtacaattatatatggcaggtagttcctcttttgatatgtgagcaacagtatgtgctcatctatatgatttttaagatgattttaatggtggtggtaacgaatatgtcacccacctactatcattctatttttttcatattaccctttcaatttcttagtattacataacaactagtaaatttaaatggatagtcacatataaaataaattaaggttagtcttccctatagaaaaatgtagacaacaaatttcatggaaactatgcttttatttattttagaaaaatgtatgacatttnttcttttatccatagccaagtacgtgtatttacgtagttatgaagaaaagaaaggcatgcaaccagtgtttacaaaaccaacaaaaatcagtcggttttcatgaaaataagacttctcgggcttgttcgagaacacaaactgcccagtttcctggtcaaactattttttacaaattttgactggatttttaacggtagtcaatactccaacccggcatgcaacttcccacttgcacctgtaggaactagctaggaagtcaacctgcttgtgcaatgtgcatatagcgtgtcccctatagtgcaggaagttgccgtgttatttgggtgtaaaggtttgagtagtctgacttcaagcagcactcatctcatgctaaaatgagctgtggcccagaaacatgatctcctctattaaaggatgcatgatataactaaattaacatgtaactttaagcccccatttggagctgagtttttttttacagaattatacatagagaaatctcaccaacttttttttttgttaaagctcatgcagttagttagaagttattaaattattctaaaattcacgttttatcaacaagatgactgtattttaagagtatgtaactgaagggcacacgatgttgtaagtaaggtagtgtgcgcgcacaatttttatagatacatgcgttgtcaggtaactcgagcaaaattcagtttatttagttgaattcgagtgaaccaaaacctactcataattaacgacgtgattgtacagctagtgataactggtttgtctcacttcatctatgagagaccctatcctatagagctaaatcgagagcacttttgaaatagattt

SEQ ID NO: 108168 - DNA, 1322 bp, Oryza sativa
tttagattgtatgggtatcgtcggtaccagggttatcgaagtgtaaacctctctagcgggaggacgtgagaccccccccccccctttgtgagttcggctaggggatagggcgcgatgatcaagagtgtgtcatcgccgtggactcggctagcgaggtggatggtgaacggggagtgagaccagagattatctaggttcgggccgcttggaagcgtaataccctactcctgtgtgtgggtttatgtttaggttgttacaagggatcttgaatccgggagtgcaatctgcaagcgttcccccagagttcaagatcttccgaatcccccttactcggtaggcaaggtcctccttttatagtttagggggttaccacatgcaccgctctacacatcttgtcattggaggggggcccacatcaactctggtcgagccgccacccatgccttagatcggaagtaaggtggccacccgtcctcaggtgatccccagcgcagtcttttgtctgacacggggggacatcccctgtcattccctcataaattcttagagactttgtgggttcatgcataggggatgcaccggtcggacatcggtctccgggcgtcgatgagacggggcatacctgcccccacgccacctgacacagggtggggcatgggttagggttgtcaaaaaagcttgaggctcgcgaactactcgagctcggctcgtcctaggctcgattcgagttcggctcgagctccagacgagccgagcccgagcctatccctaagctcgcgagctttgtcgagccgagctcgagcttctaacgagtctagtaatatatgatttttgttgttatttaataaattaggagatcaaatatgttatttgtatgtcttatattgacatcatatatttattttgttcttttttcctcttctattaatacgatgaactagaaattaattataagattatctttgaaatatatattgtgttacttaaaaatcaagctcgagctggatcgagcttgagccgagcctgtcaaaaagctcgaacattttataggctcggctcgagcttatatcgagctcgagcctaggcagacgagctcgctcgagctcggctcgttgatagccctagcatgggtgcgctgccacccgtctcatccgcctgcgactagtctcagcctggtcaagggcgattgacgcacatcaatcaatcgaacgtcgcacgactagccatgccacattaaatgcggcggtggtggttggggcgtcgcccatcaatgcgcctggcagcgcctctttctctgcccactcagcagcaacgtggcagcc

SEQ ID NO: 108169 - DNA, 673 bp, Oryza sativa
tggagtactatcatttttctgcttgctagtgttaatcacttaattaataatttagcattttacccatgtggagatgaagggcaattagcaattgctagtaggttttttttttcttttctgaaactgacggtgcatgggctagattggtgcctttgccgtcagttttgggcatttttcggccggcggaaaactgtgtggcgctcccagttttcggctggggtgtttagagcaagtttaatagtataccccactactatcttcaattcatatattgtcaatctaatagtcaattcatacaatagttgcttaccatactattaatatctggtcccacctgtcatacacatattacgtcttggaatccgtgctgcagctggctacagatctgtagcccgctgctcttctctctcatcctttatcttattaaaaatatatttacagctggcttaatagctagctgctcttaggcgttggccgacgtcattcaggccagcttcgctctctgtggccgggctacaccctcttgtctgcatgcctgcgcagcccattgttctagggatcgcctatccccatttctgatgctatctatttccgtcccaatatataatattttagaatcatattagattcattttagatttgtagtttcaggataggtctaatctcattctaa

SEQ ID NO: 108170 - DNA, 677 bp, Oryza sativa
aaggtgtttgactttgagactgagcacacatgggcatatgacagcaatcatgaagccaatttaccaatcgagcgatgaattactgatacaacaaaatctctggcacttttatcatgcctcacacaacacagcctcggtgtacatattctgggtagtattacacaatgtggccattaggccctctattaaaaaccaaatacaccagggaggagttcagcttggctccactatcaagcaaggttcagacatggtagccagtacacaatcttttcatcaattgaatcagatccagtcagcgttctgtaatgacagcaacaaaaaaaaggaccaggttaggttgaattcttattgttacagaaagcactgaaataaagcattgcgtggcgggtattaagatgactattagtgcccactacagtttatatgttggcatattatctgactttgaaaataaagaaagaaaaatgcataaacacattgtagtcttaggaaccaaaccttgctctattctaagtaaatcttggttgtgattgcgggaagctgctggcagatgactcatgcaattcatatgtgaactccatatccatgagccgatgattctcttttgagcgaaccattgtaaaagaaactttaacattgtccccttcgtttactttcagaggcggagtcagcaagaa

SEQ ID NO: 108171 - DNA, 709 bp, Oryza sativa
tgcattgcatgctacagctcaagtaccatcagttgacgaatgcctgctctacgcatctcaactctgcacatctccagcgaggtttcaggctttcagctagtgattacagtacacagggagtacagcacaggtccagacccaagaggggtttgctgcgtccccaactcttcatttgcacttccatttggcattttgcatatcatatcatgctattactttcagaaagtagctaggcttgctccgtttgatttagattatgagcaaattattatcacggatacttgcaagcatgtggggtgtcagtgcgattcatctcaaagattggcttagttttcaaattttggacattttaattcatggaatttgtaacgagatggcgcatttaatttactgtaccacctgtctgtatgtactgtatacaacaataggctccaaaagtccaaataatctccggccacctatctattgggctcaaccctgtaggccggtcagagcccacgtaactggaagccccttacggcccaaccaacatagccgcatgtaattcacaatccaaaatgggccgaacgtaaggcccaatcccgttattgggtcgcacataatcgaaatcgctttgcaggccaaccctcatcagcccggcccatggaaaacgccttacctgggctgctagcccgagacatctctctctcccgaattttttttatttata

SEQ ID NO: 108172 - DNA, 597 bp, Oryza sativa
tcacaatgtcatttttcaccacagctatctgttgtcatgatattttaatagaagaaacagtaattattacaaatttgcaacaccatgctaacaggcgatgacacatacgaatgaagagcaccaacaaattgtatgaagcatgctacacaaaagataacacataatcactaaaataaactatgaaagtcatggtacatagaatgccatagtggcatggttgaatctcttttaaaatcacagacaaggttgatatatgttcaaggtttcagatgaaagattgtcgcacctaaaggaggatagttggggagatacaacattaccagattgttgttttcttgtgaaattaagcacttcaaactttaatgaacttgtattatgatatttagctatctatggtcatcgatacttctttatcagttacagaggtaatataatctataagatgagtgctatatatgttctccatccattcaaagccacttccctattcatgggtttataacataatttacaccatatgaaattactggtactttattatttaggtcaaaggaagaaaaatcatatagctattgcaaatcaagtatatatactaga

SEQ ID NO: 108173 - DNA, 527 bp, Oryza sativa
gcgcacacggaattcttctcgaggtgtaaaccccgtttggtaactttggggtattaatcaaagctgctaaaccgtgcaccgctatgtgccacatgggcgcagcattcttcccgagctccgaattgataagttggatctggtacggcgtagcgtacgcattgcatgttgcgatcgatcgatcgatcgaagtcccggcctgggcaataattcgctggtgcacatccacacacaccgcaagctgacagcggctggctgacgtggtggaaccaccaatcggcattacgaacagctcggcaacgcccaggatgactcgtcactgacacgtggatcccatagggcacatcacgatcttttcttagagaagggtattttttatcggcctctacatccgaccggatatatgcaatatttttaaattataaatttagcctaacccaatctaaaatttgctatcatgaatatgctacttaagtcaatgcaaccgctaaactacatgtggcacgtcacaatcctgcctgcgttgcata

SEQ ID NO: 108174 - DNA, 916 bp, Oryza sativa
ctgttttgtttttttttctcttccttctttttcgttctctttctgttttggttttttcggttttttttctctttctttttcccgttttttaaagatgtatttatgcaaagtttctttttcccgttttttaaagatgtatttatgcaaagtttatattcatatgtataccaaattttgtacttgtatatatacaaagtttgtattcgtgtttttttctctcggtttttaatatatacatatacaaagtttgtatacgcgtatataaagtttatatacgcgtatacaaaatttgtatatacgtatacaaagtttatatacatatatatttttggtacacataaaaattatatatacatgtgtgtatatatatatatatacactttgtatatatatgtataaactttgtattttatcaatataaagtttatatacgtgtatatatatatacacgtatatatacacgtagtagtattgttgtagtagtagtactactgtagtagcagcagcagcagcgcgcgccagtagtagtagcaggagcagtatgagtaggagtagacgagtagtagtagtactactagaagagcggtagcagcagcagcagcagtaggagcggactggtcgcgcgcccacgctcccgctcattagggtcacccgccgatttctacctgcaagaacaattgtgtcactccgttgaaatgaaaaatttcactcatatgtcccttttctatgagccgaatttcaatcttatatatcactcaaccataaaactaagtacaacacatcattatcctgcaaaaccggtgtaagtgaggttccaagataatattgagtccgataagctaacgtgtgatacctatgtggcttatttgatttggtctttcatcctaggtggcatcgacgtggcacctacttatcc

SEQ ID NO: 108175 - DNA, 551 bp, Oryza sativa
aaaaaaataggcaggggaattatgattaatagtttgttctttgattatcattttgcccacgcggtttggtctttaatcaagtttgcttcgaatattagtttacctaatagtacaactcatatgtttgggcattggataagaagacaaccgcacaatttgagatctttggtcttattaaggacaactaccactatttggtctatttggctttgcagaaatgatgtggtttttcaaaggaaaaacatatcttctcctttacaggttattttttttattacacattggctctgctcatgggctatccttcagaaggtcaatttgcggggtactatcattgcggcttgtcaacaattggagctagtggccatggagttttctaccccggcacatgggtggcgttctaggctacggttagagggctcctgaagttctttttgttccttctattttggatgatgagtttatcttttgtttcttttttgttggctgtgtgcactctttgcgtgcaaaagccggaggtgctctcagaataattgtatcacttgatgaaa

SEQ ID NO: 108176 - DNA, 685 bp, Oryza sativa
ggcttatagaaaatcagagtggatgtaaagagcagtaagtagctacttcctccgtcccaaaaaaagacaaaccctggtttccatgctcaacgtttgaccgttcgttttatttgaaaaaatatgaaaaaaattaaaaaaacaaatcacgtataaaatattaatcatgttttatcatctaacaacaatgaaaataagaattataaaaaaatttcatataagacggacagtaaaagttggacacggaaacctagggtttgcttttttttgggacggagggagtaggtgccaaaggagtatttactccaacatcagtccaagaacaagcttgaggccatgcaaggtgagctaagagaggtgcatacttgcatgcatatactcctatatttcaggggttacaaaacactaggccctaggaacacacatattcctggctaggtaggctgctagctgcatagtaatatcaaatgctaaaaagcaatcgaacgagattaaattgtgtgttgggcttgggatgcatcaggagtgttaaaagctcaggaaactggccccacaagtaagtcactgtcattctttcctaagattcctccttttaactttcgtgctagtgatttacatgcttcattttatatgaaatatattttcctttgtagtatatatccggcaaactgatgggattctcttttct

SEQ ID NO: 108177 - DNA, 700 bp, Oryza sativa
cacaggaaattcgttggtacctgttcaggttatttttcatgaccgtatagaaaaattcatatatagctccaattaaactgaagcttcagttatgaaacacgaatgcaacacatgtgtgtatgatctcatctgctatgatctcttcttcatggcaagagaaatacccttatggtgaactaatttggcagacaaatgcaccttcatgaggggttggcctcatcaagaatgttgcatattctgcctgcgggaacaagaagattgctcacacctgtttgtcacattttaattcacagggtgggtctcgagattgatgcgaggttggattgccattgacttcccaatccctgcgtcggacaatccctgcctctctgactggtggttgcaggctagacaacattttcagacatgctacagggcgattttcgacaccgtcttcatgttgacatattgctggttcgtatggaaggagtgtaatgcgaaaatttttttagcagagatcacgaacacccgagcagctggtggaggatcaaggaagagcttataatttggatggcagcaggagttttcacggaatgtaataacagcaacaattaatctttcgttgtaagaaccatatttttgttgtaaactttacatccctttttaatgaaattggtcgaccgaatctttcggccgacccgacaaaaaagaatgcaacaca

SEQ ID NO: 108178 - DNA, 589 bp, Oryza sativa
tccacattttggaagttttatcccaggggtattttggtcatttggacaaaattgtacagtactaacggagactaactggacggcgatggtaaatcatagaagttaagtaaaagtcgatggtatattatagaacgtgacaaagtcagtggcaaatcggagagctatgacaaactcagtggcatataatggattgtctcttagggtttcgatcctcccccatggacacctgcgacgctaggggctactcctcatcttcctctgccacgactaggcgcttgcaatctctctactccttgtttggtgggaagtacaccgcgactgtgcaaattgctcaaggagcggcagggtcgggcgactgtgcagattgcttggtgtcacgcccagaaattcacgaaccagaatttctaagctgaatgtgcattaaatccctgtccaggaccagccagggtacacaaacgacaattgttgacatacagatccacgtcttacaaaaatataaaagattacaaatacagcggaaaagacaaaagcgagctaagcctgaagacttgactcctgcacgaggcgactccattccacaggcatcctt

SEQ ID NO: 108179 - DNA, 514 bp, Oryza sativa
tataaaggtctacttaattagtctagaccgttcatctttcccctatactcctttaaaagaagtagtgatgagtggtgaatctgccaccatcccatcaccaactccctagccttttgaaatagagaaagtacatgtggggtaagagagtccatctgtgaaccacccttacaaccaaatatgtactttttacggaaaggaaaatgatagtgtgggctagagggtctacgtgtcagtaacaaatatatgtagaaattaggagatgatgtatatagaaaataatggctataatgagttaatgataattttcattaattaaaatcccattgcgacgcacaagcagtatgctaatttaatctgatagatcatatctatttatagaactaccttaaactgctggcagtagaattcataaataaaagcttgagatcacttctcctcgtgataatattgggaatacttattctgtcccactgaataaagcgcacacccattttaaaatttaactctttaaata

SEQ ID NO: 108180 - DNA, 976 bp, Oryza sativa
gagcttttccttggagctgccttgacgccatgatgatgtgtggcgtggaagtgcaggaaacccagccgctgcagggaatgaggttaatttgctgcagctgaggtgggaagatctagcactagcaccggctgcgaggattgtttagtaagaaacacaacaggaatattttaaagtgacacattcaaggaacatagtagcatttttaagagaaagatatgttacaaagtattatgtactccctccatcctagaataaattataaattaatctgtagtacgggcaaagacgtttcctagcactatgaatctggtccaagtgcatgtactaggatatatcacatctcgtactagatttatagtattaggatatatcacatcccgtattagattaatttattctaggatagaggtagtaatatgtagtctagctaagtagctagcttaatctcaaaaagaaaacaaatgataacactagctagcaggtataaaaaaaatacattgcattccatgtcattaataatgcacaacttacagtctttcagattgatggtagagcaatacaaacctgaaaattgatcgaatttcccaaagcatctcatgcctatattccaacatagctgggtaatatttgcacaagtgaaatactagatcaatcatgttttatctgtcatgaccaacagagagtgtctgacaagtgatggaggaatggaccaatggtgtcggaggcccatatatatggccatatgtatatcactcttcagcaatttttatggtatcttcaaagtgattcactcaacaactgaggctctcatattttactctctttcattatgaccaccaaactccagaaattttgaatcaaaattgtgaaactaacctctgccttttcctagttataatgctatatgtcttcatgtcttgcctgtgcataactagtgttccttctgttcaatggattattagcatctctcctgata

SEQ ID NO: 108181 - DNA, 509 bp, Oryza sativa
tttttatatgtaaattcaataaagtctaaaactaatttacatatatcatataagtaacttaaaaaaaaaacgaaggtaactttaattaatgccttttttcattgaacaaattatcatatatataagttacttttagatttgattaaaatactttatatacattcataatgctctgaggtgattacttttttttattgtttttagttaattccataatttgtgccgattaatttaatttcttgatagagtcgtgtttttatctctataacggacttacttcaaatgacatgccaaagttaccttcgttttgttctaagttatttctataatatatataaattacttgtagactttactgaatttacttttatatgtttaagaagtaatttagtgaaatctaaaagtaatttagacatatcataaaagtaatttgtgatttttttatcaaaatataatcatgtgagatcttgttgtaaagatttaatagttacgaacacaacaatgtaatc

SEQ ID NO: 108182 - DNA, 510 bp, Oryza sativa
tgtgtgtgtatatataaccgtttgctgctcacaactgacaaattgtttatataaccgttggcagatccagctaggacatgagaaggttccgtgacatcactaaagaaatgtatatagtctaggtcaatgtgctgaaattatttggtttggtcatttcgccaataatgcacatgcaggtacatgtacatcttcaataaccaatagcaatattagaaatttaacaaggtcagaaatataccgtttaatataaaaaagaaatatactatacgtacttaagactgcgtttgttcccgcgctgaacaacccagatggaaactggagcaagcaattagcatatgattaataaacttgaaaaataaatttatttgaatttttagaaacttttatatgattttttctggacgaaaaatatatatgttgtttagcagttcgggaatcatgctcactgagaacgagatattatctcattctagatacaggaacaaacgcgaacgaagtgcgcattaagag

SEQ ID NO: 108183 - DNA, 569 bp, Oryza sativa
tcagatgatgccaaacagatcttattgaactgccacaaatgcaggagctactgttgctttcaaggtactttcacttctttacaggggatgttatatctgaaagatcccaatgcaaattattttgtggaagtattcagataactttattgctttagtaagtttggcatctcaatgaattgatgcggtacagcataataccaacacttgtattttaacctctatatcttagataattgtttggcaagatattttaataaatggtgtggggtaagcaaataaggcaatttgcaatccatatcttaatgcttgtaactgcaagagtttagaaagaaaattttctgtaatctagtatgcagaaaatgctcaggcaagagcatgtcgatcgcttccaaatcaataatttcagaaagtaacagtctcctcacgaagacatgaagtatggaacgattatttgcatcaccatcatgcatgattgtattttgttctgaatgtttggtaaatcatgtgcagaagaactagaacaatagttttttctccatgttcattatccactttcacgaaaggatgct

SEQ ID NO: 108184 - DNA, 666 bp, Oryza sativa
ctaactagctcgtagtgacagcagagacataatgatattgtgtctctgtgtaggatgtacaatactaaatgcatatttgcaactaaaacaagctagtgtgctttagtagtgcttaattaaatatgagtaaatttcagaaagctccgggttttcaattataaccacattttggtgtgttcaatcataaggcattcagatccctgtggaccctgccccatgcatgcgtgacatagctagaggagcagctagctagcaacctggaagcctagcaataaacaacttatttagatacacttctaatttatttctggttcttacatcggtttcaaccaatgtccatccgttaattaactgcacctgcacgttaattgaatcataattaagtaacattacaggattgtattcgagtgtatgatcatgtgaggtctgcaacgttctaccaatcaaacaagtggagtagtacttgtgcatgtacagtttcaatctcagaggctgaaagtatcaatatttttcatgttttgaatttggaaagttatgacgtgctaatgatcttagctaaccagtaaggcagtaaccacctagcgctggcttcagctgacaaggaattttttagatcaaaagctgacgaggatcggaatttccatcgagcagaatgcacagggggag

SEQ ID NO: 108185 - DNA, 682 bp, Oryza sativa
attgagggggtgcatacatggtgaaaatagatgaggtatagctaaaaatttttctggaccgggttcctgggcaccccccctaatatactctagctctgcccctgcctctgctccatctagcgggaggggagtcccgctcctcctctccatcgaccgactacggcttcccgtggcagtggagatggtggtgggaaggcggcggtgccctcctcctcctctcaatccgacaacggccacagtggtggagaatgaggttattgatgtgcttggatcatcttgattagagccgaccggtatttttttttggctcattcatccttataggtgtcttttttagctaatatcggtacctataaattatcataggtgagttatagaaccggtcattagtgctgcttgttgggtgccggttgggaaatccgacacctatgaccggttaccaactggcaccaatggccttttctgtagttatgtgaaaagaccaaaatcaacctcaaatttaaagtattacaatttaaattatagcaaaggctgataaggtgaaaggaaaatgatgagaggttaggtcagcagcggagcccaggaccggccagcacgggcaagtgcctgggctccgctacttgcaactggttgaatactactaattactcctaaattgtttaccaaattagctaaccaaacc

SEQ ID NO: 108186 - DNA, 805 bp, Oryza sativa
tttgccatggacgcacgcacagtgcgagatacatctaaaagaggcgacaatttctccaagctttttgcagccacggtttgacgcgatagagtggtagtcgtctcgtacacagagacagtgtatagtggcggcttcgataggcatgcaatgcatgattagtttggatcggtcaagctaggcggattgtcgattaattattgggggggatcagggatgggactcgggaacagctgagggaaaaagaatttcatttcctatatatataatcgtatatctcatatatatatatatatatatctgtttgaatgattgaatcctatccactactctatttctcctaaatattcccatgttatttatgtaaacagctgacaactacgtactaacatactccctcaatcccataaaaaaccaacctaatactacatgtaacatatcctactactacgaatctagacatacatatgtatccagattcatcgtattagaatatgtcatatccgattctagatttgttttttatgggacagagggagtacgttattatcctttgacaatttgattattaagttaaagatttaacggatctttgctatatcaaacttggatagaaaactcaggctagatcttgcaaatcgctttgatctttctattagctccatgattcgtcctccagcgatcctctatctccgacagcaccataaactctgactacagtgagaggggttgtgggcagagaaccggagcacgagtgttataaaaaggagagggatgtgatcgaggacgttcggtataaatccgatgg

SEQ ID NO: 108187 - DNA, 540 bp, Oryza sativa
cttgatttctccgctacttgttccgtggaaagccatgatccctctttgcaatttttaatcttttcgagagcaatttgaccccaatctaatacaatatgtcatgaatatattctttataatttttaatcacttgaagaagggattgggatgcatcaagaaattgactaccctacgcgcaatctatgcctgttaactgcattttgctctcagtacaaacatttcgagcactgcttcccgtgtggaatctcaactttgtcaaacggaggggtactcttgccataagaaatcgcgaagcaatccaaggaaggatttggagggtattcaaccaagggagcataacatgaggactgcccttcaaagagtctggaggtaaaaaagttgccagatctgcgacgcttggccgaagcagtaatcctgcaatttgcctcaaagctacctgttctttcttgtaagatattaatataaaactgttctttcagtccttaatccctcttggcttccattaattaacctctcttatatattctcaaatatctgcat

SEQ ID NO: 108188 - DNA, 706 bp, Oryza sativa
atattcagcccaaatatcatcgccgtgtagatatgggatatccataatctccacagctgttttttcactttatttttttccattggatttgagtatgaaaccctagttctctgtttgttcgtgattatttttcctcaaccttctgttgcccgtgagttttttctgtcaattgttcgtgagttgggtggaggcgttgttgtgagatgtggctggggtaggatggtgcatcgagcaggggaggctgggagcggttcctttttgggaaacgtcgcgcgcgtgcgggagaaggagcgcaaccttttttttggaaataggtaatgtcgctggttagcgctaagagcaagtataatagcaggctataagccagctataaacacatatcaagaaagaaaagagaagagagaagaaagcgggctataaatttgtagctagctgcaacattgactccaaaacgttatgtgtgtataagagatgggaccggatattaatggtgtagtatatttttatagttaactattgtataaataagctattagattagctatagatgatttggagccggtagctggctaaactattaaacttgctctaacacgctaccacgcgcggtatagtcgcgtccttcgcgttaacttctccgcgcgaatggcttccgacagcatcaggtgtgcatgttgctttcctaatcaggcaaattttccaaatt

SEQ ID NO: 108189 - DNA, 711 bp, Oryza sativa
aacttttggagctaagatcagctgatgctagcggtttgtcagctatggtcattataacatgtcataacttcccaaattacaacatgaaaaatttagacactttcatatcctccgagacataaactgtacatgtgcaaggtagtccacatgttgttaggttagaattattgcagacctggcatgatacacacaaattgggcgttaatgtgcatatacaagtttaccatattcttggtacctcgaggtaccacaattttttttactttgagatactttttagtgtaaaatttgatatctcgagttacttagtatatcaagaaaccaaaattttatgtgtaaaatgtgatacctccttatagcaaatgttggatggtaaatttattcgaaactgtacatgtgcatggccctccacatattgatatgtagagctaccattactgtaaacttcatggctacaaggagcacttgtagcatttgctaacccctacatgatatgcacaaatgtatagttatataccaacatgcagatactatataattaatggatcgaatggggttcaaaaccgatataaggatctaaccagaaatgcaagcagctgcacttgagaggcagaaatctgaaatacaattactcaccaatggcatgttctcactttgaagtacgaatatataacataagcttgggaggcaatgcgattgtgcaagttactg

SEQ ID NO: 108190 - DNA, 516 bp, Oryza sativa
ctccaccataaagggtatcggtgtctagaccttaccaccaacaaggtcatcacctcgcgacatgtggtgttcgatgagacatgttgtaacgccccgattttcgttcgggaataaaaatcaattaataatacattttctagaaattaaataaaagttaaaccaatttaatcaagtggaattatagaggaaatttgaaattttcctttaaaaatcattggtcgggaatattttgtaatattctttgcgccctaatgtactctccagaattttccgtgaattttcggagctcgagaaatagttttaatagcacaaagatcattgcatcaattaaaataaaaaaaaacaattaaaattccacttcctctctttgggcctttttcggcccaagtcttccttccctcccgcggcccgcgcgccccttttctctccctctcgggccggcctcctccctcggcccgctcggctctctctctccctcaagtctgctttacctccctcgcccgttttcccctctct

SEQ ID NO: 108191 - DNA, 732 bp, Oryza sativa
  unsure (1)..(732): unsure at all n locations
agccctactatttttccaccaatcacctcccatttaaattctctttattttgatatctaattactctcttttccttaacaatatcaataacacatatataccagttttaccaacaaattattatttggttgcttacatgctattttatagcttaacgtgtagtggtagaaatgaaaataacaaggtacctaattgttcctcgattgaatttttctctgttcgttgcttctcgctttcgtcatctttctctgaaggagcaaaaaagaaagagaataatttgaattcgatatcttgtagtaggtaaaaggatatgtcgtaattgttgtcgcttgattagtatgctctctggaatgacgtagctgacgtttaccttgacgttggcctgttgatcgttccgtgtgtgtactagctacctnctncctgtggccttccttcagtcctctgctcccatcttctacagacttcacaatttcagcaaagaaaaggaacgggattatctaacagcaattcttaatcatgtaaaggctgatatataccttgcatgcttgattcccttgatatgttgtagcaggaatcgatcagtttactagttgtgcttggcctaaataagctgcggcaaggaaatcangacatgaacctcatgtggaaagatgacacatgaatctcatgtgtgctacttagacttctgagtttcaggcaacaaaggagatgatatagcagccatatgagaaa

SEQ ID NO: 108192 - DNA, 524 bp, Oryza sativa
gccgtccacgatggcagccatggcggcggacagaaacatgctaggaactcgatacaagcagggaaagaaggtcgtctagaggtggtcctgctagtgctggggtgcggcggcagaaggtcgacgacggcggattggtcgcacggccggtcttggctatggctggagaaaattttggaatagaacgagtttagcgcttagaggtctagagaggaaaccagaagtgattcagacttctgtgctcatttgctttgaggaagaggaggattggaaaaggagggaaaacaaaggagggattggcaacgagcagctgcgcggttacgagctcggggcggcacatggagcagcgcaagcaggagcgaggctgcacgcgacccgactagcgcgtgcgaacgcgggcagggtgcagggcggcgcgagcggctgctgcctcggctgggccaacggcagccgtgggccggaacggcccaaactgagggagatgggtggaagaagtgaaaagaaatggactacatatatatttgtcg

SEQ ID NO: 108193 - DNA, 778 bp, Oryza sativa
atttgggatgtttctttgatttgggatgtataatctgtggtgtatatgattgatttgtgtatttgggatgttacgttgatttgaggatatgcatcccacctaatttgggagaaaataaattagagattttgatttgaggatatgcatcccacctaatttgggagaaaataaattagagattaagcggtgagtagcaataaatgaaaaaaaaaactaaccggtactgccgctgaatctttagtcccgaaataaggatctttaatcccggtttaaaatccgggacaataggggggttacaaaccgggactaaaaacgatctctccaccagtgatattctcttgtcagttgctaaaaatttggagttcctttctctaggtatttcgctctccatttgtagcggcgcgcaagcccgtgttagtgatatgccctagaggcaatcatagagatgattgtatcacacactatgtttacatatttatccgactttgttccttgaaagagataaactcattattggttaatgaatatgtgattctttcatgagactctttatgttatgtgttgctatttctaaaggatccctgatcaaatatcatatgtagaacaaatatgtttagatgatcagcacatatattaattgatgatcatgtcttatggatcatggtatagagataccaaattactaatgtggacacatgttggtgaatatgttgttggatagacccaacatgagacactgcaagagccatatgtgttgtgtcatcagtgatcccattta

SEQ ID NO: 108194 - DNA, 615 bp, Oryza sativa
gtccaattaaattattaaacaaattcaaagatatttgcttaatactatattttatctatttgtcaaagaaataaatcctatcgatgaatctttttttatttaagatatttacattccataggtctcatttgggttcaaaattataaaatatgccaaatatcacatacatattctattatacaaataatattccaccatccaaattataacaattattggttatttatctgaaaagatacataactaataattgctactactccgtcccaaaatataaggatttttagaatagtatcaagtcaaacattttttatctttaaatattaatagaaaaaaataaaaaagatcaatcatgtaaaattgatgttacttgatttatcattaaacaaagtattatactatgcaactctttttatttaaaacatcttattttatagatattattggtcaaattaacatctcgaagactgtgtcaaagtctaaaaatacttatattttgagagacggaggaaatatattttaggatgaaagtggtatagaataaagtggtgggatggcagattggggaccaccagcatgttgtcttaggtcattcacaatgcagtgatgtgacac

SEQ ID NO: 108195 - DNA, 2962 bp, Oryza sativa
agccaactaccgaaaatgacctatcatgtttttggattgttggaaatatggtcaagaatcggcatattttaatccaaaatgttaaagcaataatcatggcataagcagtgtaggttgatcttaacataaccagtagcatactatgcgcatcatgaatgtgaagaacaggaacattacagcaacgcaataacatgctagaggcatcatgaatatcaggaacaggaacatagcgcacatagcagtaaagcgctaacagtgggaacaggaacaggagaatgatataccccgagaatggccctccgctggattatgaggcagaattgcctccgttgatgttgttgttcgcgccaccggctccagctcctggcggcggcgcaccacctccgccatttcctccagcagcggcggcggcaactccagacatggcgagcagtcgtgcgggaggcactcccaaaaaacctgatcatccgcctacccggtgcagatctcaggtgaaggtgtggtttcggaggcactgctccttccaatctctcgtgctcgcaagagatcagaagcgaggaagcgagaacagcataggcgcggaggaggaggaactaacaccgggaaagaagcaatcgatcagaacagatcggactcgcggcctccttatctatcaggagagagaggcaatcgtgaaaacgtggacgcgctgttgcggagagagtcgtgggaacgtcggttagtggctgcaaaagaatagcgacgtgacgcacacacgccgctagccagccacgcctcgccctcgccctcggccacgccccggcccggcccgcgcgcgcgtgcgtgtggcattccgacccccacctcaaccagtcaactgggagcctccaataactccctatttaggttgagatattcctcgcttaaatcctgaggtggtattattatccttaacatttattatgggcctttgagatttaataggataagttgggcctagcccaattattctaacaataatttcatttcacagcttgtctgtgaggatgttttgatttgagtaatatattttcccttcccaaaaaataatattggtcaaatatttaaagagttgaattttaataagatacatgtgcatcctagtgagggtgacgaagggagtagtatgcataatacacatcgctgaaaatcttgtcaagtttatttccaatgcaacaaatagtgtcatttggatttcccaataagaagtaaagatcaaattactgaatggcttcgcggaatccaaatgcgaattgatttcgggatgaccttcgaactagctgtctccagcaatttcacagccatttcatcacacaactaggatggttgttcttagcgtaaatatccctggtatctaagtacttgatagactatgttgattcaaatataaaccactttttgtcagtagtgtgatactctctccgtttcataatataaggcacaactatttttttgatgtttcataatataagacatacatgcatgcatacaattaattaggacctcttctccattaaattattgcttttttaaatcatccacccttaaaatttctaattctattggatgcatgcattacatttattagggtgatccaaactaggagataataataattgtttcttgatctttgggttatgggtggttgtgtcttatattttggaatggagggagtaataaatatttgagaaagatctctacacctttctcttgtgattgcttgcagtattactaatatttgatcactcttcttcataagtgacaactattcaccacgggaggattactgaccaaggaaaccggtcttcaagccattttcggttaatttctaagagaaaagaattagagggatttattttacaactattatgatgtggaattattttaccttaagccccttcaaacggaatgaagccttacctggatctaccactcttccgtatagattcagatccaaagtctaacttcaacagcggaaaggcaaataatgtgaacagtgtagtcacttcaagaagagtttgtaattaaccatttaatctatccacatttgtaacgatcccatattcccatccacaataaacagacaagaagaccgattctgatatagtgcaatttatactatgctacctacatgttaatgtagcatatctctctgtttacccatctgaagtcggaggattaggttccctttcgcatcagctaaaaatccttagtctatatcttatttggcaatttgtcaagttggcagttttgaagttttcgaagtgttaattgtagtagttacaggtacagatctagtagtgccacttggatgcaccattttcctacacagatgtataaatcgaaaactaatttaatagtgctatttttctagaaaagtctattttacacaatcctaaactgattcagatctactcaaggagctggtctgaacagggtaacaagcagagtggatagaagtagttttaggaaagggttaatttgatgcatgccactataaatatgacatattaaaaaaatagcgtactaaaggagctggtctgaacagggtaacaagcagagtggatagaagtagttttaggaaagggttaatttgatgcatgccactataaatattataaatatgacatattaaaaaaatagcgtactagaggagctggtctgaacagggtaacaagcagagtggatagaagtagttttaggaaagggttaatttgatgcatgccactataaatatgacatattaaaaaaatagcattacaatttgtgttatcgactgggtgccactcaaaatttctaaaattaaaaccatgccactctcgtaactaatttcgtcctcctctctcaggtcgccttcctcaccgtgacatcatgcacagggctccaacggcaaggtagggacatcgtgcaccgggctccaatggtgagcttcccaaggagggcg

SEQ ID NO: 108196 - DNA, 1149 bp, Oryza sativa
gggaccgatcgctgggcaatcgccctggcgatcgatcgcccattaggcccgcccagtatctaccatcagaagctagccttaggtgcactctaatacatgagagaaggttacaaatttagatttgtaccaatttcataccgaaagagtgcaagttaaagctacaaaaaaaacatcaactaacattctgttctgcgagaggtggtgtgcacacaagataagcagcggaaattgaatgaacccgtattaacctttcaaatggttagttctgaacttaatttgtctattaaatattggctgtgttcgctaggggaggatgggaacctgcacagtgcgcacggaaaacggattagttcattagcatgtgattaattaagtattagctattttttttaaaaaaatagatcaatatgattttttttaaacaactttcgtatagaaactttttgcaaaaacacacagtttagcagtttgaaaagcgtgcgcgtggaaaacaagagaggagtgttggtaacttgctcttgcaaacacaaccataggtgaacaacgggttaggttacttctggtaaaaatctactcatgtttaacttctagtctatctcgacataggtgctcgtatttattgtcaatttaacttttattgttgagcgagatatacacattgacactgagacacttgagatgattccatcattttaaaatatgacggctcagtctcggttctcatagggaaattaagtgtatattcatattccatagggtaattgtttctgcgtgttttatgagcgcatatgtccgtattatgttttgaaagaaatgaatagataatactcatgcctttttcttttaaaatatgtttgaaactttttattttatatcaaatgaatatatatatttttacaaatttatagaaatactccttcctctgggattttttttttgaaaaaaaagccatcatatccttccggaagacgggttatataatataataggatgagagtcatttcacatatagatcctttccactctcttggttgatgggatagaataaaccatggtggccgggtgcggggcggtggcgtcgccctcctctccgccagatccggccggaggggaggcggcaggatgagtggccggccggcggcgggatgg

SEQ ID NO: 108197 - DNA, 619 bp, Oryza sativa
ctagaggatcccccgcgacatctatggctatcaatataagaccccttagggaggggaagacaagcccatacaaatcaacaagctcagtcagaatagataccaatacaggccaccagacatcaacatcaaagatcagcctagacagacccaatctggtgccatcagaggacgacaagagggatctagcatcataggacgacaagagggatctagcactatccctgatcttgccgagtatgtattcaaggaggaagactaccccgtcgtcgactacttgttggagctccatgccaccaagccaacgatgactagatagggcatcccaaatattatacttggggaattcaaatgaataacagcaacaccggcttagggcaacaagagtcgggttataaccttccggggaaggggcccaaacctgtaaataaaatccttggcctctgctgttttacctcaacctcgcatatattctgataccaacaatgcccataccatgcaaataccgttaaacgtgatctcaaacatctacagcggcataccagataggcccattggttcttcaaggtttcgaccacatggggccaagaaatggaacctgcgacaacacactacttgatga

SEQ ID NO: 108198 - DNA, 541 bp, Oryza sativa
cacctatggctgcgtttgcaagagcaagttaccaacactcctttgttggtttccacgcgcacgcttttcaaactgctaaactgtgtgtttttgcaaaaagtttctatcctacaagctgtttaaaaaaaatcatattgatctatttttttaaaaaaaactgctgttacttaattaatgacatgctaatgaactaatccgttttccgtgcgcactgtgcaggttcccatccttccctagctgacacagatcctctttaatagacaaattatgctcacaactaaccatctgaaaggttaatacggttatcattcaattcacgctggttatcttgtgtgcacaccacctattgcagaacagaatgttcgttgatgctttttttgtagctttaacttgcactctttcgacatgaaattgttacaaatctaaatttgtgaccttgtctcatgtattagagcgcacctaaggctagcttctgatggtcgatactgcgcggacctaatgtgcgatcgatcgccagggcgactgcccagagagcggtccc

SEQ ID NO: 108199 - DNA, 723 bp, Oryza sativa
attttggtgcagatgtggaatgctttaatgtggaaaatttgtggcggaatgctaaatgttaggtgcaatatagatttatggaatagagctttaaaatataaaattctactttgactaatctgcagtctaaaacaattgtccgatcagtaagacagatgatgttgttaaaaagaagttattaattattaggggcaatttcgcatttgatcctgttttgaggactaaggccgtgtttagttgttttggtaaaaaaaattgtcgtatacggacacacatttcaagtattaaatgtagactaataacaaaacaaatgtctgtaaattgcgagacgaatctattaagcctaattaatccgtcatcagtaaatgtttactctagcaccacattgtcaaatcatggcgtaattaggctcaaaagattcgtatcgcaatttacatgcaaactgtgcaattggtttttttgtccatatttaatgctccatgcatgtgtctaaacatttgatgtgacggaaaagttggaagtttgaagggaactaaacacagcccaactaccaatttgaccctcttctttcaactttgctcatttgagccttcttttcaaaattgaaaatataatctgaccctactccgttaagggcatgtaacggtgttaattggagcaacaaatgccccttcttcccttgcttatttgattctattttataaaaaatataaataaaatata

SEQ ID NO: 108200 - DNA, 624 bp, Oryza sativa
tttgtatggccacatgcgggggtccaagttttggtatggttgtggttccaaatactgtgctactaatgtttgcttttctataggacaagtgtgaaagaaccttaaccatgagaatgttccatactattctactgttccatgtcccttttaactgtgaacacaagcaaaggacaggtcttcattgacatgccatggtaggataccagtaaatggcttcgcttctttttaactgttatatgagaaatgagtataactccatggtctactttatgcataagttacctttgatctgttcaagtagtttgcagtgtacttgaattctttgttcatggttatgtacataaataagtagtttagattagatattgtaaattttctctttcagcagctgaaactaaacatgcatttacaaattgtttgcatgtaatttcagaggtaaggtttgttgtcttgctgattcatgaagagatggcagtatgttggtgtgatttcgatacgtgacattgtgtttggtaagtgaacctatgattgtatttggacatggttgggtcggcccatgtggacatgtgactttgttttggtcagtgacttatggctggatatgcatggtcaatgtactgatgt

SEQ ID NO: 108201 - DNA, 989 bp, Oryza sativa
gtgcaatgaacagtgacttttcctatttatcccgattttagtgtattttccatataaatttgaatccacaattcctaattttacatatatgcattttactcaatatttgtgttatcttaactaatgaattcaccctagattaatattacccatatttatttatttatcgcacaaatgaattctttttagattaatttgagttattggccctaaggtgaacttatatatttttgaagactttggggtactattaagtttaatataacgacttgtcatgattaatacattagcagattggtcaagtttagttgtatagcaatatattttacacggataggttcaatctatttattctataaatagtaaattgagactcggcacaatatttatctacttgtttaattaaacactcacatattcttatttatgtataaagcctaatttatttatatgaccattattttatatgagtgattttcatgctatgaggagcttgataaggtgtttcaaatattaattatatattctagtgagatgctctattatagatggggccattgatgtgatcatcatttcatgtgtacttatatttcatggcacgcatcacatggttcaagtatttaatatttgatccataaattaaattgctaattaaccttccctttgtctggctttgttttctcgtgcgtaaatatttatggggttcataataaatatcttattattataattattacttagctgtataactttagtttaattttccattgtgacaatttatagtttggcaagtaaaagcaaccataacatccagcatgatgcaaaaagttttaaaaagttcgaaattttagtgatttttattgttgggaatttttaggatgttacaataggaccccccttaaagaaatctcgtccccgagattcggtgggactacggtgacattaaactagttcgactaaaatatcgttcgacaacaaaacatgctaat

SEQ ID NO: 108202 - DNA, 1185 bp, Oryza sativa
aaaaggattcaagagtttcttgcctttcttctttctcggtctccggaagaacgtcgtgctaataacgtattacgcaaccctcctgctacacgaagcagtctaaggggtcccgtaatgtctacaagaattggggacacagagatgtaagggtaggactcttttccttcattcattcacttatgtaacacaatagcacctcctcccctctatatataggcatagccatgagtactttccatatttagtgatgggtccaattagtgggtaaccgggccagaccttcatgggtcggcggtttcctaacacttgctacttgctggagggtcccgtaatatctacaagaattggagacacagtgatgtaagggtaggactcttttccttcattcattcacttatgtaatacaatagtacctcctcccctctatatataggcatagccatgagtactttccatatttagtgatggacccaattagtgggtaaccgggccggactttcatgggccggcggtttcctaacactcgctacttgctggctgattgggggaacaatgataaattcttttcaatttatttcctgaattttcggtgatgttgatcctttactcacctatgaatttttttggttgacgtctatttgtgttaatctggtgagctttgagctctgttgtggttcgttactcacctctgatctgtatatgacgtgtgcgtactagctattgcatcttcggtgagagggcaaagagaaaactaatgctggtccacggtgatgggtcgcccatggaaggctcatggatcggcgggccaaccgtgttgtgtgggtcggtgtgacccgtgacccacagataaccagcttgggtatattgggtcagacactggtggagaaatcatctttggtcggtccggcaaaatacacaatagtcccggatccaaaaagaaccgggatctttagtcccggttcatcccttgtcagatgtatgtcagggggccgagaatctttagtcccggttgatgttaataaccgggactaaagattaccactttagtcccgattggtaacctgttggtaatacgaaccgggactaaaattaaacacgtagtatataatccctatcactgtcctctcattcacagtgacagatcgaatctcaccccctctcctcagatctatcctctctaactct

SEQ ID NO: 108203 - DNA, 677 bp, Oryza sativa
  unsure (1)..(677): unsure at all n locations
tctctttttttttgccctttactcctgtaatgttcccagacttgctttatattgtctacttacttttaagtattgccttgagtcaaaattttgaaaaggggggcagtccagcctgttatattaaatgatcacttaaatctggccatgagtggaatgcagccacatagttctagctattctgcaactattggcaaaatactattttggtttctccattgaaggtttctgtaacatattgacttggtcaagaacagttcatagtcttacctagcttgttgagtatcttgattgtgaaaagacttgggagcaatcttgctaggtaacctacaaaggtggattgagaaagcgattttattatttnnnnnnnnnnnnnnnnnnnnnnnnnnnnnnttatgaggctattgcatatattttcctgattaagtgcacataggttgtcatgctattgatttttctgtaatgacagaaggtgacaaacaattttgtgtgcagatgctgtgtttagatttttacgagtcccgtcctgcaagagacgtgattatgaatcgccctcactacagtctcaagagagcttgcataaccggattcaatggcaatggagggcaagttgcactagtaaaatttatcctcaagaatgcagtaaaattggaggaaatggttatagatccaaaaggtag

SEQ ID NO: 108204 - DNA, 641 bp, Oryza sativa
  unsure (1)..(641): unsure at all n locations
agagaaacttcgggagaatgaatagggcttgggtaggaagaagactatataggggcatctttgcaggcaggccatataagtggcacctgtgaagatcgatcttcgcaggcgcacgacgtttgccgcctgcgaacatcgatcttcgcaggcgacgcttatatggtccgcctacaaagatcgatcttcgcaggcggaccgcgccctccaccccgggtacattttttgccagtggggttttggctccgaattacatgcccgcctgcgaaaattgataccctacgacgccgaaaatgagttttctagtagtggccggcaccagagttgcagccctctcttgcggacgcttttgcctcgagcttcggttattgcagccttgctcacgaccacgcgatggatcccctggctggcaacctcgcgctagggttcgcctgcatggcagttagacgaaacctagctagctaccggccaattttgtactgtgtgttattattttgcaaatttagctgaacagctctcagttgngtcatgtacaaacaatattaatttcgttcatctggtcatgacgatcatgtgattttacaatattcatataatggtatggaaataataccattgttgttgtttaacctaatatatacctt

SEQ ID NO: 108205 - DNA, 705 bp, Oryza sativa
agtagctcatcaagatcttgtcatatatagagagagaataaaatttttaatatctatttattcggtgcaatcaaaaaatagttatagtagtttgtaatatgccgatgatatgattttgttagattttcctaatgtactaatttggcaagtctgtgtaaaaaaaattgaaataaactttgtttttttattaatttacaattaacctttagttaattagttttgaatagcgataagttttttcagtaaaccctacaaatttggtattaattgtgcaaaattttatgtgcatttttttagagatatggaaagtcgggaatggatgtatcattggccgaggtttttgtctccatatagaaacgaagtgtctaaatttattgttattgccaaggcacacgctgaaaagaacaatatgaggaagataatttgtgaatgtgctgactgtaagaatgaaatagcctgggacttcaacgatgcttttaaagtaaaggagcacttagtaactcgtggatttatggacgagtacaaaatatggacacgtcatggcgaagaacaagtggacgggcctgaaaatgtagttccgacacaagttgaagacatggtgcgtgacgatggttctgttgaggacaaaatcgacctacaggaaatgttacgtcatgcagaacccgaggtgctgatggggtcggctagagggttaaataactttga

SEQ ID NO: 108206 - DNA, 918 bp, Oryza sativa
  unsure (1)..(918): unsure at all n locations
gcaagcaatggatcttagtgccattgccatggtggtgagtcgccttccaccatgcttgtcatgcttgtccttgaggcggtgactggcgcggttgcggaggagatgaagagacagcggtagacgctcggaccagaggggggcaatgactatggctcgatggtgtgcacttgtggatggaggcggcgatgacctgagctcagggatggagggggaggcactacaacaaaaccattgttttaagacgtttcacttaagtcattctataagtcgtctcttttttataaatgaaattaaaatagggacgatgtttgagacgctttattagttgaggacatagtttaagacgctttacaggttagcacaaaattaaatcgtttagagatgaatattgagacgtttttggaacatctcatgtgtagaaatgagttttgagacgtttttattatatccgtgtcatcgttattagataatatataattatttatatagagaaagaagaaaataaacacactgatcctaatcgtcatcatcaaataccattataataatattataattatttggaccaaaaaaaataaatatttaatattcagtcttagataaaaaagaagagaactgctacaggacgcatgtntgcagagttgcaatataaaaaaaactatctatttaccttcaagattgtcacgttaatgacttggttagtgcatgaactttgtaacctgcaggtgttgtgttcgagcccagatgaaagcattatatcaaatatataagatgtgcgtgcctatataaaagcgtcttatattttatagagatgcaatttacacgtctctagcaacggcttaaataatataggtacgctttaaaaagcgtctccataattttgagacggtgcaaacagagacgatcctacgacgcttt

SEQ ID NO: 108207 - DNA, 561 bp, Oryza sativa
cacaaacaaaacagcagcaacaacaacttcctctctttccttccttttttttccttctcttcacttctgatttttttctttcttttttttcatttctttcttttttttacagcaagctcaaagcttcagccaacaagtcaaaacaagccttagcaaaataaccttttcccaaacattttcgaaatttcacaagcttcagccaacaaatcaaaacaagaagtaatgatgggttggttggctagttacatgattcagccaacaagtcaaaagtgagagtacttaaatgctttcttgggaagggctgattcacttcaaaaagttgcaaaagggttggctgttggtggaggcagcaataaatgcatttgggggtggttgatgtggtgatgagggtgctgctggttgtggtggacgaaatttggtggggttggaggtggatttcgtggtgaatatggtggtgatggtggcagcgggatgaagataaatgaagtgatggtggaagtgtatgtggtgacaaaatcgtgagtataacccgaacttttaaaagactaaactactagaacc

SEQ ID NO: 108208 - DNA, 568 bp, Oryza sativa
acggcggtgattctaaaattctggttgtttctgtttattttctccatatattgaatttaaccttgatattcctttcatgtgttattttatgaaacacaaaacaaacaaggatgcttatatacatgcacatacacagttgcccttatgaactcttacatgtataccataccctaatgagattaatgaaatcaccacatgtgtctcgcagtcgacgtgtatatattactccgtcggcgattctaatatttagatattagtcaaagtttacatatcttgacttttcaaaaattatgggcatactaaattttaagatggaggaagtaggaggaaaaatgtggagagagagagagatgggtaaatcttatgtatcattcacgtgagaccgtgtatatgtatcagaaaaatacaaaatataattttgacttattttgaagaaaaaatatataaaaactttggatcccacaatcgccactgattttggtagaaactaattgggattggggctagggatgcaagtgggttgaccgcggatcctcttataggtcaaacaagtggtaacccgcaggtt

SEQ ID NO: 108209 - DNA, 866 bp, Oryza sativa
ttttaaaaaatagattaatatgattttttaaagtaactttcctattgaaaatttataaaaaaaacacaccgtttaacagtttaaaaagcgtgtgcgtggaaaaagtggaatgtgagttgggaaaacgtgacacagtggtatggtttcaatttttccaaattcgagtggcatgtagccgatatcgtgaatagtagtgacatttacctaaaatagtatatttgtaatggcatgaatccaactaactctaaatataattatactactatataattatcactatgttttgaattttttatttggaagaattgtaaaacaaaataaaagaagggaaagggaaatcatataaacaaggggaattctaggggtcacctacaaatcggacgcccgatttttttttttttacaaaaatcgggcgttgttccaccaagtagatcggaattgtttcactaagtagatcgaaaatgtttcaatcgtttaaaaagatgaaatacaactaaatcacctcatgaaatattttgctacaatgtatgaaacaatggtttttgaagttgtttcaccatatataaaaataatatttcagcaaatagcaaaaggatgtttcaattcactgcaagatttaatctatacacagtgaaacaacacaagtatacttactgaaatattgttggtagaaaaaaaattgaaacggattcctttaatacataatacaagtatacttactgaaatattgttggtggaaaaaaaattgaaacggattcctttaatggagcgtttctgtaatatgcgagtgatttgttgcaacgatgcgtgtggtgggacgcgtggtgagatggtgtggaagcacgggtggtgcggtgcccattttt

SEQ ID NO: 108210 - DNA, 1099 bp, Oryza sativa
ttttttttggttacaatgtgagaagattaagtacagattgcttgatgcacacatgcatgatatggtataatttcagggcaagatcacttgtacaaagtcagttggaaccgaaacatcttagagtaatacaaattcggagctagtaaaaaatttcacatgatccagtaatactaacaatatgtaagtaaactggcactatatttttttgggtttctgtaagtgcagaaactaacactgaaacaaatttatactccatccttcccaaattgattatcatataatgaaaaacaaattttctaaaattgatcatcatataactgcatggacacggattttatcggagtgcaattaatatagcactgaaaaatgtatgcatgctaaggacctaattgtgcattgtatttttaatcgatgcatgcattgtgagagaatgtatgcatattgtgcatagatgtggtttaatttattttgggtcctagtccacaaacattatatgatgattaatttgggatggagggagtaatctataagtactgaaactaattccatgtaaaattaacaatctgaaactgaaactgattccaggcaaactgtaagtactgtacctcatctgaaactaaaagtcacttgaaaagacaaatcatgatgaaaaccagtaaataatatgaattgacaattgctgaacaactttctcagatgttacagataagatctctgctattccccaatgtgcatctctaaaaatagcaccgtcttcagagtaacaagaggctcacacaaagcatattagcaggcagaacaatttactgaagtgaaactgatctactaggttccatggccaaatctacaaagttcaacatctgtgaagtcactagaatctgaaaaatgaaactgtaaagtcactaggatctgaaactgaaacatatctactaagtttcatggccaacaaacaaatctacgaagtttagaataaattgacaaaccagtaaatacaaatactgcatgagcaagttcagggtttagcatcatgcagaaaccgttaagttatgaattccatggagtactaagttgagcatcatgcagtgtgtggagagttcag

SEQ ID NO: 108211 - DNA, 585 bp, Oryza sativa
tagtttggggttggtttatattatatcaagggttgctaaaaatattcttttgtgaattttgtaataataaatgtagctcggtgagccaagggccgaatggtattttgttattaaaaaaaagccccaatataggaactcttattttaattctagataatttttccttgcttcatattttacatctagtttgttgtctcgtttttctttgataattctttcgagattattcaaaaaccgaataatgtcaagatcggactttagatggttttttcaagttattatttaagctcttatttgaaaacatttagtgacaccttcaccatcttttgttttgctgtgtgaagcacaaaaatcaattgctactagaactcaacacgtgttgttgctatagatttcgccagttttacaagtaatgtacaactcctattttaaacatgcacaacttatgttataaatacatacaagctcttctcataattcagaggctgcatatacgcagatgtaccaatccacagtgacgtgaaactcctttttttttgacgtgtaactccttttataaatgtgtgcaacttatgttataattat

SEQ ID NO: 108212 - DNA, 1034 bp, Oryza sativa
tcctttcctctccaatcttctcgatgcgcagccagcggcagatggcctggtcgccgccgctctgctgcgccagccacgcgctcgcttgcaagctccggccgccgcgcgctcgcccgctagccgcttgtcaccgctgctccgctccaccggctgcacgctcgcagctgcgctgctctggccacctgctccggagccggattaatttggagtcggggcatgtcatgatgtcgttgaattgatggagttgacatgggcaagtaagcaagcgcatggcgcggtggcctagagacacggaggcgcgcccccctcgccagccgccgcagccgcgctcgctcgcctgctccgtacgcttgccgcgatgccgccgccagttgccgctccctcgtttgcggcaaagagaagaacaaaaggagtagagaaaaaaagaaaagagaagatgaaaaaataaaaagaagaaaatggtggatagaagggatgcggacccatgttatttttttcacttacacgtgggaccagattgctgattaggatgccacgtcagcaaaaccacccatacatattgtcatgagatcttgattgcactgttttgaacatttgagaggagaaaatttctgacattagaaattagggatgtcatacagactcgacgtaaagtttagtgacggtagtttaacttattcctttccttttccttttgcacaagctccttttctttttttcagcattgccgttggatgtagatctgatggcgcacagaatcgactgaaaaaaaaaatccaaaattttaagtgattgcagaataggtggtcccaattaataattaagggagtcaatcaatcatggtggaatggggcatgagtccagcttgtgacgtgtccaggaaacaagaatattatgagtttcagtgtaggaattaagggagtcaatcaatcatggtagcaccgcgtaacccgatggatggcgtgtaggaattctccaattggccagaaaagagaatagtcattcatccgtgcacgtcatagtttcagtgccta

SEQ ID NO: 108213 - DNA, 766 bp, Oryza sativa
tgaaaaatatggactttttgaaacaaagataatattatattaaattctattattcaaagatattttaatatttagaaagatattaataatgttattaaactttgacttacttaaaacaagtccaaaactgcatgtccctaaatcgccagaagataaggaacacctgtacccgtgataacagaggggtatgaaatttggacacgaggcttctttggcagacgtggcgctgagtgagcttggctcgcttggtcaaactccgtgcagggacattcagttagctagctagcagcattgtcgacaataagatagcctttaaatgttagcactcaccagcttgtcaaaaaccaaggcttggtgacggcggcttcagaatgaaggatagatggataaatgtctagaatattataaagtccaacaaaagatggagcacatgcatgaaagattacgtacacgaatgcagttgatacagtggatgttaggcataagaagctctataaatagagggtgcaatccccattgccctacacaactacacaagtcgactatcattacaaggaaatttaagcgccccgaaggtatgaaagcatagcagtactctgcattttttttttttgatgttgttctagctagctctgcttaaggttttcctttctttcgttctttgttttttttttgtaagctcaactagttgcatgcaatttagattttatccttttacagttggaaaaacatccctataaatattaccatgaatgcatagagattc

SEQ ID NO: 108214 - DNA, 740 bp, Oryza sativa
agctcgacggcgccgccctcgcgtgtttcttcttcctcctccctgaccaccagcatgatgtcgcccaggctggagagggcgctgcacgtcgcggccatcgccgtctccattgctctgccgtctgcaccgcaggctgttgccgccggccagctttgtccttcctcgtgactggtgtggtggtggagccggaggcagtggcaatcagaccaagcaagtgtcagcaagtgtcattgcgatggcgattgtgcagcgccgacggatttgtttagatttgagcgcgggacacctggtgtgtttggttggagggatatccctagatggaagatgacgattcagtttttaaatgtgtttggttggtgggcgaggatggatagggtggtccagagagggaatatttcacgaagatgctggatgagtgtatccgaccaaattggccggacgaggatatcaacctttactaatctttgatcattagttcttaattagcaataattaaagtatattattgttaattagtaattaacttgttaaaattagtgttgattagaaaaaggtactctattttaatggtaattaggaataaataaggctataataattaatatttaccaaatttaataataaataatacggtggtggtttccatccaatccattttcttccccccacccaaccaaaaaacttgaatgttaatatccccctacccaaccaaaaaactataccattgatgagctactgta

SEQ ID NO: 108215 - DNA, 612 bp, Oryza sativa
gatcggtatggaaagcacagttcccttgggaatttttaggttgccaagatcgatatctgaaccagcaatcctccttatgattactactgggctgtacagcctcagtgattccaagagaaccatgttaacctgaaggccaaatgataaattctcatgcaaaatgagggcaaaaacaacaaattaaaatgaatcgatagatggatggagtaaatgaagggtgagtttgtttgggcatactccttttaattttgtacacataactatgtaaatatctttttttttatagtagggtaggagcctctcctgttgtttcctaaaaaaaaaagattgtttgggcggttcattcaggatttttgttggaatgggaaacgagacaaaccgaaaggcgtatgactaattgagactggaataatggatttatttcattttttctgaaaaaacttttgtataaaaaacatttagcagtttgaaagcgtgctcgtgcaaaacgaataaattgccgcagcaagttatccgaacgaactcagagtaggtttgcaatttccgtttgaaattttagaaatttcgataatttcgccccctgcaaaaaaatccaatttcgaaattgaaaac

SEQ ID NO: 108216 - DNA, 644 bp, Oryza sativa
tttaggttgaaaaagtgatagtggaattgcccaaggaccaacctgaaaacaacctgaatatgtataacggctaggtgacgtcatctagtcgttactcacaattttgaactggaaactagataggaagttctggacctggaagacaggaacttccggactacacttaggaaaaactttttcacaagatcggaacttctggacctagaagacaagaagttccggacttgcacttttggacagatggagtatatgcaaaaatgactcctagggaaacttgacacttggttcacactaagagcacttgacatatctcagagcatcacctggaacccctcttaatagtacggtttttcctaaaaactcgatttcaaaagataaactatcctatgaacttctcaagttccggtccgctttgattttgtacttttggggggtctccaagcatccatcttccacaccttggactaatgcacctgaaagtcactcaatgaactcattagtcccttaaccacatttgtcattaatcaccaaaacccactagggggattaatgcactttcagccacgggcaaggagcataaaaaagacgagggctacgcatgaactcgcgtattgacaggatcaagatattggactgttccttcc

SEQ ID NO: 108217 - DNA, 553 bp, Oryza sativa
tgttaagagaataagttagcataggacaacaaatcgtttctaaaatttcttaaaatacaagataattggaattgtacaaagaagtctaccatcagtagttcagtgtagctactgatgaactcatatccctaaaaatcgttctcatttcttctacaacaattctctgcagctaattgagtttgtgctaatatgttcccatcttcttgtctacaagaattctctgctggtaattgagtttgtgccgatatgttcccatcttcttgttcctgggcaacataatagtgtgaaggtctacaagaaatatgatatattttcacaataagaaaaaaataaggcaagaaaatcaatctatatgataaagaaacatacagtggagattgatgtgcagcagtaactttagaggtgcttttttgtttttcttgtgccgttttttagtccaatttcggtatctctttaagcttttattctgaactggatcttcttcagccgtgcagctcttagatgtacttttggtgcctctaggatcatttgctcatcacattcagcatcatga

SEQ ID NO: 108218 - DNA, 592 bp, Oryza sativa
gcttaactcattaaaatgtattttaccaagcccaccaagttctagtccatttttcctattgctggattagtattttctttaaaaaaaaagaaacttgtcaccttatactccctccaatctacgattttagagtgtttgtaaatgcttgataaacttttataaaagaagtattaacatctatcacttcaaataataaactataaaaatgatacatatctcatatcaaataatatagttctctttataaatttagtcaaagttaggatatgcgttaaaagagtgtttcgtatgtgctcatagagttaggatatgcgtgtgagttaatagagataactatgtatgcgttgtgagcgtctatatttattttattctgtgtttctaaaagaataatctagggacggaggacgatttaaatttatcttccacgagactcgacgtagagcaagcctgatgcaattttatttcttacaattttttttgtccatgcagatagagcttggccctttggagtttctaactgggatatgcgggaccatgggcccatttaacgaggcaccggatagggatgtcgtcacatcactcacgctgatca

SEQ ID NO: 108219 - DNA, 1183 bp, Oryza sativa
atgcgcaccgaacaaaacaccccttaccaaaattacccctaaaggatattagaagattacttacctaccctttaaaataaacggtccagattaattctactcggagtataatacttcaagtatattgcaccggagcatcagtcttaatccaatggttctatatctatttttacttccaccagtaaaatgagcattactctctataaaaagtaaaaattaggagtacaaaaaataaagaggaatgactatgtgtcaggtgttcgagagtaaccaaactcggtcctcgcttttttggactgtttgatccaaaatcagagactcagataaaaaaaaaatctcaaatctaatccaagagtgcacgacaatgaccaagacttaagaaaaactcaattgcctggcaaatagcaacgccataaacaggaacctagaaattttatttgtgatgggtgattcgatggaatagtgagcaagatgcaccgtgagaagacaacggcgggactgaaaagaggaagcctaggttgaaagaactctacgtcgattcaccgtcaaatagcactcacttttgtgcctctgccatatacagttttccatgacaatgcaattgacaattgtttctctggcacagtatcgccgttgttgcccaagtagaaacccaacgtaaccttccttcttcatcactggtcataaatttcagggcaacaatacgatacatacgattcgattttaatttagttacactttgatcaaatgaacttgtttgtcgatgaagaagacagggaggccagctgccagcgtggttgatcggcatccatatcaccgggccggaatttgattgcattctagggggggcgtggttgccggcaactgcacggtcgaggcaccttcattcaccatgatcgtcttggtgctaaccttcgcaacgaggccaacagaacctagcagcagaatgtagagccagaataatcccaatacataatctgtcagccattttagccttctctaatacaagcgcacggtcgaggacaccagcacactttacgaagatcaactaacaaatttagctcacacgactgttctgcaactaatattaaggaataccatcagagggtgtgagaataactacgtacaggttcccgtttgccttccattcccattacattgttctgtaaggagagaaacaatc

SEQ ID NO: 108220 - DNA, 5315 bp, Oryza sativa
cctcccccctccctccacctattttcttttttggcaccacattactttcctattttagtaaatttatgtacctaaagtttatacacctcaagtttacacattttaagtttagagaccaaaagtttatatatccgattcaaatttaaatttgaattcaaatatttttttatatataatatttctatacatctaaagtttatacacctaaagtttatagaactaaagtttataagtcaaaagtttatatacccgattcaaatttgaatttgaattatatccgattcaaatttgaatttgaattcaaatattcgattcaaatttgaatttgaattcaaatatttttcatatatagtatttctatacatcaaaagtttatacacctaaagtaaagtatatagacctaaagtttatagaactaaagtttatatacccgattcaaatttaaatttgaattatatccgattcaaatttgaatttgaattcaaatattttctatatacatctaaagtttatagatccaaagtttatagaactaaagtttatatacccgattcaaatttgaatttgaattcaaatattttctatatacatctaaagtttatagatccaaagtttataagtcaaaagtttacatacccgattcaaatttgaatttgaattcaaattcaaatttgaatttgaaaattcaaattcaaattgaattcaaatttaaatttgaattcaaatttgaattcgaatttaaattttaatttgaattcaaattttttatatatagtatttctatacataaagttttctaactatttgattttttaaaatttttttgtggtttactgtagtaggaagagaagaaggggaggaggaagggaagaagtgggaggactgcgtatagggggggaggcgggggatgcgatcgctgggcgatggtcctggcgatcgatcgcccattagcacccccctataagttatgcctatgtgtactgggaagctcaaacaattaacaagaagcaaaatacaatatttttttatttgatttttggtcataccggcctgcacagttgcatattcatcgtacaccacgattgacctttttcttttttttttcttttttttttatgcgcgagaagacgccaagatttctccaagacagaaaagcactacagcacaggagtgtgaccttgcagtttccagccattgattaattctatcagcgggctttcttgtttggacataacattccaagaagcagctgccagcgatcaccaaggaaccaaatgtcctccaagcaattgatcacggaagcaacctacgagttacaatgggtagcccatccactggaatcctgcagcttcccattcctatggcttttctctaacttgcaccagagaacgcacaaccacgacagactaaattgaattactcaagcccacattttcattgaggaggtatagagagctagcgtgtgttgtgagcaagcagaacaatgttatgccatatgcgtctggttttgtaggaacgcaccgcttctactgaaattaataatggtattgctatagtagttgagcacgagcaatgcaaatacatgcaatctattttgatttatccagattttttttaaaactaggaaggtagcccgcgcattcacgtgggcatgtgtcgtgcgctaagtttgagatacttataaaaagtgaaatattaaccggagaacatctcccgcaatttctctataaactattttcgtggcattaattgcctttataattttataatctattagctttattatgttatatcatatttaagtaatatctataagtagttacttataatcttctttatcatttgaaaagaaggtagacttactttctttagaaaacatgtcagcgtaagtacaaataagtgtaaagtaaaagtaagttgcttttcttttttttaattgcatatatattatcatagtttactaaaggatgaattgggtgggacatgaagctctagtaattgtatgtgtttataaagcctaatatgatttatgcagtttgagagatgatccatctatgaccaattcatgtagagtgagatggcagtctaacatgaatatgataacaacgaaatataattgcgcgataatattttttaaatgtgatgtaccatgaatatacgattgtttttttatatatatgatagatcaaatggatagtaataatggtttcactggtttaaaagacataggagtattccatagcttatggttgttttaactatgtagttggtgaagaacgtttaattgatttttgttatgtgcaatgatttagtataatacaatacatattttcaattaattttctttttatttagtgtccatgcaaacgatagggtctaccttcaaatgatgtattttaacttttatatagcaaaatatagctaatgtctgtttaattataaataaaacaatagctatgactgttttaatattatgttagttagaaaattagaagagaagataattgaattggagaggagagggtgtaagagccagagggggaggatcagtggtataagtaaggcaggatgatgggaagagattattgtttttaagatatatagaatgggtcctatagttttgagttatctatttatataaatacatctaattgtagatctaatataaaatactttgggttttgtattttataattaaactacttaatttgttctaatttttgtgtgtattattaatcagaaggtttaaaaatctatttgattttttcataaacatatatggatcagtgaacaattgttagtccgtaaaatatatatatgacccaaagtaatgaattttttaataatatagttaatttggatcttcaattttaaattttataataaataatctaatggtgtgaaaaaaaaatagctatatgatttagataatatagttgtttaaaatttgttatcataaaatattttttccatctaactaaaagaggaaaataggagagaaaggaaatatgtgggaaggtaagtgagggggtagaatatggtggcccttttttttatccttttgtatttggataaatcatttagttctttttccatctaactaaaagagaaatatatgagagaaaggaaatatgtggggatgtacatcacacgtatgtacgggaggggtgggatatgcaatgggtcacatgaaaatttatcacacgtattcttttctatttgaataactaaatttaatgatagaaaacaatggatcacatgaaaatcgactgctagatgatttgtttattcttagaaatttatgattttaatgtgcagctggagagcaaaaccttctttcctcgtcactggagcaacacggcaaaagttttctactggaatcctttaccaggttgcgctaattaccaaagcacatctgtgccatttcatccatcatgagtactctcatatcaaaagacggttcttcgacccggagggcgtcctggctacaagcaaaaaatacaagaatcttcggaatgtaataacgcgatgccataatgtaattagataccgtatttgaagtgacaatgtaaaaaatattgtaacatttcgacaacgcttttcacttatgcaacttatgtagatttgtcagtatcaaaatgttttttagttaataatattatttatgcatcaattaattaattaattagaaaataatttatcacaaataattattgtaacaatttttaaatttttgtacctcttttcgcaggcagcgaattctaatttttgcaggcggacgttgcatattttcctaggcagcccgtttagctccacttcgcctgggaaaaaaatcttcccaggcaggcgtcccgccgccgatcttcgcagtcgtttgggtgcaagtggagcgtccgggaagactcatttcccccggctgtgaaaatgctttttctagtagtgttgaccagaagatagatttcaattagtttcgattgatttgattgtagaaaatgaaacgaagtttgatgatagtatcatggagataagacatataacaaattgttaatcgtcttatcatctaccgcttgatgaccacatttttccaccacctgcagatttttttttttgaaacttcatcgctgagtaagagaggtttttttagactgactaattaggaagaggaaagatgggagagagctcgagaagttgaacgttgaaacaggtggggagcagagcgggcacatgcgcatgggagggggtttttttaaaagctaaatctaatctaatgtttaaaaataatggaactaccaatttgagtggaaaccgatgattggatgttttgcttttttctcagaatttttaagatttactcagtgccacgtgttggctttagagcgtttatagaaagtttaatggacttttagtatataatatatagatggttaatattatctggtcctttttaaatgaaattaaaaggttagatatttttctttttcaatcataattttgtatgaatttctctcatttattagagggtcatgtggcagcttagaagcgtttatagaagcgtcacgtggtagcttagaagcgtttgcatgggttgtactcggttgaaaacctcaattatagtttatcatggtttaattgttctaaatttcatgattaatgaatatataattgtcctctgtttggtttcttaattatagaattttcatgattaaatgatttcgaaatttagaattattgagttgtatttggtttaaagttggcccttttaaagtagagtcgttgcgaactttgagaggagaaaataccatttatcatagttggagaggttgaagaagactcccataatccttgtattgctataaatcgtcaagtatggagagttgcccttctacgtttttttcagattgacacattaaactacttttgtacaacttaacgtgcacaactaattcggagagaaacgtacaggtggattagatggtggcccatacatatccgaacaatttttttttaaaaaaataagagaaaataaatctaatctaacgttttggaatgttgggtccactaattttaataaaaatcaaaggtcagatatttagcttttttctcataatttctcagattttcttgtgccatgtggtgacctaggagcatttgtaaattaccatgtggcggcttaggagtgtttgtagaaagtttaatggacttttggtatataatagatagatagattaatgtgtgtttgattattattttgtgatgaacaattggtttgaagattattggttttgatactttgtgtagtggtgctccttgtgtgg

SEQ ID NO: 108221 - DNA, 1078 bp, Oryza sativa
gccattatggaccctctgctaaaaatcgggttttgtagtgttagctgcctagctagctaggccccgtcccacatgaaatttgcttgcagtgcacttcactgcgctactgcacgatggataaatcgagcacagctagccagatagccagctaggtggaggatttgctgtattggacccaaccggttatccttgcttaggctggtgctccctcagcctgcggcagcacttaccccacccaccatcactccactccacgccactgctacccccaattaatgatgacatcctcatgggaatgatggggtgcaagcttttccccctgtcaccagacactcattcatcaccctcgcttcttgcctttgcacatctatgggtctctttagatcccctagcaaattttttaccctatcatatcgaatgtttagatatatatatatatatataaaatattaaatatagaaaaaaaattagttatacagattgcgtgtaaattgcgagacgaatcttttaagtctaattgctctatgatttgacaatgtggtgctacagtaaacatttgctaatgacaaattaactaggcttaataaattcgtctcgcagtttacaagtggattatgtaatttgttttgttattagactatgtttaatactttaaatatgtgtccatatatccgatataacacggcaacaaattttacccgtggatctaaacacagcctatctctggctctaatttctaaggggaaaaaaacaagaggcaaatctaaggacgacaaattacttcttttatttttctttaccccttaaacaacctaatctaaaatttgtttttagtgtgatttgatcttaggacctttgggtgccaagtcagtgcaccactagactatatgccatttcacaaaaataaagactatatgccatttcacaaaaataatgggcttgagaaaaataaggggtaaaaatgtgacttcctttttcaataatggataacaagcatggtggcccgcataaattgcgcgcctcccatcattatattttttttcatataatagtatatatgtgtatatatatatatata

SEQ ID NO: 108222 - DNA, 1908 bp, Oryza sativa
tacgaactctaaactctacttttaattatattatgttttattctgaattttagttagttttaaattcctatatgtacttctaatattccttatttttattccgaatttctattatttcttaattgtatttctatatgctctctatactctacttctaatattccttatttttaattccgaatttctattatttcttaattgtatttctatgtggactctagtctcctcttctaatattccttattttttaattccgaatttcaactatttctaaattgtatttctatacgaactctgtttttctttttctccgattaatatgagaatttaatttctaggctgtgagagcgaacgtggaggctcatttttcttatattcggcttttacttcaacataagttataatcaactatatattacaaagtttatagttgaaccaaatacaaatgacggtcccaagggggaaaaacatgtacaccaagtaccacctaaaggagaaacaaatctatatgtaaccgttgacttctatgatgaaaatatttgattattctatataagtacatactccagaatgccgtatatgatatatgctatatatagcctttgctatgtataatttacggtctctagaccatccacagtgccgtgcatactgcatagtgcatacccataaacacgttaattcacaaccatactaaggctgcgttttttaagtccaaatttccaacctcactctctcatttaccgcgtgcacgcttcccaatcaacaaaaaattcctataaaaagttgctttaaaaaatcatattaatctatttttaaagtttttttaagctgataattaattaatcacacactaaattactgctctgtttcccgtgtcggatgtgatttcccaacccccgcttaagaacgctgcctgatggtgttttctaaagtttaatgttctttattgtcacaaaaataaattactttaccaaattgaagtgtttgcaaatatgcatggaccactttatctataattaatattcaattgtgaggaccaagcaatctgccattaaaatggccccatcctaatctactccctagcattctagggtcagtactggattattgcatagctccacaatttactcccggtacgtactaccgatgtactgtacattacgttaatgaaaccccgtgcattgctgtgggagttttatatgataacaataaataaaaataatgtgcaaaatagctagacaacataaaattatttaagttaacatggtttacggaaatttaaatttacatagtatatagaatgatgattcaaatgtaaaagtgaatttatgaaaaaaaaagtattaaaatagtttggaccgtagattaatcatataaaggctaaaaataattaaggtgatatagattaatgagagagataatttggactactatagattaatcatttaagtacaattgatatgatatggcttaatgagagagagaagagataaataacattaactaattagtgaggatgaactatataggtaaatagcacattataaaaaataataaagatatatattgaaatattttgtgaattatgtgggatgatgatttaacatgtttgcattttaaaagctctaaaatttaataaattataaaatataaaatcatagataatatagcatgtttacatgatgtttaaatttaatgattggtagtggatgatgatgtggcatcttgttagtggatgatgatgtggcatctttacatgttaagctttatgagttaatgggttatgactttatagtaagagaagattcagcatgtgttatgttaatatcacctacctaatagaaaacataatttttggcctaaatatttgcttaaagatccatgtccccttcctccaattccatg

SEQ ID NO: 108223 - DNA, 513 bp, Oryza sativa
tgacatctcaagcattgcagaccccaagtctactgtgattgccaaaagtgaacactggataaaaacccaaaaacaggctaccttaaatgtttaaaatttcagctgaagggactattagtggaccatcagagaaaaccaaatgtgtaccactgtgttgtattagtttgcataaggattaaagattatatgaggacaaaaaaggatctgctccatcaccctagtagcagaccatcgcaaacataaatgttgagttgaatacactataatcctaccagacacaaatgcattgctaaaccattactgcaccaactagaactgcccccattagtaaatagaaatgtctaaacagataaactaacagcacactgcacacgtcaagctacatcctgaaggatgaatactcaccagtagatccacgacggctaacacgagatatcacttcacccacgaagaggaacacagaattggaggcatctagtccattagcatcttcgccagcagccaactccatag

SEQ ID NO: 108224 - DNA, 1254 bp, Oryza sativa
gtgctcccggtccaccgtggaccgagaggctgacgcgtgggccccactcccgtggacccggtccgcgcgccctctctctcggctgacgcaataattcgatttttaaattaaaatttaaatgaagaaattcgcaaatatccatttaaagagcatataaacttcaaatggccataacttggccatttgaactcggaattggaccgttcaagtctctaatttttccttaagaagtgaagaacccatttttgtgctttgtttctgctgttatgtggaatttattagtgtttgtgtcgcgaccgggaaaattgccttttcccgaacgctagtgtattaatccccgtcccaggaaaagccggggtacaccacacaaacatggtataaaagacacatctttattatatcgataatatttacattattacaaaggcacttaaggcctgacaatcaaaaataaacagcagcggactagcgggcctacggctcaatcttcacaggcgctcaactggggtataagccaggactccacctaagacatcttctccaaagcttctcttactgaagaggggaaagattgagcaagaataagtacaaccacagtactcagcaagccacaccgggagatgcataattaatgcaagggagtacaaggggataataatataggggttaagttttgcagtaaacagcatttaaaagtcacttagttgccccaaagccattttataagacaatcctagagctacacagtattattaaacaaggccgtgaaccctcacgaacctgccttaacccaaggcctacgatgattcaaaccgaactggcaacccgaccctgggtcccaggtcgtcccaagccaacccaagccaaccattccacattttagttgatgagcaaattttaagaattgaaacactgacttgggtacattgctcggcttgcccataaccgagggcgcggctattcaaatagattatactctgatcagaggtgtacatctttacccacaagacacatcttcctcacgtgtaaccacgtgccacataccaccacggtatacagacggaagacgtgacatagtttccaacccattctagccataaacaagagtaccgacccaataccggctacgggcggaacaccccggacaggcaggcatgactgaccccctatcagcaaggcacccaaccctctggcatatgacatctcgactacccggccgcaactagggtaaccttcatttgccctggagaatgt

SEQ ID NO: 108225 - DNA, 2475 bp, Oryza sativa
aaaatgtttcaatcatttaaatcgtgcgctgtttcacctcatataaaaacaatgtttcagtaaatagcgaaagaatatttcagttcactgcatatttgatatatccatacatagtgaaacattataagtacactagatgaaacatttttggtggaaaaaaataaaacgaattctcttaatagagggtttctataatatgtgggtgatttattgcaaaagaatattttaattcactgtaacattagatctatatatagtgaagcattgtgagtatactaggtgaaacatttttgtgaaacaacaaatgaaacgaattcctttaatagagtgtttccaaaatatatgagtgatttgttgcaatggagtatgtggtgaggacacgtggcggggacgcgtggaggggcgtcgcgtggaggggcgtgagcgcgcgctagaggcgcggcgcccgatttcctcagcgctcgacgcgcggcaatttccgaaaatgttacaaattctaaaccacttaagtcgatggactcactgttaaatatttgatttggctattaaatacctttgatctataaaacaacaaacccacagctaatcctcctctctaacgtatgtacgtacggcccatgtagcagccctcaggatggggattgtttggacatagatgtaatcaaaatcattttcagtgagtttgttgatgatttgtcatgccctgattttttttcagggttttaataattatttaatattatttctagaatttatattaaatgtaaaacaatgtgtaagtcaagttaaggtgagaaatactattttaataaataatggctgagaatacttttcttgtattctccatgccctgaattaatctatgttcttttctcggaatttcgagagctatatttataatttgaataatacaaggtttatttcaacaattatttggtttggaaaaccaattaaaattccctttctagttttgggcagaattcggccaaagtccttttcccctactttcctctctctcccgagggtctgctcccccttccctcttttaccctcctccagccagcctggcccaaccatgcggcccagcccggctcgcccccgcatccgctcgctgacagatagcaccgagacccacctgtcagccacgtttcctacctacggccaagcaaccaccgctccattgtgcccatgtcactcccacgtcgcgcgtccaccacacgcactcctacccacaccttcccactcaaatcccctggaaccaatagcccaccatctctaacttttgccccacccctcaaatcacaccagccttgtgtaacaccctaaaaattttgaatctgcattacgaaaacaaaattctggataataaaaaaatcttttccaaagtctgtcatgttggattttattagattttatctcatgttttctgttgcgcttgaaccacgaggacggaaatctagggacaaaatctattttagattcaaatattatttgttaaaagaaccatgattataaaatatactaattaataaaatatttgtaaataccatttatctttctgaaaacccttttctatgaattagaacctatttgatgtatttgtttgataaataaaaacaaacactaaatatttagaaaaacattccctgaggaaaactactttttcaaacgagggctaatgtttaactaatctctgaaaaatcctagctagaaagttaaacattttggagtagttttacaaataaagacaatagtaaatttactagcaaaactctatttacgaactaaaatattgatagagtttatttcgaaagaattcatggaaaagtctagttttcttccttgaaaggcctggcccaacccgcataatgggatttgtgttacttgtgtgcatttaagtgtttgtgccaagatctcggttaatccatccttgtgaatcccaactcttgctatatttttcgcaggattcaaattccgtagttcgattctcctttttagtcgaacccctcccgaaccaattgttctagtgtctggaattactcgaacacagtagttcttccagaatcgcctctcagggtaaaatcctgtaactctttgaaaattcgacaagtaaaaacaaaacccaaaattgtgtactttcaaaaacttttgaataaattgcatcggcaagttcttctagaatcgcctctcagggtaaaatcctgtaacactgaaaattcgataagtagaaaagaaacccaaaattgtgtactttcaaaaacttttgaataaaattgcatcatgccgatgttatttgcctcttaatcatcgaagaaatgaaaattcgacaagtagaaacgaaacccaaaattgtgtactttcaaaaacttttgcctcttaataaaattgcatcaaaaacttttgaaatactaaggatgaaaatagcaccagtattgatatagaagaaagaaatggtgagaaaacatgcgttcaaag

SEQ ID NO: 108226 - DNA, 1809 bp, Oryza sativa
gtgccaccccgcgacctcccttgcccgtgcaccgtgcatggcatgtccgtgcaccgcaccgcgtcgcatcgcgctggtgtggtccccgccgcccgaccaagccaccgaaaccccgcgcaaaagctgcgccgctcgggtgcgggcatcgcctcggagccaagggataacggcccatgtgccaccctgcgtcatcctagagaccctagctcctaggcccaactaccctaaagtcgcctggctggatatccgctctcaccgagccgcgccgctctgccattgcccatgtgcgtgcgtcatcgccgtcgcatccgtgacgccgtgccatgccaggcggacctcggtcaagccgccgtcctctcaaaccttctactccaagggttggggagtgaaccgagtggccacatccaccgcctcatccacaactaatgatgactagagcccttctttgtgtccgatggataaaacagagccctctccctcagctagtactagaacacccattccataggtcctagatgtgatgattacctacaaaaccttaatggagaaggaaatccactcttatctgcgtcggccacctcattgcccttattcgagtgttgtttgagcttcttaagcttccctctagtcggcctcatccttccggaggaagctacccatcggatgtctgatgctaaaaaaaaatcggacggtcaaatattgcagttgaccaacaaatgaaacattaagttatatattgtgaaacaaaaaaattagcaagtgaaacatttaattattttatgaaacatgatgaagatacacgttgaaacatgtcgctgccacgtataaacaacaagtattaacggattgaaacatgtgttttcttttatcaaaatataatcatgtgatatcttgttgtaaatatttaattaaaacgaatacaatggtgtgattggatcatatattggataaataatttaagagaaaaattattttgaagcttactaaaatacatgcacgtgtgcatggatgagatggagagagaggagagagagaagtagcgggcagtttcaggaatgtaatgaaacacactgaagacgcacattgaaacatatcactatcacgtatgaaatatttagttttaacggtttgaaacacatatttttctttcgacataatataatcatatgatatcttgatgtaaatatttcattggaacgaatacaacagcgtaatcagtttgtagattggataagtaatttagaagaaaaaatatttaaagagatgaggaaagaatgaaaagaaatagctaggcatacatgttacagtgatagggttcatccgatctgccgatttgcagcatttccagtggggtagatgaggcgtccgatatttccgattcgtcggacgtgcgatataaagcgttctcccatccttccacaacctctcaaacagtttctcactcaaacctctctctccaacccaaggtgacgagtgtcgaacacctggtgggcggggactgcgctgccgctaccttgccacttggctagagctggtggcggactggcggggtgtggagttggcctcgaggcgctgctgctgctgttgttagaacgagccggaggctatcggaagccgaggaacgggcgtcgaacaccttcgagcgccgctgacgccgttcgcctctgctttacccggcccggaccggcgtcgttgaccttcgccttactccatcatttggtaagccctcacgcaccgagcacctcctagtgacctagaagccggcggccctcccaatttgggctatgtgccgccgtagccgtaccacct

SEQ ID NO: 108227 - DNA, 759 bp, Oryza sativa
cctatttaagttgagatactccacttttaattcccagggtggtattattatccttaacatttcttatgggcccttgagattttaatagaaaaatcgggcctagcccatttattctaacaatccccaacaaatttcatggctcataagaaatgttctcaaagttcaacctgtttgatataccagtgttttggtggagactgttaagttgaacttccacctaggaaaagagttacatcagaccacaactgaacaatggactatgccttgaattgtcagtcttgtgtgagcaggtttcactcaaacccttgactggtactgggctgccgtttgcatccgctctgtttggagcatataagtcaaactccaggccctttcatgagtatctagagatcgcccaaatctcatagactgtgactagcagtcgaactcatataggtgtgttccttctgagatgttttgcaggtcaatatctctgcttagaaaagccacttgaaccacattaaggcataagccatcctaccatgcataatagaagagaagtacatcatgaaaatgagcccttttcaagggggcttttaactatttgccacttttagatttggtaattaactatttgccacacctatctcaatgacatgtaggtccacatgtgtctatgacatgtgggtccagtggcaaatagttaattgccacatctaaaagtggcatatagttcaatatctccttttcaagagtctcttctctcaggggctgcaggaa

SEQ ID NO: 108228 - DNA, 2430 bp, Oryza sativa
agagtcgtacgagtgccttgccaggccagaggcgtctcaggcgaagagtgcaaggcgaagactatctgccgaaggaagatgacttcgcgttggcaagttcacccccgcaagggccgaagaagccttttcggcctatcaagcctaggggcaatagggccggcgatcgccagacggcccatcaggggcccatgagcccctatatcatcatgtacctctataaatgtccctttcataagggtaatcatgtaaattcccctgtataacctagagcctactagtaagaacctataatggggctataaatagtcctctagggccatgtaatgggaaaaaaggaaagaagggaaactcaaaatttaatacacttcgttttcttcctaccactgttgagtaaccacgtctttcgatgtatgcggttgtcatttcgacaacacacatatttgagcccttaaatggcatcaaacttaaaagttgtccaatagaaaattggacatctcatcgagagctataattttcacaaaagtttgtctcaaatgatctggtccagatgaaaaagttccgttcatatccaaatttgtataaatatatatgataagggtcatcagtgtcagttcataacctaacccaaatttgaaaattttacacagaaaaataatgttgttagtgccggttatcgtaacgaattgatactaatattacttattggagatttttcttatctaggttagggagcaaccacactgttttttttatgtagtgttaaaagtaactagttgatcagtagttagcttgtttgaaatcaaagaggatatcaaagaggatactgatgtggcaaactgacactactgtgtttgactagcatttcctctagatctaggatgagtagcataggtttggccgggggtttctatttggagattgttgataattttattttcgtattcttgtatggtccgactcaactcaaagatgaaaaaatggaaaaaagataaggtatttgtattagtattaagagtaaattgcatcggcggtacacgaacttgtcaggtaggtgcaatatagtacatgaacttgtaaaatgcttattttggtgcacgaacttatttggtgcgtgcgaacaaggtcaaaatcgcactgcaaggttaatcttgctgattttgttgttgatttgaactctatacgttttgctacatactccatccatttcaaattatattgttattcgaggtatgtcctaagtcaaacatatgcagtatttttgacatataaattatatcttacaaaagtatttctcatagtaaatataatcttctgatgttaaactatatgaaaatttttgttaaaatttaaaatgtttgacttaatataagcttaaagcgtatttgaagctttgaagggaccaaaggagtatacgagatatatatgagcttgacatagtggctggtaactttaagctcgtctttgcttcaaggagcgtgaagtcttcatctatggggtcatgggggtgtatctatatataagcccctaataataacagcttttcaacagtaaataacattatatattgaggcgtgctgtacactactgtttataccattatgcctagactaattcttaatttccacttggtactactacatgcatccatgaaaccgatgaacccatactagatctacctatctagttgtgtgcgaaccccacattgccatgcacacacagtgcatgcagctgatcaacttgtaactgctaactaccagctgtttgtgcacgcatggactatagctacagtagtatatgtacaaattaacgaggaacataggagccgataaatttgttggctttaattggacgatagaatgtagtaggatgcgttagttggacatatataacgtaggaacagtgctcaaaatatatatatatataacgtaggaacaggatctgttatagcatgggcttggagattcccttaattatatactacctccatttaacagatgacgtcgttgactttttcttacatgtttgaccattcgtcttatttaaaaaatttatgcaaatgcataagatataaatcacacttaaaagtactataagtgataaaacaactcataacaaaataaattataattacataatttttttgaataagatgaatggtcaaacatgtgagaaaaagtcaatggcgtcatctattaaaaaacggagggagtacaccacaacaggttcctggcatccaatggaaatttgtaaccacctcatcacgaaatgcaaattaattagttgcagaggataaatttgcatcattggaaaaggatgcaatgcgggcttgttgcgaaaattttaaatcactcacggaagtttgtcgctattcttctagtcaaatgattcaaaaaacggatcaagtgattctatgctaaatggcactcacct

SEQ ID NO: 108229 - DNA, 1095 bp, Oryza sativa
ggaaccatgagtgcaaaaacacccacgcgggatctcccactttgacaaagcaatggagcaagtcaacaacaggaaaagaaatgaaacattcaatgacatcaaatgcacacaacctgcaaacataacgtggtggttgtagtgttcatgcatgccaattgccatccattgatttgatttcctggctggctccatcgatctgatgtcctggccggcggccattgatctctgatgagttagagctagctatatatgcatggacaagtatgagagcacaagcttacaacccgtactccgtgcacaccaactaataccaataaaaagttctagaagaaaattgtgcatgtattttcaatagtgttgtatatatctataaaatattaactttaaattcattatattctagccataacaaaaaggaaatatgataattttatgagtatatcactgatagaagtttgttttttttttttgctaacatataatgaattgaagatgagactttatatataggtataattaatactattgacagtacatgcatacttttctctctaaagttttttttgttgaaatttgttattacctctgtctgaaaataagcgcagtcctctaatttaaatttgaactagatgctgcacttttttaaaacaaagggagtagatggtttgcgcggagtatacatagaatgcgttccggatcagagtttccagagatacaattaatgcagataagccagcatatgtacatgacatgtcagttggtgtacgtacaggatttgttcgatcggcattcatatctacatcttttccaactggcattctctcctaccgtagttttagttaattccctcctctgcgttgtactatgtccattggacaacaggccatatatgcgatcgaacactgaaacagtaaatagatcgaagatcgaattgacttaattaatagcgcagccgaatatatagaaaatggtaggtccttaccagggcgaattgtatgaatcgtatatttgttatagaactttaaaatcataaggtttgaatgaggtattatttgtcattaaatttactcgatattacctactgttgaaccggag

SEQ ID NO: 108230 - DNA, 761 bp, Oryza sativa
ttttgggacggaggtagtacaatgttgcaattttgtcggcttccttggcgcatcggacattaagtccaccccttgttaaacgagaagtacaatgtgttgatttcagaatcgaccgacccaatgccaggccacccctgacagccgcccggactcgtcggtgaatctgaatgtattttggccaagtacacattggtagagtaaaccggatgcttttatctaacgaaatcttcattagagcttgttcggttaatcacatgagaaaggaattgaaagagattaagaggatttattttacacctcaattttttttttagaaacacggtacaaacattgacactcatagcacacacacacactcacccctaaggcatttatggaagattgggccggcataaatccacacctcaatatgtatagaataaatcatatctaaaccttatagaacaaggcattttttgaaaagaaaagaaaaccgaggcatatgccttagcactaggcgtgcaattgaacagtgaatttagctcgtctgtgttatctgtatttttaactctaccctacctcttgcactgtccatttctttgtaaagaaaaccgcaccgtccatttcaaaatattaagattgtccatgcacatattaaattctgtgcatatagaatatatcgccgatagattcgatcatcctaaggaccaaacaaacaggcttcgaatgatccatccgttgattcaattcggatatatgcacagcccatacataattaagta

SEQ ID NO: 108231 - DNA, 717 bp, Oryza sativa
tcatttggcaccatgtacagtgtcttgcttcagttaaattaggctactcaatccttgtgggactcctgttgataatccatccatccatggctgatgaacaggtatctaaattgtaataagctacagaggttccctactgttgtcgctaacatacaatacaaaggtcttttttttttcaaaaaaaaaaatacaatggccatttggttcgtgtctaacctagacatgcaaaggtttagtcatgtctagtcacactttcttagcctgatgacctgcacacttcaaaccttagggagttggtggatttttacaactcgagtgcatgcacactttgtttgcttcccacttctcaaataccaatcaaaagagttacaaaataaaaaacacttatgtaatagacatatatcttcttgcgaaatttcaagtacaattctcagtttatacaacaggcatggcaaagcgggacaacttccaagtgtaccaatatatccggttgttagtggatcatgcagaacttcacaaggaataaggaaagcaaaatggcaagatggcgataacatagaaaaagaataatataccataaactcagaacatttgagtaaataatgttgtacattaagtgtcaatacaagctagcagatatcgaacagactatatatctacacaaaaaaagcatcggtattaagttgctacatttgctttacactccaaaaacgtgac

SEQ ID NO: 108232 - DNA, 1017 bp, Oryza sativa
ttcttcagttacagttactgtgttgtgttgtagccggccgtccgtacgtctatggcggcgatgggtagggggaaggtgttggggggaggaaggtatttataggaagcgcgcgaagaagaagggaggcggttttgtgcatgtatgtcgccagccatggcatctttctcaccgtagtgaggtttttgatttttgcagcctctgaattattgcctttcttttttcttcttaaaatgtgcatttctttcttttttatatacagtttgtccgctgtgtcgtttttcgatattacaattatttgcgattaatttatggtcatgttttatacataatgctcggttaattgtatataatgcactatcgatccaccatgcacgattaaattcagctatatccatattgggaggacataaatactatgcattatgttaagaaaaggctagtgcttccatgatttgtgcctgctaagggcttgttcggatcacaggataggaaaaacataggaataggaaaacacaggaataatataggattgcatatgcaaaacgtataattgaaaaacaatggaatttgatgatatgaagcgttcggaatacatgaatatataagccatagaaatgttctaattaatattgatctcatatattatagtataattatagtataattaagcaataaatattagttcccatctagtcactccaacgtgattagcatctaccctgtggtagctaatgaaaaaaatgaggtgtgagtggatgttcagaatcctatgaaattcccgcattttcacagggttgttatagtattcctacaaaattcctacacgtgcttcctatgaaccgaatgcatgaacatggccaaatccaaaggatttgccaatcctacaaaatcctgtgtaatccctccgttccgaacaagccctaactaaataaaaaagcaaaaaagtagtatctaatgtatggaaatgttcatctgtatatgtttcatctttactgtttgagaatccgtttttgctag

SEQ ID NO: 108233 - DNA, 763 bp, Oryza sativa
aattcttttcgtagcattgcagttcttgctccgtccttaatgcatgattcaataggctacgcaatctcgtttgtagcaatgaattttaaaaatttggaatcgctaactatcgtttgacagatttatgagccttccatcattcgtttttttaagctgtcagatggttaaaaattataatttattatgaaccgaataaatagcttcgaacaagctaagctatgctgatgtagaaaaaaaatagttcgagaaccgtggtatatccccccccccaaaacctccccaacccacccataaaaaaccggatggcagcaatcacaacttagcattgcttctcatagcaatgttcgtatactataagtgcaggttagttcagacttcagacacctatggtaattgttttttattttgttcgttaggtggtgtttgggtccatggattaaactttagcctttatgtttagacactaatttagactaaatatagattacttacaaaaataattaaataaatgagagctaattcgcgagacaaattttttaagcctaattaattcataattagagaatgtttactgtagcatcacataggctaatcatggattaattaggcttaatagattcgtctcgcgaattagtccaagattatggatatgttttgttaatagtctatatttaatacttctaattagtgtacaaacatccaatttggaaagtgctaaaaaattttagtcccttccaaacacccccttattatttttatcaaa

SEQ ID NO: 108234 - DNA, 747 bp, Oryza sativa
ttttcagactgaatttcgtatatggttaactatactatgttttgttcaatatcttcgtcacgagatagaaggtatggaataccatggatggaggtgaattgtaagataggccttggtcttgtgattgttatcttagaaggtcgatactaatgtttggtcttgtggcgttagtgaaactgttttcgtagcaatgtttggtcttgtgatgttagtgaactgttttcgtagcattgtagtacttgttccattcttcatgcatgatttggataggttattgacaattgtttatagtaatgaattaaatattacactcctaaatctattatataattaaaggaatagaaaaaagagcctccacgtttactctcatggcttagaaattctcacattaatcggagaaaaaaaaacagagtccatatagaaatacaatttagaaatagctgaaattcggaattaaaaaataaggaatattagaagagaagactagagttcatatagaaatacactttagaaatagttgaaatttggaattaaaaaataaggaatattagaagaggagtatagagtccatatagaaatacaattaggaaataatagaaattcggaattaaaaataaagaatattagaagtagagtatagagtccatatagaaatacaattaggaaataattgaaattctgaattaaaaataaggaatattagaagtagagtataaagtccatatagaaatacaattaagaaaaaat

SEQ ID NO: 108235 - DNA, 1798 bp, Oryza sativa
acgattgatcagaggccatgtaacttagtaagacattagtattaattagtatattcacaattcacaaatgagtgaatgactaacacatgagttacagaacatgtcaatgctctacctttacatgcatgtctctcactttttgttcgatgtaaaataagtgttcccaaccagccgatgccactagcttatcagcatgatcagatgggctatctaccaactccttttaattacatcatggatgtacctgttaactcagttacctgatatgtagctaattagctatagctattactacccacgagtagctaattaattagcaaatgcaatgctaaaaatttagggttatcttgatgctaaaagaatttcattctaaggagataagtggataaacataaaggcagcatatatgtgcaatgaccatgcttgcagcccatgaacaagtagtggttagggagtagctttcatgaagggagaatagttaagtgcttgactgttgccaagatttgaaagctaaaggacttattaacaaaccaattaaatttttaagggctagatgacctccccctaatttggcacctttagcttgtcccttcatgcatgttaaaacattattttctttcaccatctttcgtagccttatcaatcgatcttaggagttaggtttgcaagcatgaagtcttgagagctacacctatgtatagccttttcgtttgtacgtctcatgcatggttcatcttgttactgtctgaacacttgactactgatccaaataaccaattgcccgctgtctagatcaaagaaaagaacgaattctacgtcgtcaactactgtgcgatgttaattaatctgagatttcgacattgctaataaatgaatgtgggacatcatatcgtgtacttaaaatgaaaaaaaaaaggttttgagaaatatattgacatgcaattcttttgcgcattcgcgaaaaataatgactgaaagtacatgatgttattatggcaaagtaattgctctatcctcatcacgcttggaggtccctcaataacgacatgttttttttcttttgatgtgtctattgattaacatgaattattcaagagcacgcagctgaattcaatatatagtttctggccggttatcactgtagctcattattcattcttaaaatatatagcgagaaaatacatgtagtggaaaccacatgtgtagtagtgaatcctggacgtaggataagaaaattgatgcatgcgattgttcacgtcatactaatttacttttactggtcacatatattttccctagtgtaaccgggcaaccgaacctttcaaaaaaaatttgctgggtaagttatccagcataactaaatttgtatgtttttaactgaacctgttgccccataaagatatatgaagagatcagattaattagcatcttaatctaaatgttcttctgcatttttcatcttatgagttcttatatatgaacaggaaatatattaattagcttcagaacttaaaattagtatttttagatgacagtacttcaaagttaaaattagttgataccctttcatgtgtgctaccagtttattttgatagaagccttttggtggagctccagctgcaagaattctttgcaccgcaccatcttgttcatattttagatcacgaagaatagatgcttaaatcattatattttaacctataaactccaaaatctagaggtttgaggtttgccaaacaagccctaagaatagtacattgcacttgtagatttgggccatatatgttggcctgcatgt

SEQ ID NO: 108236 - DNA, 579 bp, Oryza sativa
  unsure (1)..(579): unsure at all n locations
catgtccgccatcgctcgcgggaccgttnacgttcttttcctaaaacgacaccgccttcgccatccttttttcgcgaggcctcctatacccccgacggggcaacgcgatcccagccctaccatggccattacattttcctttgtttcactgttaagtctggtgaaatgtctataacgccctcgacgacttacgctggaatataaccttgaagaacaattaaaatttttgtttgagcgcacaatatgtgcattttgtaaaatcaatgagattaaataattagtgcggaaaattttgacataaattctgaaaataaaaaatgtaataaattaaatttttatttgaatctttaatagggcaatggatctttttttatcaggagcattcataaaaaaataccgtggacgttggtaagcctatgtttgtaccaatactcctcaatttttatgacttttttaaaaaataaatgcatatgtttcatttcattatctaaaaattaaatggccataaataatgtatcccacaacaaactcataactataataatcctcatacgaccaaacatgtaccatttcaattat

SEQ ID NO: 108237 - DNA, 704 bp, Oryza sativa
acatggtatatctatgcgtacgcgaatatttcctttgtgattaaaggaaacctttcgtgaaatcgattgatgaggagagtccttctcggacaagaattgggttacctacgtgtcgtgccaggtctagtatattcgagtcctactcggagagcatcagacctgcgatataaaagggaccccctggggaggccatggatcatcgaatctcagagccaacacaacccacacagcctacgaagccggagcctgcgaggagccaaatcgacgagagctagtcgaatcaactcgactacaatctcgccaaaccccccgagttccatcttttcctttgtaacctgtgttttccaccatataatcccatatcgtcgacaacaacgccaacaccagcttcagccaagtttttcctacttcaacaatgctggtatggactcaagtcggcgaaatcgtctacccggtttacaccacgatgccgatctcaaccggtcctccaatgactggaaacgagaacgccgtggctacgaaccaagacgcctccatgtcgaaaaatccacccgttgaaacggagaacggattgccgactacgtccaaactcgtgaaggattctgatgtggccaagctttgtccttctgacatgaatcgcgggccgataaggataacttccgaagctaccaggtcttggtgtcctatccacaaaaccaagaaac

SEQ ID NO: 108238 - DNA, 695 bp, Oryza sativa
gtggcacacttgcatcacttggttgaacacttcattgtttttcttcctcatgtaagcccaatcaatacacttcatctcaaccactggattctctctagccataatcactgagttataccaatccaattgagtgaaagtcctgaagcgaggatcctgtgactccttgtcacgcccggaatttctacccaaaatttcaaacgcttacatgtgtgttaaaccctcgtccaggaatcagccgaggcacacaataacaaatcgataatagagtacaaataaacagctatttaatattcgcaaataataaattattacagaggtggatagttcctctcaaagaataacattctacgcagcggaaaaaaaataaaagcaaactacggaacaactatggagactccactccacaggcaacttaacccggaccaagcctagtcctccagatcaccttcactgaagtactcctcctctgatgaatgaatattgcaagaatgagcatatgacatactcaacaagccacacagcaaatatgcaagtgcataggataacaaaggacggcataataaagctcatttgcaaaaaaaggccttttgcaaattttggataaacagcattaataaatattatgagaatagaaaccagttgaattattaagcagtattaaataaacaccatacaacacttgcgtgttgcatggg

SEQ ID NO: 108239 - DNA, 634 bp, Oryza sativa
tgggcatctccattgtcggtggctggtttgctgatcgccaccacgagcggcgtaccctttgtagactctccaggacgtgcaggttcgtttgtttttaacgcgtttgttttcattcggaatttcggatgatcacccgatcgcttgttctgattccgtgccgtctcaggatcatggtcggggcaacgagacatcaggcgatggtgacatcctggcactgcttgtagcagaggcaacgggagttcaccccgatcgcagatcagagcagcccatccaagcggtggagaaattataagtagtgagggcaactccccacaattgtctcgatgatggtaagaacaagactttccagtccgatatttcatttcatattcatcaatggcggcgacgacaacacggcatcgatcgatttgcgaagcttatgcatcacggcatcatggtggcggcgacggcaccgccgcagcaatcgaaggagcagagaggcggctgcaccacagtgcgccgctacgactcctcgctaccgatgtggaagaagaatgatgaagctcctaattaactagttctttgctccatacagatgcatgacaaatacaccattgatggtggccaacaccgggcagtattcgcatagttgcat

SEQ ID NO: 108240 - DNA, 603 bp, Oryza sativa
gatctctactctattcctattccactagcttaagaacactaaactaacttgagagaatatgagagagctcttgcttgaggtgtgtggaagaagtaaggagatgaagcccttttatagctaaactatgacggttctgacagttggaatggtcggaattaccctccaaccgtcataggggcttcatctcagccgtccagccaaaacctggatccaacagccaaaccaggggcaggcccatccagccaacaacttcgctggtggcctactctactgctcctctccgcagacttgtgaattttggcccaattcgtcgtgtcatttctgagttcttggcccatttatacataagtctgattcacgacatcgtccgattgatttatcgtctgatttgatgtcgattctcctccactttatggttattctctgcaaaaggttagtgaaccaaatactagtggaatattattgttctaaccaaatactagttctcctctattttggtaatattgacggtcgaaactgatcgctaacgaccgtcaacagtgtccctcaatgtacggcttgaggatggcgagttgttgcagcatgccgctatgtgcttccgct

SEQ ID NO: 108241 - DNA, 1042 bp, Oryza sativa
ccactggcatcatagctccgggacctggatgttaatgccatagtcaagctcccaaatgtcttgtattatccgtagtatgacttattctcccctattgcgtccaacgcctccacacgaactccactattctaacctgcgcttttcttgtccttgcctatgtgtaaaacataaatccgccgatgtcgtacaattgccatgagttcatgaggctacttgggccagttgccagccagtgcaagcgattcaccgaacggcaagtttttttccttcaaccattcaggaaatttgcatttatgttcctttgagatccaagtcgccgcccttctagggttccaggctcttatctcgttcatgtgtctgttggtatttcttaacgacattactagaaatataattcccagcaatggcgcagaaatactcctagtatattatggttacaaagttcatccgcaagcgcacgaatataccattgtagcatttcacccgagagtattccaagtgtatcgtatttatttaatccagtggcaagatcatggtatagagaacttgactaataatttatttgttacttgtaatagtcatagtctaagcaggggttaagataatctaagggtacagtgacacacaagcagactactcattctcatactaaattatctaagctaagtggaaagaaaagagaaagagaatctattcctatacttctactatacatagtatacatacattctagttatttgatatactagctaataccctctatctgatgccctcctggtactttgagaagccacccctgacgaccaagctccttacgacagcccgtcatgaccatacaaccggggctaaatacggaggagtacccttcccaggaaagtaacttaggactatatacacgcctggaggaatacccattctgagctgtcaccatcagcggcccacctctcatccgcagcatataaccataatgataccccgtaatttagacaccacgtctaaactgccagatactactctaatatcatcgtcatggcatagagta

SEQ ID NO: 108242 - DNA, 724 bp, Oryza sativa
ccgggagggggaggagaggccctggagaggagggaaagagagggaggagagggagactttgggctgggccgagagagagagggaggactttgggccagacttggcccaaagggaggagggggattatttttaggttttctttttaataaactttgataattgtttttggttgcttaataattatttccggtgctctgaaaattcaagtaaaatttgagggctccttttagaccaaggagaatttaacaaaaattctccgggccacatttgaatttttcttgtacgtattttagtgtttgccaatttcttttcgaattttaattaattctattattccttttagaaaatgatttttatttcaggatgaatttatcaggacgtgacaactacttgcacgcaagaattattgagccaaaaatattgcgactttaattaacagtacaaaagaacagtgaaatagagttaatagttaagtccattttacccgtgtcagagtgaagggtgaggtgatcgtaaggtggctggcatctcccaaaatcaattttgcagccagagagttagcacaagagtcatatgagccacccacgaaacggcatgaggtatagatgtttcttgccgtgctggatgggcagcagcccccatcatagttaagggtgaggtgatcgtaaggtggctggcagctcccatcaaagtgtttgcaggtagatagtttagcacaggcttc

SEQ ID NO: 108243 - DNA, 749 bp, Oryza sativa
ttgcaacagaggcccgagcttaatccttatagtacccgaggtacgactagcaaaacccaaccacgcacctcgagcccagcctaaaaccaatttggggattttgaatagaaggagcggtgtgaagccaattccacaataaccaaaccattccatagtgtccaggtgatatgaaaattcccaaagtctaaagttataaaattacctaatgttgcctaattaaattgcgaagcatctacctaaaattaaactagtggtgccatgagtagagtgtccactagttggggttttgtttactctagggtgaacaaggaaataataacaatagcaataataataaggtcataacaaaggtaaataggcatggctaaataaaacagtgataacgcgggaatttaaataaagcgataatgcattaatttaaattaaaaataattttgtaaactgggattcaatatgctcaaggatgatgtgacttgccttgctcgctttcccaaatgccggcttcaacttccacgaagagcggatcttccgaagctgcagcgtctacacgaccgacggaaaagaaaaggcttttacgctaataaactccacataacagcagaaaaaccaaaaaaaaggccaaacccaaaaaaaaaaattggggggggattcttgacttcttaaggaaaaattagagacttgaacggtccaattccgagttcaaatggccaagttatggccatttgaagttatatgctctttaaatggat

SEQ ID NO: 108244 - DNA, 2002 bp, Oryza sativa
acagtagtccatcagttaagtattggatggatggaagttgcttctatctatactataaaaaacccttgtagctgattcggtgtgggttgttgcgcccctcgaaggtactcttggcagccaccgtgtattgatctgatcgtcttgatcacagacactgaaactttatagcggtgactttttccgtggattaatttgttaaatcaaataccacatatattaaggtaaggtcaggaaggctgcggcttccacttgattggtactccataatagtgccaagtaaaatcagtctcactctgtagtggtagttgaatgaagttcagttccttatagtatatgttgggcttttcagatttttgtacttctcattctgcaaccaatcattctacagaagaaacaaatagcacatatttattagtctgtagagaaacttgcctttgcaatgacatagaaagtactgatcaatcaatacatagtgtaatgagatgtatatataagatagggcctgaatgtgtgggaagtaagtggattggacatggtctgaatcaacgattagaaaataatgttgggaagataacatcaaatttatacagatattttctaaagctatgtttcttgacatcacttgttctggataaatatgtatctcacattcagtgatagcatgtttatctttgtctcttgctgattagggttgcattattttagttaacatatttcctgtacagaagagatactggatggtatatttatctttgcctcttgccgatcagggttgcattgttttgattaacaacatatttcctatatagaagagatatgtaataacactgaaactcattaggtctttatattaaaaggacatatttcttagaagagagcttatctaagcatggaagcatggttgaggccaaaaatggcattggaagagagcttgtctatgcatggaagcagggttgaggctgtgctgtagcatgtaggttgacaacttgacaatgttaaatgaaggttgtgccaaagtggcggatgctacgacgaagcaaacatattaaaattaataaagttgtagcagtagaaagataatatgaggtaatactgcatttctttttttctgtacacatgatgactcaactataatcaaaggatgtagctggctatttatacttcagatggccttgatagaacttttggctcgcggaaggatgtatgccgctggaaagcagaaacgcatcaggaatggcttgcagcttgctgacaaatacttagcttgaatgcttgaatcagcgataaccaaaagagtattatagtcacggcggtatttgataatgcaaatcaaataatcaaaagacaatatatgtttcagtaaaggagattgatttaagacatgcaaaagaagtaataatgataagaagagttatatattttgttgttaatacgtcctgttataaatatttgaggtttactctccagcagggtttacaagaaaaatcaaacttattagactggcaaaaatgtttggttttgtgttttcagcaagtttaaaaattcgaactgactttaaatttttgacaaaattcaaccatattttaccagaagtcaatgttttttttgtagtaatcagttgggtcgttaacggtgcatacttaccaaaaaaagattcatacttgtctatcttaatttcttgaggaataactcaaccattcttttttgtgtggatatgcattgtcctcatacagtgtatattgaattgattagatataatcattgatgatcttgaataaataattttaagttatatcataatatttttttttgatatatgaccttcatatagtgtatattaaattgattagatataatcattgatgatcttgaataaataattttaagttatatcataatatttcttttttatatatgaccatggactgaaagcttaaatggacagattctaggaaaattattttcattgcagtcgaattttaataacttattaagaaaaaat

SEQ ID NO: 108245 - DNA, 637 bp, Oryza sativa
agatcaacatcaatatttaacctaatcggctaccctctattaacagatgttaaccgatggtaggttagatgatgatattgctagagattatgtaagacatatgataactcgacgaattacataaacgggattagagtatcatacagatggaagcactaatcctaagaacgcaatccgtcataacgaattttacctttgttgaagattgaaatcgatgcagctcaacccgaaagcaagaactcgtcaaaacaaaactaaagcaaaaagggtggcgatgcgccgagattgtattgaacatgtgttgttaaaaattacatagggctcggggtctatttatacccgagaattacaagatatgcccataccggacacgactattatctctaacaaactctaagatatcataagtctttgcggcagacttttgcccatatttatctataaggaatttacataagatatcctaattaatagatacaattgccttcccaggactctatccgtgcgtggcaatcatcttgaagcacattaacttgaccccgatgtcgtgtacaagtcgtattgtccgaatcggctgtatcggcttacttagcccgactcagacccagccgatcctaaccgtagccgatctggactc

SEQ ID NO: 108246 - DNA, 2589 bp, Oryza sativa
gcctctccccctccccccagtggcccgcctcccccgccaccagtcgctgcccgcggtagggcaggtatgccgccgcctcgcctcggccgcgagatcgccggtcgctaccgccgccgccgccgccactcgccgactcgcggtgcgagagggaggagaatgagttggggagggggcgggggggaggggtggggagggttagggttttgataaggccgtgggccgaccggaagggacggaaataagtctattttaggtccctcaggccggaaataagtctgtattaggtccctcaggccgaaaaaaaaagagaagttcatttttagtgcttcattttttcagaagcatttataattatagttattaaatgtgtttatttctaagcaaacctaaaaggaaggattttctttctttttccaattaaataattattaaatgatatttgtattattaaaattagcaattaagttctgaaaattccaataaaattccaaagagcgtaactaatcatggagaatttaataaaattaaatttaacaatgtcattttatttctcgtacttgctttacttgtaaatttatttaattatacacatacctacttaaaaataccaaatatttcagcgaatttgtattttaattaatttgcatatttttactgatctgtgcgcttcccagtgcaacgcacgggcacttttgctaaactaaacaacaattttggtcaatatacacactccgtaatcacccggtgcaacgcacgggcacttttgctagttatttttatattcttttattttgaaacagaaacgaatgtgcaagaaacaaaaaaataaaaattattgaatacagatatgggatgaataagaagcggaatgaatactttcacggatatttgttggaccataaaaaccccttacgaggcttccgaaatcaaccgagagataaagttcgtttaaattttaacaactctatatacatatagaggtattgtatggacatatataaactaatagtatcatttggttttattacaataaagatacacagttacactaggcaccataaaaagctccaacattaataagaaatatcaggccattataaacatatcatatttgttgacgtcgaatcacgccatcacaccttgagcatgttatgtgcaacctgctgttaacaactaaatttggtaacatatgtgtcaggaaagaggatttgatcaaagcggagtcggaggcggagatcgggttcaaaagcagagcagaaatcggctggagtccagatcggctacggttaggatcggctgggtctgagtcgggctaaataagccgatacagccgattccgacaatacgacttgtacgcgatatcgggtttaagttaatgtacttcaagatgattgccacgcacggataaagtcctgggaaggcaattgtatctattaattaggatgttttatgtgaattccttatagataaatgtgggcaaaagtccgccgcaaagacttatggtatcttagagtttgttagagataatagtcgtgtccggtatgggcatatcttgtaattctcgggtataaatagaccccgagccctatgtaattttttaacacacacgttcaatacaatctcggcgcatcgccaccctttttgctttagttttgtttcgacgagttcttgctttcgggttgagctgcatcggtttcgatcttcaacaagaggtaaaattcgttatgacggactgcattcttaggattagtgcttccatcttcatgacactctaatcttgttcatgtaattcgtcgagctgtcatatatcttacataatctctagcaatatcgccacctaatctactatcggccaatatctgtatgcagaaggcagccgattaggttagatcttgacgttgatctagattatataagatatctaccattttacgaaacttctagcggcttgattgtctagatatcgttcttcttttcatacttaatgctgcatcagttgagtttgatctattaagtcgtgcttagaatatcgatctctagcctgccttctagttgccgattagaatagcatcggagtttcagccgatcgtatctgatttagctatatttattctatatgcctcattgatacgttaaatatgccctttatatcaagatattgctgtatctaaatatgttaggcctttgtttgatatattattcttgctttaatatcctgacatagagtagtatcggagtattagccgatacatgatagatctacctgatcggctacgctataaacatatatagtcctgttattgatatatatttcgatctaagtgatttatactgtctcggcatgatgaccgatctatcccaatcacttgatttaagtatacatcaatataaggagtatatatcgttaatatctacagccgatcgagtagatttagttcttctttacttattcatgactgccgatcgatacacagatgacatcggcccaaagataaatgatatgccatcggcatctagccgatcggctatgatttatagatttaaccacgggtcctttgcttctatttcttgttgattacaggatcaaat

SEQ ID NO: 108247 - DNA, 2446 bp, Oryza sativa
aataagtaaactctaaacagtagggtcaaattggtagttagggtttaaaatggggtcaaataagcaattgcccatttagattaaatgcatatttatgactgaagggagtaatatttatcttgtggctacgtacacttttagtagccacgttacgcaaacacacataggccctagtataaagttacagaggatataaaatttattctcaatccatatgtactagtttatatcgtgagtctctgtctattactttctaggtgaactggacaggcaaccaaatggcttgctcgccaaagcttaatatggggatgatattattataagtcaattacgaccactagaacggtcattcaagtgatattcttataaaattgaaaaaaccagtggcaaattcgcaagttcccatgttgttattggtgttattgacagaggtaataagtagttaaggtctaaaacagtaccacgtgcaaccagagactccctaccgtaaaatataggacaacatatattttagtcaaaattttataattctaaccattaataattcttaaatgcttattttaaaaataaaaagaaataatatgcatagatttgccttgtatactactgggctgaaattcttggagagttggagggttagccctctcgaggttttcaaaatttttgtgcaataacaaagtaataatcttaaaacaaccatacactcattaatactcctagtttttcttcgagctccatcattgaattgtacaataacatggtaaacttggtccataagctgtgtgtacgtatatttagtaccaccttactagttcaacatataggatcgcacaagatcaaacaaacctatgaatggtaggaaaaacaaaaaacccaaaaatcttttgtggaattaaagattaaccttgaacagagtagatgatgaagccttgtcactgccggtcgaaccgcccgaacacctacggtcagaccgctgctatcccatcggtcagaccgcacgcacacctgcggttagaccgtcgggacccagaaacaccggtagatgacaatctcgaatatgtagattagaacttttgactttattgcatcaactagtgtttacaaagtgcaccaacaacactcctcaccaaaatctcgaactaaactcgaaaccctaactttctctcaactcaagtctctctaaaatcgatatcgggaggcctcaccctccctctcattttatacatgaggtaggctgtgcaaagcccacgaatctaacacaatttaggactcctaaccatgtaggaaactctctcttgcaagtatccaactcatctctttccttatctcagtcaatcttcccgaatccggattcccttccaaattcgactcctctttccatacgtacacaatccctcttgtataccatatgaatttcttcatcaccacgtgtattgtgatgaaaatatgaacaaatggtttgtggttcataagagttgttcatacgaatttcttcatcaccaccttcacaaatccctcatttgtgtagtttataagagttgttcgcacatgtttagtgccacgttactagtttaattagcaagagtgaaaccaatttataagatcttgtccctccaactatatcactcccgagttaaccattttacagaaaacaaggaaaaaagtgtaagtgatgtggtatgtataaatagatccgcccattggatggactggggcatggcataggtagactcggtgtgaggcacatggcacggatgatttgtcctgtatggcacataagagttgtgtgcacatgtttagtaccacattgctagtttagtaagggtggaaccaatttataagatcttgtccttctaactataccacttccgggttaaccattttgcttgaagcgactcccgggttcaccatcttatacggagcgtggacgtaaatgtaagtgaaatggtatgtataagtgggtcctcccgtaggatggattgagctatgtggttctggagtgcaagctattacaactgattatctagttttagcaagttttatcttaaataatatttatgtctgaagggagtaattatatatatgttggatcttggatggttgagttgtcagttctgactccattcattgtgtggctacaattttcgtactcactttatgcaaacacaaatgggtcctagtataaagttagaaggttaatagatttatccacaaaccatatgtattagggtattatatcgatagtctatatcatttttattacagaggactcaatagaaaaaacagtagtggtgaagtataagtaattcccagctctacatcatcaccttaatattgctttttcgtgaattggttagcataaataatttaataattgtttgttataaaatatcatttagattttcaattatttgctattatcatgtaggtatcacacctgagtcac

SEQ ID NO: 108248 - DNA, 556 bp, Oryza sativa
cgcgctcctccctcaccagccgccagccgcctcaccccgacgatgacgcacggtcacggcaatggcgccgggcggcacgtgggggaggagggaaggcagacgaccaccggtcctccccgcgtgacggcagccatcggcggcgctcgccttcccgtcccggtctctcgcaccgtcctcgatttgctcccctccccttcccctgccgaccgccgttcccatccccacccccgccgctgccgccgcccacctcgccgtctccacgcccgacttcgacgccgcggtgggggcactctttgcgcgccttagcagccgtgcgcgccgtgcggtcgaggagggtggggccgccgcactcgccttcgacgaggccgatgccgtgctgtcaccgccgtgtcgcccgccgccattcctctgcctcgtgggcctcgtgggcggcggccggcggaggagcccgcgcgccgctcctccccccgtgcgccgttcctacccccacgttgcccgtcgacgggtgctgcaccctcctcgtgccggctgatttagagaagggagagagagagat

SEQ ID NO: 108249 - DNA, 1572 bp, Oryza sativa
cccccccccccccccacgtgaggcccccaccatgacgttcctcgtctcactgacacgccgggcccaccccgcggtgtgccctccttcacccctggcatccttatcctgtgcctattcgacacgtcacacgtgtgcggcgcctaaatgacgcaacagtacagtggctagctatcagcactgtagcattctgctttcatcgatctcctgctatgtgagtagtaatagagtggtactagtagtaggtcacaattcacaagccatacatatgagtatattgtacaataatagaccctgtttaaatccttcaaaatagcaaaagttttatcattttaaagtattttttgttatgttgaatctaaacattaatagtaaaagttggcaatttgtcatttgccatttgctaatttatagtagcaaattgtgtcaaaaagtgctttgggaccactctctctttaaaaaaaatgataaaatgataaaagtttaagcatcttaaataccatacttttgccattccaaaagtatctatagatgcccatggatgcacgcagctgggagctgtagatgctatcgatccccctgcgatctcgatccgattcctcctctaatttttcacctgtcatgaagtccgattactgttccctttaatttccctccgcttccgctgctgctgctgctgcatgggcgttcgctttcgtccgtcgacgcctgcgacaagcaaaaaaagctcagcgcggaatacggcgggagcggctctctctctctctttcggatgccttgctgaaggcgggcgaggacggccacggccagcgtacgaaccacgcagccgtctctgcgggctgtgctgggtacagtgcgcactcgcgcatgcaggcgcgcagaggcatatgcatgcggtaacatgacatcacggccgcgggccggggtcacgtgagtagccgaacgaggacgtttgggccggccgcacggcgctcgtttttttcccctgcgggtgtcaggacgggcggcaggcaggcaaaggcagcgagccgtatacggcatggggaaattatggcacacggccggccgctgcctgccgggcgggtccgggggggtcgcggcgcgtggcagtgcacggcgcgggcagcggcaagcgggcaggggtactggtactactggtacgtgcgtgcgtgcgtgcgtggggcgtcaccggaaaagacaagacggaggcgatgccgtaccgtacatggtaggcgcgcggtaggcactatacggagtaaaggtgccgtggcggccgtgcgaggcggtttatttgaatgctgtgcggcgacagtacgggtacaaggcttgaaaaaagcggtgctaacattgattaggccaggcgtcctgtgaatctgggttattagttcggtgaagccgtaatgtttgctctgcacgttccattcgttaaatcttttgctttttttttggcatgattaaatctttcagttgtctgtgcaatttataactgtctactagcaccgcaacattatcttcatttgaaaaggcgagggtaacataaaatgctgcactgacagggagcatcacaaagaaatg

SEQ ID NO: 108250 - DNA, 616 bp, Oryza sativa
ataataaagaggccggccggccggccggccgggctggagcagtactaccggtctagccggtccatccaaaacagcatgggcatggctaccctatacagtacacacgcacgcactgtgccaacgcctttggcctttcatcaatggtacgcctcttcccaaggcaggggtcgtcgccgctcgctgcgctgcaccatcagcgctcgacaggtcctcccgctgtcccacccagcagaaggcagtcaagcctcgcgcgttcccaaggccccccccttctctcccttcccttcctcccgctgctgctgctcctgccgcggcagcctagctagctgcggccatgccatgcccgtctcttccccaaagtattttttcccacattcaattccccacgagatttggacgggtcgagccgatccatcgtcgggtaggcgcgagatagctactgctgcccgcggcgctgcgaatctactccggacgaggagtaatttggagcgtgacaagcggctggctacccacccaccgaacggcgtgcgcgcggacaacgccgtgccggataggccacccacccaccggggcgcgccgaggcgactgctactgttgagcggcgccgcgccgcacg

SEQ ID NO: 108251 - DNA, 578 bp, Oryza sativa
actggcacactcgcatctcatcaagatttggacctgcacaggagctaagcagatctcccaggccggtgtgttcgaatttttcgtcaacacaaattggcacgcttggtgggaccacgaattttatatccacatgtatgaagaagaagtcaatgccaagatcatggtcacggtggagaatttaatggaggaacaacaatattggctcggggggcaagcgcatcagttttagcatggtggagcacatcagtatcggctcatgaaactgttcaaaaaaatgttatatagaaaaatgaccaaactaaaagttgtaaattttgataagttatacaactttgttgttgacattttttccatttgaaatcatttactaccctgaagttattttgagtcataaaatgaattattatactgcacttaattattttgctatagttcaacttacaaatataaacatttcatacgaaaaatgaaaaaaaaaaactcatcggtgacgggctttagttaatgcccgatagagataagtcatctcaatcgggaattagtatatagcccgtcaatgatgagtcatctgtgatgag

SEQ ID NO: 108252 - DNA, 752 bp, Oryza sativa
ataaaattaccctttacttaaccactgatatttttccatggagaaacaaactacgaaaacagagtaaacgaatgagagtatccctttaaattttagaaatttattttactgttaattgtgggtgtttcattgttttctaattctcggcaagccaccctagctttgaaccgctaaaagtaaaagtataaaagtcttattttaaaattaaattacttttagttgttttgtttatttttcttggctcgtagctaagccatagctttattggatcactgtccactatatttattccatatcgaaaaactattttaaaagattttagtagtggtgtccgttctaatattctaccactaccacacatgattcgttcgatcgtgtaccaacgttgagatggagacttagcactgtcatggtcgtgtcacccaaatttatattgtttaagggttggagtgagccaatctgcgaagcttcaaaggatgaatgtgtacaatataactatttataactgtcataggattacttatagtcactttgctagctattgaaaaaaagctaaagaagaattcctatgtcctttgtttagtaagggaaaattggaaccaagacattataattttgtaaaatttgagatatgccatcctgaccaacatgtcattgactcatgtaggtcctacatgtcattgatatatcgatggcatattttaaactttgcaaaattataatggcatggttccaaatcttgtttttttagt

SEQ ID NO: 108253 - DNA, 648 bp, Oryza sativa
cggcggcgggggacggggacagcggcggcggtagggaacggggacggcggcggcgggggacgggcgcgcgctgatggcttcggccgtgtcgcatgggtgagaatcgcgtttgtgggggaaaagcatcccgttgggaaacggtatcccatcccctagcattcccgtttttaaagccttattttataaatagatccttaggaaaaccttattctagaattgaatccttatggtgatgttagcatccctcttgttcctaagaaaactaaatcattgatgtaaaatgatcgacgcaaatgacactaacgtcaaggggatggtatcatcatattgtccatcatgttaaaccacggcgttaatgacgttggtgccgcgaaaggcatatatttatgtaaataagaagttaagtaaagtctatcaccggtccctaaacttgtaccactgtatcatcccgatccctaaactcgcaaatcgaccgttcagattctcaaacttgtttgactgtgtcatcccggtccctaaacttgcagatcactcgtttaggacctccaacttgttcagttgtgtcaccctggtccctaaacaggacagtctaaaaactttatatcaaaaaataattcataactttttcatgtgaactctaatgaggac

SEQ ID NO: 108254 - DNA, 929 bp, Oryza sativa
ctatgttgaaaaaatattaaaatcaaattcaaaaataagttttaaaattcaaattttggctttggcttctaatgaggcccttgctcttgcacggcacgcacaagtatcagtatgtatagtactagtatcagagcaagtacaataatgagctaatagcctgcttacataagattttaacatacgtggcagagagagaaagagcggagagataaaagcgaacgactatattatcaccggctcaggcgcgagtgcctagaaactttctctgagggcacccacaatggttatctataggctctctacaagagatccatgtcagcatattttcctacttggaatgtattaaatgaagagagagagcaaagctatctactaacttagagatagtctatagagaaaaacgagacaatgcatgagagagctatagatacaaatgtagacatactattaaggtggtttactattaatcgagtctattgctgagatgtacatgttttatagatagcaccttactttaccattgcgggtgctctgacgcagccctgtgcaagggaagagatacctgcgaacagccaatagaaagatagaaccttacgttgggtaaagcaaatgttatagccgattactgtatttagcgtggtttaattagctgttagatgacgtggtaaatttttagcgcttacaggtgactgtactatttaacttactcttagttcgagtgtccgttccatatcactacatttacagtgactggggtttcccagaaggaataagttcactttaggtccctctatttgtcggtcagttcgattttggtcccttgacaacaaatccgggtacgacccgtcccccaacttacgaaaccgggcaaacaaagtccctcgccagtatggaggacggttttggccgatgtggcatttatgtggcgc

SEQ ID NO: 108255 - DNA, 658 bp, Oryza sativa
agcggcgtcatcagcgtcgctccgcccaccgcccgccgccgttccatttcgccgcgctgccgctccgcttgctcccgtcacccaccgcccgccgtcacttattcatcgctggccgctgcgccgcttcgctccgtcgccactccgctccatcgccgctccgcccgtcgccccctcagcaccgtcgctcgcccttctctcctggcagtgtaggggggagagagagggggatagagataaggaggctgacatgtgggaccacatggccccacctttttttaattattttttgtgtagctgacatatgggtcccactatttttattattttttcgagataaaatggccacgtaatcgccacgtcaatgccacttgggatgaagacctagtcaaaggagccacgtaggcgccacatagatgccacatcggccaaaaccgtcctccatactgccgagggactttgtttgcccggtttcgtaagttgggggacgggtcgtacccggttttgttgtcaagggacgaaaatcgaactgacgcgacaaatagagggacctaaagtgaacttattccttctgggaaaccccagccactgtaaatgcagtgatatggaacggacactcgaactaagagtaagttaaatagtacagtcacctgtaagcgct

SEQ ID NO: 108256 - DNA, 1525 bp, Oryza sativa
attcgtctcgcaaattagtccaagattatggatgggttttattaatagtctacgtttaatatttataattaattttcaaacatccgatgtaatagggacttaaaagttttctcccatctaaacagggccttataataagaagtgggcaccagatggggacccaagcgagcaaccagcactagagtgggctggttggccgactgctgtacgcctgtaacgactgcatactgaaaacaacgcaatgcagcagaattggatcctgcaactcctaggatttctgtgcaagcattattctttaccggatctgtcagattcatcctactacctccacttccgtcccataataaatgcagccgtggatatccgtgtccaacgtttgactgtccgtcttatttaaaaaatttatgaaaaaatttaaaaaatttagtcatacataaagcactattcatgttttatcatctaatagcaataaaaatactaatcataaaaaaaattcaaataagacgaatggtcaaacgttaaatgtgaatagtgtaaaactacacttattttgagacggagggagtatcttttgtcacagtcatatttgggcttgtaggttcagccaccggctgttcttcggagttcagaggatgctgaatttgctgatactgatcaaagttggagcaccaactacagacgagtaccaactggttcaaggagacaaccgcttaacctaactcgtgcctccttgcatgccctctttggtctttgctgctgtcgatatctattgacacagtgatgcccctggtcgtcttttctacagtcccgatcaagtactacggacgaaatagatttgcagatccactaacatcgatcaggatgctgccggccgggttaatttatcagcgagtcgtgacaaaagctagctatactcatcaactgacactgtagcgtacagttgacgtcaccgctgttaatcctgacgagctgtgccctttgtcgaaggctaggagtattgccaggtatattgaaatacagttgctaaactgtgacgacagaagaaacagcagactgcacgttgatgatgatgatcgaccgacccacccttgctgcatctgaatctcgcgcccactcgccagtgtccaagttgccagttcaacttgtattaattcggaacactgctggaaccagggtgcacaggccaagaacagatatggtccatagcgtactcgatccatgccataccctatcgatctcacccggagatattctctgatactactgcctcagcttaacttgactcggactatcttagctagggggagactgaaagtctgagctctgaaactcaccgtcgtcgcctgcttataatggtctgcgagaacgaatcggattcccaagctattgcctcctgcttgctctgatgaagaagcatttcttggagatcagaaatgagtgtatatactactactagcacatcggtcagcggagacggtgatgacgcaagggaggatgccggagacgggagtggagacaagcgctt

SEQ ID NO: 108257 - DNA, 666 bp, Oryza sativa
tgcaccccgtaaatgtttattgatgttcaacatttttctggtcagctgagtggcagatttaagctaatcattgatttattctatctcaaaaagtcattgtatttttttatccattcagcgagtgctagatgccaaagttggcatgtaagtgtaagttattcccaatgtttttaaaggctgggcaacaaactgctactttatgtttgttagtgtgttactgattttgtatgcaaggcgaaaagtaagcttcaaagtctctgcccaaaggtttttgagaatttagtgtaatggtactttcatgatagtaaactagttattgaagagaaatgtatttaatacttgaatacaatggggcccttgtatttcctgtttactattgcccatttcctccaaaggtttttccttaaaagttttggattaaatgctataaaattcacgaataacttaagctcttgagagatgatcttgctatttgttagctactccatattttcttaattcagaacaacctatttaggttgtttcaaatcatagactgtttctgaccagttttccatcattgtagatgcgcctgaacaaggtctcagaactcatacacaattcttctaaccaccagaatctagacagtgctggggtctccgtccattttcaagaaatcattgattt

SEQ ID NO: 108258 - DNA, 665 bp, Oryza sativa
ctgcgccccaccataggttttttttttttgatctcctgccaccatagttttggtggttgactgtggccgtttttttaacacgcttctgtgtgctgcagtgcaagcccagccacagctttctgctccctttcacacccttcttttatttatttttttagacttaccctttttttattttgagcggcaaatctatcgcctattgatatactctccgtccctaaatatctgacgtcattgacttttttaaacatgttcgaccgttcatcttattcaaaaaaaattaagtaattattaattcttttgatatcatttgattcattattaaatatacatatagttttacatatttcacaaaagcttttaaataagatgaacggtcaaatatgttttaaaaagtcaacggcgtcaaatatttaggtacggatgaagtatgatttgctaatatacgtagattcacgtatactactagttcatagttcacacaatcactcgcccaatcggcaatgcaagaattcttgagaaggcgacatcactgttgaagtagagtactccctccatgaaaaaaacaagagacaaacttaaacatgaatgtgacattataatgaatctagataggtttattgtaccagaaaatattatatccgggtctaggtttgtttttttac

SEQ ID NO: 108259 - DNA, 1007 bp, Oryza sativa
ttgttttgtcgtcggcgtgaactcttcattgtttgattgccgcgcgcgcgccgccgtgcgcgctgcagcgccgtgcatgccgccatcctcgccgccgtcgcccctgtctgcatgcgtgcgcgccgctgcgccgtgcgtgctgccgtcctcgccgccgtgcgcgtctcggccacgtccccgtcctcgccgccacctccggccccgtccgcgtgcgtgcgcgccgccgccgccccttggtgtccccgcctgccgccgtgcgtgtgagagagaggggaagagtgagacagagaagagagagagaggagaggaagagtgagagagaggaacagtagaagagaatatgacagatgggtcccactttttttttataattagaatgctgactggactgccacgtatacgctacgtaaacaaaaaccaccgtggattggattaaggggggtaattcatctggtttgcatagttagggatgaagaatgtccggttttgtggttcaggggagtaattcggacgaccgcgatagttcgaggaggggggggggggaattctactttttttttctttaattttcaattttttcatacttgaagtaaaccattcacttcgacataccagtctaaacacaagaattcatttcgaggcaaagtttacaagatccataagggcccgtgaagtttggagttgtatgtctctctctctctcggcccgacggcccgcaaaacgcctcctcaatgcggcagtccaacgggtgaaagactgaaggcctgtttggtttggttccaaattttgccccaacaattatttggcaactttaattttttttagataatggaatataacatcccggtttttactcaaaagagttacacccaattattacatagaaacgtttgaccaacatagtgtaaatctaattgaatagaacacacccgcaaggaacaataaaaaatctaccctaacataaagagattacaattattgaagtctatttgtaaatctccaaccat

SEQ ID NO: 108260 - DNA, 546 bp, Oryza sativa
gaaagaaaagaaaaaaaaatcgtgaaaagaaagaaaaggaaaaaaattacttggggggagggggccaacttgcgcacgcgttgccgcgccaatttgccacacccgagcggagcaccccgtcggatccaacctgacccgaccattaagcgggttgtgcttgcccaacttatatcgggcctaggcctggtcgtgcacgggccgggtggctcatttggtcatctgtagttgcgaatcagcatcgttcctctcatcggctccctctgacttgcttgttccattcgaacccatcccggcttgcacacatagacctctccccacctcctctcgaacgatccagatggccaggcgaaccccgacgccaagggcggatctactatgggcacggaggggctcaagcccccacaagcatcggtagaactatgtaagccctcactgaggttcttataaaatgagggttaaaattatgtctagtttggtcagccccacggtgtacttcctttattcttcatttgtagtgcttacaactgctccttttgcattatgggc

SEQ ID NO: 108261 - DNA, 642 bp, Oryza sativa
caccagcactactagcatccacaaagacacaactttcagggttaggctgccttttggtgagtgatcaaatcaaataatcaatacgaggagtattaagataacacaaatatctatcactgagcagagtgcaccaatgacaatattggtgttttggtgtcatgcagggagcgtgcgactgaagaaggtggctgtctttccacagtgcgacagagtagtactgaggctggggaagaaacatctgcacggggcattctcaacctacaaaaattgtaagaagcacgcccaactcgtaggcacaatatacttgcgctcaatctggggttgttttgctctttttatgtcactatataaacaaaaaattaagaggttataatttgttttacatattcacaacgtagtaaaattattgcttccgacacagtaaatctaaaagtagttttttggggcgcaacacctgaaaatagttacaattatcgagattatcacagtctaacgaaatgccaatggttatcatacacaagaacattcttctgctctacttgcatgagtacacttgtttgtctcgatcgatcgtgccacaagacagtacccaccggaagtccggtactgcatcatgtcacctgaagtgtctgccttttgctt

SEQ ID NO: 108262 - DNA, 687 bp, Oryza sativa
taaatatttgagcagctataaaagggaccaccttcgcatctcatgatttctaggacttacgatcatcttgtcattaccttaggtggtataactttactaagcaatctaaattatgccctcccagaattcctcaaagggactgataccatacaagaagcagaaaacttgagagtgaatctagtactaccaaccattttccccaacaaagtattaacaccaaagtcatgacaacccccagtcagatgaaggtgccaattaactgttcgcggcatcgcggttgataaggcttgcgaattgagtggcatataataaattttctctgataaacaactcatatattttttttcgcgaacgcaaactaactcatataggaattgatacaaataggtgtatcagatgcaaacatgaaccaagctagatactagtaatacattccacttacaagctgagacctgtataatcgaatgtaaagactaaaactacagctaatttagcaagttatcaggcataattgaagctactagaactcacagtgaaagctctcccaataggtgtggccatgaagtcagtcagctccctcctatactgcacaggaaaaggcaaatcagccacaaattaatgaattccccctaaaagagaggatatgagataaggagaaagctaaatggtgatgggggagaaaaagat

SEQ ID NO: 108263 - DNA, 664 bp, Oryza sativa
  unsure (1)..(664): unsure at all n locations
atattgagagatgagtttagagtccacatagcaactcaattagaaatattaaaaattcagaattaaaataaattaatattagaagagagcngtaaagtctatatagaaatacaatttccagaaaattcggaattaaaaaaagaaatattaaaagccgagtctagagtccatataggaatatatataatttacaaatacctaaaatttgatattaaaaataattcttaaccaacacgtatataaaatacaatataaatattactcatttgtagtttcgtaaagttattgcaaaatttaaaattatgatatcattttaatatatttgaataatataatgagaaaacatatatgctattatatgagagaaaatataatgatgctagccgcgcaatctgcgcgggtcaccatgctagttttttaataaaaatctaaaatgtaaaaagtctacgatgaagagtcgcacgagaggagcatatcgatcagctgatgacaagtacatatagatcatacatgatacatcacacatataggagtatagtacgtccacagtccactgcatattactgtacgtaggtggctgtgcctgttcggcgctgtaccagcagatagaatttcatcaatattagctggccatgtttattcgtgtaaccatattatttcatgg

SEQ ID NO: 108264 - DNA, 7070 bp, Oryza sativa
cggcgcaccggcgctggcggctggcagcggagccggggattcggcaggcggcgcgccggcggccgccgcggcagcaggccgttgtcttctctcttttttttttgttgagattctgtgattcagatctgagacgatttgtgtgtgatgtgaatatgtgatgtatttgtgatggattttgtaaaagttgtgatgtaatttttttaagattttgtgatgtatttagaaatattgatttgagaatttggagactattcggggatgattgatttaggattttgggataggatagagtgaatcaattaattaaaaacaatgaagaaaagaatagaataaagtagcaatcggagctagccagctagcctctttagtcccgattacctactctatctttagtcccggttggtgctaaaaatagatttttactttcggtttttttacccgggactaaagataacgatctttagtcccggattcatagtcccggttggaaaaccgggactaaggggggttacgaaccgggagtaaaaactccttctccaccagtgcacgttggttttctatagcaaggtcaattaacctcttaatattactttatctttttctttggtttttaacgatgaaaataatagtattcccttttccctcttccttcgtgttctctccacatgaataaaggatatgatttaccttttaactcgctacaactgtaacgttttagggaccagtaatcgtgcacgtgcaatgcacgctactcacaatatgtattgcacaaaattacattcaagatgtaaaagacaaaaaacaattaagattttattattgcaatgattaagacttttacattcaatttgagaagcatacatcagtatagaaaaccttcctaccagaagttaattaacagttgaaggccttacaaactctgagatgaaatctaatgggtaaatccgagatgcaatccaaatggtaaatctgaaataaaaaaacaaaagttaagcggaggacattatccatatcaaatccattgaaaagtcatgcatgtgaaatcatgtgtagcaacattctggactttggtgaacatatctcgggaaactgacattcatttctttttattatgattgagctgagggatcaatcagtgactcagtgtacagtaacagtatacttactaaaaatgcaaaggtcagctaattaaaaaatataaccagaacattcggtctgataattttggtctgtttttggactcaatactttaacattttttggtaattagaatctgggtacgtgtactggccacatggaatatattgccgagggatcaagcatactgtaatatattagctgcttacctcctcatgaaatttgccattggcttacaacaaattcagatataaatgaaatgtgcatattattagtgctttcagaaagtggcatgagagctcttttgatatttgtgtagaaatagataatatagcagaagagtatcagtagcctaaacttttcagaaatccattgcatgtgaaagtttgagaccctctttagtttagatggtaataaaacttttaagtcactatcacattggatgtttggacactaattataaatattaaacatagaagattaataaaacccatccataatcttggactaattcgcgagacgaatctattgagcctaattaattcatgattagcatatgtgatgctacagtaaacattatctaattatggattaattaagcttaaaaaaattgtctcgcaaactagctttcatttatgtaattagtttttgtaaatagtctatatttaatactctaaattagtgtctaaatacagagactaaaattaagtcactgatccaaataccacctaaatctcatagcaaatgagcaaatcctgacaaggatgtcagatcaacattcaagatatacgcctaatcgtgcaagtgcaatgcatgtgcaacatttatagcaaacaactgatgtcatgttcgcataatctaggacatgcttattttccatcatcaagaaatacgtggagattttgatgtgccattgtttttattgacagaatagtagaaaaaattctaccattggagattgatttatcgcaaggagcaggataatttggagatggcaaatcacaataaaaaataattaatcttaccagctgtaaccaactgcatttccagccactataggatcatctccaaacctccagttttgatattttggctatgataataggtctcgagcaagcaagctgttgttgcaacgcttttagcttcaagagaaacgaaaatggcgacaaactagatgcgtgctaaagaggccatcaataacaaaaaaaaaatacttagcaagatttacaaaatgaccagagagccataagctgaccttatccctcccaaggttgcgctcccgggaacaaaaatgagataatagcaagttttaccagcaagatgcgtgaaatgaacaataactcattgcacatatttcagttggcaactaaacattgaagtttctaggataaaatttaggggaaaacttactgccactctgccagcatgcatatgggaatttgtctgcgcaagctgccagatagcgagccgtagcttctagtcaattgcttctcatctctatgatcttgctgtatgcaccaaaacaaagcaaaaatcgagtcaaatcaagagcacatagcatcaaaagccacagccactcaaaacctcaaacagaagggatgaattgatgcaaggaatcaggtggtttcagggatgtactcactcactcctggaattggcacaaaattcagaaaatatatcaccgttagcgagcaggcccatctctcagattagtagcaatctcagagatcaaagattaaaagagagatgggatcttgccttgaccagccgcgcgattccctcctcgtccggtccgcatgctccatgggtgtacctcctcactacagccccgcccttggatatggatatggagctcacaccgttcgcaaaacctcctccttggcgcagcagcaatggccgcctccgtctccgccgctggcagcgctaggatggcgacctggtggagaacaaggacggcgccctccatgggtagcttatctcaatagaggaggtgcagtggcgtccataacgggaggcggcaccgttaccagaaggttggcgcggcggcggcatcatcgggcggatgccacggcccgaagatagcgcgatggcgtcatggcgatgtcaccgcgcgtccgctgggtggggatggggaatcaccgctcaatcgctgaattactgagttgaccagacgcgttgcaagacacaatcctccacatccgtgttcagccgttggatggatagatcgaatggctgagaaagcaaagttgatttcacccgtagtattggaagggggcaactcctcctttttatattagtataagatgaaatagctcaagagctccaccgtttttccccaggtacagtgtaaacccagacactcattatatacacatatctccttgtccaatgagtatccgaaagcgtgtagaattaaatcttacgagtactttttctttcagtcatatttatcggacgagtcctaacaatctagggcacattatctattttctatctgagaacagatagagaatgttcgaccgattttttccctcaaaacttttaaattttttaccgccagatattctttaagattcttagtagagatcaaaagaaaaatatcgtgtgcacgctagtggaggatcaaagccatgaccacccgcttgcttggtagccacactctagccatgtagattgccatgtattcttagaccgtgtttagattcaaacttccaacttttccgtcacattaaatgtttggacacatgcgtagagtattaaatgtggacgaaaaaaaatcaattgcacagtttgcatgtaaatcgcgagacgaatcttttgagcctaattgcgccatgatttgacaatgtggtgctacagtaaacatttgttaatgatggattaattaagcttaatagattagtctcgcaatttacaggcgaaatctgtaatttgttttattattagtctatgtttaatactttaaatgtgtgtccgtatacttaaaaaaattgacatacgaactaaacgcagccttattagatatgggcatatacacattacagttacgtgttatttataatttaattgcattacaactatataattatatttggaagtttgtttttttaagaaaatgttgtatggatactctcttcctatcttgcttaggcatgggtaaggattaactagcccagctgagctaagctcgaagcagcaagcgttgttgttttgtttgtagagcaaattaagggtgtctttggttggaaagcagatttaaaagtcatagctgcttctacccaaaagttgcttttgctctggtacaaactgaaaacacctccacccctgctttcagctgtttttgatcaagtatttacctacctgctattagttatgatgcataccggttcgttctttgcttccccatcgcctctcaccgtatcgttcctcacgcgctgcttcgccctagggttggggcaccgccgcccctccacccgtcgccagcactttggccagcgcaccgccctgaccgagcagccccagcgagctcgggcatcccatgatgacgagaggaagaagatccaatgtgtgtatgacatgtagggcccgcttataagcgggactagttatttcaaaagccatagttgttgaaccaaacgagtttttccaaaggccacaacccatattctagagctgctttttaaaaagctacagcccacagctactttttcaaaagccacagctcaaccaaacataccctaaactaaccagtgatgttgatgcaagcgctcgcttgcttgccaacacgagacagacgaatattggctcttagttctcaccgccgtgagcaagtttttggtggtgtttgaatctcctgaagatgaagacgaacataaagattaagtgttttacgtaaaacgaggtggtaataacgtgtgattaattgagttttaattattacaaacttgaaaagggattaatttgatattttagaaaaactttcatataaaaagttttcgcacgaaactgtatctcatttcgcagtttgaaaattgtgccacttttatccaaaagtttatccaacttttgtgtgtggttaccgattatagcctagattgcttaacaaaacatttttttttctatatatcaaatggctctcctggctttactgcccctaaaaatatcacatatcctcctcttagaaatcctcctcttagaagtaagtatgagtattagggaatagggaatggggagtaaattttcaactagtagctagctggcttaattagctggcatccggtgatcgtttagccatatctagattgttgtatttgcaagacttcccattaaaggtcgtccaacgttacttttgtggttccttttggcgtttaaccttccttttttcttttccctacattttctactgaatacagtggacccgatttttttttttgacatatatacatagcagctagctgtgagattggcagaaacggaggattcgtgtgcttgttagctgtgaacaacgagtgagaatcgattcatgccaagagaattgatgcaaacgccgtgccaactccagtaaacgtagtaataactgctagtagctgccaacatatgtacataaccacttaacctgtgtctttgcgtggaagtaaccacgtactgcatgatcccgttgtataaaagtcatgctaaattgttgaatcattgtagtaacgatgtatgagatcatggactctttataagcgctttataatgtgcaagattaagcgtgtaagtgtagaaaagaaaaggtaattgcaagatttcagttgactttaagtaaccttcaaactctggatcatggagatggaaaaagagaagaggtagggagatgacgaggacgatgatgacggtaggggcggagctatcgtacatggggtgccaggtacctgatttagataggccatctatttttatcatatatgcatcccctcttaatctaaactcagatacatgtatcagtttaactcgatctaaagtaaagtaaaacaagcaggtagcacctctctatttagttctagctctgcccctcatggcggcaatgacgatagccaccgtaggtggtggcgcaccaccgacacatcataattactagtagtagtaggagaaggcaaagaagtaagcactcccagagtctctcatgcatagaaagaaagaacatatcctccaagtatcactctcttcttttagatgaagaaggaacacggtagccttcactccttcaacctttgcacatgagttcctacaaaacgtaccattcaaatacagaaataaagtaaactcagagcatagataaaacccaccctaatagcaacacacttaaggaaaaaaaaataaatttatggccaatctgttgctaccatcatgacaaccatagtactccttccgtttcaaaatgtttgacaccgttgactttttagcacatgtttgatcattcgtcttattcaaaaaaatttgtgaaatatgtaaaactatatgtgtacatgaaagtatatttaacaatgaatcaaatgatatgaaaagaattaataattactcaaattttttgaataagacgaatagtcaaacgcgtactaaaaagttaacggtgtcaaacattttgaaacggagggagtatgaaaaatagacccattacagtgaccaactacaaaatcgtatttttaaagaattcgtcgaatatggtaaagtcatcccaaaagatttgctagacaaggagaaagggtaacttgggacaaccttaactaacggttagtgaaaattaacatgttctacaattaattagggagtaaatattaggagaagggttgcattagtgattattttatagccagcattttaatgagaatcattcacatggtctgataatattgatgaaaataaattgtgcatgatttagttaacacaaaata

SEQ ID NO: 108265 - DNA, 1847 bp, Oryza sativa
tagtaggccattctcaatcgcatgacctttcaaatagttaatagcccatcctaacttaatatcatattgcaaagtacgagtaactaattgaaaaaacacacatattcatccaatttgaaagtgataaaaccatgggcagatccaccgcccatcaaccttgagtaatcgtcctgggctcgtcagctggacgatagaatttgaatgtttttcgatgaattggtcacaaatttctcatagcaaacactcgatataacaagatttgtctaggttcaaaattttttctgatatgtgatggaataaaatcaatcactcgatgacaattgacagctagcatgatgtaggattaaaaagagaggtaactaatgactcctagtcttgatcgatgacaactagcatgattaggactaattagtaaatactattatattattttcatgtacaagtgatggttatttgtagctggtactaataagaatgatcctacagatttagatagcattagtgaaacacaaatgtagtcatttaatgactacagctacaacgttcaaacccttcttcttttagatgaagaaggaacatggtagccgagtttctacaaaaccattcaagtacatgaataaaataactcagcgtagataaaactcaccctaatagcaacacacctaaggaaaaaaaattatggacatccaatctgttgctaccatcacgacaactatagtatgaaaaataaacccattatggtgaccaactacatatcgtagttatgaagaatttgtcgaatgcggtaaagtatcattccaaaagatttgctgaacaacttgagacaaccttaattaatggttagtgaaaattaacatgttctagaattaattagggagtaaatattaggagaaggtttgcattagtgattattttatagctagcattttagtgatgatgatcattcacatggtctgataatactgttgaaaataaaatctgcatgatttagttaaggcaaaataaaggtaactatatccactttataatttatactagtgaaagtgcatctaatcctctaagtggattttggttgattaataataaaacggttaagggactaacaaatttatcaagatgtgtgtagataattagttccaggatgcttaactttgcatggaacctctctacaaatagaatgaaaaagcagagcaaggactcggagatgcatttatatttattttatctttgctcttgagtctaggaaaattgtactatcaaggggatccaaatggttgcctgtgtcaatctaaagtgctatgagttcacatttttagaagagagaaacattttcacaacacttgcatgaactgtagtgtcaatggcaaagcttgccccaaacttcatggtgttttggtctgaacttctgggtggctattttccagccaggtgctaaagtgttgcctggaagttcccaccttttcaattcaaatatgtgagtaacggctacattacgtcatggggtgagggataaatttcccatacctctcacagctcctttggatccactttcatttttccactttccttgcctcttccatcttgttcttgagtttccacggtgatttgagtgtgaattttggggtggtggtgagggttggtgtttgtgagatggctaggaggatctaagcacatgtggatcatcgtcaagttgctagagggtaacctcttagatggttaggtgtcgcccatgacatccatcctcaagccatggattgacaccgagcaagtttgtaaaggtggaccccacatccgaaaggaaaataggtagtcctatgtgggcagaccgggtggcgtgcaagcagtgg

SEQ ID NO: 108266 - DNA, 6665 bp, Oryza sativa
ataacaatacgctgatttaacatatgctggagtagtggaggttagcgttggacctccaaaattgcaataggctgtgatttgaaatgctgttctagatatgcatgcttatgcattaaatgggaccgtaggagagcattgtgtgtggccttgaagcctcaattatttgtagcctatggggccacatgcgtatgcacacatgtgtgttgtaactgaacaccaactgaatttcactgtgaacttaaaactattataggcacatagaagcccaccaccacatacgtacctcacatctgcattacttcgttcaaatcttcctcatcattaagtaagatgtggagatactacaaaaaaaatgtggattgggtgatgactccaatatagggcaatttgtatgttgggatgccattattggaggcataaaaggaacttaggtgaacatgttttggcacaggagtatttaccagagattgaatttactttgttaatctcatatcaatatatattttgttatagtttaatatttgattggttacttgagttggagtcggttttggtttgaatccatgttggagagagctaggctatttaaacctttattgatgattggcttggcaatcagaaataatacaatctattctctcatctctattttctgatcccttatcctgagttggagttggtgtggttgagtctatgtcagagagaattaggctattgaagcctttagtgatgatcagtttggcattctaataatacaatctattctctcttctctattttctctttccactaactttgttagggcattttggttgtggtaaccgaacaacttgctagtagagcttcatagaaacttcaggcatggaagattactttaaggacatgctatcttcgcaactgaaatttttaccacaagattgaaagttttcttggtgacattgagcaaggaattcaacaggcttcatgacaatttccacgtgatgcaagcatcggttgtggcctaggtgaaggccaaaggagtcttgggggtgacttggtgtcagcattggtagggctgctgaaggccgcacaaaagttgctagatgccagcatctttgtgcccctttgcttacaacggcttgattctaggtagattggatggaggaccatagtcaatagtctaatgaagtcaattgatgaagtttgtgcctcaataaattggaaattcccatctatggtggtgaggataagctctagtggctcaagacctacgggcaattgtctcaaggatggtgcatggcagacatagtctaatacgcttgctacatctccttggtggttttctttgaggtatctggggtcccattagagcacgaccatcacgctcaagagcaaagtcatgggaaggttattgggtggagttgccaagaagaaaaggacattgcaacgatcttttgctgctcgagtgcctcgcttgtgcgattggagggcagatgtgtaaaggggattgtgcgcgtcaaggtagcaaacgacgccacaccggcgttggtgatatcatgtgggtcggggagggaagagccgggagatgacatggcgtgatttggattcggaacaacctctcatgaaaggggatggttggagccaagtatgacccaatgggttaggcctcctttgctttcctttgtttcaatgttgacccatttatccaccggagccatatttgtgggttgggccaatgtatccagtgggttgctttagaccacaaccacccttagcaatctctgtggcgaccatgggggtggattgctagagtctacctcactattaggaggcacataggacagtttgaatgtaggagcaatgggctaggatacatagctctagggcagcgattcagcaataagtatagggttgacgctgcgatttgcatgttggtagagagctcggtggcaatcctctttaatatcaagccatcagtaccacttggcgaccccttgaatatgccatgcaatataatgatttataagtactaccataaaatggaaatgttatgtaagagtggtaggagggctgcttcacatccaaatatagcaatgaaattattatgaaactatgttgatagtgaagttatgatgtatgggtgctatatgcttgtaacaatatagaaaacaagtcactcgtactagtctaaatcgacatatggagcactttaacatttgtcgtgctacttttttagcaccaatccttggtggttttagtatatgctttatagtccatgtgtatatgtagtcaattatgggaaataccttagtgctccatcattcttattgttgtcaaatgctaatgtttagcatatattccataacagaaatctatagatccgccaattaagccgttctctcggtactctggcaagacctacttcaggcgaagacggaaaggtggtgaaaagcctgcccaaccatagggcaatggccatcatgctatgtggaaatgttccattctgaatttacgcaatgacttgatactatgttcacaaatctcgtactctatttggtaaaattagcaaaattgtttggctcttagcaataggagacctggaaattctttaggggacaaaaagtttgtttaccaaattgttatattctctctttgttgtctagtcttcttaagccatgttggtagaacaaaggacatcctccattgatgtccataacacttgctttaattgcgattatggtcacaaccattgtttgcctttttggattcttgtatgcattgtttgagttcgatgactgcttttgaagcaatatgtgctacctttgtaacttagtcatgttttcatcattcaatatttaactttaggtgtgcttggttcgtaggatgggggagctcagtttttttaggctgtttggttcaaggttaggtgtaggggtgggtaatgtgctagctcggctcattaccttaatgggccaacttgactcgttaatcttaaatgagctcaaagcttagctcggctccgctcgtgagtaggctctttaagctcgttaggcttgttaacgagctccatctgatttatatcactttgacaatttaataatttaccaatttattgtgtaggaacattaaacactaactaaaaaagaactcgtcaaatacaaatagtttggatgttattaacaaactaagcactagctaagaagcaaacaagtacatgaagatgtgatgatcttttgtactagcgagctaaacggggcctctcgtgagctatgaccttcaagccttttttccaccacttgttaggtgggacggatcttctccctagagggcaatattatctctagatgcggacaagctagtgcctgaaaatcgagtggaccaactcatcccaccatgtgacacggctcattgttgaatagtataggagaagaggtatactgcataacgtggaaactttgtattgagcctcaggggtcaatttatataggttacatggattgggcccttgatggaggtggtcgtggacgcatccaccaggcagggacggcgcgggctagtcatcggcgcgggggctcgttgtgtagatatgacaagcgcataggtgggaggtagtgaacgtgcagagaggagatggaggtggtggaagacggtgccgatggcgatccaggcacgtgagacaggctacccggcgcgatatggacgaagctgttgctgctgctgactgacgtagactattgacgacgaacggtggtcgcgcaaccacccaggagtttgaatcgtccgggcgtgcgatgaacagcgaagacacaatgatgaaaacaaaaaaggttgaccgacctcaggagatcgctactcccgggggcaacaacggcggaagcgtgagaggcggctggtcgcccgctcttatactatgttgaatagtataggagaagaggtatactgcataacgtggatactttgtattgagccttaggggtcggtatatataggttacatggattggatcttaagtaacctcagagagatagagatggaaactaatcctatcctaccgtaagaaaccggatacaatacgatcctatccatatactctacactcattcccaattccgacaattgggtccacgtgttagatgcttgatcccatcatccatgtatcttgaacccaacaaaaactatgacgaccctatcccctcaatcaaacagtacacgggaccattccaccccatattatacctaaatcaaacgcgtgcttggattataccttatgtggtccttcattttcagtaccctaaacaaaaagctccgtttagtaaggaattgtttaaaactaatttattaaaacatttggtggtaatagttaattgtaaaaagccacaccactttttggcatatactccatgtaactagatttcttaaggtaaaacatcactactaattggatttttcaaggtagcacatcattttttggcaaccacttccacaacttggcaaccaaaaaaaaaaaatccacaacttgggattaaaaattgatcagtaataaagacaataataattggttaatgggacgactactacactactaccctcaattgtattacattcacctctttaggattttggaatgcgggattggcataggtttttttttttaggatttagtttctaaggattttcgcccctataaacccctttagttgataggcgagaggtccaacctcttgaaaactttcctttgtttagttttctcttgtagtattaacagaacgcttctcttttcctctgttttccattcatggaggattagagtaactaatatgccatttcagttcctacgtttttcctatcctatgttccaaagggtgtcttggtatggtttattctcatgcctacatatcctaacaaattatacaagtgtcattgtagacactttaaattcaatggcatattgaagttaacattgatagtttatagccaactgataagatgccatcctaatcttgatcccatggttttgaggtactatagtgccatgattgattattcctagaattattgttgtactagcacaatgaaatgattcttcttaagaccatgatcctgataatgagattcccaccacatctcaaaagccaaatgtcacatgattctccatgagggaaggatagttattgtgtttgggtgggggccgtggtttaggagtatagggagaacgagtcatgtggcaatataactgagtaaggctagctcaaatttaaaatcatatgtttatcgaagcataaaatttaacatcaaattagatcaaggtacctatgagtgtagttttagtaccatcaggagccagaaagtcaaataactaagggaaataatacaaatcccaccatcaccatccaacaaacacaacaggaggaataatattttcatgtattcttcaccttcacaatcattttgatgtgttcaaacccgtagcatctagccattatgccacccgtataagtccattccccacattcttgttaatttattgcaaatcacgatacattgcacccatgagcatgaggtatccagtgggcacttggtatggtcctttccgcttcttgctaattggtagcctccctctttctttagtgcacaatggtcatcgatggtagcaactctagtgggtcccatgtgttttgtgggatgtgtatatgtttatgtggtagctaacgtgtcatggtttgaaaagattagtttgtcggaactttgtacaaatctatattttctgtgcaacataatctatgtcgattgcgtgatagaagaaaagaagatcaataaagggtggaaagggaatggatatatgcgattttcttatccacatcgtagaatattcaaagtcagtgcagaaaatggaatgcttgtttggaagaagcacttggttttgagctcttggaaaatggtagtctaacatgccaatttaattttggatggtttggtcagaattaagtgtgacgatgttctacatcatacaatgagaataaccaaattagtttttacatatatatattatatttacaagctaacaagctatcgtaccgtgtagctaataagttgtctctcggcccaatacccataacactaacacaagttaattggaaaatattgtggcatgttaccgacttcgaatggaagttctattggcacctcaaagactaaaatcggacgctaactgctctaactttgcaataacattgttatatccccgctaactttgcaataacggagctgttttggccaattaggatgacatgttggcactttgtcaatcttaagtgctcgagattaaccaagtaggagaaagttaagttagaaatattgttccttttctagagatctgatactttatgttatactagcgtaatttttagaatcatgggaattgggtttcgaagatgcaaaaaagaaaatattaataatacggaattgctaaatttttgtcgcaagaaaaatgggtagataacttgcgaattttagaccctcggataggctttaagattcgtgctcgtgctggcagagaaaagaaaaattttgtgtgaacacaacgctgctgggagttcgaacccacgatctgttggtcgaacaacaggcacacaaccattgagatagccgagctttttataacatatatacttaagttacatactcca

SEQ ID NO: 108267 - DNA, 544 bp, Oryza sativa
aacatttcctcttcatacaaatactacttccatcacaaaataaattgatttatactctctctccgtcccaaaataagtgagtgcacttattttgagatggagggagaagctacgagcttaaatatggatatatatatatatatatatatatatagccaagaaaatcaatttaatttggaatggagggtgtatttatgtatactagaaatagtggcgcgctacgctgcgccggttgatgatgccaatgaacaaagaataaacataattgcgcaaacaggctccagaaaattgcaaattgaatgtggaattaatcatgattgctataacatgttgaagacacttactgagtactaattaccattaacttgtatacacagaatattgtatgcaagtttgctttagtacacatctgaaagtagaaaactttagatgaaacaaaatagttttggtatattatacatccgtccacctcagaaattaaacatactcaccgaatggttaaactaccgtctaccactggctgaagacgatcagatcagctgta

SEQ ID NO: 108268 - DNA, 581 bp, Oryza sativa
aatattacatgccatattatattaacttatttcgggactgagggagtagttttaaaggacatatcctctaacttccctattttggagagatcaagagagagagagagagacgagatgagttgaggagaggttactgaccacctaggtgtaactgatgttgtagaggtcagaccagggcaaggcgcgtctcaaatttaccgcatagctatcagcctgctgcatgcattatcaccatgctgagtctctagccaaggttaccaaaactgtctgacagttaatataacattggttaggtgaaggaagcaatgaactacatgggcgaataacagagtggtcgcttgcatgcactaaaaaaaggagatcataaattcccgaccacataaaattaaaaaaagttggtttttcaagaaccttccagattgttgcagagggaagaaccgatcgatcctttggcccgcatgtgctattgtgttactcgcatgcggatgcagatagtccgctatatctccagactgattcggcccatccttcacagcaaagtaggaaacaaagcagagcagttttagtttagtattgaaggt

SEQ ID NO: 108269 - DNA, 622 bp, Oryza sativa
aaggtaattttgaactgacaaaggactgaaaaaggtggttgatttttttcacttgctacattttttctcttaaaaaaaaatttgtaagcccatatacaataatatctattttaaggaatccgcataactttaaaaaaattattaaaattgtaagtgattaaggaagtattgaagggatcatttcaaatgtgtgaattttttgttacaaattttactggcataaaactaaggccctgtttagatcccaccccaaaattttacaccctgtcaagtcgaactcgaacatttaaatatctgcatgaagtattaaatataggctaaaaagataactaattgcacatattgcgataaatttgtgagacgaatcttttaagcctaatttctccatgatttaacaatgtggtgctacagtaaacatttgataatgacggattaattaggcttaataaattcgtctcgcggtttactggcggattttgtaattagtttttattagtgcccaaacaccccatgcgacaccctgtataatacccgatgtgacacgccaaaactttacacccttagatctaattatctaaacaccccctgtcttagttctttcccctatgtcccaacgcatcac

SEQ ID NO: 108270 - DNA, 680 bp, Oryza sativa
ctagtaagagaactaggaaggtagcccgcgcatatgcccgggcacttatttaatgtggcttaattttttatggttataaatgtttatatgtagattatattttcaaaatagatcttcactctatttaaaacatgttttagttattatctagttatgacatattacataaaaccatacagccttgaatttatgataatgacatgaatttataagaacaacatgtgtcacgataataaaacaataatagaataatggagttgtttcatatctatttgtactatatgtgatttttttacctaaataaagtgtttttttaattaccaccacggtaaaatctccaaaggaccatattgttggttatattttgataaatatctataattttgcgtctcgtgtttttcaacgcctattcttcataatcattcataatcacagaagacaccttgaccaattaatttggagaatgaatctattttcccaaacttatttataataactaattgattaaagtatacttctttgtcacatcaatagagtgcatgacatacattcatcgaattatgcctgatatgctggaattcctcaactataagaaaatatagagtgaacttcactgtgggctagtaatttttacccaagtttcattttggactaggggtggacaaatcttttcactttgg

SEQ ID NO: 108271 - DNA, 607 bp, Oryza sativa
ttacctgcgaaatttttttattttttaaaactttttattttttttaattttataaatagacctttcaaaaaaatatgtcccaatctgaaccttttggccactccagcccgcctggcttggccaaataactttggcatgccacgcccaactggcatggcagtgctgtcctgtcatgctagcctcttgccacgccaccgtggctggcgtggcaaaacaatgctactagcctatcatggttacggataaggtatatctcctatcctacgatttatggaatatatggatacgacataccttcgtttgtacgatatatttccgtatacgatgaggaaattaacaagagattatggaaattatcctcacgagcaagtgaacaacagagtcctactcaaaaagggttaggttatactatatcgtgtggggtccatagtcaccgagttttacttggagactaaggtgattcatgttataaaagacacaccccttaaggggtccagatcatcgaatcatagcaccaacaccaccaccatagcctacaatccggaggacgtgaagcctactcgctagaagatctcgtcgaaaccatctcgacaaggatctcgctggt

SEQ ID NO: 108272 - DNA, 962 bp, Oryza sativa
ttatcctacagtaaaaaaataaatatatttaccataaaatagacgatagattttaatatactactaatgtgataagaatgtccctcgaatttaaataaaaattcctttgtcctagtcatatataaactggttgtttatcatcattacttactatcattgttttaagagttaggtgcacctttaataaatgaaactatattagtaccactaaaataaatgatacattattgttacattataaaaattcatcacttattttcacatctatgtataaatagtataaatataacatatctacagaataatacgataacatctttaaaaataaacatgaatacctctctaacggatgaagtcaaatgtatctgccaaccaaggctttcatatgtaatgccttgaaacatataggttccacgtcgatgtagccatgcccctaaaaaaccatcgtagagtactattttaacacttagtttactattgttacactcacaaatgattatattgataagtctatcactttagttacattgtctatggtgacctttcatggacagtaccttaactcaacaatgtgcatgcccatgcaatatttacgatagcatagcaagtactgcaccttacattaaaggacaaagaaggacagaaaggaggtgattgaaaccattttttttaaaagtttcgagtcgatttttggtagagaatagccaatgtgtatatcaagttagtaataagtgcttctcaaagtttaatgcaatacaaacagtattatgtttttcaaatgagtggggttaatcattcggcactatttagaaaaaaagagctatagctaaagagacgtaccaccatgaaaatctacaaaacaccatatcattatttatattttgataaagattcatactttagcgctagattttttaaccatatattgtttataactaaatgagactcatttactaattgta

SEQ ID NO: 108273 - DNA, 535 bp, Oryza sativa
tgcttcctcaaatcaaattgtttcctcgagttcaacatagagattctgcagaacagttattacagtccaatgcattttttttccaggtggtttccaagacaaattggtgttccatcggacgagtaatgcagccaccatctgtcgttatatcttgacagagccgagaaggaaaatcctccagagattggccaccatttgcatggtcagttgattctccattaccctacccttcttgttcctatagaagctcagaagcgggcaagcggcttgttttgcgacgcaccactgacactgtctctgttcatcactgcagcaaccggatggcgagcaaggcgacagagatgggaatttttttcgtttttagattttttttaatatttacagaaataatctatcggcgagaaaaattgcaaaaatagaccctgccgccccaatggtgggcggcaagctgacgtggcaaacgggggaggaacggacggtgacggagggtggttttttttgcatgaaaacccttgccgccctttggtggggcggc

SEQ ID NO: 108274 - DNA, 513 bp, Oryza sativa
gttaattgtttgtgacctaaaaaaatcaaggagtgagtggcagcacagtaggtcagaggcaaggaacaacaagaatggtccaatgtgcaatataaggtagcaaatcccggtccaaagtgaaaacatcaaacatagcctagtccaaagtgaactttggcaataataagtggcctaaagtgcaattcactcgaaaatatatcgtgagtagtttattgcgtatgttacttgattgttcatttgttatcaaaactatttgacaaagagaaagacatacatatgggacaataaatctcatgatggactaaatggttgttttatagcaagatcactggcttgaaatatttttcataattattttttagatttatgtaatatttatgttgcccaattatcatatagttctgaaaattcaaaaaaaatgaaaatattaatctcaagaagtattctattaaatcatatctacttaaaaatacacaactaaattgggttgttttccattattttacatatgta

SEQ ID NO: 108275 - DNA, 1632 bp, Oryza sativa
ttagttatattagattttgtttccaacataatgctgaaaagggtcaaattttctattatattttatttaaatatttagttattttcattatttcagtactcctaaaatattaaaacattgctatttagaatgggtttcaatttttttaaaaaaatgttaaatttagaaaaaaaaagttcagtcttcaattatttttatcatgttatttttttatagatttccattccatcgagcgtctcttaaatgttttgatctctgcaatttggaatggccatacaacttggcatgggataaaggtatcccttaaatattttcaatgtgctgtgtatgacaaatagatcctagacggggtacacgttatgacacgaaaaaatgatataattataagctttttctctaatctattagtgacatcagatatcatatgtataatttagatattatgatcatcttaggaacgtttatttatccctaaaaagatcatttattcataaaagtgcatctaattaagttcaaatataagtaaatagcccatatatgcatgttaagaaaaattaactatttccactggtgaggaaaaatatatcaatatttacaacccccaattatttttattggattcaaaattgaatatgttttataatatgaatggtttgggtagaaaatattactatgttttttataaactaattcaagtaatttgacattgacaaaatttaaaatgacttataatctgaaacataaggagttggaagaaggagattagatgtctagcatggataaataatgggttgaccatttattaaaaacataaggtgagatattttaatttttaatgagaaattttagtgttctattttatttattggaggcttaaaggtggatagatgtggtccacaatgtaagtcaatacagatattaaattatttatttaattaaaaattaaaatagtgtagaaatatcataaatgaatatacgatttaaaattttatgagtgttttaaagtctagtttatattgtttctgtaagtgctagctggaggagaaagataaaaaaagcccattatagagggaaagctagctagacttgttaggtggagtccatttttggagtttttttatcctaaagataatgttgggtttagttactagggagataaaaagaacagagaaggaatggtagggagagaggaatcagaggaatggaggaatgtgagggagttttgggatttttttttaaagatagatctaaccatataagatagtggatccatcgatttaagtggagagcaatggttagatgttttattttcatttgtcatacttatagatttattttaatttattatagtgttacaaggcgagatcgacttaaaagtgtttatgggcgtaccattaggccctgacatttgtagttagaacggcagcatgatctaatttttagataacaaaatatgagtgatatggattttgaattttatatttaattatacataacataacaattgaaaaaaacctgagtataaaattataatttgagagtcgcgatcaattagatgtccgaattattttttgatatattgagtgttaatgagaaaatatgataagttagctagaaaataggagaggatgg

SEQ ID NO: 108276 - DNA, 578 bp, Oryza sativa
atgtgacttgccttgctccgggagaacggccttccgaaccttcggcgacgaccacgaaccacgtttcgggaacctcctgaacgacgaaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttacatggagatttgcggattattgtaatgaggttttgcaactataaaacatgtggaagcgctagcctggaaaagacaggaagctgcgctgttgacatgcggaccccacatgtcaacctaaaggaccacggtagaccgagtacacagagacggtccacgggtcgacggaagcggaccccgtgtgtcaaccgaggcgagtggccaacaaacggactccactagacaccacacgggctgcacacgtggaaaccacgctgctactgagcggacacactaacacggacaccacacggtcaccacccgcacacatgaaccactaccgaca

SEQ ID NO: 108277 - DNA, 1408 bp, Oryza sativa
  unsure (1)..(1408): unsure at all n locations
ggggaggagtgaattgatcgctgcccccatcgccaggtgagcgatcgcccatttgccattagtatgaaaccgaccatgtatcaccgattctatccttttaattttatgagcgatgacgatgctgatgatttatgtcttatatagttaggaagtacaaattttgtaagtataacttatagcgccatctatttatcaatttaccaatttttttcttatttatcaatcactgtttaaacagtagatcaatatgcaaccattcacatttatacatgatttcttgtggtgaagcaaacgatgttctaacctactctagtgcaaattcttactagcatgaaacataaaatatgacttacgtaaacataataatgcatctggattaaccctgaaaataaaaacaaagtaaagtaaaatatgcatttcatttgtgttgaagttgcagtaattttattttgtgcatgtttgggccaagcaggcttgtgcaagtttaggcgatttattgtccaggtgtaggtgactgacagataagaaaatatcaagcgaatgataaaaactaaacggataattttcttcatccaatacatgttgaattgtcatcattttttagtgtctcgtgtattatcgtgtgggnnnnnnnnnnnnnnnnnnnnnnaaagagccctactcatcttgcataatagtgcatacatagcaccatttcgaagtagggtacgtccatcaaggccaggaagatattgtatatcatttttgtttaaaaaaatgtacttaattaaagatggattttttaattccgtttgaatttttatttctattttttaaaagtatgagatcaaacacaagtacaatcaaaagtcaaaaccatgcatgtatatctttagctgtactgaaatgccagaaattcggtgattttttttcagaatatatgcattatattgttctaaaacttcccaaaataatattctgccctgattttagaaacacctcccaagtcacacaacaaccctagctagggtgtggcatctgaagactgaaaatagtttttgttttgcactagaaccagagataatgctgctttattttcgtccttattggctgacgccagcgagtgtctgttgaaaatctactactagctagtgtgaagaaaacaattcgggttcaccaaggtttcaagagaaaaaatgattttccttaccaatgatgacacggaaatttattaaatcagccgtaaaatccatgcgaatagaacatatatacacgtggtgctaagtttaattatggaacctccatagtcatatcatatcatactctccctccattccaaaataatcatcatattacataggtacatcaaaactttaaaaaaataataattttctcatactatatttactccaacaataaacccgatgca

SEQ ID NO: 108278 - DNA, 965 bp, Oryza sativa
gagagagagagacagagacatagaagtagaagaaggaggaggacgagagaagggaagggggtggaatgggaaatgaaggtggaggggaagaggaagaggagaacacgcggcacttagatgtcaccgcgcgagaggagggagcgaccaccgcacggactcccccacttgccactctcgccgtcgccgcggcctatgtactctcctactactagcaatagtggagtaggagtaggattatatatatccacatccacatcatcgcttgatttaattgtccactttcccgtgcgccgaattcggaaaagtcgtctagatcgtctccgcctccagctagcgactccgtcttcttctgccgcagccgccgcccgcgcctcttggcttcttcctccggcgagctaccggcctcctgttccgttcccgttaattttttcctaagccgcgaggattagagcaaattaaatttaatagtatagcccactactaactccaattcatttatagccaatctaacagccaattcttacgataattgtttactatacttttagtatatggccccacatgtcatacatacattgtgtcttaaagtctgtatttttctctcatcttttatcttattataaaatatgtttgtacctggctaatagtctgttattgtacctgctcttatatatatgcgtgaaaaacacggtttctccaacaactttatagaacaaattagtataaacctaatttgttgttaggtttataatgtatgtatactaagggagtgtttgaggagaaggggattgaggagattgggaagatacgcaaaacgaggtgagccattagctcatgattaattaagtattaactattttaaattccaaaaatgaattaatatgattttttaaagcaactttcctattgaaattttttgtaaaaaacgcaccgtttagtagtttgaaaagcgtgcgcgcgggaaa

SEQ ID NO: 108279 - DNA, 569 bp, Oryza sativa
cgagcgctctgaaaattccactaaaaatcctgttagtgaatttcgacatgtagaactcaagaaaaattccacatgcccactccgattattatttgcattgatttaacagggtttactcttgctttgcaccggtattttcttagggtctcttataaattaaattttaggcttgggaggagaacttcggggtgtgacagttgctcagcctgagcttggggtttatatagcatgccagctcgtgaggtagatggacgaggtgtcaggtgtggggtagtggctgaggcgtggacccgatctcagccattgttccattggtgtactttgttgttaacggagagatgatgggtgtccagaagattattacagtagaagtataatagatttaatctaatcttccatcaaaacattgcaataaagcaaaggagaacgttaatcgttcttcattcatggtaagtcattcataaatcatacgtacattacaccaccacaactacattagtagaagtacataatccatacatcattcgtacattacaccaccgcaagtacattagtagaagtacaccaca

SEQ ID NO: 108280 - DNA, 505 bp, Oryza sativa
ggacaaagattatctgatccccatagcaacatgccactctacaggcatctctaccctttacatgattaaagtgcagaaatgaaaaagagagaagcacatttgcttctttttaggagggggagagtgaggccccaaaatgtccaatgggaggacttttatcattttctacctctctttctctgaggcttgttgaagaagagaagcctggctaacatacttcccctgcaaagaaccaaaaacatagacaaatacataagaaactttagagagatggggaataaaacttgtggaaattgatttggaacagttatcaattttgcctttgcataagttgtttgcataggaatgagttcttagaacttgccttgacccgaggccgacattcagcattcaccttccgcgattgataccgggtcttattggagaggaggggagtgcactgcttctgcttgtgccgcaatttcagcatgcttccttcccggataacaccgcttgtattattatc

SEQ ID NO: 108281 - DNA, 991 bp, Oryza sativa
agaggtgaagaggatagcgaggcaaccggaagatggaggagagagaatggaataattggggaaagaattgtcggagagcggccgggccaaataatccaaacggtccactttggtgagaatgtcggcccaagaattggcccaggagtatttttgtacactcctggcccgcttagtatattcttatatactagaggatgctccgcgcattgttggggacttagttaacatcaatttattagataggagttaccatctcatgaaaaaacaaatagttttttttggagaaattctttttagcagccctatccaaaatttgtagatatttaagtagcacatgtcaactgaaggggcgttcagccataaagctcttttatacggattgacaggctggatacatgtagatgtgtatagaaatgagccaatgtgttcatgtgagctatatttggcactgatgaggcgaagagactcacccggtgactaatgggttgggctctatgctgcattccatccaacgtctaagaagtgatttaatgtattcatcaaacgattcacaatttgatgatgatgtggaagcgcaaggtttgagcttttggccactttatagaaagaagggattgggaaaactaaatttcacaaacggaattttgctatattactgtcgacggttttaccttacgcccttagttcattgaggaagtgtgctaccaccacgccaattttttttttatgatagttgtattctagtcacatataagttacatatgagttacagtgtagttacaatatagttatattttaaaagttttataaagaaaaaacttgcgacatttttttagataatccctttcacaaaactatatgtactttgaccaaactatcataaaattgcaaatttagcatcttttttttttcataagacgatagatttaatatcaagtattataaaactatagatttaatattgatattatcacaaaactacattatatta

SEQ ID NO: 108282 - DNA, 533 bp, Oryza sativa
tgaatcttaattttaaaagtaaaacaatacgagatgaatcttaatttaaaaagtaaaataatacgatgggacgaattaagccctgattagtttttacgtaaaaacttttcaccttatcatatcgaatgtttgaatacatgcatggagtattaaatatagaaaaaaaaaataactacacagattatgtaaatacaatacgaatcttttaagcctaatcgcgccatgatttgacaatgggtgggttcggatgagattgccgtggcttcagcttcacagcacaacaactacagcactagcagtaaattttgtgctgctagtactgttgatatagccaacagcagttcaacagctgcaatatgtagctcaagtgaacacggccaatgtggtcatacagtaaacatttgctaatgacgaattaattaggcttaataaaaacgtctcacagtttatatgtataatatgatgtttaataatttaaatgtgtgtccgtatatcctatgatagggctacacacaaacagggaacccgatcag

SEQ ID NO: 108283 - DNA, 542 bp, Oryza sativa
tcctagagcaagacaagatctcatggcatctgaaacacctaagggcacccacaatggttatctataagctctctacaagagatccatgtcagcatattttcctacttggaagagattaaatgaagagagagagcaaagctatctactaacatggagatagtctatagagaaaacgaggcaatggattagagagctatagatacccatgtagacataccattgaagtggtttactattaatctagtctattgttgaggtgtacatgttttatagatagcaccttactttaccattgcgggtgctctaagagcagagtttgtaaataggaacaattcatcatttacattggatatgatcaaatctactttggatattgcagacaataactgtaatattcaatgctttcagacagtgacacctatgattcgtttccatatcaaatcccatcccaactatacttatgttctcctgttctattcccaagaacagaggaagtaataaaacaaagctaatcctctagccacatcagctgatttagaagt

SEQ ID NO: 108284 - DNA, 633 bp, Oryza sativa
cccttaaaaacttgaagaagtcattacaaccatgtgatggttgatggggtataccaataacttctgcccatccatcagctgattccaattactatctttcccctattgagtttgtccaagaaaattctaaaattccttcagatgacaactacgggaagcaaagataacgagaacgaatctaatttctcaatgccagcaaccaaatccaagaaaagaccctcaggtttattaatagcatcactaaaataaaaggctacaattcaacagaatacaaaattgattagcaagcccagtattatagagaattaacactaaaaacactaaattataattttctaatgaaaagcccaagcatcaactactcctaacaagcgtgatcatgcttcaatgatttcatgttacataagaagcaattcatccatttcgttcctctgaacaagtatcataaattgatgaacatatttcagcaactaaatagtggcaaaagaagatatacaagagaagaaaacaagaatccctcacctttttcctgttaacaatgttaacacaatctaacagtctaccatcaataggacaaaaatgcatagtgttaacatgataacatctacttatgcaaattaacattggaagtgt

SEQ ID NO: 108285 - DNA, 685 bp, Oryza sativa
tgagggctgggttaacaggagttcaggtataatggggccaatatgacaggagaactttataagaactaggaatagaatcgttgggtgtaatggcatggccgaaaatgtttttgactcgttataccagaatgaaaatgacccgagagtttgttgccacgtccatgtacatatgtacgactactcgcttgtctgatgttcccctccttttttttttctttggattgatcgttttttgtttggatcctttgttacagtgtctagcagaaacgatgtacttcatgtgatgtttgcactgaatacaggatacagctggggatatcctgatgggtatacgccagctactacatgatggcactatgctatcaaagctgcgcaatgcttgtccatatatgtttggacatcctccacggcgtgtaatacccaaaatacaaatttacctttgaactgtactcgtttatctaatgtcatcgttaactggtaatatacaagcatgtcctgagaaatgaacaaatgaatttctgttttccagtcttgtaaattgccagtgcactgtgacaagtgagatctgtgaagactgaagaagatacaacgttttgctaacaagagcaagctgaattaatggcagttctcagattatcacatcaaagctactctacttttaatcagaaaaaaaaatgttcagatc

SEQ ID NO: 108286 - DNA, 544 bp, Oryza sativa
ctgcaccccgtacagcaagccagaatctgtttctgctctagccgcagcctgctgctgctgtgcttttctcatcttctgttcctttttgtttcagaaacttttaccttttcttcatagatgaccactcttgaaaaacgagttgctaacaattctcaaaaaaaaaaagaaaaaacgagttgctgacaatatcatttgactgcagtggatcagggcaggttcagagcagggggaaatatgagaaaattgagtcgtccatatacaagaatcaagatcaccacagagaaggggaaaaaaaggaaccaagatctataacaggaaaaaaaacgcgaatattagggaaggatctaatatcaaataattagaagtggtgaggcttcgaacccaggtcatctagcccaccaccttgtggagctagctggaagacccggggcgtttctctataacagggaacatgtaagagatcattgcccatgtttatggcctctgttttcttttgtgcaaagccttttgatatcgtgacttgttttttgtatctcaaaaataa

SEQ ID NO: 108287 - DNA, 756 bp, Oryza sativa
ctgcagcccttatagtagtatagatatatggtacccacttgattcaaacaaatattagactattgcataataccagaaaatatcgtgtgctaaaaaatgcaaaaagtagtggtgcaaagtagccactaccaccactagtgcctttatactccagtataccagtatatagatatagatagaaggaacttaggaagtactaaatttgcatagcagacctttgcaggcatccaagagtatttgaaggctaaaggtgaagttgatgctaataaaacaattgtttaaaaggtattctcgtgatgtctgctatctcgagtacttgttcttgatggcattgcactccgtactgcaataacatgcatgcaatcatagccaattatataaatgctctgatcttggaatgtctctttatcattcatctgttgcttctttctaactttatctaggcattattaatagtttatttttcattttccctatggttgattttgatattcttttctgtagtgctggttaaattactttccttactttttctgatatgacctcatgttcgcttgtttttctcttgtatacgtacatacatgatctcagcaaatagtttgatatgcagctagatgttgccaccgaggtttatcctgtgcatgttagcaacaaatttaatggttttaacacctactctcagtttggatggcacacagttgattgatcttgccattctgtgaaatttgcatcatacaaggttggcttttaaatgta

SEQ ID NO: 108288 - DNA, 696 bp, Oryza sativa
cgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaaaattgttttggcttattaaggaataatgggcaaacaataagggcaatcccaaccctccacttaggatggtgtatatggcattaactatattgccatgtaggacttttagcttatgtgacactatattaattaagagagagtgtgaagagaggaagaaactaggtctcatgcaagacacagcttcaacacgagaacctatacactagacactatcaagttttgcattgggagagaatagtgtcttcataatagatgaagaataaatatgattggtagagaagagagatgatatatttattaatggcccactttaagaaaccatggattgtagagtgtagtttctattatgatgtcttattgacatggcaccatagacactacttatggacactatgggttgggactgccctaagtactccctccattcca

SEQ ID NO: 108289 - DNA, 792 bp, Oryza sativa
ttggtttcctgaggatatctagtccctagttcccagattctgactagtggagttctatcctaaaacggtaagtgcatcgcatcaattgctgttccttgtcttcctttttttctaatggcacagtagaacaatagcttcaaatgctgcattatccgattcaggcctaagtcaggggtgaattatttcagaaacaaatgtagataaatgctgactcgtcccaaatgctgtgaatttccccagatatgaaaactagtagctagttaatgaatccattggaaagcattagattatggccaaaacactataacaagcactaaatattatcatgaatattcgacctaaaagccagagtgtaccaacagctgtactaaaaaaaagggatatggctcacttgtatctttatctgataatagaagaaatgaaactaggcagcaacagcaacatgccagcagctgcaataggtaatgacaacctactggactaatagatggatttgaaccatcaaaacaggctcattttcacttctcaggagcaagaagtacatcacattcatcaatatcatacgtcatggtggaaccgctgcttataacatttcttttggaacaattaataaatgaaatattatgtgaacaggaagtaaacaagaataaaaatggaaacaatggtatgagccttacctgaaaaaggaaatattgacagtggtcattagaaagaggttgagatgatttaattatctggtgtagatctgtgtccatgagttcataaaccaagtatacatctttgaaactcctt

SEQ ID NO: 108290 - DNA, 598 bp, Oryza sativa
gtgtggtaagaacatgattgaagttaattaagaaataataccactcctcaatcggcctcaaatctgcttccctggagattatatagtaaataatggatttggcatctgtcatcggggtaaggaatctgccagcaaatcatgaaaaataaacgagatttgagtgagaaacgtccctccaaatattttttttaaaaaaattatgagcgtgttagagattaaacacgaaacctcgaattaaaaccgcataccccttgtcactgcaatatcaagtgcatcttaaactgacctaagctgacctatcaagaaaaggaaatactacctgctaatacaaactgacctaagctgaaatcaatgatattcatacttctggaaaaggtttaatgggtgtcaaatgtacagatacctgggtcaatggagtaccattggaataacaattatgaatgctgtacaatttggtggtattcagaaaaaaagttgtgcaatttgacttccactagaaactgtactaactgtgaatctgtacatcatgttttcacaaaaggcttgaccgcttgacttgtttataaggtttaggaggttgctgtgggggtgatatttg

SEQ ID NO: 108291 - DNA, 694 bp, Oryza sativa
ggatatgaatgttctgttataggggtgccatttgtagtgtatcctccatatctgctaggaaataaaagagaaagcctccagatatgctagaaaataaaagataaatccttcaggtcttctagaaagtaaaaaagataaatctccagatctgctagaaaataaaagataaatccttcagatctgctagaaaataaaagaaaaatcatcaactatgggcctggttcttcccacgcatgggctatagatgggtccaaattagactagatctaaattcattaggcttatgtgtttctccaaggggagtacctatacatctttcgaaagatttttataatcgtatcacacagatttttaatctttagattaaaatccgatagatataataaaaagcaaaaagcaattaagaaacaccataatggacactaaattaccatatcctcaataaaaagaccaaatccaatacaaaatttaaaatttacatgcgaagattcaaaaattacagtgtaacttacaaaagttacagtgtaagtttcataaattacactgtaacttaccagaaaatgcactgtaaatttgagtaagaaaatcgagtgagagataagaaaaaatctttcgagtgagatatagcaaaatcgttctccaagtgcatctttctttttgtttggtgcttattgcttagtaaaattcataaagt

SEQ ID NO: 108292 - DNA, 719 bp, Oryza sativa
tctcctcttgatggttcacccataggacagatgagagaaaggacgtcaccacgccggtatatcatgtctaggaaggtgtatgatactcacaggtatcaccgatgttagtactcagatcaaacagaagcacaggtgcgacgacaaaggccgaccgactcaacgtatcctaactgattggacggtctatttatttggccgtcaaatgggttgtaattatgcatacctgctgcatcaggtttcatccaatcactaaacatttcagtatttgcgtgatctagactggtcacatatgcacgcaattgcatcaaaaaagaaaaatctagatgcatgcatgtgctacaaaagtaaattaccagtgccatgcttgttaataattagtaccacaggttgaattgctaacccctccgtcaagtacgttgcttataggcagaaacacatccattaatccatcgaaattaaactataaatagccatgcatgcgaggttagattaccacactggtggagaaaccctttgtagtcccggttcgtaacccccctttagtcccggtttctaaaccgggagtaccaatccaggactaaagatcgctatctttagtcccgggtgaaataaccgggactaaagatcgagctgaccgttttttttttttgcatggccctgttgctgcatggtttatatatatatatatataaaccatgcatatatatgtttcaatacat

SEQ ID NO: 108293 - DNA, 1330 bp, Oryza sativa
atatttttggatcttacggctatactgaaatatgtaaatttatggacagttaactcaattttgttgtcatctcaaatcttttgaagacatttgcaatttgttcgacagtctggttttgagcctgtgtgatttagatgtcttttgctttcaagttgggataggataaagaacttgttgaagaagcacatgcagttagattcgttggagtgaattgaactgatttgtagtaatgtcataaggtgctgatagatagaaatgtcagtgtaaggagcagggtttctggccgcttagaatctggttagaaactatccggaatgaaccattttagaaaggagcctttcatagaaaaagtattggccatttttatgaataaatatatatttcttaactcttcaatctgacagaggatttgctagaatacatcggtttctgttgctttttcctatatacatctgtacaaattagggcccctttgaatcacaggaatagaaaaacggaggaataggaaaaacatatgattctgacaggaatgtagtgtaaaacagagaattgcaaaacacaggaaaaacgtaggaatgatcatttgattggaccacaggaaaaacataggaatttgaggagaaataaagactcaaaggatttttttccacaaggttcacctcttgttaaaattccttcaaaacttatatgggaagaggcattccataggaatttcataggattccatagggttcattcatttgattcaaagggctttataggaaaaattcctataagactgaaatcatctaaaattcctatgaatttcctttgaatcaaagggggcctaagttgagtttaattgacaatggcattcaaaatataggttgatcaacttatgcttccagcaaaaatcttttatgggttgtttgattcgaggttattgtaatcaaatccatccatgaagcatgttttggttttgaatttctttgacctttacacaacattattaaaatactttggtagtgtacgtgattcttcattcagaaaatttatcattttaagtattgtaacaactgttgtagtgaaatatgagatattttggaggttttgggtctgcataaatgggaggaatatagagtaagacactgctgataatttatgttgttctgcctatgcaaaactcagattcatgttgcttcgctcaggtcttgtagctgtcagcatgtcacctgtagcttcttgaggctacaggtttaatctccatcattgggcatatttaatctccatctttcattattagcatgaaaaatcagtgtgctattgggtgtgtttaggaagtattatggtt

SEQ ID NO: 108294 - DNA, 2002 bp, Oryza sativa
aacattgttcaatttttagttctatacttgtagactattgagaaaaacaataccaaaacatggtagtaatgcgtgctactaacaaaccggtgaagattttgtattataaggatataaaagctattttataaatattctatattactttcggaaattaagggtattgaataaaagcttttataatttgtaaaatcgggagaaatattttttgttatgtttataggtgctatttattggttcaatttttttttatagacatggatatcaacatgggtaagttacctattttgaattttaacatagtcacttagaataatttttcactgacttttatttgtaaaaaaggaaagttttgtgaattagaaaaaaatatatcttttttcatttttcattcttaattgtttttaataattgctactcttttgtacattaattttcctttaaaacaataaaatttgtggattagccaaaaaatattttattcattttcatttttatttttatttgtaatacttgctactctttttatacaataaattttattggttatattacttaaatatatggtttctattttatgactacggtgtattagaatataaaatgacattaatcttgagttctgatcattaatatctttcgtagtagactagatcagtaatatctgaaagaataaggcgaatccaactcttcttgtatgtttaagattgccacatagattttgcactgcattccaactcctcatatctgcaagcgtgcagccagtttagttcacagttagtccctccgtttcacaatgtaaatcattttagcatttcccacattcatattgatgttaatgaatctagatatacatcaatataaatgtgagaaatactaaaataacttatgttgtgaaacagaggaagtaaaatacatccatatactccatctaattaatgattcactgtcaaccatcggttaattagcgtggctaatagtacgcgagagatccagaaggacatgactactcagaacacatccatgtgtcgttaagttatatggccatttggaccaatcaaatgctggctgaacggctagcttgagaccagtagattatgttgggtatatgaaacatgactttgctacgaagggaccggatagggctgttgatgaattttttgggccaccttggttgcacaacatcctatgtttgtgttaattttaggtgactgattttattgtgcgttcactttgcataacaacatgaccagatactatgaatcattgatgaaaatgtgcctgttgagcataactctactttttgaagactcatcatttagacatctatcattcaatgactcgctttgtttcgcgtgctggtaagaccatgtttagttcacaccaaacttcccctaaacttttaactttccatcacattacatcacatccaaaactttcctacttacataaactcctaactttttttccaaactaccaactttctctaaacttctccccaatttcaaaaactaaacacagcctaagtagctcggcctaaatgctccatagaattcagccttaaagagcgtttggaccaagctactcaacaaaaagagctgatgaaggttccgttgcataaaagcatctatcattgctgtagcaaaacaatggtgcatattagcataacacaatgcccacagaaattagccacaaaatttgcatgttttaaaaccgcaagagttattgataaacattatctaaaattcaaagaatagaacaggggaacaccttctggcaggggattatgggagtaagggagccattttatagattctgtaaaaagaaagtgggggatggaaaaataccatgttttgggtagataattggattggagaaaagccactcgcagagaagttccccagactctacaatatttccttgtcaaaacaagtaactgagacaaaagttttaaatgctggctgggatgctttgaagtttaggagaagcctggtgggggaga

SEQ ID NO: 108295 - DNA, 607 bp, Oryza sativa
gtccagcccgacggttggtttgtgcttgggtctctttcttggcacgatatgctggcccggcacgatccggtctaacaacaaggagctcaaatagatttaatctagccatatgaggcacggcccaaagagatgaggggcacaaaatagatttattctaaccatacaagacagctcaaagatatgagggactaagagtagacttattctgtacggtggaggactagggagcaggcagagtaatcgatagatgcgccggttgaaggggttttgttgctcaaattgcagctagggtagaatggtttacattaccatcggtaccgcggttaccggccttaccgcggagtacggtaatagaaaaaccgctgtaacctccttaaattcaaataaatttgaaaaataacttgaatttttgcacggtttcgtgcgggttttcacggttgccgcggttaccgcgcggtaaccgtgcttacggctggggcgcagtaaccccggcctcggcggtttgggaaaccctgggtagatagaatccactgtttcaaaacattttggtccttcaaatatactgtgcatgattttttttcctccttgttgagcttaagtataatat

SEQ ID NO: 108296 - DNA, 675 bp, Oryza sativa
tatttgttgtttcagtcctagaaaacaatacagccatcctgtttcaaagaaaaaggaattcatccatattcttctgttttttccttgtacatatccgctaaatataaagttaccatggaatatatgacaactcaccggtagcattagtgagttaacaaactaggatgatcagctcagttctttcaaagataatgttgaagaacatgtacttcatttattatgtttgttcgtaatagctcatggatacaagggttgcaacccttttcgttttcattctgttgaaaactttgcttaatagtatttggtgggagttattcttaggtactttcaaatttctttatcatgtaaaaattaaatcactgatcaaaatatggatcttaaatcataggacataaaattagactaatatataaaggtaaagagcaggttgaagaaaaatccttcaataactgaggagtttctacatgatggtctgctccaacttccctctctcgcacaccacacatacacagcactggactctctcttactttggttgcattttgaagttggtatgtttctccgatagtatttaatacaccctctcctaacatgttggttaactaaaatctgtattgatagaaatgttgcagaggctacaatggacagagtgtcatctatactcttatcttggtg

SEQ ID NO: 108297 - DNA, 572 bp, Oryza sativa
tgggaaaaaaaatctatggggtgtaattaggagttcttgatggtatgggtattgcagggttgaaagttaaaattgggggcttttgcatgctgaactctgtaaatattctatcttgaggatgcctagggtagaatttagtgcacatgtggtgttctgtaggagcttttgaatgctgttctttgtaaaggtttaatcttgaggatgtttagaatggaagttagtatgggtgtggtgatttgcagcttgattgattagtagttttgttatttacttgtttagagctttgcagcaataagacttggcagtctgtcctgttggctgttgcccaccctgaattagttgtttgattggttactgcattgaatttgtaatatgttatctgtttgtgttgttttacatattctagtgattaccagtactgtagtagcaattcttggcatatggtcttcggaaccttcactttgtaagaacgtaggaaactgggataatcagagaacatattagagctggttaaagttttatcttgagaaactattttgcaagtacattaggttgcttaagttttgctgttg

SEQ ID NO: 108298 - DNA, 1355 bp, Oryza sativa
ctctgaaaaaaagagaagacaaaaaggaaaagagggccatggtgaagaggcctccgtgggccgtggcggcccagataagagttctccttctcactgacatgtggggccaaattaacggccgttgccgcgtcgcctttctcaggctcaaagaagctcgccgccgccgccgcgacagctcgcctcgccgacgagcggcgtcacccgccactccgcatcgatccggccggcgtcggtgagatccgttccaccgggccggcgccgccgatgtgtgtggccggcggcgagacgccgggtggagatatcgccgacaggcaatgggggaacgagggttagtattctttggtggactgagcggcgagctatttattctcgatcgatcaagcagagatcctacaatgcaaatggatgctctttttctggtcactgaatctttaaatgttgcgagtcgcaactgcattctaacctgcaaaaggaggctctctgttcatcaaagtttatgtaaaataatatactccctccgattcatatcataaatcgctttgactttttcttttaaattaaacttttttaagtttgatcaaatatataaaaagtatagcaacatttctagcagaaaataaacatattatcaattattatacttaatgaaactaatttgatattgtagatgttgctaaattttctataaatttgatcaaaacttaagaagtttgattaaaaaaacaacacgatttataatatgaaacggaggctactagcatcagatgcagtttcatttcatacatctttgagttttatacaatgactagtaccactcactatattttagagttcacctcaaaacgtgcactggttcaaacttcacattcaaaaccaacatcgataatttctcttccaacaaaagaaaaacacttctccaaaaaactcttccaaaagagaaatcagacgtagttgttagtctcatcatcaaatgctgtcattccagtcatccagggtacatacacacatcatccaaatccagccattctttttaccaacttaacgtccctgtatatttaactgaacttgcttggataaaacttactccctgtatatataactgaacttgcatggacaaaacttctcaaaagatttcaccaccaccacactggtgaaaaacagttaaaacttgcagtaaaatctactccctgacagtacgtccaagcaaccaacatgctgaaatatagcacccctggcttctctgtccaactccaagtttccaacaaccaaagttgccagatcaactgtgatcagaagcatatttacctgaactggcttggacaaaacttgtcacaagattggtgaaaaaacagtgg

SEQ ID NO: 108299 - DNA, 566 bp, Oryza sativa
atactgcagagaaggtgtttgatattcttaaggtgtgtatagtatcactgcatcgcaacaaatattgaaatgccatatgaaacttcaatattgcacgcagaagaactatcattattgcacactggcaactagcaagtaataatatgctaaatagggtaaattgatttgctagccgtaattggtttaattcaacattgcacagtaacttcccaacatgtgatgcatctaagtggtttgggatttaatggagtgatgttggtctgaagtataaagtcaatacatagagtaaaatctagtttcaatgcagtttgtgttagttcacctgtatagctggatggtagtctggaatctactgtctgcttcagctgattttacactcgaaaatatacttgtttgtttcaacccagattctacctgcacatacagctctcgatctagtagatacaccttaacataggaactgatgtttcagagtacataatctgtacttatatgtagccccaaaatctaattttgtttctattcattcaagttgaccatcaacattgcagtctatatctcttatt

SEQ ID NO: 108300 - DNA, 588 bp, Oryza sativa
cttgaacaagcatctccgattctcattgaattagacataattgtatcaacacgtttatggaagaaaataaataatgtcttaaggccataggtcaattctagcaaggtttagtacataccaaaatatcatttaagaaaaatagtatgttctggaaattgcaagatgaatcacaacaaggcaatatgaaaatgaattgaccacagatacgctactttgacaaaccatttctggcagtgattgcaatgggcgtagtgatgtttagtcatcttgcacagaaaggtgggttacccaaatagataattatctggcatattgtgaaaaacatgaatacaaatcaatttttaaaatacaaaggaagcatgaaaacaggacctatgcaaaacctgtaactatgataaaaatatgtccaatgagtttggatacacaattaattgtcgcttaatttactgagtctgaaagagaatcgaaaaggtaggattcaacattattctcagagtctaagcgactatgcagtaaatgttgcacacactttgccagcaatgcatgaaacaccatacttcacatgatgatcctcttcaaagcgattac

SEQ ID NO: 108301 - DNA, 709 bp, Oryza sativa
aaaggatttctttcatgaaggtcttacctcttggtaaaattctttccaaaacttgtatgggaagaggcattccataagattttcatattattccatagggttcattcctgtgattcaaagggctttgtaggaaaaattcctataggaatgaaatcctctaaaattcctatgaatttcttttgaatcaaagggggcctgagagttgatgtgacactttgttagattcattgtactaggacgtagtactccatcggattgtctgcgagtgacaaacgctgactctcatgtgttcaacattgatcaataatatttttgtcttcttttttctattttggatgttggcagatctaactctctgtatatacatgagatctttcaattttgcatattacttttattaatgtaacgtttagtatactccatatattaatgtaatgttctaagatccttcttttgaaatcaattaggacggatgagaaacgagcgagtacgcaatacatactcgttttgttcatgacatcaagagagagtggtgaaaaatgttgaaaccatatatattatgagggcatggccaattctttttttaaaaagtgtgcaattcgtccctcgaggaaacctccccttgtttacaagtcgtctacagaaacatattttttctaaaaaatatagataaatatatgatatatcactctataaatatataaattaa

SEQ ID NO: 108302 - DNA, 1061 bp, Oryza sativa
  unsure (1)..(1061): unsure at all n locations
attaaaaagaaaatcaatataagcactggattaaaaagaaaataaaattattttctttctattagaaaatggattcaaaagaagaaaataaatataagcgctggattaagaagaaaataaaattattttctttctattagaaaatggattgaaaagaaaaaataaatataagcgctggattaaaaagaaaataaacataagcgctggataaaaacaaaataaaattattttctttctactagaaaatggattaaaaagaatatgattaataaaacagaaaatggattaaaaatagttatttctttctattagaaaatggattaaaaagaatataagcgctggattaaaaagaaaataaatataagcgctggattaaaaagaaaatcaaattattttatttctattagaaaatggaaaattaaattatcttctttctattagaaaatagattaaaaagaagaaaataaatataagcgctggattaaaatggaaaataaaattattttctttctattagaaatggattagaaagaagaaaataaatataagcgctggattaaaaagaaaataaaattcttccacaacaacgaatataatgtaagcgctggattcaaaagaaaacaaaatcattttctttctnttcnanacggcttaaaaagaatataaacgctagagagagggcttgaacctccgaccttgtggttaacagccacacgctgtaaccaactgagctacatccgctgtgtgataaatgatcgaactacttgaggtgtgtgataaataattgaactacttattatcgcacttaaacacaatcaactactctagctggtcaaatgcaattaatactcctgacagctaactaatcaaaaactgcatcactggggatacaatctatcagctaacttcacttgatcttcattgcgttaagatatgaactctctgctttggtctactacttttgcataagtggtgcattatctgattgtcatcatgactgtaagacatcaccatgtttgtaattcaattcctcgatttcatctgtaacaaacaaaaccagc

SEQ ID NO: 108303 - DNA, 603 bp, Oryza sativa
tcaccatgagttaaaatttaactcgcagattcactcgtgagttaaaatttactggaagttaaattttaactcatagtgacgtggacgaatctcgaacgtccatttctcgatccaacagtgtaggatgaaagttgcattattgcaccgaattaggtgattgcaccggatacttccccccgtcaacagatctgggcacacagaaactgtccggtgctttttattggcagtaaggtaaaatgaggattacctaagggtcgaacgggggaacatcagagtagccatcacaattcttaccctccttttttttttttgaactccaatggtttttttgccctcatttcttttcaacggaagcttgtgttttctctcatccattaaaaggatttaatggtgtcaaagacatctgtgcacttgcatatttgcccctactttgctaaggactttgtgattttgccgctattttaacatgactttgtgttttgaatgaattttcacatattcagttaaaaaaaaggagggcgagtacaagcttaacatgaagtttgccccttttgacatgaacttttacaactttaagtcctcttaatggaatgggcgcaggca

SEQ ID NO: 108304 - DNA, 591 bp, Oryza sativa
aggttggtgaagaaaattgaaatttgatgaaaaagagggatttatctttccgagttgaagaattaaaactaaaggaataagaatggtattaattatgaaaaagggagataagtttgagttgaaggatatttaagatgaaatagattctatttgtgaattaagatgcgggaagagagaaaaaaatgtagttggggaataagtagattttataggtgataattcaggtagttaaaggaagtgaaaaatggttaatttaaggggaaaggtagtactgagagtttattgttaattattgatgttagagttgttaatttagaaaatgatgataaatatttaaagggaaaagcaaagttaaaagtaactttagtaagaaatgctaagatggaaagtttacttgatgatggatttttatataaaataaatctgataaatgaatgattaatgtgttaccacttcaagtcaattgcaaattgatgctgttaagaaaatgtcacttaagagagaaagagggaaagtggtgtgtgctaaagatgaaccatcacagtacaaaagcaaggaattgagaagtttggttgaagcagagtccatggg

SEQ ID NO: 108305 - DNA, 1823 bp, Oryza sativa
taatccattttccaatagaaagaaaataattttctttttaatttttaagatgagctactataagcttatattctttttaagatcacatccaatttattttctaatagaaaataatttctttttaatccattttctaatagaaaataattttattttaattttttaagatcagctactgtaagcttatttttctttttatgatcgcatccattttattttctaatagaaaataattttcttttaaatttttaagatcagctactataagcttattctctttttaagatcacatccattttctaatagaaaataattttctttttaagatcagctactataagtttattttctttttaagatcagctaacatagatatgtattcactataaaacagaaaatactacatattttataatccattttcgaatagaaaataaaatactacatattttataatacattttctaatagaaaataattttctttttaagatcagctactagaaaataacatagatctgtattcactataaaacagaaaaatattgcatattttataatccattttccaataaaaaaatttttaaaatttttctagtcgtttatgatcaaatcaaatcgtcagcatcttttattggagtttctgaaaagttaaaagatagtttttattgtggaggcatgtttccttgagatatccatgttttcatatagatatgctgaattacgactcttgtgaatatgatggtggtagattctcgataaaatatgcattcatgtttttttctcaatatttattattaaaaaaattgtgattaatgtgtacagagtaaaatataaattgtacaagatccaagtccccaagacacatgttttttgggaatggtgggaatatatttcaagaaaacaccctatcacactaagggcttattcggattggagggtcaactcaggaaaaaatataggatttgcattcctatggatttgggtactgtagcagcattcggatcaaaggaatcacttgtaagaaaatcggaggaaatctgaaggaaaatttccttggccatccattccacatgaaaactaacaatccactgcgagctcttttttatttttcctatgcatgggaacgcggcaatcaacaaactaatcttcactcctctaacacatgaatattttaagttagtgggtaagttctttaaaaattcatatatttttttacgctctatccgaacgcatgtttatatagcattcttgtgtttttcaattctctgttttattagtacaatcttatcatattcctatgatttttctattcctatattttttcaatcatgcattccgaataagccctaagttaatttgtcttcttgatgtgtatttctatttcatgtgtttttgggtttgaatgttttaaccatgtagctttgcctttactgttcgtatacttcatgtaaatcaaaattgtgccttgggcatgtgtaaacgtcactcctatctctgatctagttattttccaatggaagaatattgaagataaaacgagaatctaagaaacacccccaataagtcatctataatttttatacttgctttaatgaatgcagtattgtgtttgttcgaatgaattgtatctaaatactacatacttgtaatatacagtattcagtaaattgcttgttaatatgatcttctaaatagcagtacattgaaatttttgctgttagctggagtagctcagttggttagagcgtgtggctgttaaccacaaggtcggaggtttaagccctccctctaacgattttatttttatttacactatacttt

SEQ ID NO: 108306 - DNA, 595 bp, Oryza sativa
tgctcaagtataagtcataccttaaagtttctttaataataaaacaagtcacacaaaaataaatagcatttatataatttgtttgaatatgactaatggttaaacgtcatatcaaaagtcaacatcttctgttagaatacagagggagtatatgtccataacctatgctaccttacccgcttatgaatgaatatttgcgctacacacaatcatagtcttaaagctatttaatttgcctttgcgcatgctatttgaaaaaaaaatgatgtacctctttttaatcgatcacagtaatagtccgggtttacccgttctttaggctccacttacatcatgagcaagctaaaaatcgtgatcaagatattaaacctaaaatgaccttgatgtcacctagaggggtggtccatggagcgactcctcggaccagcgaggagtggagacccctccccgagtttgaagattcagccagggggttagcagtgcaagacgatagaaaaagccaaacagagaaaaggtttgtggggcttgatctccccgccaagcaaaagtcaccagagtttatacaggttcaagccacccggaggtgtaacaccct

SEQ ID NO: 108307 - DNA, 566 bp, Oryza sativa
tccaaaatacatgtgtgtatgacaggtgagatcagacattaattatatagtacatttttatagataactattgtatgaattgactttagaagatttggagccaccagttgaatatactactcccttcttcccaaattaatcatgtaagaataggtacaacagcaaattattagccagctataaacatattttaatgagataaaagatgagagagaagagcagcaggctatagatctgtagccagctataacacggactccaagacgcaatggatgtatgacatgtgagcccatatattaatagtataataagcaactattgtatgaattggctattagatcggctatagatgaattggagctagtagtgggctatactagtaaacttgctctaatagaatttaaaatttttcaaattggtcattatataactgcatggaccggatttcatcggaatacaattaatacagtatgggagaatatgtgtatgctagggtgtaattggcaggaggttttaatcgagtatgggagaatgtgtgtatggtgtcttgattgatgtgatttaaa

SEQ ID NO: 108308 - DNA, 726 bp, Oryza sativa
attagcgaacaacagatgcattatgtagttggagattgctcttgacatcactctgaaagaagggccaatgggtggaccaaaagattcatgatacttgtgaaagcagaagtccgtagccacatgccatataggacaatctcatcgaatggtttctctaagctccagcctagaagccaggtgcattttgctcactcaagtgcccactgtcccatgttgtcattgaaactcctgtagctctcggcgtttctatgtattttgtccatccatctttcacataattgtgaaccaaatttgtaatatcggtggacatatcgcatagattcatgcaccagtattggtctagcaaacccttgcattgtaagcatcctgcgatgcttatcaaccatgcgtgccttttgtttcgggtgaagaatcctacgaggctttgttgtgccatagtgttaggcaagacatcgagatatttccatactacagccatggaaatgatctctagtaaaagggtgccatacgccattagaaatgtcacaatgacatcattatggctataggcttgtttatggctgtgtggaggagaccaacggctgggatcaccagtagtatagctagcattcatgttgatacccaacaatagcggtttgcgtcaggttgttcgctatcaatcttatttctggtgtatagaatatcaaagatgttggaaagcccactatttattgttttacaaacttg

SEQ ID NO: 108309 - DNA, 842 bp, Oryza sativa
cacgggggggcctcacgctatcattggtccggtttcttaccatcaatctatctatctattatctattctattatatactaaaaagccattaaatttcctacaaacgctctcatgccgccacatggtgctctaaaaagctctcaagctaccacaaggcgctataataaaatagaaaaaaacttaaaatttctgagaaaaaagaaaaaaaaatctatccctccaaattcttaaaaaagtgggggatccattaatttacacaattggattagatatgttataaataagaatctatcccttcaaatttaccgaggaatactttccataaaaaaattgactagaaaaggctgagaaggcattggtacgtacgaattaacaaccacaaccgagaaaagaagaaatgatattcagcaaaaaaaaaatactgtatacgtacgtactactggaaaaaaattttaaaaaaaaacatcgctttttttaaactggattttcacttcctttgtatttttttatgacagccaacgttaaatatttagtgaaactaccgaaagaaaacaacgctctttaatctggattttctattatacttcctttgtatttttttattggtttttatatattgatgaccaatgtcatatatttagtgaaggtggtagtataaaaaatatatatcacttaacaaacatgcacagccaaaactagatctataatataatataaaatatcaaatacacgtatcatttcacactattattgttgagtatagatagcatttatttgcatcaatgggcctatatattgatagttcaagatgaaataatgagtaattaaaatattcaggacat

SEQ ID NO: 108310 - DNA, 2954 bp, Oryza sativa
cccgttacggaccacacgcacgaaatgcatgcctctttttcctccgctcctccgtcgtacgaaacggaggttaacgaagcgaacggtggtttccacgtgagaaaagggggagcttctccgccaagcggttgaacggcgcgtggcgttgggtgacccggcgacacgcgggattttacgcctttttgtccgaataatatattttttttcaacggcttttgcgtacagagggatatgggaggggggattcagaggggcgggcattgggagctttcccggaatggcgattggaaagtagaataatcattaaggtggcagttgcaatttgttaagtacagctcaaaaatatactccctctcgttccaaaataattgtattttttgattgaagattcatccctaaataattatcactctagagcactaattgcccccataaatcatagtctttttttttctcaatagatataagtgtcacaattattttttgatggaggtagtacagtatttttttaatttaaattaaaagttattatattatggtacgaaggtgtatattacgtgaggatagtgcacagaagaacattgggtataatggcgtgcacatgttgagtatacttaatctttagccagttgcaaattattaggtcttttggtattaaatatttgaatgatcaagtgcgtctacagtttatttataatttttcgctgctaccacggagcttgacaataattattgcgtacaaaatcccttttcatgttcaactgccaccaaaatttgtttataaactttttatgctaaccagggagctatgagtcatatttatttcatatggcatccttgggggaaaggtgtcttaaaaaaatcagggaaaaagatgtttttggcccagtttagatcctccaaaatggtaaaagttttaccattttgtagcattttttgttattttggatctaaacactagtagcaaaagttgtcaatttggtatttggcatttgctagtccatagtagcaaattatgccaaaaagtgctttgggaccactccatctctctttctctctcacactttagtgctagaatggcaaaacttttacatacatctaaacaccaactagtacttttgcaatgcaaaaacttttgccaccaaaacttttgccatttgtcatttgtcattccaaatggatctaaacaggccttttatttatttattgctgtttctagtaaattatcttctagaattaccagccaaaattgtcggctagataactgcggctttgtgttcgtgtcgccctggcagagtacaagaagaccagtgcatgtcgcgtacgtaggccttttgggcccatacaccccatgtaacggcccactcactcagccagccttaatcatggcccgcaccacccgcgaccccgttccggcccaactaaaatgggctacacgtatgccgcaatccagttccgatcagaccaaaatggacctagcgtcctcaccagcgtgggccgtggtgggctaccaacttctcctcttctcatttttcacgcacacgttttctcattctttcaagttggttcaagaaaatcaatttcgatcttttcttagaaagtttttgttagctgatagaagcactgcgcactcaattaacggaatcatgtgttaattcatcgatctgttttacgtgtcaagagggaaaggttgactttaaaaaaaaaaacacaacctcctaactagagcgaaaagtagggcttgaagatgtttttctactacacgtcacgcgtatggttccagatccaggactatacgacaacacctgctcatcacttcatcagctcatggtacggaggacttcctccatctctaaatatttaacatcgttaatatttttaaacatatttaaccgtttgtcttattcaaaaacttttgtaaaatatataaaactatatgtatacataaaaacatatttaacaataaatcaaatgataataaaataattattaattaattaattttttaaataagatgaacggtcaagtatatttaaaaaatttacggcgtcaaatatttaggaacggaaagaatagttattagcccaacagtgttttcgtcatcatgcgtaaaggtgcaatatatcgtccaagactgatcaaggctagctaatggctagttgcggagtaatcaccgagtaattagtgtagaaaggacaacgagtagcctgcaaattaaatccgaatctatcgatggatcaggttgcgatccgaatgatatctgacaagacatcgatcaccgtatgtgtgctcgtcctgaagagagaaaaaacacgacatgacccaatcgatggagcctggctagctttgacattgtgcaactctatataagcatagcaactggggactggacacttctgccacttgagctgcgtggagttgccctcacaacaaatcactgaaatcaccatcaacaagatatctaggggccgtttggttgctatcttcaatttacgatgtctaaggttttacaatcgtttagttcattgtcacatctgtgactcgccacacttttcaaccatatggtcccacgtatcattgacccaattttttaagtaagcttgtctaaggtgttgctaagaatttatgagccacaacttttgtgacaagccacaacttatcttaattgtggtttggtaaagatagccacaaaccaaataaccccctagagcatggtttttcttgcgatcctgtagtggctatggttttggattctgcgaggcatctgttgcactacgtcgatgacaacattgggttttcttatttaaaatatggaatcgcctaagtttcatatgacagaaattttatggtagaaagaaatccaccattagatccactccacgattcatgctacattccttcttcagcttccctgaccgccaatgacccgatgaattaaggcttaccattctggg

SEQ ID NO: 108311 - DNA, 941 bp, Oryza sativa
gaaaaagaaaagaaaagaaaggattttcctgggatttaaaatgcactttggtgatttttaattggttaaaattatttccaaggctctgaaaattccactaaaaatcctgttaatatattgtgacatgtagaatccaagaaaaattccacatgccgattctgattattatttgcatttattaattagagaattagctctaggttaattaagataatttcttcggacgatttatttagccaatttttaaagcaagcaaaaggggggaaacttcagggcgtgacaagcgtcatatatatcgacttgtacgcgcactcgcctccggtttttgccccctttttgtggcgatgccgacgccgtggccggcacgaggaccactcagaaattctggggggtgggccgaggattccaaggttctcgcaactgaaggtacccaccacgctggtgcgcacacagcgataaaaaactactagtattccacttaatcatgtttctttccaaacatggaaggatatattaaagatctttccaataatatgcaatagaaaatctcacctatatatatatatattcttttctttttaattattggatggattgattttaagattcacttaagcacactaatgccaaactcctcttcttctgttccccctggctgccattcctctttttgtttgattgactcttcctctatccgatctcccgctgccatcgtcccaatacgtagccgcctgatcttgctggttggtaggaagatatcaacgatgtcagtgagaccccgttgggccagcctcctcatctgcttatcctcttcgccaagctagcataacgagtgttcccgtcccaccgtctttcctgtctccggtgactctctgtcattgtatttgtcatcgtcagccgctgtttcctaaccaaaagttccactttacctccaccatcct

SEQ ID NO: 108312 - DNA, 895 bp, Oryza sativa
accggcgaaccgtacctgcaggtgcagaccaacctctacgtacattatattgacggcatcggcaaccgggagcaagaccggttcgaccccaccgcccaccggcgacttctgcacctctggtacggtcgtcttcctcatcggcgtctacgagaacaagaacgacactgcgcctcgatcttgatcttatcgtgcgcgcgtcgatcgagttccatacccagacacattaactaccacgccggtcggatctggcggccccgacgccttgtaactcactatacccatgcaagatcaaactcgactcaaaccgactggcaccaaaacaaaaatactctgccttgtgaacagcccccacaccaccatgaagctccacatgggggcatggcgctacccatatatacacactgcacgcgccctggcatcctcggttggtgaggacagggaatagaggcaagcgaggagagaggaatatccacgctgatttaccacgggttgaacgaaactggcaaccatattatcttgagatgaaagtagatatctctttacaagtccaaggacggtcatatattcacaaatgctactgggcgggcgagcgatcgattctccacccccccccccctctggaattcgttattagcaccgcataacttccctattgtaataaaattatgtatctaaagcttataccacctaggttgacacatctaaagtttgagaccaaaagtttataagtcaaaagtttatatatccgattcaaatttgaatttgaattcaaatatttttcatatatagtatttctatacatctaagggttatacacctaaagtttatatatccaaagtttataagtcaaaagtttacatagccgatttcaaatttgaatttgaattcaaatttg

SEQ ID NO: 108313 - DNA, 503 bp, Oryza sativa
acaaatttatgccatcactttcacgataaatttgattcactcattattgtatgaattgtttgataattcatttcttcttaatggtcaccctagtaatatttctggcaacgaaaataatcatcttcttctcaatatattcctagaactcatcaaatcttatgaaaaataatttcttaacaaatacctcctactaatgaaatggtttaagattttacatcgcacaattacgaaactgaatctatataaaatcgatgaaattaaatgaattttcaattttattacttatttcttctcattattttacgacccgagtgtgatgccttgtgtgcgtgtagcatttcctggcttgcatttataccctggtgcaacccaaggctgcttggtgcttgccgcgccgtctcgcctgcgcccgccggaaagtgtcggtagcccaacggcgccgtcggcgccatcccgccaatatggtgttacagtgcacagtttcctaactcccaaaatcgatt

SEQ ID NO: 108314 - DNA, 599 bp, Oryza sativa
attttacccttactaaactaataaggtggtactaaacatattcacacaccttcatgagctatactgaccttatcctaagggcaagtgttatggtagatgtgactaccacatctaaatttatccacatcatttactcataaattaagaggcaatctatacactatgtcacctctagtacacaaataccaatgtctcttatactctcacacccctcttaaaatttgtgtggaggttgcctcttcatttaggggtggtttaccatttctctcctcacttatctcctctacctcatcactcaatccaatatggcacatttaggggcagcatatgaaacattataatacttgccctaattggccaggctatcacactggaccgcaccagaaacttcatcaaaaaggtagagaggaacaagcgctagaagagctacccctactgccatattatttgatctctctctaggcgtggaaccctgccctttttttccccatttaaacgatgattttttgtgcgtccaaaggttggggaacgctgattttttgcacgatttttgcatggtaccgtatcaatgtagaagcgttgatttttttttctcacgg

SEQ ID NO: 108315 - DNA, 1419 bp, Oryza sativa
  unsure (1)..(1419): unsure at all n locations
aggaatatatattttcccagctgtagaccctgaagctcgccactggatgtgttcgggtattgattaatactccctccgtattttaatgtatgacgctgttgacttttcgatcaacgtttgaccattctttttatttaaaatttttgtgtaaatataaaagtacttatatcatacttaaagaatatttaatgataaatcaagtcacattaaaataaataataattatataaattttttgaataagacgaatgattaaacgttggataaaaaatcaacagcgtcatacattaaaatatggaggtagtatataccattggagaaagtacatactcaagcgtatggtcaactgatccttcctcttatcgataagcggccaagttgccccaaccgtacatgataggacttgaattgaatgaggtttttcattttgctaattgtaaatttgtatatgattaaaatgtttgctagtgaagcatataagttgcatgcatggggtctgcaattaaccatatgttataactttacctactttgatttcaattctgatatccaaaatattacacacgtgtagatgggaagtgacgatcccaaagaaggagcaaggtgggcttgagcccctcctactgttggataaacccactgtatattctttacacacttcagttttgtaaatagaatgtttgcaagatggaagaaaaagataaagaagtaaaaaaaaaccattatttttctattctttntttctaaacagatactttcatatatttatcttttttatatttttcttatatatagttcgcccaccacatatatattatgtttgcattggcacctcctaaaaattaatcatattgtgttcactactgcatgtggatatacttttaatagttatttagtgagatcaaggatttgttcctttggtgttgtcttttttcaacgtgtgttagggatcgctccatggatgtgtgcacgccttaacagggtttgtatacgtgtatatgtcttacacacttacgtgtaattgaaagaagaataagaaatgttgttgtggtgtgtcctgtgcaataatcgaaacaacaagcgttgagtaacaacgacaacacggcgtcgagtacattgttgcttttgataaaattaagaggcaaaaccaggtgctgcaatagtcaaattaatacattcgacaataatttgctgaccgtacgttcgtacttgatacgtatagtaaatttgtttgccaggaatggtgctgcagagcacaacatgtcagcatgtatatatataacgtttttgaatactaagtttttgttgttttgtccgaaataagcaaccatagtgagaaaaataaaaataaataagaacatgtatcctctcacacattggtgaacgattattagctgacagaattaagacgctatatct

SEQ ID NO: 108316 - DNA, 576 bp, Oryza sativa
ttgagccagataagggaaacagcagcatcattctcctagattgggttgtggaacattggcgtaatgatctagtcactaaggcagcagacatgaggattctaaataggtgtagtcttgactaggtttccctagtgttaaaactcgggcttctatctcacatggtcatacccacttcctaatgcaaggttacccatgcaacaggtcatgtagtaccttgacggaaacatgctccatacccccaaacttgttaccggcataccttagctcaaacatgttggagcggatgtacatcactgagttggacaataatataatgtaatatgtgtcatcgacaagtttaattggatatcatttatgatttctccagacgaaggtgaaatacatgttgtgttgaaatatttgtgttagactcggttgtactcgtctctaatgggttctgttgttatggtattcatcacaagtaagtgtatatccttgtaaccagtactttgagaaagtttgcgttgttttccaataagtttatatttatttttgaaaatttccaataagttcggataaagcaagtaaaggacggta

SEQ ID NO: 108317 - DNA, 918 bp, Oryza sativa
tttaataagtcttctggaatacttccgatgcacacgcgaacctttgcaacggcggaaacgacaagctaacacgcaaaacaaagaaaaagactaataaaaaccaaataaacagtacatataaagtaaacaaacatgtagatcataattttagatgaatttagagacttaaacggcatcattccgatttcatatgaattagttatgaattttacaagatttaattccaattaaacctattaaagaaaagactattccaaattaattaaacaatttacaaatgatttataactgagggaaaagattaaaacaacctccagaaaatattagattatatttggtagatgacatatagtaaaatgaataatatgccattgaaaagagaggaaaggatttatatggctgagattaatcttgaccaagtcgaccaagatcggatggcttagattgatctggcaagcgagcctcacgagatatcgactcaacgagtcaattctacgtgacacgggaccacccaaaagatcaactgaaactggcgaacggaaccagcggctctgaacggctctaacctaaaggacgactcaacacggacgaacgaatgaagcacggggaacacctcattcgaacgaacgagtgaacgactcaacaatggctatggctaaaccggtgggctagaaacgattcacggtaaagccccggtacgacaaacgataggccggtaggaacctagggatgcacctacggctttacaactgggctaccgggctacggctaaagcggcacacgactgcgacacggcacagcagcgacggcaaacggtgactacggtagcgggacggcagcgacttggcacgctcgagcagcagcagcacggctgtagcagggagtggcacatcgatggctaggcggctagcgcagcga

SEQ ID NO: 108318 - DNA, 538 bp, Oryza sativa
ggccggccggaggtcgtcggcgatggaggagagagagagcgacggcgcgagctcgattccggcgaggagaaggcgcggcaaagggtagaaacgggcgaaggaggtgcagggtgggtttaaatagggttggaagggggaggaagtaaaccggccgggaggtcctgccgccatcaatggcgccggcaagatttgcgggagcaaatctgcccgtttgaatgcgggagagagagggaaaaatggggggaaagggagaggggttcacggggaatattttcccccactttattgcatgcggggacggcgggagccggcgggattcgcggtggccgcggcgcttggcgcgggcggggcggcgggagcggcgggaggacggggatgacaggtgggccccacccgttagcgagggtggcgggcgggcccgcccgtcagcggtgcgcgcgcggggaggggctgagtgggccgcgggggaacaggagagagggggagggaagtgggctgaatgcggcccaagagagggaagggggatttttagggtttt

SEQ ID NO: 108319 - DNA, 672 bp, Oryza sativa
gaaggtcgcgtcatttaaagtcgggctggcgagaccgtacttctttctgaatcagttaccgtactttccacccgtctccgaaggtgatggagtgggcgtctttcgctccttcctccacacatctttggttttggtgcggatgcgtccttcttctgagccgcttgctctagtttcttggccagtatgggtggttctaccggcatcttccaatagcggttgttaggcatagttgtttccttctccatgaaattgtgcataaatttcaccaggctgtccattttgggtggctccacttcgacctcttggatattctgtgggttcggcccatactttattctgaccatggagtattgttccgtcctcggttgaaactcaaacttctcttccttgccgttgacgtggaacgggcgcccccaaggatgagcggcgtctcttttcccgtgtccatgtccagcaccacgaagtcaaccgggataaagaaatcccgtgtcttgactgacacatcctccgctatccctgccggtaacggactgacgaatcagccagttgaaggcgcatcggtgttggtgccaacactgtgaagttgagtctatcgaagacgtctttcggcatgatgctgacactggctcccaggtcgtataaggcctggtcgaattgttgtgccccgatcta

SEQ ID NO: 108320 - DNA, 725 bp, Oryza sativa
ccccttttttttcatagccatgcctttcctcccctttttttttctttttttcatcttctttttgccacgaacttttccagcagaagaaagcatagtctaatataggagtttatttaaatggaattttttctatggaaagccgacttccagtgtagaagcttagcttaattatatatgtggaaaaagatggaaatggcaatgaccccttgatcatgagagtatgaaagatatctaacacaagtcacataaatttgacaaagcttaatacaatgtcaagcaactatatgcataataaagttgatcagtaatgtacttgcatatggccttggtaagtataagatgaagtaaattggaggattgaggttttaaaacaattttattttgaaaacatattcccaagagtcataacacgagttgcaagaattcctttcatcttcaatcatctcacataaagctattaattagatgcaaaaggttccctaaacatggaaggtttttcacaagcacaagttcagctaagaatgatagatatacaagatcaatcatatgaagaatttcattagttggaaattttatctttcttatgcttgaaccgattgttttctgaattttcagctctagtactataccatggtggagatatacagatacaagacgtgctcacctgcttacctatgaaaactgagaggtattggggccaacactggtttggccgaacctggtgg

SEQ ID NO: 108321 - DNA, 826 bp, Oryza sativa
cgtgatcccacacgaacctgccttaacccaaggcctacgatgattcaaaccgaactggcaacccgaccctgggtcccagctcgtcccaagccaacccaggccaaccattccacattttagttgttaagcaggttttaagaattaaaaacactaacttgggtacattgctcggctttcccataaccgagggcgcggctattcgaatagattatactctgatcagaggtgtacatctttacccacaagacacatcttcctcacatgtaaccatgtgccacataccatcacggtatacggacggaagacgtgacatagtttccaacccatcctagccatagacaagagtaccgacccaaccccacctacggccggaactgtcatgcccagaaattcccgagtagaattccaagcagaatgtgcattaaaatccccgtccaggaccggccggggtacacaaacgacaatgttgacattcagatccacgtcttacaaacatcataaaagtcttacacaaatgcagcggaagaaaagaaagacagcaggagctaagccttgactagaactgcagcgggaacaccactccacaggcatcctcgacggcacggacgaagcctactcctcggagaaaccttcatctgacacatactcgagctctggggttgggaaaaaaatagagcaagactgagtactacccactgtactcagcaagtcataccggaataggggtatgatgcagggaattatcaaagaagagctggagtggttcatttgcataaagcgagcatttataaacagaagttgaaagattaaacaattgtaaaattta

SEQ ID NO: 108322 - DNA, 651 bp, Oryza sativa
ccggtgaaaaacatcgcacccacgtgtgccaagatatggcaatattggcattaattgacaaaagttcgccgcgcgaatcacgaagtgattttttgccacgaatgcacccaacacactccaatatgtccaaaaatcatgttttggtgctttttgaaatttttcattccggtgaaaaacatcgcacccacctatgccaatattggtagtaattgacaaaagttcgccgcgcgaatcacgaagcgatattttgccacgaatgcacccaacacactccaatatgtccaaaaatcatgttttggtactttttgaactttttcattccggtgaaaaacatcacacccacctatgccaatattggcattaattgacaaaagttcgccgcgcgaatcacgaagcgattttttgtcacgaacgcacccaacacactccaatatgtccagaaatcaagttttggtgctttttgaactttttcattccggtgaaaaacatcgcacccacctatgccaatattggcagtaattgacaaaagttccccgcgcgaatcacgaagtgatttttttgcacgaacgcacccaacacagtccaatatgtccaaaaatcatgttttggtggcttttggactttttcattccggggaaaaaacatcgcacc

SEQ ID NO: 108323 - DNA, 822 bp, Oryza sativa
atgttttggtgctttttgaaatttttcattccggtgaaaaacatcgcacccacctatgccaatattggtagtaattgacaaaagttcgccgcgcgaatcacgaagcgatattttgccacgaatgcacccaacacactccaatatgtccaaaaatcatgttttggtactttttgaactttttcattccggtgaaaaacatcgcacccacctatgccaatattggtagtaattgacaaaagttcgccgcgcgaatcacgaagcgatattttgccacgaatgcacccaacacactccaatatgtccaaaaatcatgttttggtgctttttgaactttttcattccggtgaaaaacatcgcacccacctatgccaatattggtagtaattgacaaaagttcgccgcgcgaatgacaaagtgatattttgccacgaatgcacccaacacactccaatatgtccaaaaatcatgttttggtactttttgaactttttcattccggtgaaaaacatcacacccacctatgccaatattggtagtaattgacaaaagttcagcgcgcgaatcacgaagtgatattttgccacgaatgcacccaacacactccaatatgtccaaaaatcatgttttggtgctttttgaactttttcattctggtgaaaaacatcgcacccacctatgccaataatgggagtaattgacaaaagttcgccgcgcgaatcacgaagtgattttcattccggtgaaaaacatcgcacccacctatgccaatatttgcttgtaatgacaaaagttcgccgcgcgaatcacgaagtgatttttttc

SEQ ID NO: 108324 - DNA, 986 bp, Oryza sativa
caatattggcagtaattgacaaaagttcgccgcgcgaatcgcgaagtgatttttttccacgaatgcaccaaccacactccaatatctccaaaaatcttgttttggtgctttttgaactttttcattacggtcaaaaacatcgcacccacatgtgccaatatcggcattatcggcaaaagttcgcccgcgcgaatcacgaagtgatattttgccacgaatgcacccaacacactccaatatgtccaaaaatcatgttttggtgcttgttgaactttttcattacggtcaaaaacatcgcacccacatgtgccaatatcggcattattgacaaaagttcgcccgcgcgaatcacgaagtgatattttgccacgaatgcaccaaacacactccaatatgtccaaaaatcatgttttggtgctttttgaactttttcattacggtcaaaaacatcgcacccacctatgccaatattggcagtaattgacaaaagttcgccgcgcgaatcacgaagtgatattttgctacgaacgcacccaacacactccaatatgtccaaaaatcatgttttggtgctttttgaactttttcattccggtctaaaacatcgcacccacctatgccaatattggtattgacattaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatgccaatattggcagtaattgacaaaagttcgccgcgcgaatcacgaagtgatatttttccacgaatgcacccaacacactccaatatgtccaaaaatcatgttttggtgctttttaaactgtttcattccggtgaaaaacatcgcacccaccgatgccaatatgggcaagaattgacaaaagttccgcgcgcgaatcacgaagcgat

SEQ ID NO: 108325 - DNA, 898 bp, Oryza sativa
cattctggtgaaaaacatcgcacccacctatgccaataatggcagtaattgacaaaagttcgccgcgcgaatcacgaagtgattttcattccggtgaaaaacatcgcacccacctatgccaatattggcagtaattgacaaaagttcgccgcgcgaatcacgaagtgattttttttccacgaatgcaccaaccacactccaatatgtccaaaaatcatgttttggtgctttttgcactttttcataccggtgaaaaacatcgcacccacgtgtgccaatatatggcaatattggcattaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatgccaatattggtagtaattgacaaaagttcagcgcgcgaatcacgaagtgatattttgccacgaatgcacccaaaacactccaatatgtccaaaaatcatgttttgtttctttttgaactttttcattccggtctaaaacatcgcacccatctatggcaatattggcattaattcacaaaagttcgccgcgcgagtcacgaagtgattttttgccacgaacgcacccaacacacttcaatatgtccaaaaatcatgttttggtgctttttgaacttttttattccggtcaaaaacatcgcaaccacgtgtgccaatattggtagtaattgacaaaagttcagcgcgcgaatcacgaagtgatattttgccacgaatgcacccaacacactccaatatgtccaaaaatcatgttttggtgctttttgaactttttcattccggtctaaaacatcgcaccca

SEQ ID NO: 108326 - DNA, 670 bp, Oryza sativa
atcacgaagtgagtgttttccacgaacgcacccaatacactccaatatgtccaaaaatcatgttttggtgctttttcaactttttcattccggtcaaaaacatcgcacccacgtgtgccaacaatggcattaattgacaaaagttcgtcacgcgaatcacgaagtgagttttttccacgaacgcacccaatacactccaatatgtccaaaaatcatggcttgctgctttttgaacttgttcattcctgtcaaaaacatcgcacccacgtgtgccaataatggcattaattaacaaaagttcgccgcgcgaatcacgaagtgagtttttgccacgaacgcacccaatacactccaatatgtccaaaaatcatgttttggtgctctttgaactttttcattccggtcaaaaacttcgaacccacgtgtaccaataatggcattaattgacaaaagttcgacgcacgaatcacgaagtgagtttctgccccgagcgcacccaacacactccaatatgtccaaaaatcatgttttggtgctttttgaactttttctttccgttcaaaaatatcgcacctacgtgtgccaataatggcattaatttgcaaaagtttgccgtgcgaatcacgaagtgtgtttttgccacgaacgtacccaatacacttcaatatgt

SEQ ID NO: 108327 - DNA, 2971 bp, Oryza sativa
taattgacaaagttcgtcgcgcgaatcacgaagtgagtttttgccacgaacgcaaccaatacactccaatatgtccaaaaatcttgttttggaggtttttgaactttttcattccggttaaaaacatcgcagccacgtgtgcctataatggcattaattgacaaaagttcgtcacgcgaatcacaaagtgagtttcttccacgaacgcacgcaatacactccaatatgtccaaaaatcatggtttgctgctttttgaacttgttcattccggtcaaaaacatcgcacccacgtgtgctaataatggcattaattaacaaaaattcgccgcgcgaatcacgaagtgattttttgccacgaacgcacccaatacactccaatatgtccaaaaatcatgttttggttatttttgaacttcttattccggtcaaaaacatcgtacctacgtgtgccaataatggcattaattgacaaaagttcgctacacgaatcacgaagtgagtttttgctacgatcgcacccaataaactccaatatgtccaaaaatcatgttttggtgctctttgaacttttgaatttcggtcaaaaacaacgcacccacgtgtgccaataatggcattagatatcaaaaggtcgccgcgcgaatcacgaagtgagtttttgccacgaacgcacccaatacactccaatatgtccaaaaatcatgttttggttatttttgaacttcttattccggtcaaaaacatcgcacccacgtgtgccaataatggcattaatttacaaaagttcgctacacgaatcacgaagtgagtttttgctacgaacgcacccaataaactccaatatgtccaaaaatcatgttttggttgtctttgaacttttgaatttcggttaaaaacaacgcacccacgtgtgccaataatggcatttgatatcaaaaggtcgccgcgcgaatcacgaagtgagtttttgccacgaacgcacccaatacactccaatatgtccaaaaatcatgttttggtgctctttgaactttttcattccggtcaaaaacatagcacccacgtgtgccaagaatggcattaattgacaaaagttcgccgcgcgaatcaggaattgagtgttttccacgaacgcacccaatacactccaatatgtccaaaagtcatgttttggtgctttttgaactttttcattccggtcaaaaacatcgcacccacgtgtgccaatattggcattaattgacaaaagttcgctgcgcgaatcacgaagtgagtttttgccacgaacgcaaccaatacactccaatatgtccaaaaataatgttttggtgctttttgaactttttcattccggtcaaaaacatcgcacccacgtgtgccaatatatgccaatattggcattaactgacaaaagttcgccgcgcgaatcacgaagtgagtttttgccaagaacgtacccaatacactccaatatgtccaaaaatcatgttttggtgctctttgaactttttcattccggtcaaaaacaacgcacccacgtgtgcgaatattggcattaattaacaaaagttcgccacgcgaatcacgaagtgagttttttccacgaacgcgcccaatacactccaatatgtccaaaaatcatgttttggtgctttttgattttttttattccggtcaaaaacatcgcacccacgtgtgccaataatggcattaattgacaaaagttcgccgcgcgaatcacgaagtgtgtttttgccacgaacgtacccaatacactccaatatgtccaaaaatcatgttttggtgctctttgaactttttcattccggtcaaaaacatcgcacccacgtgtgccaagaatggcattaattgacaaaagttcaccgcgcgaatcacgaagtgagtgttttccacgaacgcacccaatacactccaatatgtccaaaaatcatgttttggtgatttttgaacttcttcattccggtcaaaaacatcgcacccacgtgtgccaataatggcattagatatcaaaagttcgccgcgcgaatcacgaagtgagtttttgccatgaacgcacccaatacactccaatatgtccaaaaatcatgttttggtgattcttgaacttcttcattccggtcaaaaacatcgcacccacgtgtgccaaaaaaggcattaattgacaaaagttcgtcgcgcgaatcacgaagtgagtttttgccacgaacgcaaccaatacactccaatatgtccaaaaatcatgttttggtgctttttgaactttttcattccggtcaaaaacatcgcacccacgtgtgccaatatatgccaataataattgacaaaagttcgccgcgcgaatcacgaagtgagtttttgccaagaacgtacccaatacactccaatatgtccaaaaatcatgttttggtgctctttgaactttttcattccggtcaaaaacatcgcacccacgtgtgccaagaatggcattaattgacaaaagttcgccgcgcgaatcacgaagtgagtgttttccacgaacgcacccaatacactccaatatgtccaaaaatcatgttttggtgattcttgaacttcttcattccggtcaaaaacatcgcacccacgtgtgccaataatggcattaattgacaaaagttcaccgcgcgaatcacgaagtgagtgttttccacgaacgcacccaatacactccaatatgtccaaaaatcatgttttggtgctttttgaactttttcattccggtcaaaaacatcgcacccacgtgtgccaaaataggcaatattggcattaattgacaaaagttcgccgcgcgaatcacgaagtgattttttgccactaatgcacccaacacactccagtatgtccaaaaatcatgttttggtgctttttgaactttttcattccggtgaaaaacatcgcacccacctatgccaatattggtagtaattg

SEQ ID NO: 108328 - DNA, 737 bp, Oryza sativa
cactccaatatgtccaaaacgcatgttttggtgctctttcacctttttcattcggtcaaaaacatcgcaccaccgtgtgccaacaatggcattaattgacaaaagttcgtcacgcgaatcacgaagtgagttttttccacgaacgcacccaatacactccaatatgtccaaaaatcatggcttgctgctttttgaacttgttcattcctgtcaaaaacatcgcacccacgtgtgccaataatggcattaattaacaaaagttcgccgcgcgaatcacgaagtgagtttttgccacgaacgcacccaatacactccaatatgtccaaaaatcatgttttagttatttttgaacttcttattccggtcaaaaacatcgcacccacgtgtgccaataatggcattaattgacaaaagttcgctacacgtatcacgaagtgagtttttgctacaaacgcacccaataaactccaatatgtccaaaaatcatgttttggttgtctttgaacttttgaatttcggttaaaaacaacgcacccacgtgtgccaataatggcatttgatatcaaaaggtcgccgcgcgaatcacgaagtgagtttttgccacaaacgcacccaatacactccaatatgtccaaaaatcatgttttggtgctctttgaactttttcattccggtcaaaaacatagcacccacgtgtgccaagaatggcattaattgacaaaagttcgccgcgcgaa

SEQ ID NO: 108329 - DNA, 892 bp, Oryza sativa
aaaaaatcacttcgtgattcgcgcggcgaacttgtgtcaattaatgccaatattgccatatattggcacacgtgggtgcgatgtttttcaccggtatgaaaaagtgcaaaaagcaccaaaacatgatttttggacatattggagtgtggttggtgcattcggggaaaaaaaatcacttcgtgattcgcgcggcgaacttttgtcaattactgcaatattggcataggtgggtgcgatgtttttcaccggaatgaaaatcacttcgtgattcgcgcggcgaacttttgtcaattactgccattattggcataggtgggtgcgatgtttttcaccagaatgaaaaagttcaacaagcaccaaaacatgatttttggacatattggagtgtgttgggtgcattcgtggaaaaaaatcacttcgtgtatcgcgcggcgaactattgtcaattactgccaatgcataggtgggtgcgatgtttttcaccagaatgaaaaagttcgaaaagcaccaaaacatgatttttggacatattggagtgtgttgggtgcgttcgtggcaaaaaatcacttcgtaactcgcgcggcgaacttttgtgaattaatgccaatattgccatatatgggtgcgatgttttagaccggaatgaaaaagttcaaaaagcaccaaaacatgatttttggacatattggagtgtgttgggtgcattcgtggcaaaatatcacttcgtgattcgcgcgctgaacttttgtcaattactaccaatattggcataggtgggtgtgatgtttttcacccgaatgaaaaagttcaaaaagtaccaaaacatgatttttggacatattggagtgtgttgggtgcattcgtggcaaaatatcactttgtcattcgcgcg

SEQ ID NO: 108330 - DNA, 513 bp, Oryza sativa
acaaaagttcgccgcgcgaatcacgaagtgattttttgccacgaacgcacccaacacactccaatatgtccaaaaatcatgttttggtgctttttgaaatttttcattccggtgaaaaacatcgcacccacctatgccaatattggcagtaattgacaaaagttcgccgcgcgaatcacgaagcgatatttttccacgaatgcacccaacacactccaatatgtccaaaaatcatgtgttggtgctttatgaactttttcattccggagaaaaacatcgcacccacctatgccaatattggcagtaattgacaaaagttcgccgcgcgaatcacgaagtgaattttttcacgaacgcacccaacacactccaatatgtccaaaatcatgttttggtgctttttgaactttgtcattccggacaaaaacatcacaaccacctatgccaatattggtagtaattgacaaaagttcgacgcgcgaatgacaaagtgatattttgccacgaatgcac

SEQ ID NO: 108331 - DNA, 860 bp, Oryza sativa
acaggtgggccccacctgtcggcgaccccggaagaagaaggaggcgggcggcctggctaggcctcggcttgcggccggcccagcggggaagggaaagagggaaagaatgggccggcggcccattcgaaaagaaaaggggaaaaaaagtgaaagaaaaaggaagaaaggatttccctggaattaaaatattgcttgctcaattttaattggttaaaattatttctagggctctgaaaattccactaaaaatcttgttagcaaatttcgacatgtagaactcaaaaaaaattccacatgccagtttcgtttattatttgcattactttattagggttttctcttgatttgcactggcattttcttagggtcatttataaattaaattttaggcttgggagaacttcagggtgtgacagtgattcgcgcggcgaacttttgtcaattaatggcattattggcacacgtggctccgatgtttttgaccggaatgaaaaagttcaaaaagcaccaaaacatgatttttggacatattggagtagtgtattgggtgcgttcgtggcaaaaactgacttcgtgattcgcgcggcgaactttggtcaattaatgccattattggcacacgtgggtgcgatgtttttgaccggaatgaaaaagatcaaaaagcaccaaaacatgatttttggacatattggagtgtattgggtgcgctcgtggaaaaactcacttcgtgattcgcgcggcgaacttttgtcaattaatgccattattggcacacgtgggtgcgatgtttttgaccggatgaaaaaattcaaaaagcaccaaaacatgatttttggacatattggagtgtattgggtgcg

SEQ ID NO: 108332 - DNA, 1188 bp, Oryza sativa
  unsure (1)..(1188): unsure at all n locations
taatgccattataggcacacgtgggtgtgatgtttttgaccggaatganaaagttcaaacagcaccaaaacatgatttttggacatattggagtgtattgggtgcgttcatggtaaaaactcacttcgtgattcgcgcggcgaacttttgtcaattaatgccattattggcacacgtgggtgcgatgtttttgaccggaatgaaaaagttcaaaaagcaccaaaaacaagatttttggacatattggagtgtattgggtgcgttcgttctaaaaactcacttcgtgattcgcgcggcgaacttttgtcaattaatgccattattggcacacgtgggtgcaatgtttttgaccggaatgaaaaagttcaaaaagcaccaaaaacatgatttttggacatattggagtgtattgggtgcgttcgtggaaaaaactcacttcgtgattcgcgcggcgaacttttgtcaattaatgccaatattggcatatattggcacacgtgggtgcgatgtttttgaccggaatgaaaaagttcaaaaagcacgaaaacatgatttttggacatattggagtgtattgggtgcgttcgtggaaaaaactcacttcgagattcgcgcggcgaacttttgtcaattaatgccattattggcacacgtgggtgcgatgtttttgaccggaatgaaaaagttcaaaaagcaccaaaacatgatttttggacatattggagtgtattgggtgcgttcgtggcaaaaactcacttcgtgattcgcgcggcgaacttttgtcagttaatgccaatattggcatatattggcacacgtgggtgcgatgtttttgaccggaatgaaaaagttcaaaaagcacgaaaacatgatttttggacatattggagtgtattgggtgcgttcgtggaaaaaactcacttcgagattctcgcggcgaacttttgtcaattaatgccattattggcacacgtgggtgcgatgtttttgaccggaatgaaaaagttcaaaaagcaccaaaacatgatttttggacatattggagtgtattgggtgcgttcgtggtaaaaactcacttcgtgattcgcgcggcgaacttttgtcagttaatgccaatattggcacacgtgggtgcgatgtttttgaccggaatgaaaaaatttaaaaagcaccaaaacatgatttttg

SEQ ID NO: 108333 - DNA, 509 bp, Oryza sativa
tccgatctaccctcaggtagatcagggccatccgtcgccgcccacgtggccgccagtgtggcctccacctcggcgccacgtcagcgccacatggctcttcccctttcggtcccgtggactcggtccaccatggaccggtgcgccttgagtcaatgacatgcggagccagcttgtcggcgccgccccctgctgacgtcacccggggttaattaattgtgcaataaattaattaagggtttttcagttatagtaaaaacatagtgaatcttctaaaattcatagaaaattcatctgtgctctgtttaagcccattcaagtctcagtaaatcaagaaaaatgcgaagaatccattaaaaatggttttgttatctatttcagtagtcttatagcctgtttgcattgtttgctttatatgttccgtagattccgactgtcccgacgttccggtgtactttgagatagtcgccgaagtccctctagccgcagagcaaggcaaatcatgcttgtca

SEQ ID NO: 108334 - DNA, 675 bp, Oryza sativa
tcagagaaggccagaccgagataagggagacgatcgatgccgggcatgacgcatattcaggaagtcgtatgagagccttggcacatgggatggataagctgaaggaagaggctgttgatattcagagggagatcaaaactgttggtgattccatgtccaccaagatgcaggatttgcagagcactgcaaatgatattgggagtgtggctggcaaatcattggagaatcagatgcaacttttggatggacagagcaaggccatggacggtctgaataatctgtacagctttcaggcacaagctcttgaggaaagcaggtattttaacttctcgcttccattattctttttttatttcattgtaaaatatactgattttgactggaattttcagggagactgtgcaaaaacttgcacagtttggccagcgtcagcaggaagagttattgtccaggcaggaagaaatccggcaagctcatgaacacctgattcataattcacactcaatactggaagctcaggttattgtctcctcctgcatatcagaatacgagcaatagttttccttttgtttgactgattaaccatgatcaatcagtaggcataggattgacttctttttcaactgatcttttctccttgtgtcctgcaggaagagttcagagcaaagcaggcca

SEQ ID NO: 108335 - DNA, 1867 bp, Oryza sativa
tgccacttgtgatatcgaggccacgtcggctgtcgccactccgacgtggacccgaccgtgagggagataaagattttgggatgggaataatggtttttgtctcatcttctctcaaggacgaaaattcgagggagagtatacgtgtagatgcacgtgtagtgttcgtaaaggatgcgtactatggttaggtcagtgtaggagcttgacttggcatgggacattgacaaatggcctatgtatggtacagttgtttgtttctttttttttctacgtagtcagcaattcagcattgcatttcaaacagttgttttggttttttttttcgaaaaataaatatgaaggtaaaattaaccgcagagtttgtacttttctagatgacacagatttgccatgaagaagtttatgaatacatgcaatttatttacccgttgatcgtggtacgcaccaaccatacaagttctagaagattcagcagagaacaatattccactaaccatatgttatttagggataaggtgggacggattgaactcatcctattttttggataggatggtccaatatattgtttggcatgagagatattcctattttttctacatgttagcaaaagaaaaaagtgaattggattggtccaccattttttaaaagaacaagccaacccggatcttagaagaatattcactgtcagccccatcctatcccacatgtctctaaaacaacatcctaaaaaaatgggtataacccaaccctacctatcaaaacccttgaaccaaacacatactaagtacacccaatgttgctacaatgttttatactatgctgactacatcttcgccaccttaggggtcaatagtccacggtgatttttaccatactaaatcatcctatgaaaaaaaaggcaatttctacaacccatgatcatctctgtgactttaaacaggaccattctcattccatctcctcccaccacgtacagaacgtttgccgtaaccaccggattcaatatcttatctttaaagagtctaagagcaatttccttattatgggggcatagcccattacaagataccaatagattcctagtactccctccatccaaaagtattatgacatattttttttgtcatcaagactatgaaaaggtagagtcgtagcaaagaacatagccacagcatgccgaataagggcaatagcagtgcaaggcacgcttgccgtgcctccggcccattccagcaaggcgcagtctcgtgaccccacgccttcctccttatcctcacgcgtcacgcccacgcgccgcttttctcctcatccccacgcgccgcttctcgtcatccccgcaccgtcgacgagctaggccccctcctctctccgccgtcgccggcctcccctcctccctccgccatcactggcctcccctcctcccttcgccatcactggcctcccctcctccctccgccatcactggcctcccctcctcccttcgccggtgagaggacagagacgacgacgacgcctggttgaggaggccgaggcggcaacgtggatctggaccggcgatggattggtctctcttctcttcccttgccagctcccctctcacctcacctctccggacgagcggcggcgaaggtagagaaagaggaggcgaaggtggagaaaaaggaggcaaaggtagagaaaaaggtcacgtcgaatcgaagcaacgacttctacagtgcgagtttccttcgccacacgcccttgttgcggtgagaacacgtgtctcccagttagggggcaagcagccgagcaaaggtgcgggtcttggcgccacgtacgcgtgaatccgagctggcgctgtaggagaactgtgaagggcctaaag

SEQ ID NO: 108336 - DNA, 662 bp, Oryza sativa
  unsure (1)..(662): unsure at all n locations
aaactgttggggattccatgtccaccaagatgcaggatttgcagagcactgccaatgatattgcgagtgtggctggcaaatcattggagaatcagatgcaactttcggatggacagagcacggccatggacggcctgaataatctgtacagctttcaggcacaagctcttgaggaaagcaggtattttaacttctcgcttgcattattctttttttatttcattgtaaaatatactgattttgactggaattttcagggagactgtgcaaaaacttgcacagtttggnnnnnnnnnnnnnnnnnnnnnnnngtccaggcaggaagaaatccggcaagctcatgaacacctgattcataattcacactcaatactggaagctcaggttattgtctcctcctgcatatcagaatacgagaatagttttccttttgtttgactgcttaaccatgatcaatcagtaggcataggattgacttcttttcaactgatcttttttccttttgtcctgcaggaagagttcagagcaaagcaggccaacatttttgctgctctggacaaactttacatcctccacaacgccatcttagccgagtcacgtttcatcaaggcgttcttcttctactgctgcatcgtgtttctcatctacttgctcacaagcgc

SEQ ID NO: 108337 - DNA, 1920 bp, Oryza sativa
ttgttacttaatatgagtatatgcaaagtgaaattccgattccaaattaatcactagtactactggagtagtacactatatttccccttgtttattgaatcatatagaaattaaaggaggaaaaaaaagaggagcactattaaaaaaagttggctaggcctacctccttgattccttgtagaaccttgtcaatcataacttgtgaacgcacactttaatttaattttgatatttttgagtccccacacatcacattttttccccactttcctgacacttttatgtgattcacaaagaagttctcctgtatcaagcaaagaacactgatgattattctgagccggatgcattgatatatgatggattaaaaaaaaatgcattgatgcatttatgagtcagaagagactattttgatgggaatagtaccatgataacgactcaaaaatatataatgtctattgaaaaatagacataccaagacgactaactacaattatcataatagacctacatatacttcatgtatatagaacggtttcatgacctggcaaatgtgtggtaatacactatatatgactttaattgcttaatttgatcatgatatttctttatatggttatatatttaccttatgttaatttccttttatatatactactatgtcattaattagtattatgccccgttctaattaatttcatttttttttatttttatggtcccttctgtgtttgattcatcttgaacatgatttctccacgagtgggcaatggtgctccacattattgtgctacacgtgtgacaactaattagttatgccactgctctctctgatctgcttgccgaccatatgtatacagcagctgagagagatggagagatagaaccccctccatgtattacactatgtcactaacaataaaaatatggaaaaaaatatttgtatgaaatctgatcttgtctaaagccgcagtaaagcaattaattgatcgagtatagtattgaggaaattaaaattattttcgacagtacgtgtgtgtatatataatatgtgcttccatactagcaaattacactacgcacaactatatgtatgcaatattttgttgattatataaacagctagctagcattgcatgactctttctagatgaaaaccgctcatatacacacgtacttcatccgtttcacaatgtaaaactttctagcattgtccatattcatttagatattaatgaatctagacatatgtatgtctttatattcattaacatctatatgtatgtggataatgttaaaaagtcttacattctgaaacggatggagtacatacttattcctatgaacatatatacacgtacattttatccctataaacactttcgaaaactaaaataaatatttactaattgcgcacaagaccactgaacacatcgttattaatcacgctgctaaataatattaatattgtcttctaaaatagttattactccatctgtcccaaaatgacttaatttactgcgttcaatatttgttaaaaaaagaattaatttttatcccctacccttgtccatataaatcgtggagttttatccattcaacatatatcctttagctacccatttggcaatactactttcctacaaataatacttcctccgtttcacaatgtaagactttctagcattatccatattcatttagatgttaatgaatctagacatatgtatgtgtttaaattcattaacatctatatgtatatagaactttctagcattgtccatattcatttagatattaatgaatctagacatatgtatgtctttatattcattaacatctatatgtatgtggataatgttaaaaagtcttacattctgaaacggatggagtacatacttattcctatgaacatatata

SEQ ID NO: 108338 - DNA, 1139 bp, Oryza sativa
gcatgtatatacattactatacatcgtaaaaaagagagcctattaaacatcaaccgttgattcattaaagggtagtttagagattggaaataacataacaggtagtttagttatccatgatcaactggaacttctctcttggccggctgtttgctgcctgcccttgattctttcctgttttcatagtcatcggtgttcgtcgtcgctgagttaaaaaaaaacaaaaactgtaatgcaatatcaagggggcacatgtacacaaagcatgacagaacgtataagctgaagataattactaagaactcattgcatgtgcgtctttgtgtagtttgtcaaaatatttctcacttactatggatgttatcttagaaacccctggggttgaagatgtatcgtcattatgaaacatgactctttgaagcggctatgattatcattgaacacggaaccgagaagaacaagcaactgttccagctaagttattggaggcgaaagagaggaatttgaaacatattggaacacaataacacgaatgagaaaataaacaccctgtgtcatcgatacagagtcaatatatgcagtaagttagagcatcacaacagtcctcctatatttttttctcaaaattgattttgaggaattttatgtgaaaaatgggatccaacagattccttataatcctacatacattttggatttccttccctgtatttctcgctcagttgatttgagggagagaagcgctcccctccgactcccagtccaatcgtgtctctcccgcgctagtgagcagagctatctattcccgcaaggtatttcacgcgcaaggagaaaacaggaaaaccaattctgttgttagttcaacagaagggcacacttttattttttttataaaatttagactttctcttggagatatctaggtagggattatatataatctctcagtgatgctaggaacagttatgaaatataaattggacctctaatctaaatgcatctacttcgtataaccctcgcatctggaattctggattgcgcatatcgggcccgtgcattgtttcgggcccagtgctaagctctattcatgttttcctttctttccttttggcgcttcccacgcttgaagcccatcagga

SEQ ID NO: 108339 - DNA, 867 bp, Oryza sativa
gagggaggcggccggcccagcggaggggagaggaggaaggagaatgggccggcggcccactcgaaaagaaaaggaggaaaaagaaaaagaaaaaaaagggaagaaaaggattttccctggaattaaaatattgcttgctcaatttcaattggttaaaattatttctagggctctgaaaattccactaaaaatcttgttagcgtatttcgacatgtagaactcaagaaaaattccacatgccaattctgattattatttgcattaatttattaaggttttctcttgatttgcagcggcattttcttagggtgatttataaattcaattttaggcttaggaggagaactacagggtgtgacagaggacgaccggccgcagacatagaagcgtcaagcgcggcggcgacgcaatgatagccggcggaggcgaggtgaacagtcccgcgatggcacatggcgaggatgcacgttccggcagcgagcctggctccagcgctgacgggggcggggtggctggcatcggggtcatctcttggggaagcagcgccccggggagcagcgccggcagaatcttgtcggccgcagcgtcgctggccagatcttccaagcggcgaggcggggacgctgcgagaggtgccggtgacatgggctgtggtaggagagtgtcatcgcctggggtgcgagctgcagcgacagccagctcaaggcgcatcagcgcctcctcaatttgctggcaggttgtcagtgtgtcgaccgctggcgtggccggcaaggcctccctgatgcggccaaagacgcgcgcaacaggcaccggcttccatgccgtgctgccgaaccaggcttcagtcccagtaaaagaccggatggc

SEQ ID NO: 108340 - DNA, 1682 bp, Oryza sativa
gcgggagtatgtattacgcggcgcccctggttggcggtgggcgcgtacgtacggtggctcggcaggatatatgcatgcatgggatgggaggaggatcttttgttgggatttttatttgaatcaaagaaggccttattacacccaccatgaacagtcacacgctttctttttctttttttaacgaatcggcgagccgctaatttcattaaatatagtagaaaaaaactgtacagtgtaaaggaaaagaaaaaaactcaggacctttggccctagtcaactaaggaacaagccaatttttcaaatgatgcgcgcctgctaaggcccatgtcttggtctcttccttgatttttgtcacaagaccattcggtgggagctccttatgctggaatgttctgcgaattctttcgttccaacagtcacacgtttttcatcatgcacatgtttttgatcaacagtcacacgtttttcatcctgcgcatgtttttgatcaagattagaggctagtgtgtcggggagattgagaccgagagaaagatcatcaatttactctagggctgagctcccctttttttttttatctttgcgttgaagggaattgtgggcagctccaaaagaaacgaatttgggcaccaccaatcacgacgtgtagttaagtgcgtaaaattttaacgcaaattaaatcgcaatgatcgtgcgtagataatgggtggaaacggtccttcgcgtggtctttcctcactgagagatcaaatttccaagacccggaacttctctaaggcctagcccagctaaattaacacatctcggtagcaatttcatctacttgaaacaaagtcattggagtactgttgcaaattatcatttgattacaatgataaattaaatattttgagaaataaaccgaacaagtggtttaaccaatgcaacgcaaagcaaacaatccaatgaagtaactataaaatgggttacatgtatgatgtagagagtactagtgtactaccacacatctaaatttgaatcccaaatgagattgagcccggccgctagctgcatgcctgcaagcagcactaggagtaggaaaacaaaatctcgtttgttttgcccaattggcagccgtatcaaactttggtactgtttaggggagcttgtcccagctacagcttttatcaaaaactgcttctgcaagaagctgccctaaacagtccacagcttctttacagattctgaaaaataaactaaaaagtcagaagctggagaagctaggtttcagagctttttcagattcttagaagctgactaccaaacagctgcttctcagaatttaaagctccccaaacataccctatatccatgcaaccaattccaaagtaaaaaaagaaaaagaaaaaatgcacccatggtcacgggggtcatgcagcgaagtgtggttaaaaagccaagccatatactaggtgcatgcatgcagcagcgaggagagaaagagagcgagattgagagagagacagtaggtgacccacacccaagcgccttggtccaccacaggggaatacaggggaatccggctcccggccaagcgctgccggacaaaccctcccgtccgtctcacaaagaaagccatctccttcgcaaagcagcaaaaaacccagccacactgtacacagagatgttgtcagatgtgttgc

SEQ ID NO: 108341 - DNA, 3294 bp, Oryza sativa
atatgcattttccgtgcccactggtgatcaccacacaagctagcacaaatatatatttttttagaacacaatacaaacacagttggtcgataggggcgtggggcactcatttctataaatgcacacacgtgcatctacttcctactcccatgagtatctaaaactgggctagcatatcttgagattgacgaagtcaccaagcgcgtctcgctatcgacggatgcgtcgtctacaacttgaaataatgtgtcaaatttagggcgtgtttagatccaaagtttggatccaaacttcagtacttttccatcacatcaacctgtcatacacacataacttttcagtcacatcatctctaattttaaccaaaatccaaatttttgatccaactaaatacagccttagaacttaaatttaggtggattggttctgccacaagaaatctaaccattttaattgcgctcacttcgctatcccaaagatatttgacaagagagagaaggagaatgagaagggtctctccctctcttggcctcacctcctgacacagtgccagctatagggctcacactgtgtagggttttcacctcatgcttgggggcgtcgtcgccgctttattccaatccttgtagccatgcggcttgtgcatgtatatatggatggatcgggaagccgagcttctgtgtggcgctagcttgatgaacgatgagctgctactactactacttgtggcagcagcagttgctgcatgctagtagcttggaggagcgtgcaatgtgcgcgcatgtgtgcctgtgtgagattggatgggacgggaagggggaatagggcactttgaggcagagctctctctatgctttgctttgcttgcagctgcagctgcagctatttataggggcgagcaacaagaagcttgtcttcctccccatcctgcacatctccaaagctctcttctcaccaaacagacatgtagtacgaacgccattgttcatcttgtactactttctgtgtgtgtgtgtagttgtgtactgtctcttcttcttcttcttcttcttcttgtttctccagctgccatctccatcacaatgtcatgccagctgagctcttggctttggtggagtagtagtagttgtgttgatgtacatatataggagttgttgttgtcttctcttctcttctccaagtgttctgggctttgagtctagcattggggtgtgtgtgtgagatgagcactgcagtgttgaaagaagggaatacatggcatattggcaaggatgcagaaggtttggaagctgaaaagcaaaagagaggtgaaaaaaaggggatatgcctggctccctgtatgccactcgcgtagctgccaaactcagttgaaacaactgccttctcccggcgagattcaggcattgtgttcgtacgtttggctctactgcggatggcgtgcgaggagccaagcatgaccgtctctctctgtctctatctctctctcattgactcattgtgtgtgctcacttaagattacacgcttaattaaacctgataaacatggatcatacggtagtttatactgcagttttagtagtcttattagttcttattacaattagtctcttttaattagttatgcgcttggttatggtttcttattagtttgatgagtagttatgcttaatacatattgcatgcattttatttttcgcttgtgtgtgacgctgtcatgatttgcagtaagtgagcaaacctgtgtatatagtgtgtactaatagttctctggttgattacacatctgcatgcagtcacttggtgagcaacttctctgaaaaaaattattgacagcctagctagtttgtttcatgtactgtttgccacctttttctgatgcatggtagtgctgactgctgacataaatgcatgcatatacaattgttgtcatggttttctatcttgatctgattaggagaggttagattatggtagatgcatgagctgacctgtgtgtacgattgatatcatggtcttatatcttgatttcaagtgactgatcatgcatgccaattgattacgcaattatgcatgtgtatatgtatgtattagtttcagatccttggcgtttgatggagtgctctcttaattcttaattttgtcttgcccatcttagagagttcgagatgagatggtagattgttcagccctatataatataggactgtatatcttatctgtagggtttatttgtagttgttggtcatttggcatatatatatatatatgagtgtatgaaggtggtcagttggtgtcatataattatgtatataggttttataaatttagaaataattcatcaattaatttaccttatatttcatacttataacatatttaatgtaataagttgcaacgataacgaacgaatatgatgctagtccaagaaaatatatataatacctgcatttcagaaaatcttgagcctttcttcttttttccttttgggctgcgcttggactcgtttgctctttgggcctagtcaattgggctgggaattttcaggccctggaggggcccgtttaatttctccaacacctgcagtacataatgcgtactctgtcaattatgtacaaaattatctaaaattaactacaaaattatgtactaataaacttagcttcggtcataagcttaaaaggcaaattaatgatggaaaactaaacttatatttttaaataaaaatcctgcgcttcccacaacttgcagtcacggtcaacacgaaacgaatatccccaaaacacaaacaagttacaagtccttaaactggagtaatactcaaggaaaaggagatgtcagtcacggtcacagcctcacaggaaaacgatcccaactccgactcacgctcacggctcatgttgttgcggtgttctcaacgacgaaattcccttatcaactcggattctttcttctgaaactgaaacggacatctgcacacagcgccgatcgagttcgaatcctacacccgtatccaccccctatatacgcagcgctcctcgccgccttgaacctcacagcgaaacctgatcaccaccccaccaaccagagttcaccacgatcgcttcaatacttcgatctacgcacgagcgccgcagccgagaactcatgctcacgcacgcagcagccgccgctgaggaggaggagagcgcagcgccggccatggaggactgggtcgttctcagcgacagcgacggcgacagcgtggagctccacgacggcagcgacgtctgcggctccgacagcgagagcggcttc

SEQ ID NO: 108342 - DNA, 2422 bp, Oryza sativa
atgatgaggaagaaatcgactgtgaggaggacctggatgatgatgatgatgattgtgagagcctcgacgacgataacattgaatgctttgatgcagaagacataatctgtttggaaacccggacgatgaaatctagtaccaatatagccatgtaacatcgatcccatgtgcagcctcatctaatcatcgaattattctgcattttacccctactttgggtcgctaccttttatgttttgcccccatataattttgattgcgtgtcaacacaatgttgatcgtggttgtgcatatactatcagttattcaacttcacatctagcacctgcctagttgtctttggaccctatgtatatatactgtggccttgtttagttggggaaaatttttgagtttggttgatgatgagagccttgacgacgatgacattgaatgcttcgatgcagaggacataatttgagaggagaacccggacgatgaaatcatgtcccacttgttaacctagctagtaccaatatagccacgtacatcccatgtgcagctcctgcaaaaagagacaaaaatagtgatgttatatctccaatcaagtagtttacaggcatacccagttagtgaaattctttttcaaaaaagaaaaggaacccagttagtaaattatcacgaagaaattagatgatagactatatataggtgcttctcatcgtctgagaaagctagaatatttgatgacagtagttttatgtgtggtttggtggcacccgagttctcagtagagaacgattgatcaagcacctttcttagaaattatctggatgccttccactcctagtaggagggcaatgcaattctcaaacatttctcacccagctacactcaagcacatcacagcttgttgttctatcagtgtacaacacgacagcgtcttcttctctcacttctcagttatcaggcattagacaaggtatttgatgaatcagattcagaggataaggtgagaagcagccatgaatgaggccatgtatatatagagaagatggctggcctgttggctgcatgttagttgtcattagttgtcagagatcgaagaagagtttaagcagagttggtataggatcgaattgatgaaaaaagtttcagaaaagagctagcattgttgaaattacagtaaccgttgctccttttattttgtgctcgttttccttttgggcatggctaattgggcattttcatgctattttaatttctcaaacacccgaatagctgcatatgaatactctgccaaaagaactgcaaatattttctttttctaagaactgtacatccttctcttcgtatttgagacgaactctagtactaaaaacattcgttaatgctagctttatctgtgcaatcaaccacaaatgtttactcatctcgctacaagtttttgcaacgacgagatcatcctgctcaaccgtagtttcttccaataatcccaaaatggccgagtctaatccagcaaatccccaatcctgatcaactcgtctagttatgaaaaaacaagctaaaacgtctgttccagagtctagcttggattcaagaactgaacctgatcggtagtatggactgtatcatgcgattgactcccagcatcaatcaagctataatgctatatcctcctgctagggccacaaggcattttgtacctcagatagacgtttggttccgcgttcctgcatagcatgacctaggaaactgaaaacatctagtactgacatgaacggtcggtaaccaaattcctaaactccatcaaccatcctacccttgtgtaagggatttagttggtcctgcataaaagaaaaatgatgtaattacatcgtcaatcgaacagttcataggcaaaaaagtttagtaaaattatcagacatgaacataagacaaactagaatcttggtgcttcgatcgctccggtttttttgacgtgctacttactattaccattcatggaacataattttttttctttttgcatgctgttgcttgaaaattacgaatgcccttgaagatgatggtgtacaccaatacaccatacaaaaaccaaattacttcatccccaaaaggtgccaaatcgaagtctccaatgagttttttgcaccatgtatgaaagttcaaaattttcaacatgatgaaatgcacttccaaatgctgtttggcgacaaggacacccaatatttagtagagacaaattgatcaagtacctttctcacagattctccagatgccttgcattcctaaggaggccagttgaaaacaaagccatttctcacaccagctgcagtcgagcattacactgcattgttgctctatcagtgtacaaagtgacagtgtcttcttctctggtattgatggatcaaattcagtgacctctagaaccagccgtgta

SEQ ID NO: 108343 - DNA, 537 bp, Oryza sativa
attgccattgcataaaactgatcactacattaccaaaatgaggatgacacttttcaccaaaactgaagttgaaccttttatgcctttcacatatactacatggccagagacgaaggccagtgtatcagctgattgaacaataccctaaggaggcatttgcacatgacactgtgtaaaacaagagatcagatttcaccatggttgactcgacgaacaactaactgaatgtcattcctgatgagcaatttaaataccttctccaccatgaaagaaggctctccgctctccggaggacgacagccaatgacagaggacattgagtcctcgtcaattatataaggcccccactcagcgaaagcatagacaatatatatgtacgtaaacaccgattcagcagttcacccactatctcccattgtctccaacatttacaatggtgaaagaaatagacgatactagggtgccttactcgactctgcttacctatgtccatgcttgcactgcctcacttgcactgatcgaggacctggctgatcc

SEQ ID NO: 108344 - DNA, 583 bp, Oryza sativa
tcctgcagcccgtgtgtactataggagtaggtgttctaaatagtatattgctggatgcggatctacttgatgaacacacagatgacaagttcgatctaatccattccattaaaccatggggacaatcgacgcatttgtctgagacaacattctatttattatcttgccgatggtccttagcatgtatgtagattcttctttatgatactgaataggcatgatgaggaaaccttacgtacatctgatctatcatatgataaaaacctcctactcgttctggatgccaaatcctgaacattaggaggtatcttttcatatgtacattagacagtccgttagtgttctgcttgctccatcatgaacatgattcaatcaatggctctctgctgaatgactaccacaaaataaatcgtattatggaacatgatgaacaaccgttggaccgtgtttatgatcatatggagaggaaactacagtgatccacttatgcttgtgattccaagactcttatcctcatgaaatagattacttctatccccactagatagattgcctgcgtgtgaatgaattcaactactacact

SEQ ID NO: 108345 - DNA, 596 bp, Oryza sativa
gggcatggcggggtgatgccgactacctgttcacagtgatgcatcctcagagagctttcattgtttttttttcccaaattttcccttttttttttcgcaattgggggccaaaggggggggaacggaaagggaaattgcttcgatggccctctataacacaacactctgatcactgatcagtacagaatggactaacattccacaaaactgataaaaaaaatcattctgattcaccatcactgccagtgccaaatcccagtatagaagcagaatcatagtcttttttctttttgtgagaactaagcagaataatagtcacgatctgctttcttggatagagtaacttgtttgctgccttgctgagtgctcacaggcataagcataactgacacatggatcagttgttagtgaccagcaaacactgtgcaaaatcttgcaacaggaacatagagatagaactgctgcgcagcacatcacctgcaattagaagaaactgggtctgagattaaccatgcctacacgttatgaactcatgatgtacacctaacaataaaattcattggtttccctgatccttgtgggaacaaaggggtaca

SEQ ID NO: 108346 - DNA, 603 bp, Oryza sativa
  unsure (1)..(603): unsure at all n locations
ccttatatggggctgtacaatctaccatctcatctcgaactgtctaagatgggcaagacaaaattaagaattaagagagcactccatcaaacgccaaggatctgaaactaatacatacatatacacatgcataattgcgtaatcaattggcatgcatgatcagtcacttgaaatcaagatataagaccatgatatcaatcgtacacacaggtcagctcatgcatctaccataatctaacctctcctaatcagatcaagatagaaaaccatgacaacaattgtatatgcatgcatttatgtcagcagtcagcactaccatgcatcagaaaaaggtggcaaacagtacatgaaacaaactagctaggctgtcaataatttttttcagagaagttgctcaccaagtgactgcatgcagatgtgtaatcaaccagagaactattagtacacactatatacacaggttttgctcactttaactggccaanaanaatttntcaatttggggnaaaacccacaaaggnccgggttttccccaaaaccccccacaagcgaaaaataaaatgcatgcaatatgtattaagcataactactcatcaaactaat

SEQ ID NO: 108347 - DNA, 513 bp, Oryza sativa
tattgtctgatcgttatccggccaaatttgaagcttcgttgttagatgtgattttactctgacctctgtagactatcttcgatcatatcacttggttcataactgggaatagctcccacgaacaagcaactcagattcactttctttatgttcagtttactttccgctattctcttcatgttgtcatcatttagcattcaacgtattcctgtgcaccttcagccttgatgtgttctttcccattggatcatctcccaagacatggcgtcgcctggtaaccggggcttgcacttttcactccgtgtagcgtctgataccgagttgaagatttcactccttgccttcatagaaacacttttacctaggtcatcttgcttacttaatgacaaggtgactgttgtggggcaattacaattaggggtctttcttgagcgatgcagagcatgttttttgttatcaatcacctttcgggctacttctttgatgctagagaacatctttgccaatctcttt

SEQ ID NO: 108348 - DNA, 807 bp, Oryza sativa
acgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcgggtgtcgcgtcccaaaacgactctaaaatacatcctcgaaattatgcctagaataattaaaatccatgtgaaagcctccaacaattaaaatgtgcaaagttaaaagtcaaataaggcttggaggatttttgtatatttcctaaaagcctaaaatgtgtaaataaattttagtggaattttcagagcacaaataataattaagaagaaataaacaaagttaaaatggttttataaaaagaaaagccctaaaaagtctttttccccccccccctccccctcttgggccggctcggcccagccccctccctctctctcctctcccccgcgggcccatccggccttcccccgcgcgcgcgccgctgacgggcgggcccgcccgccaccctcgctgacgggtggggcccacccgtcatcccctacctcgcgccgctcccgccgcctcgcccgtgccctagcgccgccgccgccgcgaatcccgccgcctcccgccgtccccgcgcgcaataaagagggggaaatcactccccgtgattccctctccctttccccccatttttccctctctctctctctcgttcaacgggcggatttgctcccgcaaatct

SEQ ID NO: 108349 - DNA, 1518 bp, Oryza sativa
ggtggcacggttaggccgagatagcgatcaagatgataagggttagacatggctaggggaggggttctagagcatctacgaggtatttagagggattccgacagcttgccgacctttggcaaggtgcggagaatagttgccgacgagcgcctccataggcgacggccgtgttcacgtcggcagctcagagggtgatgtgttagtgcaaagggattgctaaaatagaatttaggtagtatgtagatggttgaaacggaagaactcactgaaatcggttgaaacgacggattgcggccggaaaaacttcgcggcggtgaagaacagagcagcgcgggggcggcgatgctcggcttgatgcggcgaggtaaaactcgacgcagagctttggttagggcttagtatgctagaacatggctgatataaggtgttctatgaggtatttagggcggaggatgtattgtttatggtgaagtcgatcgcgcacaaggtgttcgaccgacgggcgagggtggttggtgagatgggttgatgaaacacagcttcgggttgtggggctatggtcgtggatgatcgatgatggacagggaagggattggggtcctatttatagggctaggagaagcggatgagctcgggcaccgtcatcgtcatggatgagcttgagctttggatatggttagggcggcagaggctgaaagagggcgggcaagatcgatttgagtggcgggaggccacgttcgaatacttaccggcgaaggattgacttgaccgcgggtggaaatcgctggcgacgtgttggcgccaatccgagcatgacgcgcggcggcggcgagggtgaaaacagccggcatgggggtgaatggtttgaattgagggaggggataccaccgtctatcttcaatctaaccgtgcggcaagaattggcgcgatttatcccgggtagaaacgaaatcgcacccgacggcggcttggacgggagtgtacggcgtcgagcagtgatttcatgcggcggtcgtcgtcccggctttgtcgtcgtcgagattggtgcggcgacggtgggttgaaggcgttggacgggcggcagcgcgccaaggcggttgggcacgcgcgatcgatcccgagaccgacgcgcggcggctcggcgcgcggcaaagtcggctgccagtcggcgcgcgtgaaagggaggaagaggtaaaaagaaccacggttttgagtgggatgtggtcccctaggaccaattctaaactttgcataagattgggttggagttgggctgctctagctgggctgggcattctgtcgagcaccttgagtgcaatgaacagtagatttcaagaattttgaatatttccctagaaaagatttgaattcaaactaggagtttggaagggtttcactagggtttaaagtatggcaaatccttactaacattagggtgaactaagaaaataatctatggtttgaatttgagagaatttgctcaaattcactagggtttagaataaagggaataaattg

SEQ ID NO: 108350 - DNA, 1390 bp, Oryza sativa
gtttgtgtcatgctaggtaagacaagctagttctctttgttgaaatgatgaatagttgctctattctatatctcttatatatgggctcatatgtaagtgctctctcaaaaattaaatatgagtagccaacaattatctgggaacctgaggtaaatgagctgcatttgctaatctgagtctaagtgtttccaagatatgagatggtaaataagaggtgctatgattctagtcctcgtttgacttgaatcccggatattctgtttttaaaattttaaatttgaaagtatctcatgtgatataaattcccacaaaaaccaaaaatgtgacatcattgatgtaaccatatacattttggttacttgctattccattgaactttgtcaaatttttgtgacttgtgtcatacttctcatgctctatgatcaagatcatacacccaggtatatgcacatgctaaactcctacactgggagctagcaattatccattccatttccatactaccaccaaaataaattctccatgcttttatgcgctttcttctcctaaaaagaaaatcctttttgaaaaaccaagaagagaaagaagaagggagggaaaggcatggttatgaaaaaaaatatataaagttatgctctctcaagcataagcatgataaagaaaaaaagaaggaaaaagccatgccctctccttattaataaaagaaggatttttgggagaaggaagtaagcacaaaggagaagcattttctttactttttcttcatattcgactttcaccatatatcacacactttgcacgatcttgatcttgagtatgtttagtcatctattttactctaagtttttgacttagtaataaatgtaaatgcaagtatgctatgtttgatctcttccgagctccatatatcaaaccttagagtaggaatcaaaccggcaaaaaaaaatggtgaggaattcatattgatacacttagagagactgagtgaatcatttgagaaacttggcttttcttttataaaatcatttgaaaacttccggaataaaagttgaataaagattggatgattggtgctctaattgctgttctgtctttcaaccacccaaggcaaggagaagcagtgtctcgtgggaatcaggggtaagggtaagccaccatgccaaagattatttaatttgagagagagtacaaataccttgcacctgtacatttgagatatacagcatagtagcaactcttgatcaataaccaagtctttgtttcctttcgtcctttactcgggacgagcaaaggttcaagtttggggggttttgttgacggtcgttagcgatcaatttcgaccgtcaatattatcaaaataaaggagaactagttatgcttgcactgcata

SEQ ID NO: 108351 - DNA, 5187 bp, Oryza sativa
actctatactctacttctaatattccttatttttaatttcgaatttcagttattttctaattgtatttctatacggactctatgctctacttctaatattccttatttttaacttcgaatttcagttatttcctaattgtatttctatacggactctatgctctacttctaatattccttatttttaacttcgaatttcagttatttcctaattgtatttctatacggactctatgctctacttctaatattccttatttttaattccgaatttcagttatttcctaattgtatttctatatggactctatactctacttctaatattccttatttttaattacgaatttaagttatttcctaattttttttctatatggattctatactctacttctaatattacttatttttaattctgaatttcagttatttcctaattgtatttctatatggattctatactctacttctaatattccttatttttttaattccgaatttcagttatttcctaattgtatttctatatggactctagtctcatcttctaatattccttattttttaattccgaatttcaactatttctaaattgtatttctatatggactctagtctcctcttctaatatttcttattttttttaattccaaatttcaactattttctaaattgtatttctacatggactctgatttttctttttctccgattaatgtgagaatttctaggccatgagagcgaacgtggaggcttatttttctattcctttaataatataatagatagataacctttttcttctttttcgtaccactgattcggtgtgaaaagttggccgacttattttatgtagataatagagtgattttgcagtatcattcgcatatgtaagtgaatattcaattggttaaatcaaaatactcttattatttgttatatatattggagaggtaacctcacccaactaaatgaagaggtaaacaacactcacatccatgcaaccaaacaaacaaaatccctttcaaaccgtatctctcatacagtaaccaaacaaaatctcatgctagcctggctagaccaatgcaaccaaccaaacaactgcatatgtatactcttagcaaggtcaaactcagcctggatgcgagaaatgagccaggctaggggaatatgggcaaccaaacacaccctaaagagatgcacttcacttcagaaaggatatatgattggttgcaagctgaccagttcaggcaacaacgacaacaaattgaacataagaaaaaaacgacaagaaatcgatctttggaattaaaattcttctagcttcagaaattggaacttcaaatttacaaaaaaaaaagaagaaattctactactattacgtgactctccatttccaacctaaaagtctcagaaaccctccacctatgggtcacacttacttttaattcgaatcagacattctgttaataacatcaagcttttaaaataaaatctcaaatatttaaataaaattggttgcagccaaacgatgctttttttcagcacaactatatacatattttggaggggctcataaaaagtaggatgtgctcccttcaaaaaaaaaaaagtaggttgtttggacacatgcatggagcattaaatgtggatgaaaaaaaccagttgcacagtttgcatataattgcaagacgaatcttttaagcctaattacgccatgatttaacaatgtagtgctacaataaacatttgctaatgatggattaattaggcttaaatagattcgtctcgcggtttacacacggaatctgtaatttgttttgttattagtctacgtttaatacttcaaatgtcagtggtggacgcaagattttgaagatgggggtacaaagttatcaaatcgttgttccataaagaaactgcttagtagtaggaaaagtaatgagcaagtttttcttgctacaacaaataaaaatagaaacattgcaaaatagctaaagatttgcgcgttcgtgaaaagaatagctaaagaaaaattaaatcttggagaagagatactatgttttcatcccaaacactccataaagatttttgcactaccatctaactctttttgactcctctaccatataaattcagatatgcacattaatcaaatttcctaaaagcaaccatcaattgaatcaaacatgaactacaggaagaatagttgggagcctaaaaaaatatatgatacgaacacattcaatccattgagccatgaggttgcttctccagtgcagcggcttgtcgatcagctgcttgttcttggcttctctccgtgaccacgagcagcgcctgcacacggctgcaattggttggttgttccaaaccataggaaggcatacgatatctcggtattctggttgtaagccccatatacaaaccagagattcaaggtcatgagacgagatcgatgagcttgaggagcttgtgttggtctgcctgagccgttttctatgagttgtattgtaattttaggctaaagaatagctgttttgccccaactaatgatatatatacaggtaatatacctattaatccaaagattatttgtcaaattttttggggtacagctgtaccctcatgtcccacactagattcgcccctgtcaaatgtgtgtccgtatacattaaaaatttttttttgccaaaacaactaaacacggccaattggttgcaagctacagctgacagtccaatcaccatgacgacacgaaatctattgattttcgaggcttcatgtcattttccttgtcggttggacacattacttggccaacctaggggataactaaatgtgataacctcttgtctctttcatatgtcgttttcatatgtcgttgttctttaatttgaaatcatcagtgaaaccgttaacttggatatttgtacatcctcgagccaaaaaagttctttttttccaaagaaaagtgtatgtagtcaacctatttggccttagttatttttaagaattttttttataaaaataatatacaaagtgtttcgttacaaatactttcatacaagttataagacttatttatatataaacggaaaagggaatttgttggtcaaaattgttttctgtttatttcgtgaaaatcctttcctgaccaacaaatggagcaatttttttgaagctcatgtgacgccgctcatctgcacgctttggttcgtttcaagctcacgtggcacgtgttgactgagtccaagtgcaaatataggctcaagaaagggcctttctgtaattgtgcttgtaatcttggactcttggtcctctttcatgacctgtttagcttttgcatattgggattgtgaaaccgacctgttgtatgatcatgatggtgacttcagttttgcaatgtcattcctggtcgaacaccctgaaagaagctgtaaaataaaaaacctgtatgtcgttgttgctgttaccacatgaaagcaaaaggaatcatcgttagttgtttactagtgtgtttcttattcaaggaatgatatggaagttggctactccgcaatttgtgcacgttaatactccaagatttcttgaaatggtaaattcctagcaaattcatttacagttttgcaattcatgttcaagttctggattgaaagctggcattggtagagagacttgagacatcacatatgttttcactcagcaattggacaaaaaaaaaaggtcaggtgaagttgcgaaaagcaccacctgcttgatggtcaaacatcaatcaccacctcaactccactctgtagacttgactgatgctaagatgataaagctaaaactgtctcaccaaattcatatggtcctcatcttgcacctacggatctccttcaccaccaatgtccatcatctgcccaaaaacgtccaaagaaaaacattcatattagtgcaaaccaagagaataaccaagtgctgtcagcatccaattaagtaatcagcagtcgtactcagtactgttctcagctaccacaaagtactgcgagagaacaaggcactctgcggttcatctctttttccaacaagaaccacaccaaaaaatacatcaaataaatgaaccagataaaatcatgttaatcttgtatcataagccaggcccaacgaaagttaggactttttggcacggctccaacctctagctcctagcttcttagcttgaccattgaagttgaagatgcattttctgaagttctttttgaggcaaagttttttttttttttttttttttttgaagtttgcaccataaagaacaggctcttaaaaaccagaacaaataagcattatatggttagccttgacttgcgaattctgccacaaggacaacaaacgattctcttgatgtattacgactccatcgcatctgaatcctcctgcaataacgcattcaaaagaaacaaatgaacaatgtgcatgaaaaaagtgccccaaaattcaaccatccttgcatgtccattggtttcaatcttaattgatgtgaaaatgaaagattctcctttgctttcaggttatccaaatctctaagcatttgcttgggcatgtgtatttggcacagcccctttggatgaacagttaaatgaattgaaagttccaaaaagggattggctttaatccctctgcatattgaaaattctaaagtagaatggtttcaccttaaatttaaataatttacccatgttttaaattatgaacctagaaccctttctctaccttatatcaggagtatcatgctaactgcatccctcaagtagaacaccaaagagtgccaaaggtcagcaaaaagggacaaatacagttgatgcgcactgctctctgtaagaggcagtaaaaaagcactggtacgtaaggcataaacgtcaatgataaactagctactcttagagataccatatactccctccgtcccaaaaaaataatcaacctataaagggatgtaacctcttataggacaatgtatctgaacataccctatgtccagatacattgtcaggttgattttttttttttgacagagggagtatgctataagttaagcaaaagatattcacttcattttgtacagtaaaattactgaaagtgcattgaggttaccagcgaggggtcataggcagttaggcacaactttgaccatctaccttcgca

SEQ ID NO: 108352 - DNA, 1035 bp, Oryza sativa
tgtcaactttgctctttttgccatgcagcttatatctgaaacaaaaacatatcagaaatgaactttagctgcaatgaagaaaatagtatcatgcacagggaaaaaattataacaatttaacggccatcaggagagattttaaatgttgtgctataatcaggtctcagtgtcagctatgaactgtgctctgtaattagatctacaatgatacaccagggaaagagctgaggaaccaaattgatgttggtatagcttcatcaaatgctatatcaaaacctgcattgtgtcaaagaagtgtttatacacatagcaaactcaggcgtggccacactaattttctcggatcacactaacagatgagatatgaagcctaaataaggccggagtacataacaattatgaagcataaataatttttcaggctctgttttagttgatgctccctcctaaatgctaaccttctacattcaagaagattgaaatggtcaaatattgtcccttccaaacgactaccaggatcacattttggagagtttgcatcaaattctttagcctactgcctgctaaactcctttttgctgggatggctgctgtcctaggagagaccatccaatggtattaagattacctagtgctaaactcctcaatttaacctagactaattctgtttgcttgggaagattttatcccaaccaggattaattaattcttccgatacagccatggatggcgctggatctggatcttgtttgctcctcaagacctcaaccctgtgttgcacataacacttgctgctggtagaacagcaagaacagaagcatatccaccttgcggaaagaaatcagaggacagaggaggagactggagaagctgacctggaacccttggcggcggcggcggcggcgcccgccatgatgccctcgccgccggcgtcctccaccgtctcgggttgggcggcgctctctcctcccacccccacgtcgccccgatctgtcacgaaccaacactatcacacctaatctctcacacacagtg

SEQ ID NO: 108353 - DNA, 5011 bp, Oryza sativa
aattccgactttcagctaatttaaatcgtattcctagttgaactctacttttcttttattttttaatttcgattttctattttttattttgaattttaattaatctcgtattgggtttttatatggactcttctttcaatattgcttaattttaatttcgaatttcagttatttttaaattgtattcctactcgaagtcctcttttttctttttctaatttcgaaatttattttatttttattctgatttttaattaatcacgtattgggttcctgtatagactcctctttcaatattgcatatttttaattccgaatttcagctattttttttattgtatttttatttagactcttcttttctttttctccgattaatgtgggaaattaatctcgtattgggttttatatgtactcttcttccaatattgcttaattgtaattccgaatttcagttatttttaaattgtattcctactcgaagtcctcttttttctttttctaatttcgaaatttattttatttttattccaaattttaattaatcacgtattgagttcctatatggactcctctttcaatattgcatatttttaattccgaatttcagctctttttttatttttattgtatttctatttgaactctttttttctttttctccgattaatgtgggaatttttaacctccacagcaaacgtgatgcctccttttcaaagctgttttaataatataatagatagatagatggcatgctttcaattttgtgtatagtaatggtatttttccaaacctgcaaatttataatggcatggatccaattaacccttttaaaagtggcaaaaataaaaagttaaatgtcacgggtacggggcatttcagtatccaaaagacagtcccgtcttgtgccctgcgatgctagagccgatcttctccaccaaatcagaatgaatctttctcgatctaccaaaattggttgagggtttttgatccactagattttctctctccatttttctcaaaattggagcgagtccacaaaatttgggataaaaatagccggggatgctagagccgatcttcaacaccaaatcagattaaatatttctcgatctaccaaaaattggttgagggtttttgatccactagattttctctctccatttttctcaaaattggagcaagtccacaaaattcaggataaaaacaaccggaggaagctcgccggcttgacatcattgaaatcaattaatctggcaactagacccgaattgagagagaaaatcatgggaaatttgataagggaggagtggggaatcgattatcacctcatcatcatcaacttgcccgtggttatccaaaatctgagtttgcttcgagtgtatcaggcaccatccctttgaatgaacaacaaaaatgaattaaaaaggctccacgaaggaattgactctaatcccttcctagaaagtcctaaagtggaatactttcacattacactttaatatgaaatattttatccattttgttccttttttaaattgtgaacctggaaccttttctctaccctatttaggtcaacaagacccccgtatcttaacaggcatctgtgatgtccaactgtataccctcaggcaaaagcaaaaagagataggaaagctataggttgcagttacaaatatagtgacgcggcagactgatgatacacatacaaagaaagttcttacaaaattttacaaacgctgatgtggcagacagtggttgaatcatgattttgcataactaataactgagcaaaacttaatcatctactttagcagtgtatttgctccatctagggtcaagggtttaaatggtttgagaattcaaaacattgtctcaaccatttagtcttgtcagatagtgtattatgccatagtgctttttagtttctgttatttgttatccaaagaataattcaatcaataatcaacacatacctctgattgtggagcccttctggatcttaatatctcgttgcactgttccatcaggcttctcgttccaaatggtctggaagactttgttggtcctgtaaagcattctaaaacagatctaatgaagattttgtacattccaccgtttttggttagagactttggatggtatgtataacagaccttggtatatgcagttctttaccataagttcagtatctgtctcatgttaatcattgatccacctgtcatagaattacaaagaggtcttatttcatttctaaaatcctcagtatggaagtaactggagaggcatattgcaactttctctcaacttacatatatcactggtttccttcgaggcaaattgtcaactttgctcttcttactgtgcagcttatacctgaaatacaaagaaacgtaccagatactatgaattgagctgtaataaaaaaaagatcatgtgtacagtgaaaagactatcagtaatcaagactcagtttcagctatgaactgtaattagatatacaatatatacaccagaagaactactgggcaatcaagtgatgctgctataggcttcatcaaatgatatattaaaacacatactatgtcaaagaagcgcgtacacagagcaaactcacgtcagaccctaattttctcttatcatacacagatgagatgaggaataaataaggctggagcatatgacaattgatatgaaaagaatgttatggaccagcaagaattcttcggattctgttttagcttatgttccctctgatccatcggatgcaatttggcgcacatgtgtaatcgcaaacaaacatggttgtattttctctcgagaattttatctccctctccttatcctattgaatttacttttactcgctcgcacttctcatggggtcccaatctcctatgccgttcacctcaggttaatgtatcttattagcttagccaagttacccattaagtctgtatgttgctgttcccacagcagagcaaaaaagattcatcatgcaaatagtaactagaaatttcctaatgctggagtactttagttaaatcattgttcctcatgagtttcttattcaaggaatgacatggaattgttctatatttgtacccattaatattggaggattactcgaattggtaaatccctaacaagatcatttacagttgttaaacatgttcaggttgacctgctctcactgtaagctggcatttgttgacacatctgtttttgaacatgtgaaactgtgaaagtaccacctgcttgatggtcaaacactcaaacaaatcaatacctcaactctgaatagtagactgatgctacaaagatatagctgaaactatctcatcaaattcttatggtcagcactagtgctaactttgtgtaattattgtctcatcatcatcttgtccctggctatccaaaatcatagtgactgcttggggtcacacaatccctttcgatgaatagaaaaatgaattaaaagctcatcccaagggattggctctaatacctgcctatagaaagtcctaaactggactacattcgccttacatttaagtaataaataattttatccatctgttaaattaagaacctagaccctttctctaccttatatcaggaattatatgattaagagtaggaacacatgtagttatagaccacttttcaatgatgtccagatgcatccaccagcaaaacatctaaagaatgccacagtttagcaaaaaggaataggaagttataggttccacttacaaatattgatgcgcactgctctctgtattaggcagtaaaaaaactggtacataaagcatatctccagttcacaatgaagtcaatgataaattgcgatcaataaactatctacacctagatattccatttgtgcctgaatttagaaaatgtaattcacttcatttgctatattttaaggtaaaattcctggtggtgcagaggttaccatgaggggtgataggcacaacctgatcgtctactttcgcatggtgtatttacatttatcatgagtttccttcaaggtaaattgtcaactttgctcttcttactgtgcagcttatacctgaaggaaaaacataccactatgaatttgagctgcacttagaaaaaaaaaataaatcatgtgtgcagggaaaagattaacaattcaatggccatgagatagaaagatttttaaaccatgtgcaattagtaatcaagtcccattttcagctatgatgtgcccaattattagatcaacaatcaaaagaagaactaggcaacatgatgttttgtacagcttcatcaaatgatacattataacagattatgccatggagcaaacccaagtcatacaataattttcttggatcatactaacaaatgagatgaagagtaaataagactggagtgcatcacaagtaatacgaaaatggaccaaaagaatttaggtgatgcttcgtcgtaactgttaaattttcacttcattaagcttaaggatattcaagttgaatctttttcatataccttttttctggataaagggcagggcccttgcttttaagagcaagtttgggatatagaagtttcagtgctggggacaacagctaaacatgaaggaagcatcaacatggcctaacaggggaacagtatggagaacacaaaaaacaccgattgaatcgccgttttgtttcaggttcgctaaagacccaaacagaagacaatccacaccctaaagaaagtaagtattctctattgttcgcagatcagtcgcaagcaatctctcaaagaacagggcccagaaaaatttagcctgatgttatgcaaatggagaacacaaattacactgtatatagagatgttcaatattatagcagcatgaacattattacatcagctacatcaaactgcaatcttatatcctaacaccacagttaccattgaattaaaagtagtcgtctaacatcactaacatcattctatgaaaaggagaagaagaaggaggatatccagcctt

SEQ ID NO: 108354 - DNA, 727 bp, Oryza sativa
gcagccctatgagtgatatcagtgatcatcagagtgtaagatcccctcatccagccacaatatccgtttcctacattattgagcattgtgccgcactgtaacaattcatctagagagtatttggcacacatgacggaccaattgactacctcaacatgtagcaatttgcgtggttagacttggtcaaaaccaacggggcatgggtacagaaaaaaggatattaccaatggtcccgatcagaccccttaacttagctgtctatagctagctagtctctttccaagactttcttcttcttttttcttttttttttgaggggctttccaagactttctgcattgcctagagtatgtactttctcttgttctttaatttgctcttcttttcaaaatatgatggagaacactagcacatagtttagtccgccagtgcttgactactccacaaatgtcttcaaatggtgccaccatctgctagtccaaattccctgtggaccttggtatttccgtcttagtgaatttgacgcttttgatgttcttgctcaatcgtactacgtacatattccatgccctgcttatcctacccggccggagtggaattatctactggaaatcactagaggtacaaatgttggggttgtttcttaatcatggatagacgatgactcgatccacttgactacaaggattttaaatcctgctgctcacaatttcgtacacataagtgt

SEQ ID NO: 108355 - DNA, 569 bp, Oryza sativa
ctaatagctcgagtggatgtccatccgtttattgcatgtcaactacttaattacgaaaaattttcaaaaaaattgccaacatagattaatatgtagtatatcactctacaaacatgtaagttcaaattcagcttctacaagttgtaacaaaaataacaaatttaattgtaaatatacatatagtaatttgagttttgtttattatttttgttacaatttgtagaagttaaattttaacttgcatgtttgtgtattaatatattacatattgatctatcttgttcttctttttttcaatttttttcataccatttaaatgacatgcaataaatgggtagacgttcactcgagctgttaaacagtttcccgcgataaagttaattaaatgcatgaacaagttatatactgggagccggtggtctggttagatgtggagcgctatgaacgaagcatataatagtcggcagggttaggtcggggtgagaggtcgactcgttaagataggaggtggtagatccagcagtacgtggctctaaagatgggaaggcaatgcactgtggggtgtctag

SEQ ID NO: 108356 - DNA, 554 bp, Oryza sativa
cacaattacatgatgaagtaacaatgcctaaattatgatctaacaaaacaccaaatgaacttaagggggtggcttaatatttatacatgaagtgatctaagacagtgtgtatgacatggcacgtgccctacgacaaaccagacccatctgcccaagtggaggtgatgcaacaccattggttttggtttctaagaacaaaccactcttacgattcagattggttggatccgtcggaaagagaattccgagatctttctatcaaatccccacatggatttttagatcaacgggtatgctcgtttgaatttggggtggtgcagcaaactgaaccgaaatattctatcttgcatcctcgttgagcttttgttcatctctaccgtcattcctaatcacaataacatcaccactagcatttagtagtactacccaattcagtaaatcattcttatgcaaccctacatggtaattaagttgacggacacgagctcgagcgattgatccttaatcactggttcagcttgtgtgcctgccgttggcgtgattatatccatgca

SEQ ID NO: 108357 - DNA, 605 bp, Oryza sativa
acatctgtctgaaacagcggtcataacatcacagagacagagattcgtagcagtgcaaaagttttagcgccaagtgcaacgaagcagaggagagcgaagcgccgaagcgtgtgcgtaggatgaattgcgtggttttgaacggggaaaatcacagatacgctttcgcgtgggcccacctatagcctgacttctcatcagtcgctttttactagaaaggggtcatggtagtaggatattctggcggacaggtaatcctctcctttttcttctttctcgcgacggtttacgtacgtgggcgtggccgcgtgggcgctcgtgttcgcagtcgcgtcgcgccgccaccaaaccccagggactgtggtggaggcgtggagccacctggagaacgttggccaagaccgcctcactcagtcactctcacccgttcagagcgtcgaagggagactgtttctcgctccccatctactatacctcctctgctttcttctgctctggctcccctgctttgcaggagtagtagtcttagtgttctccttgcattaggattaaacccggaatttaattcctcttgctaaacctttttttttacattgagaaaatgtcac

SEQ ID NO: 108358 - DNA, 657 bp, Oryza sativa
tttgctactctaagattggaaattgatgttttccatctagccatatgtcatcgacccccggtgtattgtcacagcctcactgggggcaaggggcattctaaagagtggcaaatgatcatatttgcctgtaatttcgatgactccagctaccagacgatccggcaaatgtacccagatttagttttgctctcttgtgcaattggtgattgctggaagctttgaataatatagcctgcattggtacagagaagcaaagactaaattaagaacctactgaaataaccgcgaggaaaatgcacgcatgacacgcagtaacttactaactacatctgatagagatgtgccaaatttaatatctcagccgaaatcaaatagcacctatgatttgggaatgggcaaaactatgtacaaactataggcagatctagaacaaaggaacatattttaaatctcaaatatgaaggaatgaaggctacctgcgcaggagaacatgaaagaggctcaacaccaggtttaatttgtttgggggcacacattatgcaacactttcattaactcctggggtgaattgatgttgccttttgatatttctgcactgaaatcaggcaagctctgcaacaatgctttgccttcattgcttgcaaccagagaagtgga

SEQ ID NO: 108359 - DNA, 1509 bp, Oryza sativa
aaatacttcccttgctcaaataattcccagaaaattctagaaaatagaggagcaagcatagtatttaataaaattttatctaactcatttttatattgaaaattttcctagaaaattagggtttagcttgtaggcttttaaaataatttctaaaaatgatttaaaatatgcatttttaatttaatcgatttttagggcgtgacaatattgccagagattatataggatatatgataactcgatgaattacataaacaagattagagtgtcataaagatggaagcactaatcccgagaacgcaagccaccataacaagttttacctctagttgaagatcgaaaccaatgcagctcaacttgaaagcaagaacttgtcgaaaataaatgaaagtaaaagagtggtgatgcgccgagattgtattgaacgattgttgtttgatttcatgggttcgggtcatatttatacccgtcataaaaaatatgtcctagtctttgcggcagacttttgcccaaacttatctctaaggatattacataaaatatcctaattaatagatacaattgccttttcaggacttaatccgtgcgtggcaatccatatgaagcacattaactcaattcgacaacgtgtaccgagtcacattgtcggaatcggctcaatcggctaccttgtctgactcgaactctgccgatcctgatcgtagccgattcggacttcggccgattcttgctctgtttccggaacaatctttctcttggattctgcttcaattttatcttcatctccgatacttgaattaccaaatttggtcgttaacaaatgccccccaagtctggaatatttggtaatgtttcggatttgccatattttatctccaagaaaatcgctcattgccgtttttcctaccgttaccacagcgctttaaatactaaccgtcacccctgagaaacttcacaccgttacttctgttttcacagcttaagaaaatcttgccttttctctccggcgatcccctcggtgcataaggcgatcttgagatgattttccctccgaccaaacttccgcccgtggcaatgtcaatttctgccagcccgtctgctgtgccattagccgaatatgcagaggtacgtatccatcggctagatcctctcctttgtgcagtagatcggttttcctctgtctcatcttgttttcttcttctctattcttttttgcatcggtagcatctttccaatctggttgcgattcccagtctatcccatgagcatcagtatttccttggtcctatcggcgattccgaccccattgagttcattatcaccgaaaccaataggataccttttagattggcaacccaaatctaggtcattggaaaaacactttcaaatcttggccttcccttgagaaaagatggcccgcctggtacaagcgcgtgtcggctagcaaacaagttcactgggacgaactcggaatcggccaagcgcttgctctcacaatagcaaattcgg

SEQ ID NO: 108360 - DNA, 545 bp, Oryza sativa
cagcccgactgggaggcccatggcggtggggaggagacggagttggcgacgacaacgaccggcgacgaccccgcgatggagactgctcggcgacgaccccgcgccgctcgccatcggccaccgcgcccggccccgcgccgctcgccgtccgccaccgcgctcggcgagagagaaggagaggtgacgacgggtggctcaagatagagagagaggagagaggcgacggcgacgaccagatccggccaccgcgcgtcgcggcagccgtcggccaccagccggcgacgggcggagggcttcctcgcgcggcggcggcgaccagatctggcgcaagctgtcggcggcgcgccggtggctggggagggcgcaagctgtcggcgcggcgacagctggggagggcgaggagggaggcaatggcggtggctggggagggcgaggatggaggggacggcgacgcgcgcgagagaggggagtgattggcgatgcgcacatgagagagagagaagagaagcatcggtgcggtgggggaaaaatgtcgtcggtgggct

SEQ ID NO: 108361 - DNA, 671 bp, Oryza sativa
aaattttcgtggcatgcttttcaaactactaagtttgtattgaaccagtggtctaaccggttgaaccaataaaccatgaactaacacttcgttggttaaatatcaggtcatggtttttttagaaaaaccctacatatcatggttgaccatcaagtcaatatattcgaggttgccttacaataatacaaggctaagataactattcattgaagaatccgatccataaaagtgttcacaagcaatcaatggttaaaaacatgtaaaagtggcccaactacaaatcacgtgcacaaccccggccctcaactggagatcgatgatggggacatcggtaaatatttccacggtcaaattcaacattccatccagagtgaccaaaacaaactcaccgtctctctcgatctcactctcacaggtaggatacaacctcagaatacctgtaattttccctcatttttgttccgacggaaagatgtctgtctgtaaattttttttccgctatgagagagttcccctgtaattttgcagtacatttttatttttatcaaagaagataaaatatattttgatcgataatctgttcaaagcaacctaattaaaactcgcacattttagcgttatgcatgcagtgatagagccagagagaattatttcaaaacccgatcgagcaa

SEQ ID NO: 108362 - DNA, 798 bp, Oryza sativa
tatatgcaatatacgaaaaacatatatgattttgtgcgatttagactataatacccaaaattttatgaaatttactctatctacaattacactgaattaattatttcactgatacttccccttttaaatggtctgatgtttcaaacaaaaacttgagagaaaacctatatataagaggtgccataagtagcctacttttttggtttggctttgtagaattgatgtaatattcaatggcttcaagtttaactttgtcttcttcttcctcttcttcttttttttgcaatgtttaggagagcatatttgactcatcaatatatggcgtttgttgcttaagcaggatgagggtgagatgatgaagaaggggtgcaaattgatggaagctagaatttttgcagcttttatcaaagtctggatatatagaacttgatgatttacgaaagggcatgtagcctagtggttgcagtgacctgaatagtaccataaagtcctgagttcaaatcttcataaaagtgaatttcatattgggttatttgcggggctaagttcctaatttaaatgtaccccaaggttctaagttcaaatcttccttcaaatcttcataagactgaatttcatattgggttgtttgcggggctaagttcctaatttaaatgtaccctaaggttctgagttcaaatcttcatagaaagtgaatttcagattgggttgtttgcgggaaaaagtttctaatttaaatggccgcatatatccggttggatgtagaggccagataaaaaatacccttctctaaaaaaa

SEQ ID NO: 108363 - DNA, 780 bp, Oryza sativa
agactcccggattcatcaggccgatcgatcgacaatgagtcaccgctaagtaaatcaaacgggaagaagcagcggcgaagttcttcagaaaatttgcgcgatcgctatcgatcgatgatcgatgcttggggggccaagttctgtatagctaattaagctgccaatttgctcaaatggtcactggctagtcggaccgacctgtgaacctacttatatatttaataaaaaataatccgtgagtttcacgtcatggcttagcttatcgtgtcgtaaagatgcaagtagatcaattcataagtttattttgaggtcaaattaataggtaacccgtaaatcaatccacgggttactcactaattttatctataatcgggtttacgggttaatccgcttgcatctctactggcgcgcacgttagttctataattctaacagttgcaatcaagttataccaattgcaaccaactattcagcttacagtgcatcgccgtcacccgtcatacgtcaaagacgacgctattgtcgtcaacgccaaatcatttttagattcacctgctgattgtttttttaaaaaataaaaagattcacctgttgcggtcgagcacacggtaaattcgaagttaattaactcaatttgtttgttactgccgtcgcatgttgagctattcccacaggcgttttgggttgtcttactctaagttatatttttacgagtttaattaaatttataaaagaatatacgttttcaacaaaaaaaatatattgcaaagtgtattcacg

SEQ ID NO: 108364 - DNA, 2301 bp, Oryza sativa
cccaaaccctagcacgcaacaagccaaaacgagcggccttcttctctcctcgctttccacacgaatcccatcccagaagagggaagaggaagccaaagcctctcctagatgctaccacatggttccagttccaaatcccaccaccccgccgacggcgacatccactacgccaccgacgacgacgatcccgagttccccctcggcaccacgaccacgcagccgcaggagcaaccagtggccgggccattttgcggcggcagagcaccatgggtgcgcgcggatccgtgtggcgggcatggggttcgcatcgcacgcgtaccttggcgggaagcggccgcgcatgacggtccagccggagacgcgcccctccctctccgtccgtctccccgctccgccgcggcgaggaagaagagatgggtgtcgcggcgtggccgtggccgtgtgggagaggaagcggcgacgaaacgaggctgaaaaataatttgcaaataaaattttgatatagtacgtgtttttaacaatcttaaagtaaatggtgaaaaataaatttcgctgaaaaaaaacctaaaatcaaatttggttgaaaataaataatttagctgataagtataagtaaaaagatgatgaagctggataactgttttgcttttagagttcttttagccgtttgtttggtttaaattttaaaaacaaaccctctaaaacttggttttcaaaactaaacctttctaatcgtcgtgctactgtggttctgcggcaactaaaattccaaacacatgtttaattttcacctctccagctctccttgtatgaatttgctgtttcgtcaggtaaaaactcgaaatgcagtgcacaaggtagtctcaaatctgtgaatggatctatctctataagatcatccacggcaattccagaccatctcataaacggctgaagcaatgcatatccaggtgcatgggccgcaagaacatatcgcagaagcaaaccacgcaaaaagatgtgattctcaatgaacattattgagaaatgtcaaaactttctcaagtctggaacccaactgctgtggcataataaaagaagtgttcagctgtggtttatttgatcattgccatggcgccattgcagcaagcatgtcagcattctaacgtcttgaagacgcactcagaacttgtataccatctctgcagtgtatcctaactctttcagaatgccggtgagctgcagagtaaccaaattgatgatcagtaaaacattaacatggccaagcaaaagagggcaataaagtgataaaacgaatgtcatgttgtagtggttaatgcaaatctaggaactaggatacaactgggatatttagatcactggaatgctccctggctagctttgacaggtctgttagctggaacttggcaagcgaaaattgtcgcttttagctaggaattatcttagtatgttcatccagatatcattctactgttttcatccaattaagaaggataagaaatatggcactaactacaatcacaaaaggtagatagtgacttcacattacctcgccctgcgatctatcctttgccttgtcaccggatatatgattcatcatacctggaggaccacaaacctgaccaagcaaaaaccattgaatgactgatgctttcttacattccaacattaataatcatgtttatgctacacatgaatgaagataatgttgatggagattataagcgagctttaaaattgtacaaactcttgtcaaaagcttaaagaatatcagcagaactataagcagaaatgacaaagactactcacaaggatcagagaatcctcccctggccgtggcaaacctttcaaggcaatgtccttggatatgtagccaacaccacccctccaatcatttgatggtttgtccaccgtgtagaatacctagagaaaaattaccagggcgtgttacactaacaaaaaaatcccatgtaatcagatcaaaatgaattaaaccctgtagtaataccaaccttgaaattaggatagctactggcaagtctatctaattcccttttcagcaagatatcatctggtgacacattggcataaattaaggaaacctagaaataccaagaaccataaatcagattagaacaaaacattagtcaaacattatatagctaataatgttatttctggtagcagtatgaaagtggatacattgatctgttctgtcatgtcagcatgcataacaaagttacgtggtatagcaatatcgttcacataaaatgatagttgctcaaagggataggctgcagg

SEQ ID NO: 108365 - DNA, 1139 bp, Oryza sativa
ataataaatttaaacagtctgtctagtacaatgaatctggatagagagtgagtcagattcattgtgctagaagaaattacatctttacttcgattaagggcatccacaatgtactccaaaaatggtccataagcaatataatatttgattcagccacctagcaacattgtgaaactagcccataggaaagaaataacaaaagctactcataaacatatggcctgcctatagagaataaaatatattatttgtctctatctcttctcttctactaatactatttgctatccatatacattgtgaaatttataatagttaaagtttatatatgtgggttctagttttatggactacttttgtcatatatattgttgttgtcctcagtgttgtttttaagaacggagggagtgcattcgacgatgcttactcgtgacaaagtacaaataattagtgctaactcctcacaagcaacggcagctgcctattctgctttgtacccctgaacagcgaacacatggccaacttatatactgtactatgttctaatcacaatcttgatcttgccgaccacctgatccgtacgactaactaaacgctacctgagctagtgaaagtgactgcgtaatacttcctctgtttttttaaacattacttcctctgtttttaaaatggtggttttcgattaatattgtatttgaccttcgtcatattaaaataatgatattttcgatgagtatgtactaattattatttattttcgtgtggtttgttttatcattaaaaacgctttttatgcatgagtagtatttctgcaaatttatagtattgatgttttaacacgatgaatggtcaaacatatcaagtcggagtataaaacaaaggaagtaattatcaaccctcctctgcatattaggcgaccagacaattggacatttatgctgcatgatccgatcgagattagtataataaaccagctgataatataatcagaaacgtgcgtgtacgtgtcagctggttaattcgcccagactttttaatcagcgagaacattctggaggttaaacctgagccatgtttcagatgattcgcattttatccttttgtttcatccgtcagctgcctgcctggtctgagaattg

SEQ ID NO: 108366 - DNA, 830 bp, Oryza sativa
ttttttcttctaaattacttatctgatctataaaccgatcacaccgttgtattcgttgcaattaaatctttacaacaagatatcacatgattatattatgtcaaaagaaaaacgtatgtttcaaaccgttaaaacaaaatgtttcatacgtgatagtgatatgtttcaatatgtgttttaagtgtgtttcacaaaattcctgaaactacctactactactctctctccacctcatgcatgcatacatacatgtattttagcaagcttcaaaataatttttctcttaaattacctattcaatctaagaaccgatcacaccattatattcgttgtaattaaatctttacaacaagatatcgcttgattatattttcataaaagaaaaacatgtgtttcaatcagttaatacttgttgtttcatgtgtaacagcaacatgtttcaacatgtatcttcactatgtttcataaaatatttaaatgttccagttgctgacttttttgtttcaccatatatataacatgatgttttacttgttggtcaactgcaacatttgaccatccgtttttttaatttaaaaatgtttcacctaatgtactcataatgtttcactatgtatgaatcaactattgcagtgagttgaaacatcatttcgctattcgctaaaacattattttcatataaggcgaaacggcgtccaataaaacattttcgatctacctagtggaacaagtccgatatacttggtgcaactgcgtgcaacatttaaaaataattcaataataagctaaaattttttttcatcggattatattcatgtgtggtcttgttt

SEQ ID NO: 108367 - DNA, 1158 bp, Oryza sativa
acgctaactcatggttatttatgtgtattaggaattacacatgatttaaacacgatggaggagtcttacacgtacgactacacaaagaatacagtaatactccaatacataaaaatatatgatgtcaccatttcaccatagagctatacaacttacggaaacggaataaaactaaaatattttggccattagaagtagaacctcatctaaataaccataaataaattatatatttttttattacacacaacacgtatgtgcacacataccactcactcactcacctgccagtttgctccaaaacacacgttttgaagagataaaaaccgccgcatagcccaagccctactatacatatgataaaatttcttgctaatgttgcttctatgaaactagtgcatgcaacaaacatgagctccaatataatgttttaatggcccaatcgttaatcatgcaaggcaggatcataacaagattttatcaattttatcatacatatagttattttcagcatagccctgactctgaatacccgtaaatttttattaaaaacggactcacacatacataatatttatagatacagggaatctactgacccactattgtccccctttaataagtttcattttaaccgatcatctgttagagtacgacatcttttacattaatgtaaacgtctcaaaactaaattacacctttcgctataaaactaaatcacaacttactgtttctcatcaatacagcgtggcaaatgtgtcagcatctcaacaaaaagctcctgcaatttactcctccacaacttcttttcattttggcatcgtaggctcgttagtagcagctgttcgttgcgcttagcttgttggttggacgagaaacccacatcggccgtgcctgctgctgctgctggtggtggtgatggccgtgccttcggccgcgcggcgtacgtggcggtgccctgcagcagtggatgcctgggtggcagggggaagctgacgatgacgcaacgatcggtacacgtcaccatcaccccggccttaaaattaatttttaggtttggttatcacatcgaatatatacaagcacatatttaaagtattaaacgtaatataatataaaataaaatatatgttccgctaggaaactgctagacgaatt

SEQ ID NO: 108368 - DNA, 1134 bp, Oryza sativa
ttaatctagtactagatgtaacatattttagtactataaatttgaatatatctatttaaattcgttgtgttagaatatatcacattcagtgtttaatttattttttatgagacgggaagagtatgttgctaagagcaggtacaatagtaggctataagccagctgcaaacataatttaagaagataaataaggagagagaagagcagcggactacagatttatagccagctgtagcacagactccaagatgcagtgtatgtatgacaggtggaaccaagtattaatagtgtagtatataactattgtatagataagctatcatattagttatagataaattagagctagtagttggctatactattaaacttgctctaacgctagctactcagctccacgagggaaacgtgcactagctagctgccatgatgtactaggtacgttgtactagtgtaccacagattcagtcataggtaaggagtagtaggagcactattgagcagaggcaattaaagaggtactagaggaacgtactagaacgaacgtgtggctgactagttgaactgatcctgatcgaggcacccactcggccactcggcccctcctcacgtggacatgcactactttgctatttttaagcactccctgcgggatatttaacactgttattaactttaaaaatatttaaccatacatcttatttttgaaaataatatgaatatataaaaaaatataaattataacaaaataaaattacgtaattttctgaataagacgaatggttgaatttcactctgtttgttacttcgggtgcgtccgaatcggcttccctaagataatttttagcgagacgtaaaatgagataagctattagcacgtagttaattgattattaattactataaacttgaaatttgagtttatttttttaaatctatataaaatgtattaaaaataccgtttagtaatttaggaaacgttctcatggtttaatgaaggagtagtttttttaacttacgaaggagtagtttagctgagttgtagaatcaaatgaaggtgagtccatttcatatttagaatattgtagatgtaacctaagttaatttcttaaagtttgactaaatctattaaaa

SEQ ID NO: 108369 - DNA, 510 bp, Oryza sativa
gtccattgagatcagagagctcacaactaacaagtgcaaaaggtcctggaacttggctaggaagttcagaggttctgcccagtggtgttgggccatcagtttttagtccgcagcagaatacctttgtgcataaatcagaagatgcagaaccttatcctacacagcgaggtttattacagtatcctcctcagtatcctgcatatgacaaatacatgacacagctttcatcatgttcaacaaatgtgccacctcctgtcatgtggacgccacctgccaattcttctgaagtggtcgaacaaatgtttccagtgatgaataaaaatactggggaaagttcttcatccttttcttcatatatgaatccttgtagaatcaaccttgattattttgattgcatgtggaatgaacaaaaagatcttgggcatcagactactgataaacaccatggaaaatggagcagctctgctagcaatgcgggagaccatttgctcaattctcttggagcagatc

SEQ ID NO: 108370 - DNA, 600 bp, Oryza sativa
cagtttatatattcaggagtatcatcgagaagctgctatattgcgcttgattgtctttgttgtgtagctgtcagcagttgtattagtctatcatcgggaagatttctgattccgtattgtattagttggggtgattcgaacgaggaggtgataataattgtttttttttttcaggttaaagggtggttatgcctcatattttaaaatggagggagtatgaaactactagtgttccaattactaacagcctgaacctaactgttacagtgggatgcacacagcacataggttatatagattggtagattagacagggcggaacactattcttttttaacggagtgtgattagtttacatctctttgagtgctgtaactgggatttcttatgtggtttccacatgagacggttgtggagagtagaggccatgtagtttcaatttttaactgctgcttctctagtctaaaaaagtgtttcctatgacgaaggaattatacttcatgctttttatgaatgattgttcttagttctatagcattcccagttttaagtgtatcatacaaagatttcagctatgagttcacaaatttattagagctg

SEQ ID NO: 108371 - DNA, 681 bp, Oryza sativa
tatttactgcaggaagttgcccgtcacaactatctgctccctgacattgcaagttcgcaggataggcagtgctgttttgtggtttactattgggtatggttgagataaagattttattgccttttgataagtcaacaggaactgcattgataaaaagatttgcatctattagtagggcacactaagaggttagtatccatatccaaatatgtaaattcataatgtctgagcaccttgtgtgttattgtgattttccattgctgcaagcttcacacgggtaagttgaagctcatatttgagcttacatgctgatgcttctgcttcaacccacaaatttttgtagatcgacaattgcgagacatcaatatcatcaagcgtcttatcctctgggagcttagcaacagcctgaagggaagataaggataaggtacacaatagaggataaaaagatgtaatcaattcaaattaaacggcagcatgatgctcctaatcatgattgaagctacctgtgaaatagaggtcttcaattctgaatcgttctctactaatgagtgttcaggcattgccatccataagttattccttgaacaactcatattttgaaccttgtatgagacaaaaaaaaaagaaatgagtaaaagctaatgaaacaagcttcgcctttcctacatttagtctatg

SEQ ID NO: 108372 - DNA, 567 bp, Oryza sativa
cttaggatctcaattcataactcctctatagttccggttttctaaccgggactacgaatttaggactaaaaatcgctatctttagtcccagttcaaataagcgggattaaaaatggatctttggtcccggttggtgttatcctctttttagtcccagttggtaaccgggagtaaagagagaatagcggtagttccagatggtctccttttctttttttttattttctccctaatcttatcaagtgggaagcatatccccaaatcaaagtaacatcccaaatccacatcacaaataaagtaaaatcacaaatcttaaagttacatatatacacaaatcaaatacatcacaaatcctaaaaaattacacacaaatcaaatacatcacaggtcatctcagatccatccaataaatcacaaaattatacatgtaaatcacaaactaaaaaaaagagagaaaacaacgccgttgccgccgccgccgcccggcgcggccccgccgccccggcccaccgccgcctgccacgggcgccggcccgccaccgggcatggccccgccggccgccggct

SEQ ID NO: 108373 - DNA, 598 bp, Oryza sativa
ttctgcattcgagtcaacacctttctttttttattacatctcttctctaataagtttatagtaagtttataacttttttttaaacatatagtaggcttttaactcactaatattcttgctttaagtataacacacacgtaggcatacgcatgaaaaactgagaccgacagcggttctaaactcattaaaatcatattaaattgaagacatgcatgcatcgcagtagaaaaataaagcattacggccatgaaacatttctaggttgttcctttttttaaaataagatggtgctacatgtgtaagtttgtattaatagtatttagattggtactggatgagttatatacgcagtataggtatatttttaataagtagtttcataagcaatacattgcattttggacatttggtattcaaaagacatcaaatcattcaaacaggtaggccattttacttgcacacacgtcttgtgaagttgtatctagagaacaaatgctacatccatcgatccatatctagtactccctccatccacttttttaaaaatgtttgaccgttcgtcttattcaaaaaatttaagtaattattaatttttttc

SEQ ID NO: 108374 - DNA, 945 bp, Oryza sativa
aacattccacttccttccaggacttcatgacaccatgctgccatccgcgagactacgaaccgtgccatctatgacaccaaggtctttcagatggctggatgagaaaatgtaaagggtagacaatgtggtgcagtacaagataggagatctctggatttttcttctagggcgatgctctctaccgatagtattatgctgccaggccagtagaactaatcggaacggtttatttatttttaagggtagattagtaaagtattaagattgattagggtaaatttgacactaatttttctcctcgtgggtcccacggtcagcgtcgctcgctcactcgctcctctccgtcgcaaagcagagttgccgcttcctcatccatcgaaaccgaacggcagtggagagcgcgactcaggctcgggctggaggtggtcggctcggaggtcaccacgctgggcggccaggtcaggctcgccttccttgtatcgtgcgggtctcgcgacgccgccgccgccatagcctcggtccgccacgcgctccagtccgtgctcggcaaggtcagctcaggcttcgacttcgcacccagtgcgtcgctgctgggcagcaaacgccgaaaggtctccacgttcgagtcgtcgagctgctcgtcttgacaagtttcagagatgattacgaagtaatatgcccgttgctcctttatttccagccaaagagatctgatcagttgcagggatttaattgctactgataagtttatcgatcatggactcatggttgtaaaagaaagatatatacaagctgaagtgagtttttctttaatttctttccttctttctttttgccaagattactgaagtggcttctcaacattggttagcacttagcattttgctgcttatctttttgtaagagcgttgtgctccaagcatgattaattaatgaattaccttg

SEQ ID NO: 108375 - DNA, 2594 bp, Oryza sativa
atccatgaattttacaatattcagcttgaaaacattaagatggattttttttttattaaacattgtaaacttgttcccacaaaaaaagtactccctccgtttgaggttataagacgttttgactttggtcaaagtcaaactgcttcaagtttaaccaagtttgtagaaaaagttaataatattttcaacacaacacaaatttattatgaaaatatattcaattatttatttaataaaactaatttggtattataaatattactatatttgcgcttaaactcagtcaaatttaaagtagtttgatattaaccaaagtcaaaacatattataatctgaaacaaagggagtatggtaaagttgcatctctactaccctcaacactcattaatattagttggtacaagtaagggatccaaattttaaatttgggaccagaaaaaactaaaaacaaaaaagggaattattctactaccatcccatcctaccgggtatatacagagtcccaactactagctgctaccaatttttatgagtgaaatacatacattttttatttttacaccagaattggatccccgacctctctcagcgtacttatcttttttccaactcacttacatattaattatgctataatatggaccttttttacttttgaacatttctatctgatatttgaaacacctatttgggcatttaaatgacttgaaataaaaaggttgtgaactataaaattgtaggtatcatctacagctacagtttttatataaagttcacctcgacccgatttcatatgaaaaggttatgatcatatgtgaaatttgcactaatatggttggggccatcagtttgagttatgaaccaatgcggataactcttgcttaaattgaaaatttatcagccgaaaattcttctagcgatgagtaggtattagtaagagcgggtcatgcctagaagcagcatttgacatatgtggtcatgtacatcagtgctggttttagccatgaaccgacactaatattactcatttgttctggttcttaaagctgtgagcagtaggggtggaaagcgtgtgggaagaggcacattagtgaacaggtagggtgtcacattgcaggcgttatgtggtagtgctcgaaatagagtctatacaatttctataccagatgcagtactatagtagtaatagttatgggtcaccctggaatgatttcatgtttggtgatataataacaaaccttgttaatctcagttacaggtcaacacgacgttcttctctcctaatgtaatggaccagctatatggtatgcccatgtgtgtccgtcgtacgtgcaaagaaaacgccggcagaggctaattcgactcttgacgggttgaacctacggaaatagtataagacaatttgaagacatgccttgtctatttgatcgattcttagtttggtcgtgtggtctgtattatattatacacctcttgcttttgggtctataatcggcaccaattttatttatatagcaatatatatacacatgcataaatatctgttaggttcaacggtacctaatggcaccgtggctactatcaacaggattttttttggaatacaaaagagttgtgcatcttaataagagaataagggcatcagcaatacgctcacaaaccggatagtaagcaataaatacattcttaattactacgtggtattaagcattgtgggagtagtacataactacaaccgggtcatacccctaccgccggaagcaaggaaatagaatatgtatgtatacagtgttttctgatagcaaaagaaaaaaaaaaaacaggctaccattgcttctcccaaccgtcgcatgcatgctctgtccttgctgcgatttttttaccccatgaaccccaccttaccgccaactcacggaaataagcaatgtggagcgcgtctccctctattaccacctgtcatctgggcccacgctaatacccatgtcgatagcataaattgctgatgccctaagagaggagagattttagtccctcccataaagacttgcttttgtaaaagggactaaagtttagtccctccttcctaaacaccacctaacaaccccaccgattcatggcccagtgcaagaagcagacctagcacaccacgatgttctgcttctgcgtgacgactgataatctgcacagatttttgaggcatcccttggacaactgttgatgcagagctgtgcaaatattttttatattcagtaattgactttgtcagaaaactacattcctgtcaccaaaatttaagtggtaccaaataatatcaccaactaataaggtttctttcctgcagagatggagcaaattgctgatgagaggaggtgcctggatacatggagcaaaagggttctcgaacgaccgagagtctgagaccagtcgacatcaggtctataatttgtttcttgcctctgctattaggctggctgttagttttgtatccctgaagatgttcttggttcattggactggatgtggtttgtggcctctgcagagtagtgaaacgctggttgtcccatccaggtaggattagttttggagattgctcg

SEQ ID NO: 108376 - DNA, 730 bp, Oryza sativa
agatcaatcactgacaaggagcactaggatctatacgtaatttctgaaaactttagtgcttggctgaaagattagaggagttcatctctctcacatgtagacaccactggtttaaaatgtttacataaaactccagtacgccttgacggtaggacagcgtacctccacggggctgtagctttttgaaaaatagttgtggaaataatatattattgggtgttaatttatatgagaatattatttgcagcctagatttactaaatacattaggaatgtccctataatgggtgggtcccgaaatttccaatatcacacgatgtccgaataaaatcaatattggaatagttttgttttacatcttgagaggaggccataaattcaaacggattttaaatttggtatgacatttggaaattgtgagctgacaaagattttagggagaacagccaatatggtccctaaagtttcgctcctggattattttagtccttaatctttcatattgtccaaaaaagttctttaaatttgtcatgtgggctgatatagtccttggtcccaccaaaattgccacattgacatgccatgtcaccttcctatgcaaaatctatatgatttgtccaatttacccttacatgtatcataggaaaataaaaaacaaaaggaaaaagtttttaaaaatatatggtatatgtaagagtaaaaatatacctaaaggagaagtatttttttc

SEQ ID NO: 108377 - DNA, 715 bp, Oryza sativa
taatcaacttgcagaataagcctaacatacatcataacagcaaaagacttagatctgttaaggtcctatccttagtttctaatctgtctctccccttcgttttccctctctccctctccaaacctttgcaacagatggctgacaatgagaaaggcaataaggtcaggagtcaagacattggtacctcaagctcccgagtgaatgaagcacaagacaccagttgtgcggcagtggtcccaacacctgattaaccagaacaaattgcttatagagatactacagcagcatcggatgccaattttgaacccgagtcagatgcaacctcaggtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaaggtgaagttcgtaagatgatcattaccagcacagaatggccctcaccaggaatgacaagacgtcagagaagaaacaccttccgaggtgcaccacagttgacagagcatcttttagctaatggaggtagagtgtctgatagtgaagattcagatcaagtctctcaaaagatgaagatgagaaatctccccaagggttcaa

SEQ ID NO: 108378 - DNA, 1381 bp, Oryza sativa
cagtatgttacttatcatcgaaaaataattagccgtaaatacgagactcgtaccaaatctagcaacgacttgtacctgaatatactcatttcaccttgtttacttccccgggctggctattttaatttgcacagctacattttggcaaagtcatcaaaatttaaaactttcaactcactttttaaaactatatattttttaaaatctatccaaaagtttcttcaataaattagaaaccaaaattattttttggggtttaaatattggtgaaaatatcgtttgaatttcatcaaatttgattcaacgttttttattttaaatttatgatcaaataatttaatcccctttgattttacaaatgaatcttgtttgcatttttttattttacactagcacaaataagtatgagaaaggagcaatattgtcattttgaaagaaatggaataatgtaccaacagaatatagagaagatccaaatggaaactcaagtacatataaagaattggtacataaacatttttctactataattaatggtatggaacagaggagcaaatatttttttttaaaacaagtgtttctagaaaaaaaatggttaaatgaaatggggcatcaatgaaataaaaaaatagagtaatttttttaaaaaaaactacaaatagtaaagatacagatttaaatgttatatcacaaaactacaaatttaatactcactccgttccaaaatataagcatttttagttatgaatttggacattgtatgtctagattcatagctaaaacaatgtctagattcatagctaaaaatggctatattttgggacggaggtagtattacatttataacaaaacaatagatttaagttcaagtatcataaaattatagatttaataaaaatatcttatcacaaaactactggcttcaaatccatttaatcacaaaactataacacttatagccctatatgacatcaatactagagatctgatctataaaatctatagttttatcataacttcgatatatatcaaatcttgtgataaatttagtgttatatgtgatacaatgttttaaatctgtagtttttttatagttcgataaaacgtatatacagttttgtaaaatttactaaaaggaatatatttgcatgatggtttactaaaaagaatatatttgcatgattgtttaaatggtacggaacggtggagcaacgaaatttttttaaaaatatttggataaaattgcaaggtgcatttggtaaaaattggaacggtggagcaacgaaattttaaaaatatttggttaaaattgcaaggtgcctttggtaaataatggtcccggcggggctcgaacccgcgaccttcggctcataagatcaac

SEQ ID NO: 108379 - DNA, 1558 bp, Oryza sativa
atgactgtacttctactctataataaagagacctctggtgcttgtgatactctgtctccttgtgataccagccctgtttcctgggactggtatcgattaacaggttaatttggagcgtcacgggctagatccggtcgggactagttcggggcgtgacatgtatcgatcgctaaggtgcaacacaacaacatctagtacggttgtagttgggtcgtcaacgtttctcccaaatcgtagttatcatcaactcaccgaaagattgggccaataacagctttgagtatctccagaggagcttagggttcatcatgatctcaaccataggaaataacagatggcatagatttggccaactcttggagccgctcgatttggtaagatccaaaaaaacacggggagagagatgaataatggtgagagtgggcggttcatttctagaatagctggttctatagataataatgttggagttctaattacaggatcttaggctttactctacaaaacaatcacctcttgcttatgcggaaattaattgatctactgacctgtgtttgaagtcattgccgttcttctttcttattcttctagagatgcctcacgaaccccttccagtgcctagatcggtcgggcgatttatttagggtttgagatcaaagagagagagttcggcgtctgcctccttccttctctttcttcatctcaattagtttaggattctatttttttgtaccaatcacacaaaaaacgaatttatctcttagtttgtttcttgttagataaagaaaccggtggtttagatcctctccttacccttatcgacacaagtcgacaaaatcaaccaccattctcccctagattttgagacttacttacgagtctattaaataatatagctccccaaggcaatgtgtcttcaacaacattatgcgtcactgaaacaacaagacctatagctcactatagtactcaaataaactcaagcttaatttagtggatgttgattgaaaatttagtccccctcatccaggatctgagtaaggctctaatttacatatgtactggccagaacataatcttaattaatcttaattttatgagcctttagattatggatccattagcaaattcttagcttaataattcgatcctgggacatgtctttcacaaccatatcaatgtgttaggcagaaaacacacaacacattgctactagaatagaaaactgtgtttaattagtgcacaacttataacacagtatattttgggtggtttacaccttttgagtggtttatgagcactatttaccactcttagttctaggaaatattcttatgattaatcataacatgctttaaaatctaactacatcatcgactatgcagtaagagattattttggagcttttccatggttattgctcccctatgtgtggacatagcttaatcttagttaacttaataatctttataaatatccacacatctcacaaaataaagtgtacaaatgtctctgaacttctaaggtcattggactttagaaatatgagcatgttact

SEQ ID NO: 108380 - DNA, 1473 bp, Oryza sativa
gaacaaatgagacattattgcaactgctggagaaactaagtgtgaggtctccaacaacccttcactttcatcttcactccatcagttactctgagtgttcactcccctctttgctaccgtatggatggtgcgagattcctgttatgagctaaaaacatgcacaatggcattgagttaaactcactaagtattaagggaaaattcatcataagggatttatttaatttcatttatacctttcttgactaaccacgctgtgaagcgtgtgcaatttctctgccaatgtccatctgacgcacagaagtggcagtagggacttgtacttaaaaggaacagctgaagtggaggccttgatcccttcttgattctgctcaccctctggctcgctattcttattagaggattccccttgatagacctttttgcctttatcaaaggcattagtgaggttgagccggtctttaatcttctgcttttcagctttctggcgctcttcctcttccacggagtgtaagatcaattcttgtatggtccactcctctttctgagtgttatatatttttttaatggatcatagttaggaccaagagatctcatgatgatgtgcactaaaaatccatcagatattttcatatccatggatctgagttgatttgccatatgagtcatttcaaggatgtgcttccttataccactttcgccatcgtaatgactagtgatcatctcatttacaagcgtattggcatgagcctcaggtgcaaattcaaaactttcttcaatgtttgccagatacgtcttaatgtcattagagtcaatgattcctccaataacttctggagagatggcatccttgacataaattaagcacattctgttggacttctcccagttggctaacttcttattgtaggcccacatgagattatcatattcttccccaattatattgagttcttcggctggttgaggttcctcgggaggatcctctcttatggctaagtcataatccaacatggctaagttaataagcacattatttctccattcaacgtaatttgatccatcaagaagctgaatagccttaagctgtcctaatgctgaaaaattaattattaattaaacattagtaatgcatgcaattaatttccattggcttaattaatcacatacaaatgaatcttaattttcataatcaaacaccatagggtagaaaagattatgaaatggcaaagaataatgaattacggaaattaaaatcctaaatcaaattaccaaaagtaggtagatatcatatagggcataatgccattagtaaatgacatgaaattaagatccttagccatatcaccgttgggcagaaatggtaaaggaattaagcttagtgacgaattagagatccttgatcacatcactgtaaggtaaaagtgataaaggaaataatgcactaatggcataagtaaaattctaagtcat

SEQ ID NO: 108381 - DNA, 1366 bp, Oryza sativa
tcctccactttgtcatgtaagatttttttggcaacataagttcatgttagtttggtattcatctaaatgatgtgtaaattaatttgtatatgataggtaaagggcacctctaccgtccctaacatagaaagaaccagagatagatcaacatcactatatagataatcatcgttatgccttcataatgatggtagcagttactggagattatggtatacccacgctgcacatttcttcctgtgtattcctgcatcacacttctgatgaacattttggagatgtcaagatcaatttgatccatccatgagagaacaccataagtggtgtgccaatttcatatgtttcttttaataactattggtgaagtcaatagggaacaagttcagaactttgcatcattgagcaaaggagccttgctgaacgactcatctatcattgcaaatcataattgttcaaaaaagaataatatgtgcatattattcagaaggggcaaactaagcagcagaaatagagaatgtaattgaaagttacccaatctcacttcatgtttgacctgtaacttcggacatggaattactgattttgaaatccaattatttagtctttcatccgcatttatgctaagaaggaattagagctcatgtttacattgtaacagcatttggtctatattgtaatggaaatggatgataaataacaaagaaaaacttctctgttttggagtttcccatttcttgcaaacactatccttttgtatgactaattcatgactgcacctcaccttgatgttttatttgtgtatttatcagttgtgaattgtctatagaaatcagatgtaaaaggagaatcaccaatctgtatatgcattttctccgcttgcaattggctctatacatttgtgtcaaagttctgagatctcaacctctgacaacaaaaatttaaatgcagagttcacaagatgtcaacaacagtcatgcacacccaacaaacaaagaagcatccaaagacaaacaaatatgttgctttccactcagaaggctgggttagattatatggtctcttttatttttctccggcgattttagggcttagtaaataatagcttattcgtttgattcttatcttcgctgtgttgcctttgtagtacttccaatctgtattaatgttgttagttatgtttgcccttccaatctgtattagaggatgcctttctctacgcatctaattctcgagttaggcttgctgattgtaattgggactatcattttctagcttggaaaataaagcagaggtgttgttgagcagtgatttttttttatctcaatagtacgagcacatgtaacatgttcaaacaaccctttttggg

SEQ ID NO: 108382 - DNA, 552 bp, Oryza sativa
ttccctccgcacgaaaaatagagcagtctattaacatgtgattaattaaatattagctattttttcaaaaaatggatcaatatgattttattaaagcaactttcgtatagaaacttttctcaaaaatcaaaccgtttagcagtttaaaaaacgtgcgcgcagaacacgagtgagagaggttgggaacacagggaaacaaacacagcctaagaaaggattcaatccaatcttatctctaattaattgatatgggttacctacaggtctacagcccaatgcccatgacaacaagtaaaaaaaaaaaggatgtttataggttatttagttgtaggtcacaatttcttaccatggtctactaacaaggtaactagcacaaaagctaggttactagtagaggaaacattggagaacaacagcagagaacttgggttataccggcctgctactgatggacttttattttttaagacttgatatattacttcttttttcttatatcagttacatcatttcagcgcaatccagatgcttgtgagtcgtattccgaagttt

SEQ ID NO: 108383 - DNA, 2046 bp, Oryza sativa
tttacacgaagcagacattccaatcgtattgtggtcactgaagcaaacgcggtacccgtaaggcctcgtgatatccagaccccatagcagaaacaatgcacctatgctcctccagctgcacttgactcggcaataaatcatagcaaccactctctgcatcgacagcctcagcaaagaattgtcgtagatggaagaagttgtgtctctccccgacctactccaggccgagccaagggcaatcaatatccggagggcgataccaagcagaagaccgtcatccgcttcaaccagcaatcaaaggaagcttctcctgtgaatgatagcattatgcagtcctatcacatcatcacagaaccaatcaaggatgcagtcactagaacaatgccagctatatctctccagaatcaaaatgagcagccatgtttgtggttttcagttcgctacttatcatggggtaatcgaaagtttgcagcaataatgcaatacataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgaggattcttttggaagatgcggatatgtgattatgtgtataattgcttactgataaaggagacctagggtctcatttcaaaggaactatgttctaacctcgagttaataaccaacctgttgatggaaaagaaaaccaattaaactgtgttgggttaaaaagccaatgagacagtagttggggaataggagtttggatacgccttttacagatcaagataaggattgttggatgaaacccataagggtacccgccatgcctctacattgataagttcggatatacctgcaaacagttaagaagatccaggagacatcaatatttgagaacataatagtcgatggttggtaattagtcgatcaggtatcagaaaagggtcaaaggtgatatggcagaagaacaatatggatgctccccatcccaaggaagcactaaaccctagtggcatagatacagatagcaagcaatgtatttccctgaaggtagtcagtgcagctttttgacgaaccacatcaaggtttcaccgaaaggcagcaagccaaaggacctcatcgtccccagaagcgtccgcaatccacattaaagaataccacctgttagagataagccgaaagatgattgataaaagggattggcaaagatgctctctatcatgaaagaagtaggccgaaaggtgattgataaacagaagcatgctctgcatcgctcacggaagacccctgattgtaattgccccgcaacagtcaccttgtcattaagtaagcaagatgacctaggtaaaagtgtttctatgaaggcaaagagtgaaatcttccactcggtatcagatgctacacggagtgaaaaatgcaagcaccggttaccaggcaacgccacgtcctgggagatgatccaacgggaaagaactcatcaaggttaaaggtgtaaaggaatacgttgagtgctaactgatgacaacatgaagagaatagcggaaagtaaactgaacataaagaaagtgaatctgagttgcttgtttgtgggagctattcccagttatgaaccaagtgatatgttcgaagatagtctacagaggtcagattaagatcacctctaacaacgaagcttcagatctggcaggatcacgatcagacaataagaagtccagcagtaagactagttggggagacgtcaaagtatgtcaagtgggataaattggttctcttgggaagcataacttgtagttagagtggttgaccctcgcatcgcatagcagaagtacctagcaccggagaccaggaaagctaatatgagacagttgatggcaagttagaagtgaatgacaagcatgatattcttatgatgacaaacatagtatcctagtaatgacaagctagtgttgacgcatgacgtgaaatggt

SEQ ID NO: 108384 - DNA, 700 bp, Oryza sativa
catgcatgaagtaggattgaacaaccctccttaatgccatccacaaatcaactaaggcgattgaagagcctggcctccttaatgacaacgattgagctttagttgacaaagtacatatccgttctattgttatgagtaccaccgtcccatcattactcaccgacccttggagtttgatatcttcttttgccttaccatcggttgaaatatatagacacacacatctaggaacatgtttcttagaaaagaaaatatatacatcttcataatttagtactactagacaacagagtttataaagtttttaactataatttcagacttctctttggagtatatttttatttgattataatatattactgtacacaaaatcccacgacaacgcgcggggttctatctagtttagtagacaaatctagctcaaggcctagctaccctaagcttctctttgtgctaggccttgagctagactttaattattagaattgtctttgttaattggctcaaggctattgtttttctaataaggaaattaacaaaatctattatattattaaaggaatagaaaaaggagtctccacgttcgctctcatggcttagaaattctcacattaatcgaagaaaaagaaaaatcatagtccatattgaaatacaatttagaaatagctgaaattcggaattaaaaaataagaaatat

SEQ ID NO: 108385 - DNA, 1401 bp, Oryza sativa
tagtcgattaacaaccggcaaccacgtggaatccactagccaaaagaaaagaagtcggctcgatccgatacttcgagcaaccccaaccctagcctaatcccctaatacaatgttcaaaaataaccatttttcccccccccccaaaaatttttttttcccccccaaaaccccaattaatccaacacaatatcgattcccaattcttcatatcaacagttcaactcataaacaacaaataatctccggatctcatatcaacagatgaacaacacatccaacatgaacaagaacaatatcccacatgaaccatcaataatgccctaagttgtacatgcacctgtagccaatccatcatcagatccgtcagcagggccaccatggagaaggggagagggagaccaatggcagtgaccttcgtcatcatcgtcgctgctcctgctcattgtcaactcccctgagctcgtggcggctttggtcgcccttgagctcatcactaccgaagcttgtcggcgttgctcctgctcatggttgtgtggaggtggcggaagtgagcggagaggccgtgaaggtgaggcagtggtggaagagaggtgaagtgacggtggaagagaggcaatcggtaagcctggatgatgctaggaacgatggcaaatgctgcccggcctgcgccacctgcaccggcatggccgaggtgactgcgtccttcttctccatctccatgccgagctccatcgatgagcctggacgatgttgctcctgctcatggtggaggaggctcaggaagagggcgacgtgtgaggaagacagatgcaggagaggaaggaggtggagtgcggccacaacggggaggcggcagaggtgaggtggaggaagagcggaagaggtgtagcacgatggcaggggaggtggcgttgcggcagaggaggaatggggagatttggcgagtggcagacgggagggggacgaagaaaaggagaagtggtaggagggagaggataaagctcggcttgatcaacttggcttggtttttataggtgcaggtttttaaaagagttggcacctataatatattataagtaccgattttttaattaatcaatatatatatatataaagtttataggtgtcagttttttaaaaaaccattactatactacgtcccagcttttacatcctatggagttagaaaacggttaataggtatcggttttaaataagctgacgcttattagccagtctctattaggggtttatttgtagcactatatacttttaataggattgtagtgatatcattgaattgccgttgacctccgtcttaaggagacgttttttttttttgcgcgtgagcgtgatgtatgtacgtgttccatgtaaacagggaaaaatgtcattaataaa

SEQ ID NO: 108386 - DNA, 701 bp, Oryza sativa
caattgtggtgccaagattttttgagctcgaggcagcattgcctgtttcgcacctaccaaagttctttgacttctgaaacgcttccaagatggaccgattttgagggaccgaacttgttgcctgctggtcgctttcgttgttaggaggtgagctgttctcctttgcagaatgcaggcgtgaccgtcttttcgccgatgaggtaggccctttgctaccagaggaaggagagctgaatttggccggtttctgaagcagagatggaagccgtcttctctttacagactcggcacttccctgattaacaatggaactctcctgaaaagaacacaacattacagtacagggtggtatgtaaaatgcccaaacatttgattccgctgcacattacgaacaaaatccccacataatttgatgaacagaaatgtcaccttcaatggttgcttgtcgtctgcatcagcaggcacggaattgtcagcacaaggatcgggagtagcagcctcctgcttctccatcgcttgcaacacctctctcgattcaccagcatggacaccatcctgcttgtgatgcgcggctccatccgcatccactccgcaagaggagccaaccccaccatcggcgatgacatccagctcctccatctcttccaccggcccagcagcgacaacgcccgaaccaacgacgcagctcgtcgtctcctccg

SEQ ID NO: 108387 - DNA, 587 bp, Oryza sativa
gtttgatactttgattgattatctcatccattcaatgggtaatatctcttgttagttacttggtttttgagcaagttcctttttattagcttatataatcatcattctttagaaaattatagcatggattcccaacaaaaattacggtacctatttcatgctaatactaaatatctcaggaccacacatttgagaaggtgcctgggaggtttggaaacatgttcatctgaggtgtgctgcaaaatttggtctgggtttaaaaacaataaagaggtttcctcttcttatcctgtgtagtgtttgtggaagtaatttgatgctttcaaccatatcatgcttcgtcttacttttagccagctatcttcatatatgtaatatggtaagaaatgcatggactgaacctgttttttgtgtcacatgtaaagcccccttttctgccttatttgcagaaccataactaactggctatttactggtgagaatctttgtgcaatgctatctggaaagcttgtaactgggctaatttccaaacctagctgtttttgaacaccaacatattatttactatgctgggcaaacatgtagaa

SEQ ID NO: 108388 - DNA, 1096 bp, Oryza sativa
gagactgatggaatgatatggatagctgatgacgatgatgatgattcatgctgagggaaaaagattcagattggtgtgtagtttgtgtgtgtgtgtgagggacaatggcagggagcagcaagcagagaggcaagaggcaggtgagctgttgtgtttgcttggttgcagggcaagctagctgccaagatgaacaacatgcatgtgtgtgtgtttttgtggttgtggggctgggagtgagagagcagaaagaatctcatgctgccttttctgcagttggagattgtggttagaggggacttttaacggattaggattcacgtccacggtgacttaatcattgacatgtgagccaaggtttagagcaggtacaatagcagactataagctagctgcaaacatattttaagaagataaataaggagagaagggtagcgggctacagatttgtagccagctgtagcacggacttcaagacgcaatgtgtgtatgacatgtgagaccaggtattaatagagtagtatataactattgtatgaatgagctattagattggttatacatgaattggagctagtagttggctatactattaaacttgctcttatggggccaatatattagtgacaattaatgtcacctgactttgaaggttgaggatgctagtttctttaaaacatgcatgtagcatactatctctatccataaatataaatatttctagcgtttaaaatttttccttaaatataaacatttctacagtattatatcattgagtatgatgtttctcaaaatatcaagttttggggcgtatcaagcaatttcacaacaaccttaaatccttaattttcacgtaaaggcttatatttgtggacggatgaagtaactactgtctaaaatcatttaactttataactaatgtttgagggtaacccaaatagaaacatgctcctataggattttctctttaccggtgttcagtgttgtgcatgcagggctgcatcattagtgcatgcattgtgctaggccaacttttcacatgcctgttaattttaattaactaaaagttgatgactctggttaactcctactagtacgg

SEQ ID NO: 108389 - DNA, 1048 bp, Oryza sativa
cctgccatcacatgcgtccggtgatgatgacaagaaaggatgagtggtgtggggatctactcccaccgtcccatagaaaacgaatatagaatcgaatatgacacattctagcactttgaatatagatagatatatgtttagattcgtagtactaggatatgtcaaattcggtaatagatttattttttatgggacggagggagtactattttgtggaattgtttgccccctgatgacctattatttatcgtaacaatgagataaactagtaaaatcataaaaaaaatgttccaaaaaaatttagataacatattattaggagtttaggaccacacgaaaaatttatcaacaaccaggactatctagtatttcctttttcatcagaaaaactgatttatatcaattcatatatttttagttttctgtgtggaacccagtgccttcttaaaaaaagtatcactactttttttttattttcaaaaggaccattatgcccctccgcatgcccggagcagttttcccattcagcctttctcccgtccacgcgccatatctctctccccctcaacggcgacggccgccgccctcggatcccggcgagagacaaccttctaccttcctgcccccttctctccccttcgagttccaccccttgcagcgccgctggcccgcccccttccggcctcagatctgtcaggcacggctatgattgacgcgcgggcgatacaaggtcgtgggcgcggcggcggcggcggtggccgcagcggcggcgactcgaagctgtctacgcgagcttgccggaggtcgagattatcttggtcgtgggggacccagcttcagcgcgtcgcggcctccacctaccttccctaagattccctctcgtcttctcctcctacttggtttcttgggaccaagagaaattgtacgccatgctgcaagaattcacctcaagtttgctttgatttcttaatctgattcgccgtccacacacacgatgcgatcagctaggctcggccaccgcccgttttgggattcttttccccttccc

SEQ ID NO: 108390 - DNA, 693 bp, Oryza sativa
taatgtaaagacatttctccaaatattaatatatatcaagtaactagatataagtaacacaaatcacatatttacatttaattatatgaggttgagatggttagtacattgaagataaaaaatgatcaactcaagaggtcatgagttcaaggattggtaagggataatatttttctttctttttcatattgatttgctatatttgccgtaaattctttctttttcatattgatttgctatagttgccgtaaaattcaccaaatggcacttataaaacactcttcaaaatgtctctataacatggtaaaggcattttaaaaatgtctttatagtattaggaaggcattttaaaaatgcatgtaaaggcgttttaaaaagacactcttcaaaatgtctctataacactgtaaagacattttaaaactgtctttatagtattaggaaggcattttaaaaatgtctctatagtattagtaaaatctctctacaaggtatatttgttgtagtgcaaacacatcctaattagaatatccgtaaattctttctttttcatattgatttgctatagttgccgtaaaattcaccaaatggcacttataaaacactcttcaaaatctctctataacatggtaaaggcattttcaaaatgtctttatagtattaggaaggcattttaaaaatggggctgcagga

SEQ ID NO: 108391 - DNA, 815 bp, Oryza sativa
tccaatatgtaatgtgtgtatgacaggtgggaccagatattaatagtgtggtatatattataggtaactattgtatgaattgactataaatgatttggagccagtagtgggctatactattaaacttgctcttatgagagctaacattctttatttttgtaattttctctcacctttacataagtttatagttggcttatagcctagtattaaacttgctataagagtttgttcgattaattcctatgaaaaaggattagagaggactagagaagagattcatgtaaaaatagaaagtggggagctccaaataccgctcaattctctagagagggattaatcgaataaggtctaagtcatgtgcacattcactcgaaagctctcttgtatcgtaggagtaccggatcactgaaaggagtaatgactgagtattactattgtatgttatctacttccttaaaaatctctagtataaatcggtagtaccctgcatgcgcaatatagagcacacgtatgtttggacaacattttctcgatatggtttagactgtttcaaaatacgtgaccaaaataacaaaaaatagttttggactgaaattttagtacttgtgcttctagcaatctagaagacaagattgaaaaagataaaaataaaaataaaaaaactcttaaataaattctagtatttaaagttgcctagggctcaaacaagcaactcatttgccctatgctaatgcgatccttaggggtatgatttgatgataaaccgagtatacatgctctcacaactcgtaccatcatctgttatttaataa

SEQ ID NO: 108392 - DNA, 780 bp, Oryza sativa
cagccagaaacacaaacacaacaccaactgcattattacctctagaaaaaaagagtctcttagggattatgaaaaaaaactagtcatttactcaagtaactcagctttctaaacaagatttatcatgcaaactccaaaagtctaaatagaggaagaggcccaaaatatgatataaaattacagatggctcactaagaaagctgcaaatcactggccatagcatgcccatccacaatttatttgatactattatgccagttccaggatggcatatctcgttataaatggttgagaaagtcatggtctatactacacttgtattcaatcaacaaattcatttatagcgatccgtatgttcaaaagatctgctacagactatgttttcttatggcgcgtgctagatctacattactgatatggcactaataatattacttctggttcaacttgacaaatcagtatgctaccatagaattataaatacagggatacatgaagtaaaaaacatctagcaattttaccaacttccaattcagatatcatttcacatcacaactttaaaataataataaaaaaatcagaacgcatgtattgggaccaaagcggtcgagtgagccacacttgatgtaaagaagaaaactgtgtggtgatcaattaatcatccataaaaattcaaggatagcaccaccaaacagaattagcacaaaacttaaaataaggcccggaaacccttttcttgttcaaaactgcctcaaatattcagccagctaactcctctct

SEQ ID NO: 108393 - DNA, 534 bp, Oryza sativa
tgcagccccaatccacgtcactagatggtcagctccaggaaccatccgcgtcactagatggtcagctccaggaaccttggcattgatggaataagccttgtgctcttagtagccttgttggtttttggtctttgtcgttctgttttgcttttagcatcttaggacagcatcctttcagttttacttttagcatcttaggacaacatcctttcggttttgctctttagcatcttaggacagcatcccttttatgctttatgttttcctttcacctttagactagcccgcagctagcaagctatggctataaatatgtatccaacctcccccggatagtatgacttggtactagagccactctatcctgtagtctagacatctcttgctcatccccttcacgagctcccctctgtcctcaaccggcagatggaacatccgctattcctgctcatccctcttcccctgcactgacgagcagcatattgtcagacgctaactctacccccacactgcatgcccccaatagcatgccat

SEQ ID NO: 108394 - DNA, 917 bp, Oryza sativa
  unsure (1)..(917): unsure at all n locations
tcacatgatttccaggaacgtaagagttcatttaaccactttaagcactcgtcaacttattatagatgatagcccattaaattctgaatctcatatgagctcatcgccaacaaaatattttagatacaatttttgtgcatcaatattggccatgttgtgttacgcattcctggtaatgcatatgtgagctcatatgacagttgataatgagctatattctataataagttgattaatataccaattgtttaatgaccnatcacttannaaaanannatntngnnccaacctttggggggccccccaaanaagnggggnaaaattttcgaactcaactaggtggcaagtttagacatcttaccactacaccattnangnncanangggatgggtcgtgnnnnatgctnnnnnnntatgactctactctcacggncacttccccttnnnnnnnnnngnnnangtggattttgtgccacttgtgccatggtatcaatgntaggatctttggtgacaaganntattgaggatgtttgaatcccaagcaaggaaaagcatagcctagcctagcaaggagagttgcttagtgttttttttnaaagggnnccaaanaaaaaaaagggnnaaanaanaaaaaaannanananangtanttgcnntntagttaagggccaactaactaccgagaaaagctcacccaagacaaaaagccaaatcggttagcatccgatggcaatttgtcgggctaaacatccaagcattgtacttttgctttttatgccatagctttcatgggctagcttgagcttgctaggccaagcaaaggtaattgcacaatctaaatagaccatgaatattggtgctaatgatcttggagccgagattcaggtccaattattttataagttcggtcaaggtct

SEQ ID NO: 108395 - DNA, 702 bp, Oryza sativa
tgtgtgtccatatatctgatgtgacacggcaaaaattttcacccctagatttaaacacagcctaatatagaatcaaattagatacgtttcacgtttcagtactatgaatttgaacatatcacatgctcatatcaaaatttataatattaaaatatgtctaatctgatgttaagtaattatattttacgacggaggaagaactagtagctaaataaaaagagagataacggtgtgtttagtttagaaatttagttcgaaagtttaaatttcttatttaaaaaaaaacacttgtaccaatgaatactgatgagtattttttttttctttttacaaaatgttactatagattagaatgtgtgacccgtgataatcccatgttcgattagctgaaaaagtagaacccaatctagcactctctctattttaggttagaagacgttttaattttagctaaagtcaaactgtttttttaagtttgaccaagcttttgaacaaaataataacatttttaatccaagttaaatttactatgaatatattcaattattgatttgatgaaactaattaaatattataagtgatactatgtttgtttatagatttagttaaacttaaaacaaatcaaaaactcatcctgacgcatctctgaacacaagatgacgcattgtgccaaaagacacgctcgtgtagcagcgcagcatc

SEQ ID NO: 108396 - DNA, 2554 bp, Oryza sativa
  unsure (1)..(2554): unsure at all n locations
tttgttaatattagtatattattgattaatgtgagtatataccataccatgaatgtgagtaactttttcccacgtgtgtttgagctaatgactaaccctcctttttttttctaccttctttcgaagttctccttaatgtgtcgggtaaaaaaatgttttgttttgattaaaataagaaacatttttgactagattatttttaaggagaatccactatgtgccgcttattttgtccttgtactataatatggcactgagtttgttaagttatacaatatgccatcgtattttgcttaacctctataatatacgtcaccgtccatttagacttcgttagtactgtataattttgttctaatgaccgaaatatcnccgggacagaaattccaaaatttggctgaatattctgaaatatcatattataaacaaggcagagaagatattcatctcaaactttggaagttttacaatctgatatttggaatttttcgtcccatggctatttcggtcattatgataaaattatataatactaacagatgctaagtagacaacgatggtatgttatagaagttaaacaaagtgcgatggcatattagaacttgacaaacctagtgacatattatagaataaggacaaaatcaataacacacgatggattctctatatattttaggaaaaattagaaccatgccattataattttgcaaaatctgatatatgtcatcctgacccacatgtcattgactcatgtgggtcctacatgtcattgagataccgatggcatatctcaaattttgaaaaattataatggcatggttccaaattaccctatattttatggttgtttagttcattacctatctactatcgtgcaacatttttataaaaagttaaatcttatgctataagttcatatcatacacattaaattacatacacttataatataattttcaaattatacaatgccatcttcacattttataggagaaatatgaaaaatgatttattatctatttaattatgagaaaaagtattagtccaaattaatgtatatgtagaaaaaaataatatgaaagaattacggaaatacctacaatcgtatatcatgcagtaagaaaaggagaccacaatcgaatcccttattgttgagcaaaattgatggcattaattttatctttttttagctaaatctatctgactataattaatcagcccgtgttagtagaagtctgcatcttcatgcatcaatatatcataactcataactcataagactattagtaatagccaagtacactgacccaacaatacttaatatatcacaagactatcgggtaatggacaactcatctttgattgtatatcacaggagtatcggataacagacaactcatctttaattgtgctaaagaaaaaaaagtaaattatagttcgtactatgtattcttaaatgttttcatattatgtcagcctttaaccattcttttcatttacagaacaactaactttacatttcaatttggaccaacctatttcatccatctccaagtccaatgactctataaccacacactaactctctctttctctccattttattttcccccgatagttggggaaccgctagatccagcaagaaggaagcctggatctagcgtctccactcttcatcgggtcgactcctgcctccgtgagtcgctacaatagtatgcatgacaagagggagaggaaaaaaagatggctcatggagtgcaactagagggtgcagttgcgcatgcaaagacagagaggagaaacgatggtggctcataaaaaaagagtggtggtggcggtgcgtggagtaatagttagtggttactggtagtatgaagagtttgttgtcgactcaaatcgctaactgagtttgttaatttttagaatgtggaccactagtcattataaagaaatagtcattataaaganatagctagtcttataaagtagtaaaatattgagatatcataaaggtgagagtactcgtctagagcttttaactttttaccatttttaaaatatggtaattaagaatttactactcacaatctataatacgtggatccttatgtgtatatgacacgagaatgctccttctcggtcgcgcgaggggaggggaaaaaatcggtcgctccacccttcccccatcacgtgcgcaccagcaatctctttgggcccccaccacatgtcccctgtccccacctgccacttgtccacacacacaactctattgcaacaaatcacccacatattttgaaaaccctatattaagggaatttggtttactttttgttccaccaaaaaagtttcacgtagtgtactcataatgtttcactatgtatagatctaatgttgcagtgaactaaaatattccattgcaacaaaaaaacccacatattttggaaaccccctattaagggaatttgatttattctttgttccaccgaaaaatgtttcacctagtgtacttataatgtttcactatatatggatcaaaagttgcagtgaactgaaa

SEQ ID NO: 108397 - DNA, 844 bp, Oryza sativa
  unsure (1)..(844): unsure at all n locations
aaatattttcggaatttcttttagtttttcggaatttccgaaaagcacagagtaaaatgactataacttttcgctcgggagtccattttagatgatcttggactctatggaaagctcattcagaggactacccaactcaaccaaaaacaaggtctaaaaccactcaaaggataggttaaagcttgggtttctctcaaggtagcactacgataggtcactttgagcaccgagacatacacaaatacctcgacgttgcatccctcttaatagtacgacattcctaaactcaaatgtaaataggaagagaattataccaatagggatgccttctttacatctttctttcatgtcttaagggacgccaatgccgaaaccgtttcaccatatattctttaaatgattgatgcggttacttgtagcttcaaatggtctcgcacggtccatcatgacaaagccgtcactcttccgtcaccaccgatttggttcttcggtgccaagccccttgcttgcccttcaccgccgcatggtccatcgtgaccgaccatcgcttgcccttcaccgtcttgccatagtagccactttgtatcccacatcttcaatatcttcactttgtcattcttggtatcgttacgtgtaattatatcacttgagcatcaacacctttgcaatccttgggacctatttctttcattcaactcaataaaatattagtcccaatgatccggnntgtcaacctcacatgttgaccaacccatcgcatgtataaaatgatatgaataaatgatgagttttnatcaacaccacaagtgtcatatactcaaatatatgctcaatgtaangatcc

SEQ ID NO: 108398 - DNA, 569 bp, Oryza sativa
ctgcagccccgggaaagaatgagagagggagaaaaggataatgaagaaaaaaagaaaaaaaatcaaagggtagaaacgtacttacacatgtgtttcactcttcaattcttccagatataataaaataatcacgcgggtgtccagcagctaattaccaggtttttgtggtgccctacagcggaacacgttcttgcggtgtctcctagctaattacacttttttggatgtcctgtaacaaattttgccaactaagtaaagtaccgaagatatataaagaagagtattccattaatttggaaagtattacagaagagattacaagagccgctagagccataccgaaaactcttccgaagactcgatgacttccgaacactattctattctactccacttagtactatactactaatactaaagtatgaagaggactttagcttgcttgagtgtgttgagagagtgaatgaactcctccttttatagagctggtatgacggttgtagaaacacgaaatgtcgattttgccattacaaccatcgttgagaagcaatcctggacgtccacgtgta

SEQ ID NO: 108399 - DNA, 661 bp, Oryza sativa
ttcctgcagccctggttaattaattgaaatatgatttacttggtgggttgtgggtacatgcatgatttcatttggtggtcgtgcccatgacaattaaggaccagttctcgagaatctctggaagatatactcatactaaccacaagccagatgggctctaggctgaatcttaagtataatcttttctagctgacacaccgttggcaaggtgttaacaatgaaatttggtaagcccctaagagaattatcacattaccaatagtcaaattcttgctatattcggttaaggaaattaatcgaataaaaggatgcatatccagaaatgaccgagttcaaggaggatgcggcatggcaagttatctattaattagaaatagtttgttagtttccttttatctttaggaaagtgtgtttagtgtcctataaggactttatgttttccttttatctttaggaaagtttctttcttgtcctacaaggactagtatctccccatgggtataaatatgtacacccggggtcatggtaatttatctctcgatcaatactactctcggcgcatcgccatcctctctcctgaggtttttacttatcaaccggcggaatttggcacctgacgcggggctgcatcgggtcagttcgatctccagcgaaggggtaa

SEQ ID NO: 108400 - DNA, 628 bp, Oryza sativa
ctcctcgtgtgtttctccccgtagacttgtgagtatgttatttctgagttcttggcccatcttcctctaagtctgattcacgacagcggcggattgattgatcgtctattttgctatcgattctcctccatttattctcattctatacaaaaggttagaaaacctagtgctagtggaatatttcttattctaacatgaatatgcattgtaagcataactagttctcctttattttagtaatattgacgggtgaaactgatcgctaactgtcacgcccagaaatttagcccaaatttccagactattttatgtattaaatccctatctaggaccagccagggtacacaaaacgacaattaatatatagatccaaacgtaaataaagcgtaaaatacttatagaagaggcacttagtcctcacatcgaaacaaaagcagcagcaatggaaaaaggcgatcctagcagggcttcagctccactccataggcaaaactcaactggggtctgagccttggtcctctaacttcgtcttcagctcagaagcactatagttctgaaaaatggggaaatagcaagctgagtacaaccatcgtactcagcaagccacaccaatgatgcagacgtgcaa

SEQ ID NO: 108401 - DNA, 1088 bp, Oryza sativa
aaaacacagcagaattacgatgaaatgagtatatcgcaatttctggttttcatgaagttccaggaatacaaaactagtccaaagaattggcacataaatttaaatttcccggtaataccaaatatccacatggagacatttttgtttataaagtatttttatacttttgtcaattttgtcagagaaatcttcaaattgcatcgtctccataactcgtgctataagaaactagactgttacatattaaattgaaaagctgatgtgcacgagggtgtcccgatctttcgatgagaggataagtcgattggattgagtgacgttggcgatctgactacaactatccagggatgttgctccttagcaatcgttacaccaactccaaaggcagtcgtgaattgcatagtcagcctaaccacaagggtatttgttcctgcaagcactcgagaactagcaagaacaagatgaacaagcaactcaatttgcgaactaaagatgtaggattgaatcaacagaagtatcataggtggggttccgtaccgagcaaaccggcgatctaaccgatcatgggattacacggttcgctactttgatctaaacaaaacccaaattgatctatggggtcgtcctctaaccctaagacctgcccctaacggactcaacttgatacacaacccattgggcccaaataagttgacgcaacaccgttggcagaaaaaggtctagtaaacggcgattgcagcctctccagaacagatttgacatgaggccggatccatttgaaatagacttgataagttttcgatgaagtacttgcacgccaaatcggagttcgtatgaagtcgtggcgatcgtcagaagttggtgctgtcctgcagtccgaatccagcctgcgcgaatcctctcccctctggatcctctccattgttcctgagtaaaacaagagtgcacgtgtctctggggtataaagatgatgaacatggactcaagaatgaactcacctgatagttgacttgacgtgcacgagcacgggtaataggactatgaagttggacttgtggagatgtggatgtaccgaggggctgcaggaa

SEQ ID NO: 108402 - DNA, 586 bp, Oryza sativa
tcggagtcacggtttgcaagatatgaatttccgaaggttatacggattaataatccgaggaaaaggtttcctttcaatgaatattcttcgtgaggccgctctgtcagtgggattaaagaagaattagggagatgtttcaaacttacagagaggaactcgggttgtaaggggatgtagtatgaacttgtagtggataaagaggccgcaagtgggctcggcaggggatgtaatagggagatgaaatagacttttcggcagcgtcaaggtcccgaggagtcacaacacagtaggccccaccggtgggtcccacagctttttcttttcttctttttattttcttctctctcttatccttccttcctcttgtcggtatcttctcttgctctctccccctcgtttctttctctgcttctcgcttcttgtgcgcgacaaattggacattacgccactgtaaagagtgggtttcatcagtatcgttaaaatgccactcccaatgaatgccaaacatttggttttgccatattcaccattttataaagttttcatcattttccacacatggtctgaccaaaatacccttcggtcg

SEQ ID NO: 108403 - DNA, 677 bp, Oryza sativa
actagatagttgatatggttaaataggcatgtggctaatatgggtgaaggttgagcttttgtagaatagtggctagggtttagttgtttaggccgatatcgaggtaggataaatattggctagggttttgggtgttcgctagtcgtcgctagagttggacagcatgacaactaggtttggtatcatttctagccgtgttgatagacaacatatcggctagaagaataggaggtgggtgcagttttagtggggtggaagtgttactccgtcaaccgtgagtagcggcggagcggctaggatcacacagagctcaagagctaactgtgcggcgtgcaatggaggtcaaggggatagtgaagctctgaccgctgtacgcatcaaggcgtggggtgccaggagcagcacttcgaccttaggtttggtttttgccgggctttacaaccaacggtttgacgttgaggtccgtagaccgcgcaaacgtccccatggaaggcgtaaagccggcggctttttagtggctaaagggtattttggaaataaaagaaaatatttggaaagcaaatataagtttaaattgtaaattcaattataagattaaatcaaatatttattcaaatggtatttgaataaattaaggaaattcacataaaatcttaaaatagcaaattgatatcaaa

SEQ ID NO: 108404 - DNA, 832 bp, Oryza sativa
gcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgactttgaccgtaagacaagccaactggaaaccctaagagccctctgaaccccttttttcatctgcatatgcctttttgcacctggaattgtttcgggaaaatttggagttttgcctctttggtttgcgggaaaaatcttggtcgttcattcggatcggattttttttttaaaaaaaaattattagctcagtctagggctttagaaaaattttagttggagtttattcgacagtcagtcgggaatttattgggggttatgcattaggtcgtgtctatattcgatgggggcaatgttatgcgcatcattttctatgcaactagtctatgcattaatttattgtttagttgcattagtgtctttatttgagttcatgaaaaatgttctatgcataaaaatcatcatgctcggttatttatttgagtcttcttttgctcggtttaatttggatttgagcatgaattggttcctatcccttgtctactttagatgtcggtcctatccctcgtttgcaagcgccgccccgagcttcacagtcgccgcccttatctttatcgccttcttagtctgtttgcttgctagttttcgtgtttaggtttgttgcttgagggttagtcggcggtcgatatcatgtgtcagtggtatgactggctcaattaggagttgcgtgcctctt

SEQ ID NO: 108405 - DNA, 1547 bp, Oryza sativa
taggagaatatgaatgcaaaaatggtacgttgatggtatacaatgagaggtgccgggagttgatggatggatttcggctggtaactttaaagcatgtatctcgggagcaaaatgttgaagctaatgatttgggggatgctatacaactcgttcaagagtatattatttaccgatttgggattcctcaaacaattacaaccgatcaagggtctatctttgtgtctaatgagtttgttcagtttgccgatagcatgggtatcaaaatgttgaattctgcgtcgtattatgcacaagccaatggacaagccgaggcgtctaacaagagtttgatcaagttgattaagagaaagatttctgattatcctcggcaatggcatactaggttggctgaagcattgtggtcttatcggatggcttgccacggattgatttgaggcagttttaccatgggaacagatttgcagaatgagttgtcagctaatgaatattataatctcatggccgatgagaaggaagatttggttcaatccagattgagagctcttgcaaaagctaccaaggataaggaaagggttgctcaacattataacaagaaggtggtgcctaagtctttttctgagggagagcttgtttggaagctaattttgccgataggaactcagataacaaattcggcatgtggtgtcacgcccggaatttctatccaaaattccaaacgcttacatgtgcgttaaatcctcatccaggaatcagccgaggcacacaataacaaattgataatagaatactatcaaacagctaattaatattcgcaaaataataaattattatagaggtggatagttcctctcaaaagaataaaattctacgcagcggaaataaacataagactaaacagctatggcgactccactccacaagcaacttgacccgaacaaagcctaaccctcctgatcatcaccttcactaaagtactcctcctctaatgaatgaatattgcaagaatgagcatatgacatactcaataagccacacaacaaatatgcaagtgcacaggataacaaagcatggcataatacagctcaattgcataaacaacatttaataaacatttgagagaacagtaaaacagttgagtaattaagcaatattaaatgaacactatacaacacacccgtgttgcataggcccaacctcacctgaacaaccaaccccggttgtacaaatcaaacctccataccaggaatataccattccaaaccaggagtcaatttagttatcacaaactatcaccaataatgagtagtgtgagactaatgacgaaaaacattgttaaactcacccataaccgcgggcacggctattcgaatagttttactctggccagaggtgtaccactatacccacaagacatagctccacaacatgtcaccatgcgcctcaataccaccatgatatctcggataggaactgtgacagtaccccttacacaacacaatccaccacagcgcaccgttcctggatcataatcaccccctcaataacca

SEQ ID NO: 108406 - DNA, 537 bp, Oryza sativa
atgcacagcaactattgattccaaatatgtgctttacaagagatagagcatctggcctttccttttgcttaatatgtctaacagcagtaaggattaaggaacactcagacaacatactgtaatcataggcaatgctagatttcaacacatcatgggatctgatatgtgactataacatgccatgtaaagatcgctccatacataggagatgttaatccaacagtggtaatggaccaattgcataatcctctattttttttcccattgaactttgttcaaaaactgaattgatagaactacttgtaataaaatcaaatgtcctagcctacataaaaatagtaaaattttagaacagtacaatgacacggaatgttaaagaaaagaaaagaactctttgcattaattaaagctaattgaatgggactacaaaattatctaaagatgatggccaaatgtgtcctttgctaccaaaattacaggaaatcagtattgcaatctacatctagcaacaagctactgagtaacacaacagaagat

SEQ ID NO: 108407 - DNA, 583 bp, Oryza sativa
ttttttaattttgcttccaatgccatgctcacatagtttgagaactaactcaaaccagtgcacatcagctgaaaccaccatccagaccgttttaggatcttgtttgtactaatgagggatacgttagacgcaattaacctcaacccttagatgagggacctgggtgaactttttcatttcggaccacgccaatggtctaccgggacgggcccaacttattcagtttcaccccagaaattagatcaaaacaagcccactacgcccatcaataaaccctagcagggtaccagtccaacacccgcacgcgtacagcacgccgccagctgctgtcgcttctcggctttcctcgcgagtcgaggctcgcgtcgcgtggtcggcccctccgccggccgttccctacttccttcgccgccagtcgcccggaaagaaggcgcatccacccttctcgctgagacatttccatcgagccacccgcaggcggcgaaggaagggattgcgcggcgcgatggagggaggcggagaggatacggcggccgccatggcgatggaggtggagatagaggcagaggccgtcctatgcatg

SEQ ID NO: 108408 - DNA, 576 bp, Oryza sativa
agtagctccagtgcttatcctgtggtatggtcggtcccatttactggtaatggatagtgctctgctgtagatctcgtcagtcagagttcctgtagatcctgtcgatcagggtcctgttgcgttcccacgagtgccgtcagcacacagtggttccaggtcttccggggtccttgaacggtcagacactgtgctggtccttattccttacggtcgaagcttcatgttggtcccatgcttctgttgcctcaggttgctaagcatacgaatggcttcttcgcggtcagctaatcataattaggcctggttggatcttggtgcagctggttctgagcgcccacttgttagtggttgtcctttatcttaagcagcaccagatttagaaaattggggaaagaatccaccgggaggaaagataaggatttgagtttgaaaaggggatgagaaactaacccacaaagattgcccaaaaggtggcagcttcatagcaaggaaaacaatacacaaataatggatcgctgtcccttattgcgagaactcgcactagtgagcggattaatacaacgtctacaacacaca

SEQ ID NO: 108409 - DNA, 1331 bp, Oryza sativa
acagacctagatattatgttaattaacaatgtggtacctctgtacagtggttcttatgtaagtcctcgcgaaggaggcaaatatatgctgagcagggcaaatgtgatatttaccgaggcgcacataaatatcttgattatcgcgcgatgtttgtgtgattttatggaaacctggttgagatgacgtggggtctctcctccagttctctctaaaaacctcgggaactccagaactcctctcgctgctgataacgttacgttcagagcgcatggggactagagttcatggaacaggtgccacaattgttaataacttaatactgggccatgactaagctaatgattattagcaagttatggactgcgggtaaagcgtacatctactgcagtatgaatatgtttaaaactattcgaatagccgtgctcacggatttgagcatcgggactgatatggtactttggttagaaatataattcaagattttcttaaatactgctgcatatcaagcatttcaggatttctacctctttattctcagcattctgcaagtaaatctagctctacacagatattacctctcatgcattcattgttgaataatataatagcttgctgagtacgttgtactcaaccttgcttcaacccctctttttcagagtctatttggagtttttgccgaagctgggagttcaatcatataagttagtttcattctaacttaattttcaagtatagactagatacatgggttaagtctatagcaaaaacattagagttcagccattctatagcttctgctgtaatagttagccacaaacttgtaaatatcctattattttatataaagatatctcctttggagtctttaccaaatgtatgcgatgaagatccagattgttgaacctgtatcaatctactgatccaaggcttgatacaattaaacatctcggtttctgaatcgttagttttgggatctgacagcggcggaggtgcggccgaggaccggcgggacctagggagtacagaggagggattaagagagggagaggcttcgcggcacggcgaggaacaccggccgagcacggcgtttgcggcgggactcaccgaggagtgaggggaggcgattacggtagctcccggaggtgaggaggtggtggctcgagggtctcttcattcttgcggagccgaaggaggcgacggtgcaccgcgaggaggtcgggaacggcggggatcagcgaccggaggtggcaaacggcggcggtctcgggttgatggcgaaagtggtgcttcggaggtggactgggcaaactaagtggcagccggtcttgcgc

SEQ ID NO: 108410 - DNA, 553 bp, Oryza sativa
ttcccctataatttcacttgattaaattgctttaattttaatttaatttctagaaggtgcattatttaatgatttttaatcccgaacgaaaatcagggcgttacaataggcgttcctaaaaaattatcacacttcatagcatattggagagatgagaacttttggttcaaatcggaacttccagtataggattgaagttccggtctcaagcaaaaagttcggccccggataacgaaataaaacactagctatgaactcgtagctcgaataaacaaaatgtatatgaatcaaatggtgacaaataaggtatctaagcaagatataaggtcaccaactatattaattaagcatgcaagtagatcaggtaaaaacaagatcaagatatgagagatggctagaacgagcaaaccaagagaggagacacgttgatttgtttcccgaagttcggatccaaggatcctacgtctccgttgagggaccataaggccgggtctatttcaacactttcttcacgaggttgcacaaatgcaatcatcggtttcagggctgcagg

SEQ ID NO: 108411 - DNA, 1408 bp, Oryza sativa
  unsure (1)..(1408): unsure at all n locations
ccagaagctatcaaattattatcagtttagcatctttttcaatgatgagaggtgtgagactaatcacgaaagacattgttagacccgcccataaccgcgggcacggctattcgaatagttttactctgatcagaaggtgtaccactgtaccacaaagacacaaccccacatcatgtcaccatgtgcctcaataccaccacggtatctcgaaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgacccggtccttaattgccatgagcacgaccatcaaaaccatgtgcccacaacccaccattaccaggttttagttggcacattaattaattaactaatcacgattgaccatcgtgaactatcaataagccatcatgaaataatagtgagtcataagatacnccatttatacgagctagtgtctctaagcatggctaagcattctagcactttagctaaaaccatataatgttctagctaatccaattattaaccaagtgacaaagaataggtaatcaataatcaaaaggatataacaaaggcaataggttaattccacccaatgacattcgaaaataaatgcaatagttgaaaagaaacaatagctttaaataggatcaacatgctcaaagggttgtttgggatctgtgtgacttgccttgctggccttgaactcttcaaactcttcttccgcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcactaatgaattatttttgaaaaggaaaaggggatttattgcgtcagcgggctagggtttggtggaccgggcgcacgggcgggcggttcacgcgaacggacggccgagatttaaccgatccaagatggacggccgagatcgatcggtccacggcggctcacggcggacgaccccgatgacgtcagcggtgacgtcaccgacagcggcggcaggctcggcggagaagacggctcgaacggcgcacgctcgccggcgaacggcggcactaggacgcaaacgga

SEQ ID NO: 108412 - DNA, 590 bp, Oryza sativa
cggattgaggagaaggattttaatttgtttttccgttgaaataatcactgaaatgaactttatactattaaaattaaattcttagctctcaaaccaaagagtattttagggaatgttgagaaaaacttcaggcatgatttattaaagaaaatttaatttcccatctttaattaacttcttaattgatattaattttattataaatttcaaaaatatttcatgaagtaatttaaattacggaaaaaaatcagagcgtgacagcaggaggagaaagaaacctagttttcaaggccgcaatgaagagcaagtaccatctagaaaaattcaaagagtaagtaaatgactgttaggttgtactcctaccatgcatcagttaacgttgtcattgcaagcacatttctactccatacaacatacagggttgaagggtgttacactgtcaaaagtgtccattcgcaaattctgtcaaaaggttatcaatgaaaagataagatatagattctacctcaattctggtagaatggtttcaaacttcttaacaatatattttttgtgaaaactttctatatataagttgtttaaaatatcaa

SEQ ID NO: 108413 - DNA, 654 bp, Oryza sativa
tatcacctaatgttgacaaaggacgggtaacaagtaaacatggcaaaagcgagcaaataggttatacctgatcccatgtaattagcaaaacatgcatatttatttgcaaacagtaaaatatttataaattaggctcaatatgcttaaggggaatgtgtgacattccttgcttcttcacttggatcttctgaactctttccctcgcgaccgcgaacttccggaacgacggagtctacacgctggcacgcaaaatgaggaaaaactctaataaaaaccaagtaaatagtacataaaaagtaaacaaacatgtagagctcaattttagatgaattttacaagttgaatggaccaatatggagttcgtatgaattagatatgaattttagaagttttgagccatttaaatcaatttctagaattaaatacgatttattgcacaattattaattaatttctcataagaaaagggctgtcgctgacatcattaaggggagaggcgcgccaacaggcgggccccgcatgtcagtggcataaggggaggcacacggtggactcggttcaccgcggcgggggcggcaccgtggacctggaccataggaccgacggcctagattggcctgaagccgatccaacgggcacgggcggcgcgacagg

SEQ ID NO: 108414 - DNA, 820 bp, Oryza sativa
ccgtcctccaaaaccaccgagaaagtcaaattacactcattttgatagttgagaggtcaatatatctggtcggtttaagaatacgaatcagattcgatgagtagttaagggagttaaagtgaacttattaaaaaaaaatctcggatgtttggttcaggggagggctgcctcctgcctgcattgggtttggctctaactagtgggccgttttagttatatagggctacaacttttggcccacttgtccaaccaagcccactaaaaattctgagttggcctactatgggctacgaccaggtcaagcaccctgtcactcacacaaaaagtcaattgtcaccagatgattgatgaaaaagtagagtaacgacatcctgtcgaccaggttgatacaagtgttccattgaaaagtcaacccgtcgatccagttgtcctgggacgaattgatggaatttaggccgccagcaagcaaagaccgagctgagcagctccagccgggtgttatcagggtcaaaacaatccaaatattttcaaaaatttcagttcgtttgacttggtttctggccgcgacgtctgctttctctcgcgtagcaagtggtcaacagaacagtaggttcctcgtttgactatcctatgtaatccaatattccctccaatgcattgctacactcattcggtcattcactatactttgtgtacggatttttatgtgaccagttgttccatcacggcaagggtacatgccagccgaacaccttagctaagtttggaatatcgtggcacactcccgcccatgcaaacctagtacaaataaagccccaac

SEQ ID NO: 108415 - DNA, 1222 bp, Oryza sativa
aataatcaagaaaacaacctgcaaaggaaaataaaccgttttcccataaaaaacaacatcattatttgagagccaaaattgctcggcacgttgttatcgtctctagtaaaaaaactggtctaaactttttgttatgtcgcaaaatccattacccaaagatattggacgcgtttatggatgatcaaatacgactacgagtatactccctccgattctatattaattgacgttttagacacggttgaggtcaaacttttataactttgatcatcgataactttaaaaatatttagtttaaaggaactagaacaacatgtatagatttgtctttcaaagcactataataaaagtaaacatgtatttatttattatttatattataatagaaaaataaggttaaagatatattttgtagaccgtgtcattgtctaaaatattaattaaaatgatacctccggagggagtaggagcgtactaggtgctactgcgtttgactttgactgggagcgcagcgttagggtgcatcaccatcaagttcgtctctctcactctctgcttctcactactcgtaaacagagagtaggcaagcatggaagcagctagcacatgggagtgtaggcggtactgcgcttgaacttgtctctaggcgatgggcggtgggagaacccgggaccgttagctgtgtgtgcatcactgcatatttgcatgcagtgcgtgacgaattatacttgtgaattttaagtttgtaaatttttcagttgtaaaatacaccgtttaccatttttcttagttaggaatgaagcccgcgtatttacaagacaatatgcatcgtaggttacttttgagatacttattgtttttaataaaaatgccttcgagtggtcaaagcgtaaactacctaattgtaaaaacaattaattggaagtgcggtctagcgggccatgcaaaggcaggcaggttcgatgaggcttccggccttccttatctctcggcaaggtcttctcacctggctgaggtcctagctaaagcatgccgtttgtggcaaaacgcaaaagcgagtaaaagaatgacgtgtgggtcgtctggtcttcttttcaacgttataatgggtgtattcactttgacattatttttaaccataccattttctttaaaattgtcaaaaaaaaatgtctacgtttagtttgttactaaatttggttaagaaatcatactaaaattt

SEQ ID NO: 108416 - DNA, 725 bp, Oryza sativa
ggatgcttctggtgacgatgaggtccctttggcttgctgcctttccgtgaaaccttgaagtgtttcgccaaaagctatactaactgtcgttgcctttgatccgaaaaggacgcatctgtaactcttagtccaaacaaatgtctctttggttaatcacttgatttttcttttccatcctcaggttggttattagctcgaggttagaatatagttcctctggcacgagaccctaggtctcctttgtcagtaaacaattatacacatgatcacatatccgcatcttccaaaagaatcctcttagaacttgtttttattaccaatttctcccatattacatgaatacaaggcactgtcttaaacaaaaagggaaggtgcttaacatcggtacattgtttctactatgggttagaattaacatgaggcctcacaggtacggcgtttgctccagtgaccacaaggcgagtgacttgtcttcttcttgcataatggccggagtgatgacgcaggttacgcttcggctgtggacaatctctggagaaatgacctggttctttgctctgataccagcttgtcgcgaccgggaaaattgccttttcccgaacgctagtgtattaatccccgtcccaggaaaagccggggtacaccacacaaacatgatataaaagacacatctttattatatcgataatattcacattattacaaaggcgctttaggcctgacaa

SEQ ID NO: 108417 - DNA, 709 bp, Oryza sativa
tatatagttagtcggagttctccttgggggtgtttgtatactagtaagatttgggtctcccataatccattggtaatatgaatcagggtggcctccttttgccatgtattcatggatcttactctttttaattttggttgaagtacaacaaggagtacatttttgctattatatgtttaggacaaaaccgggagaacttgggtaaaagtgccccttcggctgctctgatcaataaatttatctgcaattttctatcgatgactacttttttaagtttttcagatattttgttatgtgtgtatattgcaagtcatgttatgtcagtgatgagaagatatttctagcgttttatttaaatccacgcttgtgatgtatgtgagttaccatgtttattgtaactgctatcactgaagatttttgtttccttttgtttttggcttgtgcagggatggctgatggcttactaaagattaaagagcataaaaagtgctagaaatcaggtatctgttacattgtagctaatcaactagtagcattatttacattgtggtcaactaaatttgtatgcagaaggcatttgatccatcaacttttgcgttgttatccccacgactggtgattaatttttagtttcgcccatattcagttaaattggatgctctctatatttaaactgaaacttttttttatgtatccaggtattttcatt

SEQ ID NO: 108418 - DNA, 1315 bp, Oryza sativa
tttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgtcagccgccttcccctcctctcctcctgggccggccacccggcccaaccctagccgcgcccccgcccgtgcagcgcgcgtgcgcgcgctgacgccgccgcctgaccggtgggtcccacgcgccaggccgggcgtcgtccccttcctcccgcccggccgtcctctctccctctcccgtgaaccctagctcgcttcctcctctaaatccgctcgattcaagcatgggattcccaaattgattagggggaattaatcccctttccctcctctctctttcccccttaattcccccttgaatggcgcccccaatcgccgggaacggacgcgccaagtccggccgccttcctttgccgccggccgccattcccgtcgtcgttccgtgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggagatgcacaattaatgcaagggagtacaaggggataataacatagaggttaagttttgcagtaaacggcatttaaaagtcacttagttgcccaaagctattttgtaaagacgatcctagagctatacaatattattaatcaaggccgtgaaccctcacgaacctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacgtcttcctcacgtgttgccacgtgccacataccaccacggtatacggacggaaga

SEQ ID NO: 108419 - DNA, 1226 bp, Oryza sativa
tgaaatttgtgattattaacattaggagaaaaaatgatgtaatttagctttcacactataaattcatgagttatagccttgtggcaaaatttgtgagtattaaccttttggaataaacacatgaattttttttcctcggtccaaaatttcactagtactagcacaaggaacatatggatgacaattttgatgaaatttagcccctcgcactataaattcgtgagttgtaggcttctcgagtattaaccttaggaaaaatgcacaatttttttcctccggcccaaaattttgctattattagcatcaagaatgttgcgttgaaatttgtgattattaacattaggacaaaaaattcatgaaatttagcctacatgctataaatttgagagttagccttctagtaaaacctataagtattaacctttaaaaaaaagtataaaatattttctttgatccaaaattttgctagcttagctccaagaccgtggagtgtggaatttgtggatatcaaaatcatgacaaaatttcatgaaatttagctccacgcacttttaacattttgggcctcagtaggccctttcaatcttttgggtcttaatgaacccttttaacaatttcagccttgactggactgctttgtttttttgctttgatagaccatccgtgcttaacctttttagggtttgatgggcctatcgttttattttggggaaaatccaaataccccctacaaatcttttattttcactctcccctctacaactcgattaggtaaaaaaaaaatcgcccacaactcaaattctcttctaacttcccccttctgtctaatttccactaatttctccaatcgttcatcaacatgttggtatgataccatagcggaaggatgcagttaggggtgaaaacggagtggatttggacggatagtgctcataccatatcttaaaccatatttttaagcagattccgagcggatgcggagcggattgtttcgggcgtcgaaaatggtgtggagtcaatgcggaattggttcggaaacagattaaatttatcggatgttacgtgtatagcaatgaatgcaacatcgataaatccaaggaataataatacaatatagtcaataaataacccatcgtaataattatacgattaattgctaaacaacataaatacatgatgttcataatataaaaaatatagctacatgagtgtgacatgcaacgata

SEQ ID NO: 108420 - DNA, 555 bp, Oryza sativa
tacatcgtcgaagcctcttccaccaagatgtctgactgaaaggtatagtttttcaagccctctactccgtaattgaaccgaaatagattggagatctatccgaactcatattggtttctcttagaggagacaggcttttgcttttaatctaatttctcaagtttgttgcattgatccatctagtttgttattgatgctgttaagattcatatgaacttggattggtttatctttttttatggatttttccttttctccatgttatttttaccctggcaatcgctaatctttaagcttgtttccaatggtgttgagatctatccaaaatagtattgatttcttgttttgacggttgacttttcgcttacttcctactactttcttattgagttggttcctatagatctataatcttgggtttggtgtgtacgctataaagatccccacaaacttggattagtttatctattgataacaagcatttcactttctcacatctatttacaacacgggtggtccaatctatctagattgttgtgtgtgctatagagaccc

SEQ ID NO: 108421 - DNA, 718 bp, Oryza sativa
gcatgcttaggctgtgtttgagatgacatctatgatgagattatggtccacatgcaaaacgagacgagtgattagggtatggttaattaggtattaattatccatagttttaaaaaaatataccaaagcagaagagagatagtgacctctgacaataatctatcagcatcaggagtccaataacatgttctgcttgtttgccatttttttctacctgtcttaaactagtgcacaattaaaagcctgctttggtgctcaaatagtcgtgcaggacaccatactaactacaaactgcaccgtatagaagcatgacgcctggtgccgtttgttgcccgggagcaaatgccattggctagcagaggaacagcaccgaagtccattgcggcaaagactgggagcccgggcagctgcccatgctggctgggccctgaatccgccgctgcttcaatatatcatgaaactagctcatcgaattgtattttcaccagttcagagttgcttacttgcttcgattatcttgtgtccaacttggatgagtcactgtctgctgatcaggtccatttttaaaattatggcactagagatggttgtgttctgaacaaaaattcaatcaaaatcagtcgcagtctactctagtgggctttgtcctttgaatcagatggacattcttttaattcaaaaactagatgaatatcataaaaattgccgggctgcagga

SEQ ID NO: 108422 - DNA, 788 bp, Oryza sativa
cctttttttgttactttctagaccttttcagaggataaaaatttgccatcgacaatttcgtgactcaaacattttggttcacaggggacttgtgacctgagcaattttttctgacaagcgacaactgaaactaactaataaattatgctaggttacgaatgtagcgatggaccagatataacacaagtggcccaacctgaccaagccccacaaggatttggcctgctaggtatgctcaaaattatgtcagtcaaggcccaaaaaatatcattaaactgggctagtgaatatgtcaaggcccaaaaaatatcattaaactgggctagtgaatgtgtcaaggcccttgtactcttcagcctagcttaagttatcagcctgtcttcaaggaaaattagtccagctggaggttgcaatgttgggttgggtccctactgagttagggggtagtagggcttgagattagaaacttttatttgattacttccagttagaggattttgctaacaatgccaattttggcattattctcaataaaatttaattcatgttctgttcttatagacttgaattgaattacagctgaagaaaactttgtacaaatctagtgtagacaatccatcgactctcttaacctacaaaatacactagggcagaaatcacctatagggataaatgtgtatcgctagctacaattccttcccattacaatctcatatttactattttctgatttatgtataaactctcaacgaactttgatggaaaaagaagtacatggagattgttat

SEQ ID NO: 108423 - DNA, 531 bp, Oryza sativa
ttatttccggtgctctgaaaattcagtaaaatttgagggctccttttagaccaaggagaatttaacaaaaattctccgggccacatttgaatttttcttgcacgtattttagtgtttgccaatttctttttcgaattttaattaattctattattccttttagcgaatgaattttaattttgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaaaacttcttcactctggactgcttggctcgatctcctgttgcagatggaatcttctcttcacctgacttgtccctggttgaacctttagctgactttgactgggttgcggcacttgaagatggggcttcagttccagaactttgcatagttcatatctttggagtcaacctcatacaagttacccacttcatgtcatgc

SEQ ID NO: 108424 - DNA, 652 bp, Oryza sativa
taggctttcgtcagggaccctcttcatcccgactgttatggttagtcgtccccaactccgatactactcgtcaaggcttgcagctaggtatggtctctcgcgctcgcgcccacccgcccctcgtgatgctcccgttcagcgcgtgctcgatgccctactcagcttagctgcagtgtgatgtacgcactcgtatccggctctgtggactgtccttgcttgcacagcgtcttcgatgagttcgatcgatcgatctccagctgctgataattttgcacattcggcgccgttggtttcaacgtgttgtttacagtgaaattcctatgagaaatttgctgcttcccgaggctgattgctgtagtaatttcattttttctttttgttttcttgttgggagtattttgggctaaaattagcgtcaatcaaggtgcgaactgttgatcgtgtacccggaatagatcgaaaaatgtactacatatatatagtgggaatgagctgttatgatgacctaaccagtactccctccgtcctaaaaaaaggcaaaccctgagtttccgtactgacgtttgactattcgtcttatatgaattttttttataattagtattttcatatttgttagatgataaaacatgattaatattttatgcgtgac

SEQ ID NO: 108425 - DNA, 729 bp, Oryza sativa
attggcagagacatcggccaacgtttttttggtcgtaccgaggtggagtagtctactgtagtacaacatttggcggtgggtcggtgcatgcgagcgtcggagccacgcgcggctgccgtgccaatgtcgcgcgcgccgcccgttgcgtccgaaaattaaaggagatcaaatccactgcagtcgattgcaacgctcatttgtcactgatatgtggatccgaagcctaccagactcgtatatcagggacaaaagcacaacggtgcggccgatcgatcgacgcgagactcaactcgccagatcgatcgccatcgcaacaactcagcatttgttgttgtgacttgtcaacagtgatgcgacggatagtatccgttgatacgtgtgctgaacatccgatagtgtttatagctttttatcgatcgattctgcccccacaaagagtgagcattgtggcccacaacggtgacaacggtcggaaaacacagcatagacatagagagatgagatgcatgcacatatgtcactgtgtaataagtttcctttagttttgtttgattgagatgtttcaggaacccccaacattctgagaaaaataaattgaacggaggaataatccggcctactcctacctagctagccttgtttagttcaggaaacaagaaaacgctcacaaatcataattagagcgggaataaagtcatcttactagtggttgtacacagtcctctgctg

SEQ ID NO: 108426 - DNA, 720 bp, Oryza sativa
cattggctcactgacgatgaatccatcaaatgctacactagaacagattatataatctaggaatataatatgataatctcacattttgttgcctttacgtactcttgcatctaattaagcattcaagctacacatgctaactagctttacctcttttcatgtggtgctcatttccccaacttgcaagctactatgcatctaacatcgatctatcacatggtctcacgcatgcagctgactctctgtgtcacttaattcacaaattagtaagattcatcgtcaacagattcgtcgtcgtcagtgtgagcagccactttaaactgccatgtttagggtatgttaattacctttggcttttgtcatagcctgatggctgacatggatgccgacatgatgatcaattcccagaatcggaacggtaactgctatatagtatatatgcttcggacatgaaatggtagatgaacgaatggatcgcgtcgcgtctgcggctgtgaattcgtggaggcgatgtactgatgggctatggaattgaggcctgaaacagaggcagatattgggccttgaggactcaccagggcccgagacctggcacatccacatgtttatttcatatgggccatgcgacgggaccaagagtcgtaaactccgaattccaattccctttgagcctccgttttttcattgtcttggcgtagttgttaaccacgctgatcaact

SEQ ID NO: 108427 - DNA, 1319 bp, Oryza sativa
aaaaattttccaattgtgcaggtaataagcagagaagatttcaagttgctcctgcatgctggcgatgcgctgctgcggacttgctgagagcaaacaaatcttcaatttgcttatatgtttgctctatccttttcttttgtgattttgccattggatctgttgtgtgatgcccatgatcatacggttctcttctgcagtgggcaattcgtagtaattagacgcaaccctgtctaatccctctgctactctgtctgtgtagggcctttcatttcagtttaatctgtaattgaaacgggtatatcccggttcagaaaaacatattggagtagttctcgccttcaaagaatcaaatccctctggggaaaatagattgacatttaggaatggagaggcacaatgcagtgatcagttttcaggctcattgccggtcagttttggcagggagatctgaaacaatgataaaccttggttctgaaaattttgtgctaaaacttgttttgttgcaaaacctgattttgcacagttgaactgctgactcaggatcaaatttattccatttctcatttctcataaagaaatttgctcttcaatgtacgatggagtttattttcctttgaacctgcataataatataccggtacgtgttaatgacagcagattggacacagcaggtcttgaactcttgatgaacgaaacatccccggcccaaccgaggatcacgcggcccacatcaaggattcggccgacgcgatgtccacgtcatcgctggctgccacgacagtatggattggacaagctcaaattttatttttcaatgttcaatggaggtttttttttcttttttcagaaaacctagacaacggtatcctgttggaacgggatactcttctataagacatacctgttgtggtaccagctacatagtacccgataactgtgatacctgttacccaacacctgtaatacctaggatctgatacctatgatactcgtgcaagagaataattaatatgtctatcctgttgcaacgggatcccgtagcagccctctccttttttgggctcagaacctccacagatacctgtccgtttgtagaatcccataagaattcgtcgacactgcggcggtgcaatatcattgcaaatctccggctcgtctaaaagttcagttcatcaaggggacaaattaaaaggagaaaaaacgaaaaattagttggatgttcattgaaatttttagggattgatggtttagcccttgttgtttaccttgtttccgaaacatttgtatatttctggtttgcttttgcgaactatacctgt

SEQ ID NO: 108428 - DNA, 771 bp, Oryza sativa
cctgcagcccccactagggtttaattgccgatggtcatctttagtgcttcctcgagatggggagcatccaaattgttcttctgccacatcacctttgaccttgttctgataccaggtaaactaattaccaaccatcgactattatgttctcaaatattgatgtctcctggatctccttatctgttggcaggtatatccgatcttatcaacgtagaggcatgacgagtacccttcggggtttcctccaacaatccttatcttgatctgtaaaaggcgtatccgaactcctatcctcaactactgtctcgttggctttttaacccaacacagtttaattggttttcttttccatcaacaggttggttattaactcgaggttggaacacagttcctctgaaatgagaccctaggtctcctatgtcagtaaacaattatacacatgatcacatatccgcatctttcaaacgaatcctcatggaacttgtctgtattacacatttctccctcattacatgaatacgaggcactgccttaaacgaaaagggacggtgcttaacatcggtacattgtatcctcaacatgaatcatctctaaacatagcaagctcactgtttacagacatgattatatttatgaatttcatgattgctgcaaactttcgattacaccatgataagtagcggactgaaaaccacaaacatggctgctcattttgattctggagagatatagctggcattgttctagtgactgcatccttgattggttctg

SEQ ID NO: 108429 - DNA, 515 bp, Oryza sativa
tctctctttttttcctttacctgggcttgtaagacactggaacggcttccttcgagctgaaggagaggagcaaagcaacgaagcgtatttataggccgcgatctccacggcactagcactgtgaattcaccgatggctgtaactttcgttcactgaacttctcgttcggagcgcctgagttttacagtctaccgttcgttcagcacttcagctttcgttcgttcgttaactttcgttcgggcgcctgagtatttacagtacagttcgtccgttcgttcgttcgttcgcgcgcgtgaaaatgccaggaagtttcaggttcgatcgggaacgaacgtcgctctccgcggatagaagttcgtggcagccgcaggcagcattgcagcaggagagcaaaagcaacgaaacgaggctaatcggcaaaagcagctagcaacgtcatggggcacaagaaaaattcagagagagcacctcaacgcaaacgttggttggagttggatcagtttgtcaccatcggg

SEQ ID NO: 108430 - DNA, 586 bp, Oryza sativa
gctaaattttatgaaatttttcattatgatgtgttaataatcacaaatttcacatccagtgaccctgatgctagtactagtgaaaattattgaaaaagaatttatatgttttttttccaaaagttaatacgggttttgctggaagtctctaactcacgaacttgtagtgtggaggcccaatttcatgaaaattttctcccaaggttatggtacggtataggtgctactattaacaaaaatttgggttgaaggaaaaaatagtgcattttttcaaaggttaatactcatgggttttgacccaagtctacatctataaatttatagcctcaaggcaaagtttaatgaaaattttatcctaattatagtattaaaaaatttcacacacaacggtcccaatgctaatactagcaaaaatttgagccgatgaaaaatttcttgcattttttttgcaaagattaatactcacacgttttgcccaagggctaatttgtgcttatttgaacgtttgttccaaatttcacacaattatcttaatgccaatactagtgaaatttcgagccggcaaaaaagttcaacagtttgtttt

SEQ ID NO: 108431 - DNA, 667 bp, Oryza sativa
acattgccctggtgcaaaagccaagaaaaataataagggtgtgtttagatggggaactaaacgggccctaaatagatctcaagtcaaaagcagcatgtataagatattccttcaatttgttgactatccttatgcaaaaataagcaataaatgttttgtctgcaatggaaatacaaagtccaccataaactaaaacaaatacaacaatagtttgccattcaggatacgacacagacaacctggctgaacctaataggtgtagaacaaccaattgttagtacgatattatcctatagaatagtcatggcactgtattgctagcgaaccaatacctatgaccatgtgttgtagatatgcctgtggttttcattaggtaacaattcatagaggtttatgcatggtagaaggtactccctccgttccaaaatataacaacttttagccttcaggatttgtcccaaaatataacaacttatctaccaacattctcttcccaaccaatcacaaccctccaccattcacttttcccacctacctccactactcatccaatcacaaccctccaccactcgctttacctactttcttaataaccgtgtccaaccctaaaacttcttatattctgggacggagggagtagcagttttgagtttgtatgttatgaaat

SEQ ID NO: 108432 - DNA, 633 bp, Oryza sativa
aacaagagctttagatgtttctgttagtgtagctgccaagagaaaaaaaattaaagtaacagtaggtagggtgattttgctgaccttagtgagggaactgtaagctttagcttgcaacaattatgtcttgtatgaccagcagtggttgtatgtatgaagtaatctgctctgtattcctttttgtttcctaacctggcctttctgtcctcttccttattaccaaatcatggtagtactgcacaggtttaagagagtaaaaaaatctgtggttgctaagaacccaggactgactcactgaacatgtatgaaaatacctggacacataaaaaagtttcagtttaaatctagagagcatccaatttaactgaatacgagctaatccgcacttcaaatctagacgcaaactaccattgcatttgcagatttgctgactacatgatcctactcaattacatttcatatacttgcgtccatcgatggattgtgtctttgtattcaaaatggaaaatccaccgagatgataagttaattgcatagcacgagacaggtaaaaacaggataagatctggcaaaacaaatatagctcctcccaagagcgaattgctgacatacaacgatgattctttaaaactt

SEQ ID NO: 108433 - DNA, 712 bp, Oryza sativa
cctgcagccctctatcggataccagaagagacatgattatgtgagtttgaaaaaataaataaaaagaaggcaagaagattgccttatattgtgatagagtaggagagcatcaaatttgttcttttgcgcgatgcccctggagaaaagcctttttttttctcctgttccccctgacaatggcattcgaccgttgcgtcgtgtatttttaaaaaaaaactctgcttcttctaatatattgacgtataatccttttttctttcgtgaaaaggagagcatcaaatagctgaaaacaatttaatccaatagctaaaaacaattcaatccaaacactgctgtgcaaaagaacatatgttgatagagcatgtggcaagaaaacccaagaaaatccgtttttctcctgttccctgacaatgtccttcggccgtttgtgtcgtgtattttaaaaatctatgcttcttctaatatattgacatacaatttttttacgcgttcgcgaaaaagagagcatcaaatagctgaatgggcaccctagctgaaaataaatcaatccaaagctgctgtggaaaaaaacatatgttgcaagctagcaatgtcatttttctgcggttgaatgttttagaatttaagcaatcgtgctccacaatacttcaacttatgtctacagacaaagcaagtattcttccggtaattagcatacgcttctcttatacct

SEQ ID NO: 108434 - DNA, 1505 bp, Oryza sativa
aaatggatgaaagtgtgtctcacttcttcttagggagatcaaatccattctcattttatagaaggaatggaagatgaagggtaagagtcatggaataattaattctcatcaattagccatcaaccatcctccactacacaaccatcaaccaaccattaatgaggagtaattgatgtaggttaccaatggaataggaagaggaatagagcaactaattgtcatcaactagccatgaaccatcctccactacacaaccatcaaccatccatcaattagagtaattgatataagttaccaattccctagtcaaatggattaattctcataaactcttcatcccattgatatcccataagaaaatgaatacacatgaattcctagcataattcctagcataatgagccttggaatttatttgatttaaatggatcaattacccaattaaatctaacagtgttcggtttggatccgcgcgccgtctgagttttcattttggatcttgcgtgggtgcaaggaatcgggccggctattgattgggatttgatcagagttcgccgttgcgcgccgtctttttctcgcatggcgagcgtggtagatccgctggtctctctctttcactgcgcgcctcttcctccgccgttggtattcggtttggatccgcgtgccgtctaagtttccgttttggatcttgcgtgggtgcgaggaatcgggctggttattgatggatccaaaccgaacaccaacggcgggcagctaccaacggatccgccgcctttttccctctccgtgcgcgcttgccgatgaggaaggatggccgggagggagagagaaggacgcgccggtcgctcctctcccgtcgccgtggatagagaggatggtgggtcccactgttttttccttttgtctgactgacatgtgagccccacattgttgtttttattttttatttttatattttgcttctagtgctacatcaccgtcacgtaggacgaggaccaagtcaaccggccacgtaggcgccacatcagccaaaaccaccatcaaaaccgctgagggacctgctttgcaccggttttgatagttgagggacccgttgtatctggtcttccggttgaaggacgaaaatcggattcgttgacaagttaagggacctcaggtaaacttattccgagagagaaagagggagaataatgggctttctattaatggggttttgttaatgggcagtatttcaggtccatgttgaattgggcttaactgtgtaggttaccagtttgccactgacagcttgaagagatattctcccccccccctctctctctcttttcgaaaatgctaatggcgatcgattgcccctagcgatcaccctcctcctccatgtggttttcttttttggcactgtattacttttctattttagtaaatttatacacctaaactttgtacacctcaagtttacatatctaaagtttatacacctaaagtttagagacccaaagtttata

SEQ ID NO: 108435 - DNA, 717 bp, Oryza sativa
ggaggatgccgcctagcgcctaccattgccctagtatgcggggtggaaccttgtcactggttataggtccatgtgcaaaaagtgcggtaggtgggtcagtctacttgcatacctactttgcctcgtatgtttgtaagagtttcttggatgttctatcttgcttatctgtactgcatatagtctgccccgaaaaagaagatttttctgttgatatttgttatcctccataattaacttctcagtgcccttatcatagaattatctccagggaatgccctacgttgtttgctcttgtagttggttttgtttgcctcccttcatatgaaaattggttgttgtgaaccaatgtaaccctttacatccagacgtcttttttgtttgttttcccgtggtgctgactttttgtttttagttctatgaagctgagttatcttgttcctatttggtgtattagaataacgctcttttcacatgtttggtggacaggtggagtttatgttattcatacatgcaagttatgtcaatgacacctaactggtttagtttagatccttgtgtctcattgtctcctttgcaagacagaagttctatttgattaaagcaatgctgcaatgtatgttgattgtgaggcaatgactgaaaaggatgattatgagagcaatactgaatcacctgtctgtttgtattagtatgtgagtgtgacaataatattaatgg

SEQ ID NO: 108436 - DNA, 654 bp, Oryza sativa
tatatatatatatatatatatatatataaaccatgcagcaacagggacatgcaaaaaaaaaaaaaaggtcagtttgatctttagtcccggttggtaagatcgatctttactcccggttatttcacccgggactaaagatagcgatctttagtcccggattggtaactcccggtttggaaactgggactaaagggggttacgaaccggggactacaaagggtttctccaccagtgcctggtccaagttaaaggattggtagtatattttgactctttggggagctatgaaaatttgggccagaaaattctaacgaaaatgctgcaagatagagtaaacagtaaactagccccaccttatctgatgtgtacgtatagcttaaaagtgggaaagtagctaggctccgctgcaagagaggcaaattagctcgattgcacgcatacgcgttagatattactcccttcgtattcgtattttaatgtatgacgccgttgactttttaattaacgtttaatcattcttcttatttaaaatatttttgcaaatacaaaaaatacttatgtcatgcttaaagaacatttgatgataaatcaagtcataataaaataaataataactacataatttttttaataaaacgaaatatcaaatatttg

SEQ ID NO: 108437 - DNA, 686 bp, Oryza sativa
gcagccctatgcttttgacttcaaattcaacctgctaaagattcattggattgacttgagcatcaaaattagtgtaattagcaaagcattgctgagaatcattcatgttatatattttgcaccaaaatttgtatcatgttattgcttactattataatgaagcggttgtcctaagtgacattgagaatcagtgttatttgtaataacaactagatcatatccatggtgcttcttgttacaagaaattgatgatcaatttttattaactacatgtttgattttaagccgctgacattgtgtctatgcacagcttggtattacagtaatgtgataagtctaatttcattcactaccggagaattttgtaataattttttatacatttttttgattcacgatttcaattgaaatgaattgaaacatttggatttaatattgatagggcgcacaacgtgcgtcaaaatgtctagttctatttgttgtatcccatcttatcagaaatacaatctttttgggacaaaatttgaagggtagaaatacaattattatgggacggaggtagtataaattaataatttttacgttttaccgactattacctttgataaaaatagttttactaatttatgtcagcgtcccatttaagtaacaccaaataattaaattcacagatataaaaatattcc

SEQ ID NO: 108438 - DNA, 1284 bp, Oryza sativa
cggcatgcatgtgaactgcacgacaacaaaactatactttctccagttccataattatcaacgtttagacaataacacgatctccaaaatacatatttgactatgtttttctattatttatacacacaaaataactaaatgcatgtttaattttattatagtactttataagataaatctgtatatgttgttttagtgcttttaactaaatatttttgaatttattgatagtcgaacttataaaagtttgaccttaatcttgttcaaaatgtcaagaattttagaactggaggaagtattaattaggacgtcattactaaaaattatactaatcttgcggtgcacaaattaatgctcatataaaagcaagttttataaaagaggtggttatcactcgtcatctctaactttatccatataagctaaaagatatagtacataaacgcatacaatatatcacctctagtcattcctatacgatactacctctattttctagcaaattaactccgatgatttcattttattgatttgtccaatccacccttttttttcttgaagtttgtgcaaaggttatcccttgcttgcattagagtgaatgtgactactacctgttttacagtgaatgtgactactacctctggctaatttcatccatctttatctgctagtaaattaagaggtacgagtaacatgtataacaagttgtctataacatacaacccccaataactctaacactttcacattcttatcggagtttgtacaaaggttgctttttgcaagggggtgctttttctctatctcctgcaccaccatttagtcttatgtgttaggacttatgttatgctcatagtgcttgctattactctcttctttattctctccttcaccacatcgtataacattatgtggaatcttgtgataattagtatttaggggattatactattttaagttacctagactgtacatactatatgcatagatttttatataggatatatatatatatatatatatatatatatatatatatatatatatacactcctgccgtcgaaatataaaatgtattttgcttgattaggttaagcttttgtcaaaaattattttactaatatatcatttatgtgatataaaagcataactaagtaattttgaatatgaaactaataacattttgtgtcacaaaaaaatatatgtagagagtgaatgttggtcaaagtatgatttatatatgagacaaaatacatactacctccgttttttaatagatgacgc

SEQ ID NO: 108439 - DNA, 700 bp, Oryza sativa
aggtgagagacacgagacaggagacacaccctattaccttacgtgataagcattaccattattactaatcactaacaattagtactaattaatttaagtgtttagcttggactattctaacaactttacacaatcgctttcatgcaaccatgggctatggtagcatgcatcatgtagcctggtctcatattaggtgctcctaatagacagattaagaagtccacattaggcaagcctgatgttttgacatcgatctagggtttgtagggattctttggaacgcaggaattttatcgaaatttttctaaggccaattggtttgattcctgaaaaatttccaatgaaattttaccattccaaaggacgccatgttatgcaaaatggcttctcctttttgtaaatatgatatattcgtctgagatattgttttttaggtggtcctagaacctgtgcacatcaccgatcacatttgttttttaaagacgtccctatcagacattctgccattcatatgtatgttcaaagtacatatctagctatgttgtgggaaaaaaataacatactcaaaagaaatgcaacggttatgtatatgaaaatatatcactaaactagtcgctgaaactctgaaaatactatcataatgtaatattttaattaatatagcacatcctgtttcaaagaaaaataaaagaaaatccca

SEQ ID NO: 108440 - DNA, 2227 bp, Oryza sativa
cgcgagcactgaattttgcacatagtaactaattgaaatcagtaatcctcctgctgcattttctttcttataaatatgtcttattagttgtaactagtagagtcaaatgaatactaccaatgatttaggagacttcctcgagggactaaaatattggatcctcgattaattgatcccttctttctcctcacttcataaaagtgaatcagtttcattggcgagagggggttataaatcaactgatggattactttactaacattattacaaacaaaaggaataaatcgaaggattgtgaccatcagagcaaaggctttctctttgttatttttacaaatcaaaataggaaacccatttgtaggttatggaatagataaaaaaagtcgggttataagagtaaaaattccacaggtcctttatgctctaatcagataaaggggggtaacaactgcaaacataatgggggtaatatgtatgtaaaaaagggctatagataactacaatgtgtattattggaacaagtcagtgttacctttttttttgttgaaaccatgcatgcacatggaaggaaatatcaagatgtacaatcaaacatgaagagaaagaagaagatcttagtataggtggtgccatattaacctaggatagtaatgcaccaggattttatgcattagatggacttactattatcgcatactctttattggtttcattaaatccaccattaaatatatttctgtagtatatttgttttgtgttggaaacactactacattgtttggtcaaactgaaaatatgtatattcaagtttgattagaacaaaccaaaaatgtcttatataattgaacatagggagtacatcaagatcgatgcagtgcatccagcgaacatttgttctgtacctggttttggtgccaaagcatatctaaacctgtaatgcccctaaataactttgctagctaatttacatgtaaagaacaaaactgtattttcagtcagggaagaaaagacattccggtgtttgcaggaaatttcctcctttgcatctcttcctttattaagatagactacattatcaactaaaaacctggattttttttttacttgtagatgaagctctcgggattacaaataaagtagaaatttggcccagaaacacccgtgatcatccaaagaatatatcgatttcattgaatatgtgccagctttcacaaattatatatcatgcaattttaccatcattctcatcaagtgtaataggaggacctttttataatagtcctatcagtctcaaactataaagcatattagttttcttacactgtctacaatattatattttaacaattagtttcttcaataatatattatcaagaactagaaaattacatcatacaagagtgctttcaaatatgaatcttaggatatgaaatggatggcattaaacatatacagtatattgttagtttgttatttgtcaaaacctacatatgttggttttgctaaaactatatatggccaccttatattttaggacaaatggagtatcaaacagtgtgacatttgtaacctactcaagaatggtctgctcaaaagggatagaacactaacagggctaactttagaggcatgcctaggggaggggtgcctcctgtcgaggcgtcatgtaaaaattggttatagtaaatgtacattttctcctattaaaagtttatatattgatcctaccaagtccttaaaaaactcataaagatgggctttcggctttcgtcaatccagtatcatcagttacccacatctagagttcaaaataaaatctagctctctaatagaatgtacagtaccactctttgaccattgcatatctcaacagattgtaataccaccttaggccaggatcatgcaaaaatatagtattagtacccactttagttttctgaaaatattgcggagatgtctgatttgtaacacataaccttccaaaatggggaataatcttttttaggctagctgcacaaacccaatgggcatttgatataaaagggtgcaatttccaccaacatttacatcaaagactcaagttttctgaaatctttgacacccgcagattttagtctatctcataattcaatgacatttgttcgtggtatctagaagaataggaggtatgatccatccaagtgaaatgtaatacaatgggaggaattaatcaaagcagccctccctt

SEQ ID NO: 108441 - DNA, 952 bp, Oryza sativa
  unsure (1)..(952): unsure at all n locations
ttaatgatctctgacgacatgggaagaatcctaagtttgggcaccagttaaggttgccaacccctaatagcacctgactccactgcatcaccaatggaggcaatacttgccactgcacatgttgcaaaaatgataagcaaaagtggaattcattcatgacagaaccaacatagtttcttgttgctttcatgcatcatgtgctggcaaggctggcttcatgaatcttggctatgttttcatcctgtccaaaaagaatcttgatgaataataacaattaacaaagtaatgatgattgtaattggagccttgtgtgtggctctatctacctctagtctccatgcatgtgattatatggaaatatggtagggatggctgttgcaccagtgttgctcaggaaagagattaaaaagattactgattttgggagtggccggtgtagctcaccactcatatgcttctggctatagcttcttctgaccaagatatgtagcatggtaagggagaagcaaattgttggagtggagtgaagcctctctaaccaattggttgcaaccttcactacttctgtaccttttcagttgcttgcctgtatttcattggtgaaattaatataattgagctgcaccatatgtatatacttatctagtgggaaacctgaaaacctgtaatggctgcaaattgatatgcaaattataacagattatggaaattaaggaaaaaaaaacaatatttgttgttggagacttggagttccctttcactttttgtactgaacttgaattttgtatttgatgtatttatgctggtgactgacagttctatgagaggggacaaatcaatatacccttctctgtatttatatgagnctatatatgagagaatgagagatagagagagaaatatatttgggagagagagttagttggatcaaggtcgactgttcagagcgaac

SEQ ID NO: 108442 - DNA, 552 bp, Oryza sativa
attattgggatgttggttagggaatttgttggatgagaattttggttaaaatttctttaatttaaggatagggaatagaataagtaatctgttgggcatgctctcagccctgaaacttaacctgaacagatatttgcagtcagggccgttctagactgctcctagttggcttagctacttccttgtacttcgtgagcacacgctatcaaaatgttctttttttcaaatgttttctatatataactttcttaaataaataaataaataaatctatttttaaaatttgtaatagctactccctccgtccctaaatatttgacgcagatgacttttttaaaaaccatgtttgaccgtccatcttattcaaaaaaatttaagtaattattaattcttttcctatcatttgattcatcattaaatataatgatgagatgtgagggagcaaggcactccctcttttttaatacctgggtagggtggctttactttgcctacgtaaatcccaaccatctgtcttcatttaagatctaatctccaattaaatttcctatc

SEQ ID NO: 108443 - DNA, 1091 bp, Oryza sativa
  unsure (1)..(1091): unsure at all n locations
ctcgctcgctaccggccggtgcttgatgttgtgtatgccgtgtgcgtgttcgggaggttttcatgtatggttgttaattttctggatacggtactgcgacttcgcgagaggtgatatgtgcgtggatggatatccgatgagatcttttgccgtggtcctgactaaccaacttggtgaagatgacaggaaatgaataggtgagaggtattgtaagtccgtggttgtacgtatgtgcctgacatgcatgtatctaggtcggtatatgtagctgtagcacaatctgaaacttgcaattcaggcaaattatcaacagtactctggatcctaattnccatttcccgggttttttggcaaagcatgattgtaaataatggaggttgtttatgaatataagggccagtatatataccactaanttgntncaaggaaaatatttacgtgcaatctgtatgactaagatatcaaaacacaaaaaaaaatctaaaactaacaatattatcaactctttaatttccaatagttgattatgagatttctattttctaatgtactgatacacgtaagtttttaattttttaaaaagagtaaaaattatatctcagatactatgatttgcatcactagatgttacaaacttgctacataattaaatgtcaaaaattaacccatggttgtgaacaattgttccaaaatataaaccatacatgcatacatggctacatcctagatcaccatcaccgtaaatagtacttacttcgtctcataaaaaccgaatctagaaccggatataacaacacattttagtacagtgaatctagacatagacacgtccaaattcgttgtactaggatgtatcatatctaatattagattggattttatgggacaaagggagtggttgctcaatcttaaaaaaccatatctaacccttgtttttttcacctcatatggtgtggaccaagcgattaatttctcacccaagcagccgtacgtcaccggtgacgcgtgcaccccacatgcaagcacacctccatcatcagtcaatgtctcaatctctcatgtctgctgccacagttactggaagaagagca

SEQ ID NO: 108444 - DNA, 1020 bp, Oryza sativa
tagtatatgccacttattagttgtgatgtattgctattcatagttcaaacagtagtgtcttttgtttaaaaggtaactgcagttgagcatggtgatcaccagcgtgtttcttggcatgtgcttcaagcctctcatactcacaaattcaggtaggcacaaagaatttatgacaactgcgtgtggtctttaatcttgaaaacgtggttttgacatggccgtagcccgcaagtttatggagcttgattcaactgaaatgaaaattgtgatttcaatttttttttgtgatggctcggtgcagggttgcttgaaaacctgaggttcagtgaaggaaacctcaaggcctaggtttttgccaaactaatatccccaaatacagggtttgccaaatttgccaaactgatatccttgataataaggctctgttttacacagtttcaaatctaagatttgttgaaggtgcgtattcataccttagaaatccatggatatagatttgtgattatattaatagtatttagataaatcatttatttatattttatagaaaatataaaatttcaaactactgtaatttaatgtaaaagctctaagcccagcaagaatatatctggagagctgtgccaaggaattcgaacagaaaattcttttatggatctgttagaaattctccatcacctgtgtatatgttcgagtaatggagtttaaagggttcgatcaaactttggtttgaaactaacgggtactctctccgtcccattttaagtatagttgtggatttttttttgttattagataataaaacatgaataatattttatacgtgacttatttttaatttattcctaaaattttcaaataagatggacggtcaaacattggatatgaaaattcacaaccgcacttaaaatgaaacggaataagtactccagaggtgaaagaggaggttgggcgtcaccagacggcggcgccatttcctccctgccggtcgccgtactccggccgctggagccatgctccatg

SEQ ID NO: 108445 - DNA, 1234 bp, Oryza sativa
tccaaagcggatgaaaacgtccgtgcgcagcgcgccgatgagcatggcgtgcgacgccgacgctcctctggcctattcaagcaaatgcttactaccaattgtcgtgtcagagaagataaggccactgcgaaggatgaggttcctgagtagcactcttggttgctccatggaccagggttcacaattccgacgaaaaccggtcgaattccgcgaaatttcgacgtctcgacacggctcggaattaagtttcgattggaatttcgaaggttgaacagtagatttggtcgaaattcagtcgaaatttatcgaaaaccgatcaaaatttatcaaaaaccgtgataccgatgagactcgaaatttagtggtcaaccggtaatgtaaaccctgccatggaaaagatccgtgaaattgtctgcaaaacaccacctattcttggatgttctgaagagaaccttcacagaaagataagagtttttggttaccaatcttgggatgtgtttagttcacgccaaaattggaagttttgttgaaattggaacaatgtgacggaaaagtaggaagtttatgtgtgtaagaaagttttgatctatgtctatggcattaactacattgccatgtaccccgaaaaaaaaaactacattgccatgtaggatttttagcttacgtaacactatattaattaagagaggaagaaactgagtctcatgcaagacacgacttcaacaagagaacctatgcactataaactaacaagttttgcattaggagagaatagtgtcttcataacagatgaagaataaatatgattggtagagaagagagatgatgtatttattaatgatccactttaagaaaccatgggttgcagagtgtagtttctattgtgatatcttattgacatggcatcatagacactacttatggacactatgggttgggactgccctaagccagctacaaacatattttaaagagataaaggaagagagagaagggtagcgggctactgatatgtagtcaggtacagcacggactccaagacataatgtatgtatgacaggtgggatcagatattaatagtatagtaagcaactattgtatgaattggttattacattagctatagatgatttgaagttagcagttggctatacttaagagcaatgtcaatagtacagccagggtttacactatcggttgaccactaaatttcgagtctcatcggtatcatggg

SEQ ID NO: 108446 - DNA, 547 bp, Oryza sativa
agtaaaaacaactaaactcccttaaatgtacaatatttgagttgatagtataaagagctaccactcattgggtgaggaaaaaaaaaggtcaatagtaccatttctactacctaaagagaccaccataaaagtatactattttcttttttctattttatattataagtcatttgattttttttcttagtcaaatttttaaaattttatcaggtttaattaaaaaaataatttttagatttaatgaaactaatatgatatttttagatattgctagatttttctataaacttaaacaaacttaactaacttttaactttttaaaaaataaaacgacttcttagatatgaaacgtaggaagtggtacctaaaacgttcgtgatcaaaccttataggacgacagcgacggcgaggttaccctccctccccccccccccaccccacacacacacacatattacttacattgtggcgtgttacttatttcccatgtgataaataaaaccgatgaagcagcagagtgcacgatatgatatggcagagcactagg

SEQ ID NO: 108447 - DNA, 519 bp, Oryza sativa
atttgtgttgtgtattggtgcgctgtagaaccgattcggtgcaccgagtttgtttcactcgataaaatactgcactgcgctatgttcaattgttcataaggttttcactatgtttcaattattcatatggttttcttcaatctcttttttcttatttaatttctatcatcttctttttccttattggaagtaaaccttttgcccatcatagatataggttataaacagatttgtggtcgtcatgggtgtgatagtgatgatgcgtcattcacgacgacgacctgtacttagtttcccctactcttgaaagctatattttgaggtaatggcaagttattgttgtacagttgaaaaaaaagtaggagcatatttatttagtttaatacttccttcatcctaatttaatcatcacctaaaatttttgagaattttttaaaataatcatcatctaacaaagtgttactttgtttatttgtgaaaatagtaaatgtgtatcgtgtaatgtgctgcatgcacaca

SEQ ID NO: 108448 - DNA, 1126 bp, Oryza sativa
ggtgctcataattacgcacatatgcttcagtagagttttgtgcaaatttatccctatccttcgtatgttcatcttgctagcttaacgaaggcaaattcagggtgagtgcatatatgtcggtgtacttatgtacgtcgttcttcacttaatttgtgaaagagaaaaatatggataagccataccattgctcgcgttgttcattattctggtgatcttcttgatcaatccaagcgcaaactctatgttcactaagttggatgatgaatatttcgttcaactacggatatttgatcaaactatcatgaaactacatataagatgttgtagcataaaactataaatttaagttggtgtagcacaaaactacagatttaacattaaatttattagaaaactataaatttaagctaaatatcataaaacaacatatttaataataaaattagtacaaaatcacagattttagatcttaaatccttagtaacaatattaagtttgagttgtaaaggtcttacgtatttttaattaaattggagctaaacatatagtttagttttgtgatactccttccatgataaactactaaagttgcccgtgcattgcaacgggataaattcttattatgaagaaatataattataacaaaattgtttcataccattgaaagttcataacttttgtgttatactattgaaagttcgtggtgtagattaacaacgtctaaagcggcgagaattttgattacagtaaactaattttccgtattatttatgagggaaatttgtattattttaccacttttaagaatgaaacctttccaaaccgtcattcttagttcttagaaaattgctataggagagagaaaatgtttttaactatttgctacttttgctaacgtgacacgtcaactcacaccgccagcacaggtgaagagcgtgaatgtccattttacccccttgtgggccccaccaattatttagagagaggcatcttggcttgccgatggcgtcgacctgccgatgtacattacatcagctcaatgttacacctacatgctgggctgctatcagataggccacaacagattgtcacatacgatgggccagcctaattaggcccaagcctg

SEQ ID NO: 108449 - DNA, 688 bp, Oryza sativa
tttaagccccgccgccaagggcgtgcttcaccctgccgcggcattccatcgaacacgttgtgcgcagccgcagagccctagacggctgcacccagccgccttttctcccacaccgcgtgcgagctctccgctcagatggagaggtatgtgtcaaattttccttaagggtttgatatattgtagtatttacaaataggtccctggtttggtagtgtcttaataaagttttaaacaaatcctaggacttatctgcataaaatcgtgccttctttctcgccgtttcatgctccatatctcgatttgttttcgcatggaaaggaatttagggacgcctatgtatgcttttgaccctaatcctgatgcgaggctttatatttctggccagtttaatttggcattgggctgtatgattgagctgaagatgtgattatggtgcggattaggtcaaaaaagttaccaatttgactgtttttcttgtgtttatgtgatcaaggatggccgaattgcacagtggaaatgcagaaccttatgatattatcttatctatttgttgagttggttttgaccagtgcagattctattgtgtggtcaccagaaattctatggagatcttcttttttttattgtagttgcaaatttgcaatgatgcttggattgattttgtgcgatctcatcaaacaaagcttag

SEQ ID NO: 108450 - DNA, 690 bp, Oryza sativa
tgcaaacaaaaactcaaaatcccttatattatgggacggagagagtactaataactaacgacgacgctcctcaaatattagacggacgtgtacatatgacatgtaaatccacgagggtggatcccacatgtcaggggcatacgtccctctaatgttagtggagctgcttctaatcagcattagagtcgattacttattttattttattttactagttatgtgtactatctctgtaacaaaataaagaagttgtccaaattcgtattcatagagttaaaatagcatatgttcctctttgctcgctattctgtttggtacaatcactatgaatttagcattttgaattgagtaagatgttacaatgccattccgatttccgattttgcttattattctgcttgttaaggtgttcaatggcgctcgttacatctttcacggcacaaattctttgacagctacagagggggcttcacctgaaaccgctcaggcagggacgttaccattgaaaatctagaaaatttcagtacaacactgtacattctagtatttttaaatgagaaattaaaaatttggagggttcatgtgcacccccaaagcacaatatagcttcgcccctgagagctgcagtagtttgcggctggggataactgtctgcctggccaagttcaacaccagccgactcctccttgc

SEQ ID NO: 108451 - DNA, 548 bp, Oryza sativa
gggactaaagatcctatctttagtcccggttggggttatcaaccgggactaaagatatcggggggcctgacaaggcctgacagatttagaaccgggactaaagatcatttttagtcccggttggtaacaccacccgagactaaagatcaaatatgcccgctgtagccaccaaccgggactaaagatcatctttagtcccggtttttagtggaaccgagactattgtggatttcgggcgaccgaccaaagatggtttctccaccagtgttttatcgtcctacgcaacttcacaacaattaaattagttctatgataataatgaatgtaaaatagacctaactgtaagtgatgttccaaaaagaaacttccctcattctgaaattatgataagtcaaaataacattattaggttagtcataaactactattattcatagtttagtatctactacgaatataccgtaggaaacgaccagtaaagaaggatacatcttaatcaaacattaaaactctcattctattttcagctaataaagtactagtaacta

SEQ ID NO: 108452 - DNA, 743 bp, Oryza sativa
aaactttagatgtatagaaatactatatataaaaaaatatttgaatttaaaattaaatttgaatcggatatataaacttttgatttataaactttgagtctctaaactttagatgtgtaaaattgaggtgtacaaactttaggcgcataaatttactaaaataaaaaagtaataccgtgacaaaaaaaagaaaccagttagagggagggagaatctgcgagcgatcgctaggtagcatttccgggtagcaacgggtttcacgatgaattggttctacgatggctaagacattttatatattatggacataaatataaatgaggacatcaaaaggggagatgaaaggaaaagtcacgcaaaaaatttaattgatgaatatgtgtaacggttcattttattggtagggtaattaaggcataaacttgattaagataaatgttaggaaggccaaggaatgccattacctccatacaaagtttaattagcacaaggccggctaaaattattttattgcaaacttaatagattggtatatatctgctactgtgtatgtcgaggtggacgataatgatgaattaattgggagaggtttaattaggtggagattggagatctagaacagatacaatagcagcctataagccagctgaaatgtattttaaaaagataaatgagaagagagaagaggagcgggctacagatttgtagccagctataacacggactttaagacacagtgtgtg

SEQ ID NO: 108453 - DNA, 584 bp, Oryza sativa
cagcagcaccatcaagccgatggcaaatcattttccatgcatgcgatgtgaagattccaatttggttagaggaacaaaaagaaactaggagagattacagagagagagaaggagaaaaaatatatattagtgattattgcaagtaacaataaagaaaagaggccaccgacgggcaggacagtggcagcccaaccgccattattgggacaagaacggtttacctgacagtgtgcttattgcaaagcacaagtcagcacatctcatttgttcttgttaactttggagtgacaggctccctataatctggtctgattttttttcctcttaatgcatgcttaattaatctacatctggcatcacaaattaattatgttcagtttgtgaatctttgaggtgcaatgatgaaaacaaaggggagttcagtagctatctatatgggatgtggagtaaagagagccagggacttttattttagtgattttatatattagttgctgtaaatttaaataaaaattgcatagcatgtactatacgcttatggtgtaaataagtaaaaagaactacaatcttgttgtttgttataa

SEQ ID NO: 108454 - DNA, 849 bp, Oryza sativa
tgtcatgcccggaatttctatccaaaattccaaacgcttacatgtgtgtgaaccctcgtccaggaatcagccgagggacacaataacaaattgataatagagtacaattattactctaattaagaagcgaataaaaagtcattacagaggtagatagttcctctcaatcaataaagatctaagcagcggaaaataaaataaacggcgcagacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgctcaagataacaaaggatggcataataggttttcatttgcaaaagtagcatttagcaaacatttgagaatttaataaaaccgttgagtaataattaaacaatattaatccaacactatacaacgtaccctgttgtataggcccaaccattctgaacaaccaaacccagctgtacagatctatcttcaaaccaggaatatatcattccaaaccaggagctaatcaaattattaccagttatagcatcttctaatatggtgagaagggtgagactaatcacgaaagacattgtaggacccgcccataaccgcgggcacggctattcgaatagttttactctgatcagaggtgtaccactgtacccacaagacacaaccccacatcatgtcaccatgtgcctcaataccaccacggtacctcggaaaagagttctgacattacctctcgtacaacacaatccaacacagtgcaccactcccggatcatagtcaccccc

SEQ ID NO: 108455 - DNA, 1060 bp, Oryza sativa
agggggagggacgctggcggcggcgatggcgagggcggcgccggggcggcggcgatcccggcgggggcggtggcgcgcgcggaggaggcggcgggcgaggtggtgcggcgggtgcggcccacggaggcatccgagcggcgccgcgcggcggtcgtcgggtacgcgcggaggctcgtcggcaccgcgctcggctgcgaggtgagtgcccgggcggttcgcggcggggcgcgcccttctgcccccgtttccactccaatttcgggtttttgaggtttctcgggattctcatcctcgtttgattggggcgttttattcttcatttttttttgtttagtgtttactctgcttccgtcgctgtctgtgggatttgacgggaattctctccacgggaggattatcctttttaattaatcggcttaggttcgtacggatcaagactgattcctaaactatttgctcgcggcgcgtcgttgcaattctgccttgttttattttcgctgaccttcacgggggaacaaaatcgggatcatttttttatttcacattttttaattactaataataaactactattaactagccctcgtgaatccaaactgctgaattccgaactttagctgaggccaccgtgcgctcggatctatggccttttcgctttttggtttaataaagggttttctttttctgatggaacgtttcttgacgcgttcaagtatttattttctgttggcacaataatgttttatgttcgcttgcaagcatcacttccagttccaacgaaaaggcacgaattgctttataaaatccaactttctacatcctaaaagttcctttcaggcggaaacaactttcttctgctggtccagaagagagacaaaaagaaaaagaaaaaaaaactcctttttcttgttttggttctgtttctgctcgtgatgatcttgactgcctgccaggagaagcagtacccttcacggttcactctgtccatggtgactcatgcatccacgtggatttatccaatagtgtggcaactgatcaatgctgtagctgaatcttctgg

SEQ ID NO: 108456 - DNA, 1058 bp, Oryza sativa
tatataacatatcgttagcaatttaaaaacgtactaacgaaaaacgtggagtagctaagctcaattagctctttagagtatgccctaacggcctgtttggttggtgggagtttttttttgagggattggaagtttagagggatgaggctattaggtgttttgtttagttgggagatatgggaattttggtgggatgaggatggggaattgaggaaggaactccctccttttcaatacctaggtaggggcaggtaattgggagggaattactcctttactttgtctaattaaatctcagccatccgattttattaatggcctaatctccaactaaactccctatcaatttccatcacctctaccaaacaagatattaggattaaaatcaaattcccatcttaatctcatcatcaattcctttgtgtaaactcccaatctccttccctcgagttaccgaacaagccgtaagatgcctagcctcatgttttttttttgccacaacattccttacgaattcgggtggatcaaataattattgtaatatccccgtacaaaaaataattcctgtaatatactctctccgtcctagagtatgagggattttgcttattgttcatatttatattcacctaaaatctcttatattttgggacgaaagtaattaagttccaacgacatgatatatcgttctttttaaagtcatgaatttcaaatgagcctttatttttctttgtcaatcggaggagacgatcgatgctacattgtcatatgcgcagttgcacaaacatcaattcttttatacctacctgtcgctaatcgcgtctcgatcgcttcggctaattaaaattaactatggtgtgatggtgcttattgccatggatggcacaagacaatcattgtatgtcagcttagtgttagctctactctagtgttctgaactctgaagaaagggagatgaggagacaaggaagcttttggctgatctgatcatgatgctctgctgccgttccttgccggaaagccacaccgctttattaggtgttgggtcttgcttaagg

SEQ ID NO: 108457 - DNA, 771 bp, Oryza sativa
tgcagcccctgtttggcttttgattagcaggctattgagcctatatacaaaggaaggaagttcgtcgcttctcttatcttaataaagagtaatcatgacagtactatttgtgctataaatttatctttttttttatttctcaatgtgtagattgagtttgaaattgatttttggtgaagtgatagatttctactttgttaaaaaaatagattttttttcatgaccatttgtattgaatttaaaagaaaaatgtagactaggagacatccggtcgagggatggttacactcccatgaaattggaattcaatcatgtaagaggaagttgtttggttggtggtaggaattaagctgattggtatttgaaaccctaccatagaagaactatacagttgtaagcatcaattatttaacgtattaatcacccatgaaattggaatccaatcatgtaaaaggaagtttttttttttagaagatgtaaaaggaagttgtttggttggctgtaggaattaagctgattggtattttaaaccctactatagaagaactatacagttataataagcatcaattatttaggatcaaacatcttaatcaccccttctttgcctgctgtaagactatttaagagttcctttagtccttgaagagatataacatctttcagcgataatttgtagagccataaaagtgctcctaatttaagctaggaagtgatatcggcttatagtgattgtccaaaagaatatcacgctttaaaggacgtttatac

SEQ ID NO: 108458 - DNA, 1448 bp, Oryza sativa
tcaggtgcctatttccacccccccccccccccaacacccgtgcctcctgccgccgtcgctcccaccccaccaccggcggtcctcttcctcccggtcgacgttgctagccgatgccccttctacctgacgaccctatggctgcagtctgtaccgtcccatattcttccagccaaggtggcacccatcctccgcgccgacgctgagccgtcctcggggaatgccggatctggcaccttgtcgccggattggccccggtctagggccggacgattgcaactcgctgtggctcaagttttgttgtcggctcttcctccttccgaaccgacggacgcattggttggatgacagcagacatcagcccatgattaagcgttgcgggcggcgacgacgaccttgctgtatctgtgtaagtgatgagttttatggagtctttattcttcagactactggaagtttctttttgtccaaccaggttcttgcgatgtactggaagttcctaaacctttttttttttcctgaacgtgttcctaagtacacttgaggctgttattttggtcgattgcaaagcaatttgaattaacaaatcccaaagcaaagcggtagtgacgagttttttatgtgcatgttttactgcctcggcggtgatgcaatcattcaggttttttattcgactgcatcttacctattcaaactgcaggaaagtattgaattattgtgggttctggtggtttttatgctgacttgttcagttgttctcggtggtggtcttttttttattattagaccactgtatgtgcctcgtgttagtctgtttcttgttaaaaaaaattgcatggctcattatagtatcctactaggcttttcatgctctaggttcattgatatacaacttttctgaatgtgaatgagctccttgaacctggattttggttaggcagattatctgcattatcttttacactattgtatttggttaagtgggttatctatgtgaggccagatgtagtgattggtcttacttgtgatgctaacaagcatgctttcaaacttacagaattgttcttttggaaaaatggaacatgaactgtgatctaacgctcttatcagtcaatagccatccttttaattgtaattttcatattagagcagaactacctagcatttccctgatgctatcataacacatgaaactgacagcgaaaattgaagggcctaatatttattgtcctacaatgttgcactttgtaaaactataaataaaattataactcattgagccgcatcctttcagaacatgttaaagtctataaggctctcatgcctagcttgacagttaaagctcaattggaactgaagatctattaccatctaacgttcattgcatactgaaaattggattaggttcttttagagcttaatagggcctgttttttttataggttatggtg

SEQ ID NO: 108459 - DNA, 666 bp, Oryza sativa
aactgatgctggattgcttttaactctcacttgtcgagtgattagtgtcttgttctgtcctaaagataccatgtgctgtaacacaaataaggtaactgattagcagaacaactaaaggtttaagtgaagctgtcagtgtcagacatccaagggacaagatgtatagcatatataatgaagatataaaatagtcaagtattcatatcggatctagattttcttggccctaagaggacaatgaaaatgtatgccaaaaaaaagtaagagatataaactcatgacaactgagaacagagagctcctaccttttggagaatatgttgatctgtttcatgcatattggagatatcatctgagctatcatacaattgaacagaattatctgaattagcataagaagaacatggtgacagtccattggttggagcaattgtttgagagggtattaataaaaagttctgctgacaagacgcaccccagttgctctcatcatgtgactgctgtgaagaatcttcggtgctatgagaagaggaaactggagataatctcctctcatcagtttcagtagatgaaggtgataacagacctggcagcaccacatcagaattcgatgtgatgttaacagctggaatttcaaacgagtcccttgcaaccttacagtcagaa

SEQ ID NO: 108460 - DNA, 1219 bp, Oryza sativa
tcggtcctctgtttttagtcgtcttgactttgtccgtgcgtcctttacttatgtgtaatctcttcgctccgtacccacagatggtagatctggaaaagtggtctttatctgttgctattctgctgaacacttttaatgcgtactacgagatgtctatacagtctttgtatagctggaattgcttggaaacgtgtggcaggctatagttgataggcattagttttgcagtaggagtcatgttgtggtgtcacctagcaaatgatattcattgggcatcaaagcagtaatgttttcgcagtaatgttttcgcttaattattgtcacatgtgtgtatgtgtgccaatagtgcgcaacacagaatccctgcaagatgccaattgactttgacttttctccgccttatatgttgtttctagttcttgtttttttttttttaaaaaaatgtcgtatttgctgattggttgcttacctgcttgaaaaatatgattttgtgattcatgatagcagctcacttggtggcatattggtcgctattttctagtcatttcatcattcatacttaagacagttatattatgatttgtttccatggatgtatttagttgttttggcgcatgcaaaactgacatgactaagtatatatgtttcttagtggaataacatgatggtgacccaacaaaaagttcatcttttaattgttctcttggaaaaaccaatggtaacacactcacataccaggaatcttcgtggatatgtgatatatcttggttgtggttctctatcatattactacctgtatatgattgttgcaatgacttcttattctatctagcaatatctgttggaccttttgacgtgccaactttttgtgcaaaaatatttctttattatttcctagttctaaaatgtttcttctttattcgatatgtaggtctttgcatatggatcagttccattgaagacttaccttcctgatggggacgttgatctgactgtactcggcaatacatcttatggtagtactttaattgatgatatctaccacatccttcagtcagaagagcagaattgtgatgctgaatttgaagtaaaggacttgcaactgatcatgctgaggtgcaatttcttgttggcatgtttatgcttgctaattgctacacattccgagccattcatgtgaactgtagtttgggaaaatccttttgtttctgctggtaac

SEQ ID NO: 108461 - DNA, 3358 bp, Oryza sativa
ctcaagaggccgaacagaagatgaggatagggctaagaccagccgaccagacaaaagcaaaactgcataaagacgtacacatgcaatggtgaaaagatggtggagccccctcctccatggccgggactaggagcaaccgatggcgagacgcgagggaaggaaagccacgtgttccggacggagtcgcagacccatcactagtaggagcagtaactagctaccactcttattagctcattcactcgctgagactgaccaccaagaagaggcaagaaaacagatggagtactatacacatacagtggcaataatactcgcaaagtacaaaagcaaaaacaaaagcgaagaaaaggaggatgggccaagaactaaaactactctccttaccgagtcacatccactgatctacaaatccatggatgtaatggaaatggaaatgtgaagccggtgaagtgtgcagaggagcaagtagcaaaccatgtgaaaccacggacagatgcatgtggtctccgtctcccgactttaaggcagctactggagcaaagcagggccatgaaaattgcctgctactacgtcagtaattctgtaccgtgccctgatccaggagaaacaaaagttggaatttttctgctcttttccttccccccacccccattgtgtagtatttgtggtgtgaatgagtgtgaccttctcctaataatccagcgatgctaccacaagttaatgtaaggggcaagtggtcatcagtgctctaatctgagctccgagaggtccttctcccgggatttctgtctgtttcttgggggaggcctacaggaacgcaatctgcgtgggtatcttcttgacaaggcaaggattggatgggccaacgaggtctacgtcgacaatgaaccaatgctaagctaacagatcaatcacacaactcatggcagattaggaagcaaaaagagttgctcgggcatcttcctacttaatccaaaactagcatatatgaaactaaaaaacgcaatctttttcctcacctagactaaacaagacaaaaatgtcatctcttgattcttctcctcacctagactaagcaagataactgaagtaacagcacaagagctccaatccgaatacagtggagacaaaaaaactgaagagactcttctagaccgcgtccttgtgttattattgccaccactaacgcacaagcgttttgtaagaagaaataaagcaggaaaaattatgcagagcggttcaggacaggcaaagacttatcagccacccacccaaccccccgagtattaactccagatacggagtcggcattaatctcgatcaataaattccaagaaaaaaataaccaatctaattctgtaccgggaactccagggaagaagaagaagacgagattttgctgcatttgcacgcctaaagaatgccgctctccggttctctccaactccaaccagagtagaatagagagcgagagatcgaaacgtataggattctactacatttgtaaggtaaacggcgcatctgcatcaagaaatccatgaaagttgggagaggcattttgtacctgcagcacaaaacacggcgaagcaggattagtagcagatcgaagcagggccggccggccactcctgcctatctcctcgtggacgccgtcgcaatgccgtggcggacagcagcagcagcagcgtccatggggcgctccagctgaacaggagaagaagaagaagaagaggacactggcttggctcctgtggccctcgctctaccagtggggccgtgacatcaccgtcgtcgagtagacgacaatgccaccgagtccagctccagcatacgactagtcgaccttgcgagtggactcacagtgtgacagggtcgctgcagctagctggtgaggaaaaaggccgagcagataccgagggaggtgtcgtgtcggggagcgcggcgagcgttttgtttaatccgttttgatgggggagccgggccggggtggtcactttctcgtgatggcttgggcaccggaaaaaccagagttggtgcggccggtcgcgacgccatgccaaccagccggcgggcgcgttaggccggaaaaccagcggacgaacgatttgtagctttggacggttagccatcttgccggttattcctttttggagaagggctaaaaaaagttgtgcccaatcgccttttgtaagaaatccacttgtggtatcgtgaattccttcctaaccctgcctacccatcaactcttctcgtcttcttttctactcctatagtagtacttggagctactggattagtactattttttattgagggaaaacaggattactatttagggatggaagtcatggtaaaattcattgacagctcctataattgaaataaggtcgacagcgacaactaactagtggtgcatatcaccatggttgagaaaggaagaacacatttttagcgctcaggcatatattaagaaacaataaatatagtagaaatcgtccataaaagaaagaactcatgctcggtgtctaaagttattttggaagatgacaattgtagcgaaaaaatctataaaagaaagaatgggtgcatagtatctagccatatcatgaaatgataaccgggacaaatatcggttatgaaaggaagagagcatgtttagcacctacaaccatgttaggaagtaagaaaagaaataatggtagtggaaattagctattttgtggaacatgtgaaagtgggtgagaaagtcgactaggaaggatggagagaaaagaggaaattatttatttctttacatgagaagacgaaattccaagactaagaggttggggctttcataggaaaaaatatgaattaccccctatccccgaactatatcggtcgaccaaattatcccccctaaatctgaaaaccggacattattcacctccaactatgcaaaccggacgaattaccccctcgacccaatccgcggtggttttggtctacgtggcagttcagtcagcaattcttttataaaaagcaggtggaccccacatgtcagtctctctctcttctatctctttcccaatctctctctctctcttctctccaacatgggcgacgcagaggcaacggtgaggtgaggtgagcgcggcggcagcgacggcgaggcagggcggcatagggggtgggcgcgagcagcgtctgagtggcgagcggcgacagcaaggcgagcacgacggtggaggaggcgaggcagggcggtgcaggggcgcgggcgcgagcggcgtccgggtggcgagcggcgtctgggtggcgagcggcggaggaggcgagcgcggcggccgacgatgagctcctcctcccctcaccg

SEQ ID NO: 108462 - DNA, 1342 bp, Oryza sativa
aagatggccagagcggcgaagaagttgcgccattggggacagaggaagataagcaacctgaggccgcgtctccagatcgcaaacaagattatcttccaactggatgtagcacaaggaaacaggtccctgttgtcgcaagagctgcgattcagggctggactcaaagggcaggctctacctgacgcttgcctccctagaaaggataagcgtatggcaaagggcaagaataaagtttttaaagagggggatgcaaacacatatttcttccacatgaaagctaaggcgtgagtgtgtgacggcacaagttgattatcggcccttagcatgaatcatgatggtcacatggcaaggggatatattgattcggtgatgggggttgccgacaaggaaaacagagtgatggatcttcaagcactaggtttggtaacagcagatctgtctgacctagaaccgcaattcacagaagagggagtgtggagtgtaatcaaggaattatccagtaaaaaggcaccaaggccagacggtttcacaggtcttttctatatatcatgctgggccatgatcaaacgagaagtcaagctatacaatggcaacaaacacagggtcattctgctgccagtggaaggcccaatgatgctgaaggactactggcccataagtttgattcacagttttgccaaactggccactaagttgatggctacaagactccgcgagcaagattgggaattggcgtcatacacacacaatcagcttcatcagaggaagagccattcacgataatttcatgtttgtggaagggacggcacaacaattccaatggtgtcacaaaacaatgattatccttaaactagatgtacaattatttggtcttttggggttttctctttcaaatgctacagcaccagggttttggcctgaggtggaggaactagattgttgaactacttctcactgcagatacttcagtgggaatcaatgggggtagagggcgaaccttttaagccatcaagggatctgcgttagggggaccctcggtcacccctcctctttgttctggtaatggataccttgcatgccatattgtccaaggctatcgatgcaaggactctggccaaggttgataacaaattggcagcgccagtggtctccatgtatgcggatgtcgcggttatttttgtcccaccaacagaagaagatgcctggccaattaaaaatatcatgaatatgtttggggcagcaactggactacgaacaaacttgatgaaaagtgtgatcacccacatacgatgtgatgaaacattggtgaaaatggttcaatcaattctgatctgcagatttg

SEQ ID NO: 108463 - DNA, 1260 bp, Oryza sativa
caagttggaggacctaaattagtgatctgcaagtttagggaccgggatgaacagtcgaacaagtttgaggacctgaatggtcgatttgcgagtttagggaccgggatgacataacggtacaagtttagggactggggatggactttactcaatacttaatgatgttaaaatgttttacttttatcgtttatgcagcacacagttcgtttcaatctttcttgctgaagcactgttatgtgcatgcaatgtttttccttgaaagatgaaatgaatgaataagtacctctgcatctatgtacacagtgttgggcaactaatagaaattgttggtagggagcaatgcattattttgggcatgtattttagttgaatctctttgtagctcagtaagattttgctttttgttgcaaagtagggagcaaagcaaattgttgaaaaaggcgagttccctcgcacagcatcagcactccgtgaagttcgtggcattggggattacacagcaggagccattgcttccatagccttcaatgaggttgtgttccacataatttatatcctattgaaatcaccatggctatgatcctttacatcctcacatgataagttgataacacaacttcttgctaatataggttgtccctgttgtggatggaaatgtccgagttatcagcaggctttacgctattcctgataacccaaaagaatcctcaactgtgaagagattctggtcagcaactatctttatcgatcactgtaaaactgtacacacacatatatatatccatgtatgtgccatgacttacactaaattagcactaaaattcatccttactgcatttcatcattttgcacaacattgaattatactgataagcaatttcagccaaaatgtgtaagttcatataaccaatttgcacttgttggataagtctttgtggtcctttgtcgtgattcttctttttgcttttgggtagtttcacctttttcaggacagcatctaccctttagcatatttttcagttgtaggacagctgcggttagtaggacagcagcagttagcatctcctttatgcctcctttatgctttattcagtttggatgccctctaggacagcatcccattcaatttcgaattttagataggagggtgcagcaataggctagcagccagctatggctatatatatatgtatccaacctccctcgggtaagtatggcttttgtgtttagtgaatgaagaaaaccagaaaatcgccccat

SEQ ID NO: 108464 - DNA, 547 bp, Oryza sativa
gcatctccatgagatcaccactcttgacctttcacataaccaaatccagggagctatacctcagtgggcatgggagacatggagaggcttgtactttctcctcctgaacatgtcacacaataacttaactagtcttggatcagatcctttgcttcctcttcgaatagagtactttgatctcagtttcaacagcattgaagggcccctacctgtaccacaagaaggaagcaccatgttagattattcaagcaaccagttctcctccatgcctcttaattactcaacttaccttaaacttatactttcaaggcttccaaaaacaaactatctggaaatattccatcaatctgtactgctccgagactgcaactcattgatctctcttacaataacttgagtggttcgatcccaacttgtctaatggaggatgtcactgcattacaaatattaaatctgaaggaaaataaacttattggaacattaccagataacatcaaggaaggttgtgcacttgagccatagataataagggcaattggtttaaggg

SEQ ID NO: 108465 - DNA, 1307 bp, Oryza sativa
gaacatagacattttgactgaagttatcagtaaaatgcacgtactgtcaaagcaatgttaagatgaatcaccagtactaatttgtcggaaatatatgtttatacggccttatcagttatcaacaaagatagttgcttaccaaaatctcttcattgttgaggattcctttttattatcaggaatagcgtaaagcttgttagtgataactcaacatttccctttccgtccacaacagggacaacctacattagcaggaaagttgcataatcatgtgattatgtaaaggatcattcccatggtgattaggataggagattaattatgtggagcccaaattaatcatattcagctacaaagagattcatcccaaaatgaatcttataaatgcatgcccaaaataatgattttctgttagtttatcgggatatgcatacgcactgtttttttaccacatgtcgctcaaaagatcttcccagctttatagaaagacaacagaacatgcatatacacttatttgtctgtcatttcatcttacaaggaaaaacacatttcatatgcataaccatgcttcagcaacaaagtttaaaatgaattgtgtgccatataaaccacaaaactatgatacttttatatatcattaagtcctatgactgtctaacttcctatgaactgtaaggtgaattaataataagaaaaggatcatttcaattcatagtgtttgtaattccatccaaagtagtcaattggtcaattggtgaattgccaagtagcaatctgacatgagattgcccagcaattgtaacgcagcaggcatcaggaactagtagtcataattccttcttttgtaacataaaatatgttccaaacaaaactttccttttcagacagaacatcaaacagtgcacgggcactgtagaagttgtcacaattttccataaaatgcatagaacgttcccttccccaatcccatcatttcgtgtaggcccaaccatgattttgtgattaatttatttactactcacctccagcagaaattgaccgtccggtagttcccaagacgcccacatttcattcaccacctgcaaattattacacctaattctgcaactccaaaataaaaagaaaagccaaacaagcagaaactgtggcatatttcacaccaatctgccagaattcattacactaaatgaacagccaagttgtattagcacctactaatatggaatatttcagatgcttctttaccaaacatatgtagtcatcgacaggtgaatttttgttctagttacttgttgaagcagaatgat

SEQ ID NO: 108466 - DNA, 923 bp, Oryza sativa
aattgtttaactaaaaaatagatccatcagtttgaatgaaaatcgatgaccaaatagtttaactaaaaaattgtatcaaataatgtgtccacttgttggtttaagtataaattagttgatataaattataaattgttaatttgatagatataaaatataatggtataaacttcagacaatgtattatttggaaataattagtccaccagtttaagtaaaatattatcttatattattaatttaatgggtaaaaattaactttataactttatttttaaacattgtagagctaatgttcagttatatttatttgtaaagtgttactttatgattatatatatagtatatgtttgtaatactatattttttaaatttattatgactaatataattattttctcacatatacatgaaaaaaggtggaaagaagagggaagctggtgtatttttttaattgatgtatataatttgtgtttttagtttttttggctttaacgttcattttttggctttaattgatgttcatttttgtcttctcacataatgttttacgatatgtatgtactttgtatcttgggtttttttacgagcaatacttatgtgaacaggagattagaagaagggagttttttaaaaaatatatctaatctaacgggtccatcaatttatgtgaaaattgaaactagatgttttgcttttttttcttagaatttcaagcaatttctttaatttattagagtgccacgtgacggcttaagagcatttgtagaaagtttaatgaacttttactatataatagatagataatttaaatatagaatgctgaagcagtgttgattgatattttatatgcaagatctagtttaactgcatatatttatagagtaatatacattattcctaaatagtagaaaatactattt

SEQ ID NO: 108467 - DNA, 629 bp, Oryza sativa
tctttgcatacatagtaattcgccaggacaaatgaaactacattatttataactaatatacgtggatgaagtgttagttctccttttatttattgaagtagttgatggtcgaaatcggtacttaatgaccgtcaacaatacccccaaactaaacctttgctcgtactcgagtaaagataaactaggttgttgatcaggagtttctaccttgttttatgtcacaatgttgccatgagtagaatatgtctttcgtatataatttgaataagttgataatagtacttttacctctcttaccttatttcccatggggcttttaccttctccttgtcttactctttattcaactttctttccggagggtttcacgaattatgcaaataaaacccaaagtttctcaaatgattctcgcatatcgttcaatgcgtataattccttaccaaggcatagtattgccttcttttttttattctatctctaaaatgtttatacgtggagctcaaggtgggagaaaataacgagacaatacttgtattacatatattgcaaaatcaaaaataggatctaatgagaaaacaaattatacaatcttattgaaagtgcatctaggcccctcattattttggtgt

SEQ ID NO: 108468 - DNA, 664 bp, Oryza sativa
ataaacatacattttgaatatgccctgaatagctcaatcttgactaatgaatctttagttaaaggacgagggttttttttccgttcaattcctttctttctttctacttctagtagttacctccggaatgtgttttattaccatccataatccaatggtccagattcattcactctcttttgcctggaataaaatcaacggctaatatttgtcaaatgatgtggctcattcccggttaactttggagttacttttcactttgttaagattagtctgttggtttctccttgaagaataattggatgcatgcataccttcaagacataccacccgcgaatgtatatttgtgaacgacctttttcacgggttacattcaattatttgtgaaatcaatgatttgattattttttatgaacaactggaaagaaagcctgcgcaaatacacagatatcttatttatttgttgttcagaaaaaaagaatgctaaaaaaaatcatatatcactatatacaccataagagacggcagattatctaacaataaaaagtaaatatctttgtggtaaaatagaggtagactttatgtaacacccaaattttttatacctaaacacactagtacagaaactgataggtgccggttgggaactagcaataggtgccgg

SEQ ID NO: 108469 - DNA, 637 bp, Oryza sativa
gaaacacacatataaagaaaggtcttgctaattatcaagaacaatccatgcaagacaaaatcatgagaaaattcatgaaagcacaaatcaatataatcagctcactataatttttactcaaattaatatttaaatttcttagctcaataattcagtcaaagcagtcaactataggatgtaaaatttaactttaatctgctaaaaacataactcacaaaaatgtgcattaaactgcatagaagtgtatgagtgaaataatttattcacatactaggttaattatcaagagcaaatataatttttctagagtttatttcttctatttagacctcctaaaattcaaacaaagttctggtgagcccatattctctatttgtctgacagcaaactacacataattagtacaaccaaagaaaatagaatctagataatttcatctacctccggaaaaatccactataaattattctgcacagaaattaaataattgaattactaaagtgagggagagaaataattcaggaaaatcgttggaaaacatcttccactcatgttcctacccttacctctcttacccacatagctaccatcgacctgggcccatctagcagctccttggccacgcgtcgaccggtgc

SEQ ID NO: 108470 - DNA, 645 bp, Oryza sativa
cgaagaaaaaaaaatcccagaagactttctagtgattcctcatgtgaacatatagtataacttagctaaatctataattagttaggccaatgaatattttgtaaataaattaacttatgttaaaaccttctagaagctaagataaactaataaagcatatataaaagttcttaaacatgatcaaaatttgtgcaaagcgcgactatatggttagtcattgatgatatatatagacaaacaagtttaaaggccgacaatacactttacccaatatgatatttaagttactttgagatgtgcttttcttcaattgtttgttttcagcattatattcaaatgattattgttttctctgaaatatcaatgagaatataccatctggatatatgcatgattgctatataatttatatttatgtcgtttctcaatatataattattggccggtcctccatgttattcgccgggggaacaaagcatgaacttttccgtcatatacgaacggacattaacgagcattcatatgccatgtgcatttggacggtgatcaatcgttggcttgcacttataatgggaagtttggttcaacgttgaaatatgccataccacggccatatcttagacatgacgacactacataatacga

SEQ ID NO: 108471 - DNA, 1164 bp, Oryza sativa
atcctccatttgtgcaagttacacgatatgcacatccatcatcatagtggtatgctggaaatccaacgcttaaacattgcaaagcacctctccggctcaaactctggtgcagtgtgtccagcaccctacatttggagagagtaaaacagtattacaatgcatattcaaaacaagtaaaatcacaaacaataattagttggtcttttgtcaagttcttgaatttttttttcttcttctatcttgtcgttgatactgactaaggatgaaatataactggtttctttcatcgaactgttaataatgactacgggttagatatagaagttccttgctgtagaggccactaaaggaatagtttacatcatcaatgttgtttgattatttgaatgctagaaataaaataaattaattatatgtcctacgttcagctcaaagcatatgttattggatttgtttccattatacgaaaacggtcaaagcgtgcctcttaggctgtaattttgctgtatatttgtgttgagttgcatcaactgcctttggtcattgaaaaacataagctgaatgaggaagagagaataatacttttatacttcaacactccccaatgctatacgtacaagcaactcatagaagtgggctgtgtttttttatttaactatgatggaagccggtgcagatgcgtgggcatattagttattgttttatgaaagcaatgctaaaagaagtcgctaaaagaagtcacctcttatcatttctatgacgtgaaatagaccgtaaactttaatatatttaaatgataaaaatgtctcctagattaaaaaatcacttttgtcccagccacataatgaaataatatgtggagaaattataattacactttgtcaacttatgtcacgctataggatagatgggaggccattaatatatatgttgaccatgcacttaaaattgttatggcaatggaaaaagctatggttgtttcaatttaagtgaaaaattaaaaaccaaattattttacgaatttattagattttctccaaatggctcaacttagtctgtattgacatttgctattttctgtttttttattttacatggttcttattttaagttagaaatataggcattgtgtacatttaactgttattttagttatgaatatgg

SEQ ID NO: 108472 - DNA, 665 bp, Oryza sativa
attaagattaacgcgcgtcctcagcaaattaagataccgtggtacaagggaaaagtagctttagttataatcaactagttgggtggcccgcgtaattgcgcagctagcacccaaacaaaatcatatatttttcagtataattttacttaaaatctattaaatagatatattgttgtcctaagactttgaaaggccaaatcttatcatcctcatatttctaattaaatagtttttaaaagtcacatcagttactacccctaacttatgtcatatcttacttctgtcatatccttctttatttgctttgctcgatctactactattattcattctccttagaacctttaaaaattagatcttatagttttagagtttattgtctcgttgggttttgtttttataatttctagaagttatgtcaaacgctgccattatacttctctacggcccgtccactgtcgtttctctttattgtcattgggattttaaaaatcgaacataattatcgttcgggttcttttttactttctagaagtcccgccaaaccgtcagcggctttaccattgtactcctttatggcatgcccgctgcctcccttctttattgtcattaagattttaaaatcaaatatgattatcatcggtttttttttttactttttaaaa

SEQ ID NO: 108473 - DNA, 635 bp, Oryza sativa
cctgtttagcacgaaaaggaacaaatctgtcagtaaaacataatccagtgacgaactacaaaaatatgatataacagaacctagatatgttctaagcagcaaggacgttcttggcaaggcaacaagataagttgttgtattttgaaatgctgaaaggcaggttacataaaaacaacatccaatgattgaaaagaatatacttggaagacatgtgattttattttttaaaagaatacatgaaaaccaaaattgaacacaaggcatattgtaacatgattccattaaatagtgaactcacagcaaaattttccgaagacatcatagagttgaaattggtctttatatgcttcaattatatattgcatgttttatcaataacttatctattttctatatgtgatgcattgtttagtggcactgcagtctgcatcacatattttgccacttgtgcaaagtattcaagccatttcacttaaggacttaaggtggtaaaaaaaactattcacatcgtaagaataaaaattgtagagtggtaccaagagaaaatgggtatgaatgtgctaccatatgtgtgtgaaaatataaaattaaaatgacataatttggatagaaaggtaaagcacaaaagtcaaaac

SEQ ID NO: 108474 - DNA, 524 bp, Oryza sativa
tggagcaacatgcaagttgatcctcttcttgagcaacttgagtaggtttttacctaatactcatgctttggtgatggctagaagtgcctctgatcatgcttcgattaaagtccaaattgctactacaatccccaaatcaaatgtatttcgctttgaaaacttttggctgaattaggcaggttttcatgatcaagtcagaaatgtgttggagggcttcagagttactcaagatcaggcaaacataatttcggccaatttcaaaagattaagaagctctcttaaaaagtggagttcttgtttggctaaactctccaggactacagagaattgtaacaaggtgatcttgtttcttgataaactggatgaattccgcttattgaatgttccagagctaagattcaaaatgattgttaaaagccagttgctttcttctaagttggcagtaacaatattggaagcaaatatttaaacagaaactggttcttcttggaggggaaaacacttagttctttcatgccatggcc

SEQ ID NO: 108475 - DNA, 538 bp, Oryza sativa
tacaaagtagtggagaaatcacttatcttactcgcctgttttttttctctcttgttatggccataaatccattcattcagattagtcatggagcaagattttcactttttactcttcataagaagtgaaggactgacatattttttctgctatcttctttacaattcgaaagacttacattgataaacagagagtgattgtgttatttgaccgcataaataggaatatgggatttttggcgtacgcacatatttacgtgtttcccattttctcgaaacacattactgcattctcgtatggaattacattaaaatgatgaaaaggaaaaattagtgaacaaaataaacatgttttttagcatcttgtttctacacaatggatttttttataatctctcttaaataagttacaaagctttttccactgatcatgaaagattaaataaggtatactctcgaacatgccacataaaacatatacggcccaagtcttcgtaaacatgaatgtcatcatggttgtcattgtctaactgcttctt

SEQ ID NO: 108476 - DNA, 547 bp, Oryza sativa
ttctttacaattcaaaagacttacattgataatagtgagtgattgttttatttgatcgcataattaagtaggaatatgtgatttttgtcgtacacacatatttacgggtttcccattttctcgaaacacattaatgcattctcgtatggaattacattaaaatgatgaaaaggaaaaattagtgaacaaaataaacatgttttttttaatggaacacacaggggaggcccccgctgttataaaactttattaaaaaggagaaaagcaaaatacaattacaaggaattaatccaagatataactactaatttgtctctctcgttaagtctaaacaaaaagaaggagatcaccctttaagagttgcctccaggaagtcaaagaaggaacttttccatcaaaaatgagaccatttcattgcttccaaataattcaaggaacaagaaggatacgtttccataaagcaaagatcatgatgtcttattttagcatctatctacattggtcccaaactgaaagatgtattccagttaatgccaactgtatgcaa

SEQ ID NO: 108477 - DNA, 826 bp, Oryza sativa
cttactcgcctattatttttctatctctttggggttggccgtaaatcctcctctcaaattagacatggggcaagatttacattatttgctcttcataagaagataagatcgaacatgtgtttctattatcttcctagcaattctaaagagttgctttgaggaatagtgagtgaatgttttgtttgcccacataactaggaacatgagatttcttggcatatgcatgaatttatgtggctttcattttctcgaaacacattagcgcatgctcaaatggcaatagatttaaaatgaagaaagcgaactatgagtaaacaaaatgaacatgtttttgatcatcttggttttgaaaagtgaaataaaaacatctatcaaataaaatacaaagctttttccactgattgttgaatattgaattagctactctcacgaccataccacataaatggtatacgtggcccaagtcttcataaatatgaatatcatcgttgaagtcattgtccaactcttcatccgtaagcatgctgcagacatagttatttgtttgatccaaagcaatggagaaatcatcttttgctggatctagctatttgtttgaatggccataatacctccactaaaactagacatggggtaaaattttcgttgtttgcgctccataagaaggaaggaagaactagttttttttgctatcttcttcgtaattctgataacaacattaggaaattgtgaataacttttttatatgccaacattagtattaatatgggttgaattcttggtgcatgcacatatttttgtgcttctaccttctcaaagcacattg

SEQ ID NO: 108478 - DNA, 5269 bp, Oryza sativa
tcacccccttctctcatgcccgagcccaagaatacctcgtgctctctctcccctcttacttctcttctcaaatgactcacttcctccttctcaaatcgactcgttttggagccattttttgcgggaccttttgaagacattgaagagcaagatatactcctccattcccccctctcaaatagacttcaataattgttttgtcctttgtgttggtttttagtcactctttatgtatttgcctgaatgcttgttctttttatgagattattgtaataagtgcctgtagcttctttgaagtaaagaccaggatttattccattatctacaaaattgccccctctttttttcgttttaatcagtgaaatttgtagatcgaagggtaatcttataacccatttcgcccccccccccccaaatttatgaatttgaacgttgaaattggggatttgttgattatagtgttacatgtgtgcaatgtactcgttggtgctacgattttttagagtatgtatgtagtaatgttgattaagtttaacatgtttgacatgtcactattttaaatatgcttatattttatacttatagttttggaacagaagaattgtatgataggataatgctaacatattaaattgttctctaatatttgcacatcggtttttggcatgtacagtgttataatatgcatccatgtaccatatatttcttttaaatttttttatatatgcaattattaagaaatactaatttaattatttttatattaattgttagctagaaaataggaggttagcttaaaagaaagagaagacacgggaggggagggagtacatacgtgcaactatttctaaacataatagatctaaacaatttaattagtgggcccaccagttaagggaaaatcaaccgttgatattatttttcagaatatttagaatctttctaatttattagattgccacgtggcggcttatgagcgtttatagaaatccctgtggcagcttgagagcgtttgtagaaagtttaatggactttttatatataatagatagatagatagatttctattaattaaaatttatgttatcatatttttcctcaaaagtattttcttatgattatacttttgtgtcacataaataatatattaaggaatgaaccgttagtgaaggacttgtcctaacaaaacaaaatacaccctatatttttaaaatagtgggtgtatataaattaacaaataacatagattgccttacacatacgtaggacttgttaatctacatgcctcacattgcatcctattattcaattgaaatttttaaacattggtgtgtctttttttctttttcaccaataaacaactgttcagaatgtaatttcaatattctaatgcaaaagaaacatatagttgttgtggaaaggagtcttaatatcggtcctctatgttgaactgaacaactactaaacaaacagaagtttacatatctttcaaatgtaatatatctgaagctaacaattccaaaaaaaaaaagaaaagaacttacagtttgaggcttacacttatcaatctcttaatattacatctttaaaatggataattaagcataaactatgccttcaaatgatactttttcaatagagtaaagtccatcatcggtccctaaacttgtaccgctgtgtcatcccggtccctaaactcacaaatcgaccgttcaggtcctcaaacttgttcgactgtgtcatccaagtccctaaacttacagatcactcgtttatgtcctctaacttgctcagttgtgtcaccccggtccctagacttggatttgaatattatctgggttaaataggacggtctaaagactttatatttaaaaataattcataactttttcatgtgaactctaatgaagacaaactttatatcaaacttgtagccctcgacacgatctacaactttgtagttgattttttttattttaagtcattttttgtcccaaaatataattttaaaattaaatttcaaaatctataaacatgcaacaatattttgggaccataaacagttttaattcaaaaacttttcaactacaaagttgtaggtcgtgtcgagggatacaattttgatataaagtttgtcttcattagatttcacatgaaaaagttatgaattattttttgatataaagtttttagattgtcctgtttaaggaccggggtgacacaactaaacaagttggagaaactaaaggagtgatctacaagtttagggaccgggatgacacaatcgaacaattttgaggacctgaacggtcgatttgcgagtttagggaccgggatgacacagcggtacaaatttagggaccggtgatagactttactcttttaaataactataatttagttttgaagatacagtctctatcagaaaatatatctgtgacagactaacacatgaattattccaatgatgctgaaatcttgaacttgaaagctgacagtatcaataatttagtcataaagagataaattgtgtacaaccagtgttcacttggcaacgtcaactcaataagaaagtgatgcatattgagagttctatgtaaaaaaaattgtctacatgctattctaaaacaatttatattaagttgtggtagtccattttgcattttacagtttcgtctgattagttcataataaattcttcctaacctcacttttgctgacctatcctatcctatcttagtataaagttataacccactgatcctagagctcaacatgcaaacatgtcacctcatcatccactagcaaaaattgcatatacaaaacttatgcaagcatgcaacattatctataattcattaaattctacaaatcaacgtccaatcatcttccttcacaatatttttaacatataaatatccatatcatttttataatacttaacatatattcatccatataatcaaagtacgggatatcatatttcatctacaatctcatatagagtctactaaatgtatttctctctaaacatagtttgagaaaccaattttatttgttgttaataactaatataatttttacttttagcttgattattaaaaaaatattaaaagttacataggaatttccgcagcaaagcgtagggaattacctagtatatactaccaattgtccgaaatagggtccaatatcagatctgattatttcagcttacatcttttcgaactggtatatccaccatttatttttgcgggaaaggtatatacaccatgtctcatgctcatggatgaaaaaacatatctgaaactaataaaaggggttatgtccctagtttttcaagtttaccagttaggggatacctagcattgtaattaacagcaattttacaattggaacttaatgaaagttgagtgaaagtaactccatttatttctttgtaaaagaactgactattgaccttctgtgtaggacctatttggaatagggacacaaaattgcaggaggtcagttaatgtacatctcaagtataaaaatattgtaatatctcaaacaggcagattgtcttagagcaattgtttcataatctcttgggtagtagtacgatgaagtcacaatgttttcatggtcgtcaaaattcctcttgaacttctgtatcatttgtcatttctctgaaatttgtgataaaactttagcaccatgtctgtacataaacaaagtgcaaaaatataattttcacagaaaataattaaaatcgttaatgtcacacttagttatctttatatacttttagaagctattgaatccatagagtggaatattattatgcaacacaaatgggcatgaaagggagaagtaataaaggataagaaaattgtattatgaacatcgacgatatagaaaatataagggaaaattatggtgaactaaaaaaatctgaggggaccaacctgctgaagtaagtaagattcagatgtaattacaaggaagaaaaaatttgcaaggtggagaataacagaagaaaaattttggtacataaataaatcaatctgataggagagcattgtgccaatttccggtggatgggaataaggatatcgataaatgataaatagacctgatggctacatgatagttgagattagctcaggagagatccaatggctgatgttttctaggttatttagcttaacataagatggactttaatatcgtcaacgacaaggggttccactcccatctaaattgaaacacaagattctagttattccacattgaaccgttgctttgtgctctaaatttacatgctaaacagaaaagctacttaccatttatatcatactttcttcatatagttctcgagaactctattatcatatctgaaaataattatttcctaccttttttctgtatgttacttatgacatcaacatgaactccaacacactatttgaccaagacttttgctaatcataagttcatgaaaactgcaaaataataataataataataataataataataataataataataataatatgaaataattttaaacaaaatgtaattatttttgcctattagtgcaaaaagaattcaaaaattctgacggcaagaatttcctaatgtaaaggtgtatagctaataaattctcccttcttttcaaaatataaggcctattttgttttgttaggtactttgaccaacaagtactctatataatattttttatgaagtaaaattgatattattagattcgtcatcaaaagtactttcttatcattatactcttgtgtcacataaataatatattaaggaaggaaccgttagtgaatcccttgtcctaacaaaacaaaatacaccttatatttttctaatagtgggtgtataaaaattaagaaataacatagattgcctcacacatactccctccgtcccataatataagggattttatattatgtaaagacacatatagacgtccagattcattgtactaggacgtgtcacatccacccaaaatctcttatattatggaacggatggagtacatagtagttattgatctacattggctcgcattgcagcctagtattccgttgaaatttttaaacattggtgtgtctttttttttctttttcacctacaaacatctattcaaaatgtaatttcaatattctaatgcaaaagaaacatatagttgttgtggaaaggagccttaatatcagtcctctatgttaattgaacttaacaaccactaaacaaacag

SEQ ID NO: 108479 - DNA, 662 bp, Oryza sativa
acagtagctcatcaatgcaacctctaattctatctataaaaccttcacgtggccttgaaaattattttccttactttggaaattttaatccccttttaggtttttaaaaggacggtttaccttaacttttttttaaaaaattaacctttttcaaaatttccaggcaaattaaatcatccacctttcatttttatcccctaatatgtttcctaaataacctttttccccctttaatgtaacctttaaactgaatttcttgaaaaaaatttctaacttcattttccaaagaaaaacccggccggaaaacttgaatccgttgcttcccgtgaataaattacttatttggtttgcaaaaagacacccttttgctttgtcacctaaaccactttttctcatcaaatttaaaaagaaaccctcctactataaatgttggggatgttcatataaatgttggatttttatcaaattttattaaaaaagtatttttctttttttttcctttttgcaaatggacaccttttgctttatcaccaaactaactctttctcatcaaattaaataaaatggctctaactcatatcaattcttaaacttggaaatattcatctaaatatcccatttttatcaaattttgtaataatttatatttccttttcttttca

SEQ ID NO: 108480 - DNA, 506 bp, Oryza sativa
tatgtctcaggttatgaaaagactaggttgaattctaacttcatttgtgcacgatctaagattgatgctactatctgttggtccaaaccattcattggttactacagtactggtcgtgagtggaaactggggcaggttgaattgttaacactaccaggacagcgcagtataagaaataatttcttttatatgatgagcaagaaattagcataacacattaggatggaaagattaactgacctcattgagccatttccccagcttcctcaagggcttggagaagccaaagaagatattttgcaagagtttagactgtaggtaatcaagcttttcaaccaacagtaggcccttctgcctctccgttgcatacccacgcctgtgaagaaaaagggttatatattcattcgtaccatggtgagttacatgtgtagataggctatcaggttgcaaaaaggaaacaagaggggttacctgaatatgatagcattggactcagctgccttttt

SEQ ID NO: 108481 - DNA, 6391 bp, Oryza sativa
cagcgtccgcgcggcaccgtcgttcccgcggaacgtccgcgcggaaccgcacggaatgcctcgctcccgtgcgccacatacgcgcgaccggcgtggcaaagcaagcagcacttgcagcgcatgcattcagcgaaagcaacgcatgcattccttcgctcgatcggtcccgcactgctcttctgcatgaccgccggttccgcggaatggtggtgcgggaccgagatggttttgcgtatcccctatgcagtagaggtatatttgttcaaaattttatcgcattggtatataaacgcaaaacgctaaaaattaaagtatacttttaattttttttccttttttatcatgtgtcaggaggaggtactggaaacctctggaaatttccatatgtttagccgatttatggttttttaatacatgtacccttttgatccaatggccattgtttatcctaacgctttatctgacggctaatatatttgtgatgatgtggtgcattctcgtgtaacaaagcttgttgctttcactatataagataaggccttaattatacgcgactactactagcacgtacttcatctgtcccataaaatactaaactagaatcagatataacacatcatattactatgaatttagacatatctgtgtttgtgtttagattcgttgcagtagactatatcatatcattaatttttttagacgaatggatgtgttggtgcagttgaggacttgggggtcgtaggctgcaggtgtgaattgaccgtgtaaatttggagacttgtaactcccaatcttcttctcgattgtcaacctttcatgcttgtcctggtcatatggtactactcctgtcctgtacttgtgcctaactccaagataattaagcagtaccaagtctcatcctctgcgctgctcgcccttttgactctccacatgccaacacacgagtgaggacaataattccacatgcaccacaccactgtagtagctagtagaaccaaaagctgaaaccttgatactatcaagaatgcaaaggatgtgttcagtgtaaagtttggattttggttaaaattaaagatgatgtgactgaaaagttgtgtgtatgacaggttgatgtgatggaaaatgactgaagtttggatccaaactttagatctaaacacagtaaaattaaactgaaggaactaaaatatcatggacattgtaaaataggcagaccaaaaaccatactcaaggttgcccttatttacggctatttatttttttagtagtaggcgatatacccattgacaacaaggtgtttagcataattttattaatcttaagatatttcaacccagtcttcagatgtatttatagtgctaggtgtttatgtgtgtttccatagaggtgaatatgcaagtgtatacatatatacgatgtataaaaaaatgtatatacaaaacatacataacgattgtctcactaacatgtgggaccctgtaccgcttctcaacagctagccaccactcgatctacattattgtgccatgctaatttaagggtgatatatactcaaataggatgggttatataaagtattttggctacatataactttgctccttttttaaggagctaaagaacaaggtcaagtatgcaaaaccactcttttagcagcttctgctttttctctctggagtctggacgcgctttggtgatgatccaaagcatctcgtttcacattttgcctcggccaacgaagctcttagttggcaatcacttgagacttatataaatatatatttataaaccctaatatatacaagagagaatgtgcaatggcttttaaaacaccatcctctcttgtcctcatcgatgtgtgccctagcatccattctatctcctcactgcatgcaaacaaatttatgctctgaaattattgagccaccatccgtagtgagcaaaagttaaatatgacaaaagtcagctgatcgatggagcaaaagcgtgtgatcaaattgacggttataactatagggttcaatgcaccaaccagtttacttgaaagcttatgttgatggaaaaataataacaacatatctacttgaatactccatattgttcctagctagttattatcagggttacattaagctgtagacttaaaacaaaccactagttatttgttaatactccctccatttcatattataagtcgtttgacattttttctagtcaaacacttttaagtttgaccaagtttgtagaaaaatataatagtattatcaatataaaacaaacatgttatcaaaatatatttattgttaaatttaatgaaactaatttagtgttatagattttactaattttttctataaacttgatcaaatctaaaaaaatttggctataaaaaaattcaaatgacttataatatgaaatggagggtgtaaattttttttattaatattgtgtaaataatagaattttaagatcaatagaactaatttacagaaaagcttatagtgatgaggagatatgcaatatgtttcaccaaaataaccgaaatattaggcgttccctaattaatatatgtcattcgatggaacataatttttcgctatcacaaaatagtgtaattccaaaatatcgacaagcttggttttcactttcatttcaccgactgtcgtcgatcatttgctgactcacgaatcgctaactaatttgaaagcgaagctaggctaattacaagaacgataacatcccagcatacctggggtggcccatggtcgcacacatggagtcccagattccaactttcgcgttgtaatagctacaattaatcagagaaaaagaaaaaaaaactatgattcgaaaagcatcgtgcatgggagaaaggaggccagagagaatttcgttatcaccacgcactcaacagcgatgggtggttaccatggatcaatcagccctccgacagcctcctactgtggatagacaagaacagaggccagagagagccaaatcagtgaaagatttttgtgaatttctaaaagcaaaaaataaagtgcccattggtgaatacaaacacacggcttactcacaatatatatgacctaatttgtagatcactcaagttgttgtttggtaggtcgtttgttccttcacgatggtcattgtcatttccattcattgacctttttttccctgaatctggccacgcacacaaaaatatacatacaggcacatgtatctcattattatttttcaaatcaaatgaaagatgcactaccacagaaaacagaaacacatctttgccgactcgtcgctacccgcagcgtgtgaaacggcggtgataagagtattatcaatattaaaatttttagactgagcaaactttaatataattagtagtatttactataaaaatatcattaatttacttatcaatattaaaatttaatgtatttttcaccgggcagtggcggagccactgtgtatacataacgagtgcaaccttttttttaacacacgatctatactaaatcccttaatctcatcactatatatattcgtgatttagtatttgtgtcatactgccatggtgggtaaaatcagacactcacaacttcatgatttttttttcacttattttagtcacatcccaatgtataatatactagattgcaaaaaagttttaaactgttagcatgtactccaaccaataatttcttggttttcttagcacatgtagtgctcctgtatttattcggaagacggtcaggccggcttgctatacgtaggtcaattagtatagacgccagagagagcacgtacgtatgatgggccgtattaactaacaaacaaatatacatgaacaaatttttgtttgaaggataaatagcaagaacaaattgcccaactgccaaaaagaaaaatgcacaactagtaattgaacaacatgcttaagtttcttctcatgtgctatcactgtactttgactagacccatccgtcttaaacaattaaccaattaacacgggggaggagaagaacacaactaattaattaacacagttcgcccgggacacttggcaaaacacaacaaaaaaaataaaagatggaaattaaattattcggaatggagagagagagagagagaattgaatcatggcgtccaattaaaatgatgcatcagatccgaaatggatttgtgttgattgggtccctgtcgcgccgtccggttgctggaaacgtgtttgtgttggttcgttcggccgatcgatcgagctcgatcagagaaaaaatgtgcttgatttcttaattttgccgaatcaacacgtaccaaagtctaatttagtgtctaattagcttagctatatattagtcgtagagcatgtcgagttaattaataagtaattaatcgatcgagcagcggttgaacaggggccaagaagcttcagaaaacggtcgatcaatcgatcgattgatcggccacattaccaaccgatcgagcgccaccaccaaacgccaacgcgtcagtcaccaccggcgaaacgagatcgagaagtttgaattcaaacttgaaatttttgtcagttcaaaagagagagagcgcgcttaggattttctagctgaaatacagtctgggtgaagcgaagaaaaataacgaaaaatcagaggcaaggtggtgttttccgattgtcgacaattaaaagattccaccgataggacacactgttgcaactctgacaggcacatgcccaaaccttcaatcatcctactgatgctgtagccactccaataaacagggaagttcaagctaaattcgaaacctttgaacttaaactatagactttaattcaactcaatatagaaaaaatacaacctataaaaccgcttcaatccaaagtaccatagttcgtcgagctttaaaaaaacaattttcccaaaaatatggcgctatatttttttctcttaattccagtcactttctttcaccatgattgttgccaaagtataaatttttatatcctttcttcaatggttcaagttgataatcaaccgtgttattttcctagttctagtacacagtgagtacttagaaagcaatgtttgaaatttcttttttaaaaggtacaccgtaaatatatggactcacagtacaattcatggaatttcgtgtaataccggtttaaaaatatttatagtgtaggtacatacatagaaaaatatctatttttgatgaaaaatatgacgctagaaatacagtgtcaagaaaaattggaagtgcaagtgaatttttttaacacttacaatacactcacaatgtatgcacgctcacctctataaatacccacgcacccccctacctatccttataagtatcttcaaaaaactgggttgacatatcttcagatttaggaagtcagcatgaacgttttgttgtcgacggatacgtcgtctaccaccgaaaaaaataattaaaatataagtacttgtgttaaatcttgaacttaatgaatccggatggactgatttcatcacgacgagcctaaccaagtgaaagtgaagttaactctgaccaccaaacaattgcaacgtccaaacatcctaggatcgatatgtgctcccagcacacacacatggtcgctacatagcaatctgccactctgttctctccaactttgcatatgggggctatggtccagcttagctgatgctccctcatacactcccccacaacccaataatcaaacccaacccccacatagacacactatcacactgccgtttgacgatcgttttcgccgcaaataacaacccctttttccttcattcagtcaatgcaatcaccccctgccctccctcccttcctcctcccttccctcttctcctcccaaattcacccccaaaaaataaaataataatcaccaaatcgatcatgaccagcagtctatctagctcctcttttcttttttcttcttctcaatctgccatggtgatcgatgggtctgtttaggagattttggtaggtgcagcctcttccagaattagaagcttccttaaaccattcagtatttcattcagattctcaaaaactaaagttgtagaatccagaaaacgcactaaattagtaagaagtattctcataagatggctatcaaccaacagtttctcagaatcttaagctcacctaaacaggtgcgacgtgcgggtcccaccctgccagccaccggggcggtcgatcacctaacaccccccttctctgtcaacacggttcttagctcgcccgcgggcgcggcctcgtcggacactctcgcgctcgcacatataatagcccgcgtccccgtggagtggacagacagacagacagcccaccacaccacaccacttctcccaccatcgatccaacaccc

SEQ ID NO: 108482 - DNA, 679 bp, Oryza sativa
gtctaggccgagcggcgacgcggcggcagcaccaccacctgcggcacctccgccgccctcagccaacgcctccgtgtcaccgttcgacgtcgccgcgctcgattgtgcgccgtcgtttcccctttttctctgcttcaccgccgccgcgttcgattgtgcgccgccgtggtctccctcgccgattcctcgcgccaccaccctcctggagctcccttgaaccaccccaacccgccgccttggccgctggcctcctcactagctcccgcgccgtgcctcccctcccgccgtcgccgagcgcagtcacgctccgccgtcggcccttctccccctcgattcccgtcgctgtctcccttcccgtgtcccaagcaaccgtcccgagtcgccgccttggccgctcacgcctcatctcccctttcgccgcgccgccttcttccgccgccgcatagcgccgccgcgtgtgcgtcgccgatgaccatctaggccgagcggagatagcatcactgccggcggcgcctccaccgccctcagctgccgccgccgcctccgcgccgaggccgccgccctcagccgcctgaccgtgagagagagaggaagagagagagagaagagagagaggaagagtgagagagagtatgacatgtgggccccacattttttaaaatatagaatggtgactgga

SEQ ID NO: 108483 - DNA, 796 bp, Oryza sativa
aaagcaagacagcaaatgcacagtgcagaatagtgggttacgcatcgaggctgctagtgacggtaaaagttgacaatgaaggttttaccactgtcaacttggctaacaacgcatacaaggatgaaccgttcgttctcgccaaacaagttgttcaagtgttctacatagttgatccgtgtaacaagaaactacatgttgttcgtgaagggaaaagaagaattgttggattggacaatattgcagatgaggatgattataaccagcacttccatggcataggtcaagaaatacctctagaagaggaggaagaagaagatgacgttcaatatgcacgcgtcgaccatgaggaaggattatttttgtaatttatgtacgtagtttatgtctacatgtctgttatctgtatgactctaatatgttcgcaatgatcaatagtatattgctgatgaaatagtcaaataaaataattaagtgaagcacccactagaagtgaaataaaataattaaattattataaccattgaaataaaataataaaattagtaaaataatgaagtgcaattactactgttagtgaaataaaataattaagtataataaaaatatatagtgtatgtggaaatatgttaaggaaaataaaataactaagtgaaataaaataaaataaaattgctgtaggctaactcacctgtgacgggctctaactatggggccctcacaggtgacatcacctgtgacggaccagagtgttgggcccgtcacaggtgggatcaactggggctgacctacagttgga

SEQ ID NO: 108484 - DNA, 729 bp, Oryza sativa
aaccatccaacttcttctccattcccttccacttagtttcatacaagtagccgaaacccagcactaaggctgtgttcgacggtgcaggatgggaacccatccctcctgcacacaaacggagtgatcttttaacacatgatcaattaaatattggctttttttttcttttgaaaaatggatcatatgattttttttaaagcaactttcatctagaactttttttttttgcaaaaaacgtaccgtttagtagtttaaaaagcgtgcactaggaaaactgtcacaccccgaactaatcccgaccggaactagcccgtgacgctccaaattaacctgttaatcgataccagtcccaggaaacagtgctggtatcacaggaagacagattatcacagcaacaaaggtctctttattatagagtaggagtacaatcaagtcgggctgcggacagatcccgagctcacaactgcattacaaaagggaagcggaagccaagacttggaccaaacaatacaggcgcgacctgggaactaggccgaaaccctaaaactcatcgtagccggcttgctcctggaagaactcctcgtcagcgggatccacttcatcttcttcagcaactgggggaggggggattatttatatatagcaagggtgagtacgggagtactcagcaagccatgggaaataagtgtttaatgcaggctccaaagaaagggctgttggttttgcaat

SEQ ID NO: 108485 - DNA, 549 bp, Oryza sativa
acgaaacgtgaacgtgaaatacaatatatgttacttcgtgtttatcctaatacctttttttggatggtgccaaaaaacctttttcgtctccttccttaagcccgaatgggagcttaccctctaaaggattcccgttagccaatgacctaaatatatattagaatggatatatttatagcgctattaacactattatatttaatatgacactcttacacttaactttatagatagagttttaatactatattatgagagttataatataagaatattatagttaaaatatgagattattatatgtgaaatgacacttaatatataattattgagcagctagggccctaatacacgtcttctacacttagcatatatgactatgggagttataatataagattattagatgtgttattacacttaacatatggggttgtgtggggttctaatataccacagttacgactcagcataagattatgggagttataatataagattatgagagttctcgtataagattattatagttataatacaccattatta

SEQ ID NO: 108486 - DNA, 639 bp, Oryza sativa
ccaaaattttggaccggccctagaacattcaaccgcgacgggcatccaagtaatctgttcgggcctaaataaaagcccttaaaaaaagactgtcatctgtgacgggcattaaacttatctcaatcgggcctctagttggagcccatcacaaatgactccgtattggtgagacggagcttcttttagggccctgattgatatatggaaccctcatctcaatcgggcctcaactatagcccgtcacggctaagggtcatccgtaacgggctgtagttctatgccgatgtcccatggttgtgcggccatatcggcccaattgaaattacttccttgtgacggcccgcaaatactatacttgcaatgggccgcaacagatgaacggatctgacctattgattggatactccgtcctagggactggctcctaggtgccttttatttaaaatccagcacctattgatattttcctacctaccgcgggataaacattagagaatcgaccccttggaacacctataggtcactactataaaaatcttcattggaaccggctaattggtgccggacctttcaaaacgggcacatatagacttttcccaacttggggggaaaaaaaaaaccggcccctttaaccatgct

SEQ ID NO: 108487 - DNA, 706 bp, Oryza sativa
agggtggcggcgggtaaaagaaacccccggggttcctttattaccggttaggggccggcggcaaaggccacggtaaccggcggcggcaatggaaaggttagggttcggaaaaagacaaatccaattcaaaatcaattccacggatttccaaccaattttacccgataattccaaaaaaaaaaaggtaaaggggacctcggggatcttttcccttttatcattttaaccggaaatggaagaatccaaccaattttgaaaaaccggcggcggcccacttcgcttccggtccgcccggccaacgccccaagaaaacaaccaatcccaccagtgggccccacctttcaaccggccaaggccccccccccccggccgggcttgggtgtgggcccacctgggcccggaaagagagaaaaagaagtttgggtccactttcggcccaaagccaaaagaagactttttaaaacttttccaatttaaatttttcatgaaatgcgatttcatttattaaaaatactttcttggctcaataaatcccacaaaaatctatgaactatataatcaagccaagttttaataaaatttatctggcccaatttatattggaattattattaaaattagatcttctcttttaggcgtttaaaattatttttaatatttcccaattaaacaatattttatatatttgagattttagggtgtgaca

SEQ ID NO: 108488 - DNA, 559 bp, Oryza sativa
ctatcttaatgaaatttggtcggccattcattccaacggcccggcaaaaaaaaaatgcaacggcaaaccacgatggacaacaaatgcaacggctggtggcattcgcgcaattcgtcaaacacctcacgggcagcacaaatccctcccagcccaggggaagtgaacaagaaaataaaaatgctccggggtgaataaatgggataaaaaaagaacgaagaaaaaaacaggaaccatgccttatgtggaggtggcggcacggtgacgagctgggggaggaggaaggggggcggcggcggcggcggcggtggcggcgagggctcaaggtgactaagcgggtagcgtacgaggtggaggcaggggggtgcatatcccctggagttggtgccaaatccaccgggtggagttggtgccaaatccaccgggtggatttcaacaaatctgaaccattagttcctttctaggactacatgtagccacgtcatcttctttttgccaaatctcatgcgcgagaactgaagcatgccaagaatcttctacccatctcttgatatgacattaa

SEQ ID NO: 108489 - DNA, 1109 bp, Oryza sativa
aacatgctttggacctatctactttttagggaccatctcagattcaagaactggttagaggtacacatgcgttgcagatgtgttgtagtgaatcagacaagataaatagacacaaaacagcataagcatagagttacttacgcataaatggtgtttcctttttccgaaatctccgaaggaaacatcgaagtgcatgatatgatccagtgaatcctccaaaaagtaatcctacccggcaagcttcctccctcactattagatctttctccgaaaccagttgctgcaaattagaaaagaaagttatatcaatgacatcttatttgaactttgtagtatactagtagtagaacagtaaatatttgtcagaaagggaagtttgggaactggaccaattattttattttttaaccttttcttagtaatattttaaaaataaaccatccagtattttgttttaaatgaacctttcggccatgtcacggctgatggcaaggcaaaacagtgaaaacacatgctacaccatatgctattatctcggtgtggcagaggttatttttcaaacattattaacaaaaggttcaaaactttttttaagaaaaaaaaatcatactggatagcctcacaacagggatcgaaccatttaatgcatagcaagaaacatccctccaacaggttatttgatgtgcttcaaacactaccagctggtcctacacaagtactactagtaccagctcattaccagttcaccactaactattcaagtaaatgaacatagagcaatagatgtaacatcacaatcaagaccagcataatatgtgaccctgtcctttgctaacacatttgcacgccctaatgtgcgtgtgtccaagctccaacagttaagcaccaaaacccccaattccactccaattagccaaccgaaacaagatgaagtaaattcgcacagccgaatcccagttcccggccaaattctccgaataattccgtccaaactaaactaatctaatatggggcgcagttgagcactaaccgaaagaaatttgcaaattcaggtaggaggagaggagcaaggaggaccttgaggtcgaggagggaggagtaggatctgc

SEQ ID NO: 108490 - DNA, 564 bp, Oryza sativa
catcataaatataatatgaacaaacttcaacaagaaaagaagggaaggtagttaaatagatccacacatcacatgtgattacatcacatcacatcaaagtagtagatagttcaacacaaaagtagttcagaactaatgcagctaagacccaactaatgcagataagacccatctaatgcagctaagacaccataatgcagctaagaaagacaccatatgcagcaatggcagagtgcctctagtgcagctaagaaaggcatcatctaatacaaattcttatgctggcaccatctcttcaaccacataaatcttgcttcattagtgctaatattctcaaacataactctgttatgtttggaagcaaacaactgtgtggcacaaaagtattccacattgtcttctgctgcaccacactctactgccaacttctgacagtgtgtcaaggactcagccatttctttcttttctttctgcttcccttttaaaaaacccctttttttctccctgctgtaacaagttcagtaattagggtattggacttatcacttttagaggtgaaagaat

SEQ ID NO: 108491 - DNA, 728 bp, Oryza sativa
ctcacattcgattgtgttgttgtggaggcaataaaagatcttcttcaagacttgaatatagtggcagggagctcagtctcaaggctcaaggcacaaaggagctaaattccattagctttggactttgatgaagttttccatagaaaccttgattttctttcactttgaaaaaaatactctatgttagatttgtttccctggacctactaattacttagtgtggagttcagacagtatgtttgatatggtttggaaagttataaagtgttcccaaacagagcatgggtattaccaatgattttgttctaatccaaaccaatcacactaacatttagctctcttctgaaatgcagaattgggaaagtagatggatataaaaaaatacatgattttgacacgaataagaagtacaacaagcgattgcaaaagacagggataaaaaggaaaaagaaaaagagaggaaatgactgtttgattagatcaaatgaatttgaagatagataaatataaagaaaactttacatagggttagacctcatgttgaattttctccaaaacaaacatagaatgaggcattatatatgaattccataagattcaacaatgtctagtcctttgaaatatcaaagggccatttgaaaaaaaaatctatataaatgaaatactacaaaattcctatgcttttcatttaaataaaatgggtgttattttcaaaataataaataaca

SEQ ID NO: 108492 - DNA, 821 bp, Oryza sativa
gctaatatatgccaatattgacattatttgagaaaagttagccacgcgaatcacgaaatgtgtttttgccacgaacacacccgatacactccaatatgtacaaaaatcatgttttggctttttttgaactttttgattccagtagaaaacatcgcaccctcgtgtgccaatattggcattaattgacaaaagatcgccgcgcgaatcacgaagtgattttttgccacgaacgcacccaatacactccaatatgtccaaaaatcatgttttggcgttttttgaactttttgattccagtagaaaacatcgcaccctggtgtgccaatattggcattaattgacaaaagttcgccgcgcgaatcacgaattgagtatttgccacgaacgcacccaatacactccaataagtccaaaaatcatgctttggtgctttttgaacattttcattctggtcaaaaacatcgcacccgtgtgggctaatatatgccaatattgacattatttgacaaaagttagccacgcgaatcacgaaatgtgtttttgccacgaacacacccgatacacaccaatatgtacaaaaatcatgttttggctctttttgaactttttgattccagtagaaaacatcgcaccctcgtgtgccaatattggcattaattgacaaaagttcgccgcgcgaatcacgaagtgagtttttgccacgaacgcacccaatacactctgatatgtccaaaaatcatgctttggctgcttttgaacattttgattccgttaaaaaacatcgcacccgtgtgggccaatatatgccaatattgacatta

SEQ ID NO: 108493 - DNA, 744 bp, Oryza sativa
ggtgtttttggaactttttgattccagtagaaaacatcgcaccctggtgtgccaatattggcattaattgacaaaagatcaccgcgcgaatcacgaattgagtatttgccgcgaacgcacccaatacactccaataagtccaaaaatcaagctttggtgctttttgaacattttcattctggtcaaaaacatcgcacccgtgtgggctaatatatgccaatattgacattatttgacaaaagttagccacgcgaatcacgaaatgtgtttttgccacgaatacacccgatacacgccaatatgtacaaaaatcatgttttggctctttttgaactttttgattccagtacaaaacatcgcaccctcgtgtgccaatattggcattaattgacaaaagttcgccgcgcgaatcacgaagtgagtttttgccacgaacacacccaatacactctgatatgtccaaaaatcatgctttggtgctttttgaacattttcattccgttcaaaaacatcgcacccgtgtgggccaatatatgccaatattgacattatttgacaaaagtttgccacgcgaatcacgaaatgtgtttttgccacgaacacacccgatacactccaatatgtccaaaaatcatgttttggctctttttgaactttttgattgcagtacaaaacatcgcaccctcgtgtgccaatattggcattaattgacaaaagttcgccgcgcgaatcacgaagtgagtt

SEQ ID NO: 108494 - DNA, 762 bp, Oryza sativa
aaaaatgcacaatatctcggtaagggagaaggaagccaaatcaagattcaagagatggaagtttctttgataggtaaagaatcagaagatttacaagtaattcaatggagcgacacatgcataaatcattgaacgaaaaaatagcatcgagtaaacaaagccacaataggacagagagttctttcgaggcagaaaacagagagacgtgtagagaagaagcatcctgcatattgcatcaggagcagcgaaatgaacagaagaaggcatctagctaatacaaattcagaaactggcacttccgcagcataccaaaacagaacaaactgaaaagagaaacgaattgatgtggtttaatttctcgagcttgcactggtagaaatagagaaacggaaggcaagatcaagaccaaatagagaaacggaaggcaagatcaagactaacatgttccgaggagaggcgaacgagatcaccatgaagcttccgtgctcttcaacctcctccaagaaactcacacacccaacttcaaaagcatcaagcaacaacaacacgggaaagggaagccaagaacaggaggaaaaaaatgatcacggccaggtaaaatcttagcaaatttcggattccgaaacgccttaaaattcgagaagagaacgaggcgccgttctacttgatcaatacgtaaggaagacgggcagattgcatcaggaacagcaaaaagaataagaagagggcatttggtttatacaaattcagaaactgacacct

SEQ ID NO: 108495 - DNA, 561 bp, Oryza sativa
ttggataccggccgataatgacgtcgtggaggatcaggggatgatagaaagattctctgtggtgctacttcattcggaataaactgggatgatctctgctgagctgatccgctagcttaactttttgttgaataaacttcagggaaatctcatcagcagatcttctccttgtctgagaggtggacccacagctaacttttggctgactttgagaaacacgaactctcggatgtctatgacgtctattctgggaggagacacaaagcacctacataagtggaaaccaatccaaccagtcagagctattggataggaaaccatagacgtaacaggaaaataatattccacccagtaacaaaaaggatactgtactacgtagacaagacaaatcagccattcgaaagctgctactaggatgaccaaaccataaggctaacaatgactacttaaaatagaaaggaggatgaaagaagcaagccattactcctgatgggataagcctaatgaatactaaaacatacgaccgtgtgaaaatcccttcctgctaaataatcctataca

SEQ ID NO: 108496 - DNA, 1370 bp, Oryza sativa
atggcagagggttggtgccctgctgctaggggctcagtcctgcctgcctgtcccggaggttccggccgtaggcgggattgggtcggtactcttgtctatggctaggatgggttggaaactatgtcacgtcttccgtctgtataccgtggtggtatgtggcacgtggttacacgtgagaaagacgtgtcttgtgggtaaagatgtacacctctgatcagagtttaatctattcgaatagccgcgccctcggttatgggcaagccgagcaatgtacccaagttagtgttttaattcttaaaacccgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtttagtgctaggatcgcgtttacaaaatagccttgagcaactaaatgtctttaaatgctgtttactgcaaccctaaccctttatattataattcccttgtactcccttgcatttattctgcatttgtgggtgtgtcttgttgagtacggtggatgtactcagtcttgctcaatttttcccaagtccagaagaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgacaagttggtatcagagccacccttgaccctaggacgagccgtagatcccaagccttagctatattttcaaaaataaaaatctttggttatttgtgaaaattgtctagtctctctctgccttgctgcttcatttatcgccaaaatctgatcttttaaatgttgttttctttttgtttttgtttgtagatggccggcagcgtcacccgtcgtggtttgcacatgactggcttcgtcttggagctgcggggcatgtgcgtggtcttggggtatccacatggagtggattaccaggccaggccgctcccggagcaggagggtgaggatgcagagccccacgctggttgggaggtcactgcagtgatcctctctggctctcccgagcggacttcgctggcagtcaccgcgggtggagattccttccccgccgcttgccagaacgccgccctcctcgccatcggcaccctgcaccagcgct

SEQ ID NO: 108497 - DNA, 701 bp, Oryza sativa
tgaaggaaaaagtacttctgaggtttatttttttcagttagtggatgttttaggtaaggtgaatgatagtcttcagataccctgtatgtctttgttacttcattcctatgaacgacaaacagggtgccatgtatgtttactaactttcagcatgggcttatattatgggtgtctattcagcgtataattggcatgcagcgattgatcaaataatcttcaacgtgtcttttcttttcttttctttcatcctttaattctctgtgctttcttcaaggcaatgtttgttgacaaatttttgcgttggaaaacattccctctatgttgtctgagatggattcttcactatgctgtctttgaattgccaccaaattcaggcatagaaacacagaagcaaaggacatcgagcttccttggtacactgcaaactttagtcagtgtttggtccaagaaagagtttgtccaggcatactcagtggagcaacaagcttgtatcctttgaggcactcaaaactgtattacattacacactttttatttgcaaattatcatttgacttgttccccttaaacaacactcagacatcactgcagcaattgggttgtgtttggagaagatgtcaaaaagagaattagaaacaactaaagatgtattgaacaatattcttgaaggtgtaagctgtgagtatcccccccccacccccc

SEQ ID NO: 108498 - DNA, 1400 bp, Oryza sativa
tcaatctgaacagcccaaaatcaagaggaaagttctgatcgtttcaacgaggaagagcccaaaatcaagaggaaagttctgatcgtttcaacgaggaagaggacaaaagcaggcttttcccccaataatctgggagtaaaagcaggcttttctcccaagatgcagatcagatcgcaccaataattagcgcgcgaatattcctatcgtcccgcgccgtgaaagcgtcgccgcagcctcctgcaagctgtggcgccagccagccaggcatcagcagcgccgcctcgggtcggactcggacgtgagatcgcctcggcaccgttgcagctggccagccagctaccaccgacggcctaccagatcgatcccctccgaaatcgcggtcgcgtcgccgtcatcccgctcacgtacgccgccgccgtatcgctgtcgccggcaataaagcgcggggccggcgcttgcccatgccctctccgaaagggcccggtgatacagcgatgcctgcatccgcatggcacgcgcggcaactacccactccctccggctaccacatacgatccgtgccaatctctcgtcgcactacagtcagcggcggcgttcgttaattacttcgttttcctggagcgaaaacgttttccgtggcgcaggttgcagcccttgtggctgtcgctcggggtattcggaaattggagcccttttcatgcatcgcttctgaaaaaccgataaataaaacgatgccgggggatgtggccatcgtgtgcgtataatggactggtggcgacgtgcaagtaaaacgacggcttgactttctgactttatccaatggcgtgtgattattgttaatcaccctcctgagtcctgaccaagaggtaatcgtggtactacatgcagtactagcgctactgttgccaagaagtttcagtgcagaggcaaatacggatcgattggattattctttagccgggtggacgaaccgagtgatttgtcaaggcgctcaaggtgcctttttaacccaataaaaaaatctgtactttctgatcttcaattaagatatggatcggagtaagttggatcaacagcaatgtgacggatcgtgccgtatctccatgcttgcggcccggcactgtggacggttggtaagatgcacgcagattatctacttatctgatgatgccaggaggatgcgatctccacgcccatgacgccagccgagaaaagtgcatacggccaaggccgcccttttcgcgctggtctcgaatgaacaactcggatgatgagaaacccctgcgcgttttcttattgtttccgctgagcaggttgccggggctgatctgacctctccgcaaatattaatccgtgtctccatcgaatggggaattatagaacttgaagtgtgatgcgca

SEQ ID NO: 108499 - DNA, 743 bp, Oryza sativa
cgcagaaatatcctctcgtttgtttaaaaacgttcatccaaacggttatgaaaatttttgacaacactcacacaacatatctatacaactccacaaaatcttaggttcaaactcatctcatactccgacatatatatatatatatataaaaagataaattcagcgtatgaataataggctaatttaaacttaatttttagtggaccgatggatatctctatactctacattgtcaattttcttttagaatttttcacaactatttacatcaagtttgaaagaaaaaggtatacgaggggacatccccttgagggattagaatccactccccttgcaaggttgctaagcctgcgaccatacatatgtatcatgtatccattttaattgtacttaattcggttagagattgagaattttagaatatgcaaatgtttttatcagcagaattccatagataaaaatatggcatttatgttcatgcatataactttaaggtatgggaagtcctggccttagcttgaaaagccaattgttataaagtttacatcacaaatacctgcatgaatgaatcctaaaggtaagacaccagcaaactttccgttggaggtaggccatcaggaccttcggccaacttgctaaaacaacaacagtaacaagtgaaggagcttggggaaggggcatacgacgaagcttaggccatggagcaaggccacaccacgaagcgaagcaccgggtggcgaaac

SEQ ID NO: 108500 - DNA, 568 bp, Oryza sativa
tggaagcaggcctccaggctcaaggagcaggtctcccgccaggtgacgctctcccatccccctcgatctctttgaactcctgtgttagtacggttctcgatcgatccgagtttgtgattgcgcaaccggggtgggtcgatgtcgatccctctcaggtgtctgtcttgttcgatccggtctctatataagtttgatttgatgtctatgctgatgggttttgagaggctaccgtactcgtctatggttaggcgtctcaggttgattttcattcatgctggcgagtggtgaaatgaattgtgagggggaggtccaagcttttgctctcgaaaaaaacaattgtgagggttgggaccgcgatgcgcgtgtttgcaatccctgagatgagaaacatcaggttatgattttacgacagggttgatcaatctggttaagctattagcaacctgtggcttttctatttaaaagcgttgctcgtgattcctgttcgaaatatagaaccatgtaaacatgacctacccgaatttgctgttttgagtaataccgccttgattattttcatccatcttgc

SEQ ID NO: 108501 - DNA, 745 bp, Oryza sativa
aaaagaacgggacctaaccacttgttagtaatatgtaagttctatccttcaaccttcagacttcattcataatttatatgaaaataacgtgtcctatagcgaagggaagaagaagaaatacgagccgatcaacgctgaacttttcttttatcgcatcatatatgcatgaacaaggcccatgttgctgattttgtaccaccgaaccgaatagtattaatcatatgtttgtgagtttgtttgttggagtggatctaaattcaagagacattatttaataggggacatttgcacatgttgtgtcctatggcttaatagaatgacatttttttaacaacactccaattaaatcttatatgcacgtactatacaaggtagcacactaagttcggtatgggcccagctgcaaaagagcgaggagtaccacttcccaaaatcgcattgagatgatcttgagaaacatctcgatctcctacaacctctcataatcgatgctttgatctcgattcctctgtcgccttgcccctactaactaccggattcattcattggactcaacagctctagaacgctagtgcatttgctcgctcacaccatctaagggggacaaagaagaagagttccatccaatgccacttcacgttgcacgaatagatccgggcacaaacatctccaatccaatggtactttggccctagataaaacattgctccctaaccatttctggcacctccagcgagcccttcgt

SEQ ID NO: 108502 - DNA, 540 bp, Oryza sativa
ctgtacagagaagcaaatcaatgattacacaaatttataactgaagttgcacagatttgaaaatgcaactacaacaaccagggagtgcaatacgtcgccgaatgtatatgcagtttacacaaaacaaatgcaagcccagtccagtcctgaaaaatatggtgtgctagtacgaagcatcatttgctatccgtcggtactcaggcatgtgctgggtgaaagtgaaccaagaaacacagagaaacatttcagaaagcagagttgtctctcttcgcctcccatgcaaaattttgaacaagcaataatctatagaaatatagcagtgtcactgtcttcagtcagggagttcatttcgtgatctctgagccaaataagatcgctgaaacctttcaaaacatctctctctctctctctctctctctctctctctctctctctctttctctctctctcattagacaagtacacagttcatcactaaatctgctgcttgcatatcacatatacagaacgaattgtgcatgttcagaacacaaggaaata

SEQ ID NO: 108503 - DNA, 1306 bp, Oryza sativa
cactatatttgccattgcaacaaactgttcttgaagggtttttaattcaggtggcagctactcctgcctcgtgcgaaacaaaattcagggggcgcccagcaaaatttaattaggaggttcaaacattacaacagattactggtgtacagggtctaaactcaataacatagtattcagtagaattattgtctagaaaactcaatgaatgttagggattttatcttatcaccttatttgaataaaacaaatttatcggttattatatgtcttaccacagggataggcaggagctgtagcttagatgtaaattctttctattattaaaaaaactaacaaggtatattacttgttctgggaggtaacttgcagtgccattttactctgaaagcatctcaatatctcatgtgatcgtttcggagatttggagaaaggaacaattattgtgataaccacttacaaacatgcctagaaacatcagtacacagtgcgcttgatcaaccagactaacagagttcttccgataaacgaggaagtaggccaacgtagagctctcccgagttccgacagagacgacacctatatatcgaagttcataaccacgctatccatgtgaaaacaattctttttttttttctggcgatggcgctcgtcaaaacagataagaaatatatataaaaaaacataggcaatataagttatcctaaagagtaataaagtatgaagaaatataggattaaatttacgtgacatatgaagaaaaatatttatttacagttgattttcttctttatatattcctctatatgtcggtaacattgcttgtttgtgaaagaatttgtcataggataaatttattcatttttaatatcttttataacgttgtggaccgcatacaataaacaacagatgctctagttgggggctttataatccatttctttgtccatacaagctatgcatgcatacacctgacatatgcatctacctatttatatgttggtatattagatatgggatatctcagatacataaagatacgtgatatgggacttctcctacatgatgtacacacatactttcatgtaaagtaaattacatcaccattccttaaagttgcaacgtgatatcactttgtccacgatcttgtaaatcgtatatcttggacttggttttgatgtatcatggtaggtccattgtacgtttcccacatggatgttcaccttggatgcaaatttgcattcagctccttcatgcacattcgctatgtgtctcctcgaaatatcctctcttctcttctgtatctatt

SEQ ID NO: 108504 - DNA, 751 bp, Oryza sativa
aaagggtcaacgccacatccgttggcgctgaacccgtggccacgtggatccgaagctgatctatttgtcgatgtggcatgaggtcaacgccaactctattgtagcatggtggtgtggcctctgtgcatgcaagcttgaggtaacaagtttgactcccttgagcagcataaattatctatttttattgcaacttttttaccgtcattttcttccggaccgatatacttcaaaaataaatataatacttccattatctttcttcccacgttactatttccgacatatatactccaatggtacattcaaatatgtagtatacttcttcttttttaccgtccttttcttccggaccgatatacttcaaaaataaatataatacttccattatctttcttcccacgttactatttccgacatatatactccaatggtaccttcaaatatgtagtatacttcttaccgtccttttcttctggaccaatacttcaaaaataaatataatacttccatcattttttcccacgttactatttctaacatatatactccaatggtacattcaaatatatactcccttcattccaaaatataagtcacaaccacccttaatcaaataccaagaaataattgttatcatatcatagtttagattatcctaataaataaaatgtatccacccaataaaattagatatcttaatcgtggatgatttaaataataatattttagtgaaaaagagggggctgcagga

SEQ ID NO: 108505 - DNA, 1083 bp, Oryza sativa
cataaaccaacacggagtacaccacgtacacgtacgcatgtctgaaacgtcagacggattcaataatagcagcgcgatgccgagaaattgtttgcgtgctcgatccaccaatcagcactacggtgccgagaatcgcaagctgggcagcagtagttttagctagaatttcatctacgaatacattataatatagatttatacatagcgcttctagttccatccatccttctctaggaatgaaatgaatagcatgcagtttcgcaccgatcatatcctaaagctagtgtgcgcgtacgtccgtagtggtgcagcgctcgtctgacgtttgcgagctcaatcagtccggccgtttgcgcttggtcggtccggcgagttgtggagccaggcgtggccagattggctcggccggcgagaggagctaagctcgcttttctagacacgtctagttggcttacatagtcaccaacgagaccgtgggcatcgatcaggcggcaccgatctaggatagcccgcaaagccccaacgcgctcgcacgagctgtgcgccaccgcgcgcctcaggcctcatgcgtgtctcggttcttttacgcgagaagacgtagtttggacgcctcgcgcgcgcgcggcacatgcacgcgcgggcgaagccgcgggcgggtggtgtgggtgtagcagcctggacggggcgggcaacgcgtgagagtaggtaggctggcagcaggggcggagtatgggtgtgggctgtggcgtgccggtgccctgcgactctgcgagtgcagcagggttacgtgaccgggggcgtgcggtagtgtaacagcggggaaacgtccgggcactgttttatcgatcatcgatgatgctgtgggtgtgcccggtcgacggagtagaggccacgcgcgcgcgcgcccgtgaatcgaggcgtggagcactgtccagtgtccgcagcgctgcacgacgggcttcatcttgcaagccagccgccgacgccatccccccttcgatccggtcttccccccttccgtgccaaattgccaataatccactttagattgtactgctccctccatctctaaaataagggatt

SEQ ID NO: 108506 - DNA, 836 bp, Oryza sativa
attttttcacacttacacgtgctcattggggggggggagcagcaaaaaccgacacctttgtgaatagataggtgccggttctatataaaaaccaacacgtaaaatattagtattggtttattcaaaagaaccagaacctataatatattatagggtctggtttttaagaaccaacacctacaatcatataggtgtcagaattttaaataaacagacacctattaaaaaaattggtcggagccgactgaaccgaccaaccttatctactcccactcctagtcatccttatcatccacactgctaccccactcctgtccctcctccttcctactctctcctcctccacactaccggcccactcccacccgtcctcaccgccgcctccccccacatgcttctgctacgctcctcctttctcccactcttactctccctgtcgagggatccaggtgatggcagcgcgaatacacgatgacagcgaggacgacggtggcacgacagcacgatgacggtggctacgcgacggcgctggcgccctcccctctgccagatccgacgaaaagggaggcgacgggctccccaagccgtccgcctcatccctgccgtcctcgtcaccgatggccacgtcatccccgttgtccatgttgtggatccacctatggacattgctcatcactgcgggttgtggtcgttgcctgaccccctccttggttctagctcaatgggcgctggatttggtgaccctggtactaggcgtagacctctcctagcagacagaggtaatgtcctcatcggcaatagcgacgatgatgatagtagcccgtgtcatgcccact

SEQ ID NO: 108507 - DNA, 760 bp, Oryza sativa
ccaagccaatctgtaaatgcatataggtatttttagaaggatggacgtatatatacattgattaataccaaatcctcagcacatgaataattgaatacagcaacagagccctggcaaagattgaactggaagcaaacccacccatcccgagcaaaatccaatttgaacctttccacaatccgcactcacatttcaaaaaagacgccatttatgatttacctccaaaagaagagaggcatcagtgcctcctggccccaccaagtgtcccccccggccactaatccctcgcttacttttacccaaaccccatccgttcaatcgtccggcccagcccacccccgtcacgcacactaatcgcgaggcggcccggcgaggcggggcggggtagaccggaaacacgcaaacgctcccgcgcgcggcgcccaaagtctggctgtctgggggtggctacggttaccaccactgccccatttcacatttcacccctctcttttggcttcttcgaaaagagggcgtatacaaaaagggagagtgatatcagacagatgagattacgaagtggcaagataggatttaaaaaaggctaaaaaacaacttaaaaaatcaaagatagaaagcagtaagcaccaagggcagaaaaagaaaagaagaaaagaggaaagatttggaagggagggaaaaggaattggggaggagtaaaatgggagaaaggtgagggtcgaggggaaactggcgcatttgttgtgggcacggactttgg

SEQ ID NO: 108508 - DNA, 673 bp, Oryza sativa
aatgctcgacctatttagagacggagggggtacaaaagatagctctaaaagcaacaactagatgtccatgaaccatgttagctctggcttttggaggcctactatttaccacattaaatcagcaaaaaaaaaagagaaatgtattcgatgtatggccttagtgggtccagaagctataatttatacaaattacaatttatctattatatactaaaagtccatgaaactttctacaaacgctctcaagccaccacgtggcgctctaataaaatagagaaaatcctataaattctaagaaaaaagcataacatatatcccttaatttttatttaaattggtgggtccaatattatacaccattagataaaattgatcctaaaacaaactaaataccatgggtcccacctatcctctcctcccgtgcattggcaggtggagtatataccgtaccctccccccctttttttcctttcttcttcttttttccatttatatatataatggatatattttttaaataatgataattttacaaacaaagaatctaccatcatataacttaagccggtgtactttttactctgtactattattttcaaataatgcactattttaaaataaactctacacaattatatcgcgtcatatcaaataaacaatatctatattaact

SEQ ID NO: 108509 - DNA, 660 bp, Oryza sativa
cccacctgccgacaccgtcgagcagcgcgtgtccgtacccaaccaatccagtcacgccacgtattatccgtgacgcgtccagccggccgccaggtcggatgacgactcggcggcaggtacgcctcgcggaccgcgcccgttcggctgacacgcgggccgctgctgctcagatgcgttgcgtgttgaggcgacgtgctgggtccgggccacccacgtcggcttttttaactttgcccgcgccgcgagagaaggcatcgtcgtcgcgcccaaattgtctaaactgccccgctcggctcgtggcaccgcgcgcgaacggtggcccggttgggcgacccgagagccgatgcggtgtacccgccgctcggatgtatttttttttcctttcgtcaggaagggtattccggtaacttcgtgtgacaatggaaacgattagtcaattttggcgattcccgcgacccgctccagcatacgggcgtccgacgaagaagccacgcgacgcgagtgccgccgcggcaacgcgtggaagcgggccggcgaaggagggaaacatttgaactgtgctaatctctctaataatggctgcgaatttctactcaatactattctcatttacgctaacgtggcatttcaatcttctaaaaataaaagattaagtatttc

SEQ ID NO: 108510 - DNA, 728 bp, Oryza sativa
tttaggaatgggatggtatgtggggtgatcctacgttattaagggatcgaccgggtgcggcccacatgttagtgagagagaggggtggattggattagtccaccacttaggtgtgatcatatggaatattttcttttggggaccatctatcccacccatgctcaaacaaaacacctacaaacaccctgacggtccagcatgatccatcaaatccatcgaactaggtgtgtatcgcatgataacataatatagagatacaaccaggcccacatgttagtgagaaagaagggtgggttggattactccaccacttcttgaggtgtgttcgtagggaatattttcttttggggaccatctcatcccacccatcctcaaacaaaatacccttgcaatccaacacgacccatcccatccatcgaaccaagtatgtatcgcgtgataacataatgtagagatgcagctctaacccacatgttagtgagagagagagggggacggattggattagctcaccactacttaacgtgtgtttgtaaggaatattttcttttggggaccatctcatctcacccaccctcaaacaccctgacggtccaagacgatccaccccatctatcgaaccatgtgagtattgtgtgatgacataatacggagttgcagccagccgtgaggcacatatgctttgtacacgacgagacgatggttaggggatcaaacgagacggacgg

SEQ ID NO: 108511 - DNA, 532 bp, Oryza sativa
ttgaccacacacatctctgtagcatatcgcatcgccacaccggcaggcacaacgccttcagcgcagtaggaaagggacgtgagcatggtaagtggatatgtacgcatcaatttggcacctaagctccccggcctactactggtaactggtaagtggtaaccggttgcacctcacacggctcgacagcgaaaagattcaaaagcctaataagatcggtgccgactggatctttgacagccacgaacactactcgattgtgcccacgcaccgcagcccaccgcaaaggcccaaaccgaacggcctcgcgcggcgcgacgtcgcgtgctctcggcgcggcggtggcccgcgtggggcgccgcctccgacccgccgcgccattcctgtgagttccccatacggccataccccatacgcggtgaagggaacaccgaacacgtcaactcggagcccatgcatgcggacgcagatgcgtaggccctcgacgccttaaaagtttttaagcaaatctatggatatccaccgtcaatcacgt

SEQ ID NO: 108512 - DNA, 1243 bp, Oryza sativa
gttttttaaaaaaagtggatagaaaagttattttaaaaaattgttaatttattttttaaaaatttaaaataataactacttaattaattatatgctaacggtggatctaattttgtccattttcttaaatttttatccccttctttcaaacacatccttaaaaaacaagaggagttactgtagtaaattattaaaatatcgtgtgctttgctagcagcttcttatctttgattatgggtaaatgttttgtcaacaccatattccaccttctttattgcgatcgaatagctttacctcttactcctctttttcatggactttgacaaacgcttcgaaatggtgattgctgcagaactgacgcaacatctctaaactaccctgaaatttcccaggaaaacagcccgtgccaaagctgaaaatgagctggaaaaagacgagtttggcaattctataccgccttgtttacgttttcattccgtcggtgcttcttcaccagtcaagtcgttcacttcttcctccaaaaaggaacatcagatggaaaatcaagtacgatgatctggtcaattgtactattaaattaataatacaacgaccttatccattattatcccatagcattattcttaggactcattccactaaaagtcctgctacaattgtaccgcatgtactattaataatagaatcttttagaggttctctcctatctttaagagatacaatacatcctcaccacctcaccaccaatatccctttagactgtctccaacaacgcgacgcatactcatttatccgtcgtgcacagtgattttgggtaaaaaaaaacagcctccaacgggagaggcaaatgcgatacgcatattgggtagcggccaaagcgctaggcaaatatacgtctcctctctccaccgaacactggagcggagctcgcgcagtcgcgcggtgggccagggtgaggcagagctggtgcggtgaggcggagctcccgcggcggggcggaggtggcgcggcggggcgggagcgccgtcggggagcaccgtcggggagcgtcgtcggagcgcgccgtcggggaggaggcgtagtgggcccgtagtggcgttagggcggagtgcggccgacggggagagtccgcggcggagcgcggtcgtcgcagttcccgctgctccgttctgagcatcgccgccacgaggacgagccgtgccgcgagccgccggtgggtgtgctccgcctgccaccaccgctc

SEQ ID NO: 108513 - DNA, 1201 bp, Oryza sativa
ggtttaattatattgccaatttgtggtagtgataatagtacacaacaagttgatgaatgacatggtgttcaacaacacagtacatggcacatgtttttcacccggtcatatatagtatattatcacaatcaatatgtatgcaaatgtctgcgtcggaatctgctaagtacatcctgcgttccgatataactagtgtatatatagtcgcgcattcatgcgactttaacctttctctatgctaaatatctctacatatattatttatatggaaagcggttcagttttcttttggttttaatctttcacttagtatatctcatatttttaataggtggcttttaggggttgacaagaaaaatagtaaactgatatttgtcggagcttcggccatttgttgggctctatagttgagtagaaatgatatggtttttgacaaatcaccatctattttctttataaaggtaatttttagggcaactcattggctccggttttaggtacaattacaaaggtgtgatgaagatggagaatttctgaaagttgcatgtcgtaagttggagacgtcggttatgcaactttttgccaactatagatggagattcacaaataggcttgaataaatgtgatcttcttattttggattttcctatttaaatgtttggtgtgttctattttatttgaactacacttttatctcgagtgctactttataataattggttgtagctcttcttgagcaaaggttgagatattatattgcattatctaaaaaaatataatatttgtagtaataaattatatttactatatgccttaaccttcctctatattgaatgcttttatatgctagttgaactaattaattatattgtttatagatacactaataaggaggtggatttgtgatctatttagtataaattgaggattcatttgtttttaacactaaaccaatatccattcacttgctcatgattcatcttaattcttacttatgtttagttagttaacctataaaattttgtaagttttgttttattttattaaaattttaggtaatctaaattcataatttttcagttcagaagatctgctcattgccaaaaaaaattgagatggttaatttttgtgctgaacaaaactggagatcgatagtttatactccctccgtcccttaatataagggattttgatattttgc

SEQ ID NO: 108514 - DNA, 684 bp, Oryza sativa
tttatatacgtgtatattttttatacgtcaatttgttgatacataaaaaaattatatatatgtatgtatatattttacatacatacatagaaattttatattgatacataaaaatacaaagtttctatgtgtatatataaaatatatacatacgtatatatacatgtagtagtactgttatagtaatagactaatagtagtagtgctagtagactagtagtagtactaatggactagtagtaggagcctgatcgcgcaggggttagggcgcgcgaccagtgggcctgtgggcggtgtccatggccgccggccaatctttgcacaaaccgtgacttcatgagggagatcgctatgttatggattcttcaggatcagcaccactagctctcgacatcatcaggcgcgggtcgcgcatgcagctcgtgctcgcccatctgccgtgtgccggcgagtagctagctagctagctgcctggctagctgggcagggtcgccgaaccttggaattggatctagctagctaccgctcaattggcagctatgagcttgtgattgtgtaaagacgatgtttcgtttttattttatttctggtcatttattccatgtgtacgatcgaggcgcgagtattttcgtgtaccaagtgatacacaaacagcgccgtacgtgttgacaacagatttaagct

SEQ ID NO: 108515 - DNA, 1430 bp, Oryza sativa
cttctgtgattaagatatagattttacatcagtttccgtatacatttttcaaactactaaatggtatggttcaaaaacattatatataaatgatgctctaaaatatcaaatagattcgtttttcaattatgttggtgataattaaatcttaattaatcatgtgctgatagctttctcattttacatgctctttatatttatcttactgaggttcaaatggaccttgttgtcaccaagtatcaattgcaccatgcattcattcaacttacacccctatcttaaaataaattaactcctaatcgactacgaatttgagcagctttgtctagattcgtcaggatttaaatatttttgcgatggatggactatgttgattggccctccattatcctttctctgagagttcaggtcatcttgagactgttgcacttcacactccgagagtacagaacggtactggtactgttctagcttgacctaactttggagacttgagcagcatcacgttcttggacagcagcttcacgtttttcagccgctatagcccttcaacatgtggaaaaaccttattcattctccagtcactccaataatagcacaaaaccccacaccaggttaaatgcaccagaatttcttctttgttaggagcagaccatgtgccatcaacaattcaataggtttcttgccaaacatcgatccatagcggttgccattcacttcttctctatgtataaatgaaaaaaaaaatctatgtagttaacaacagtatagtactaagaaatcctcaactggcttttagtttagataaacaaatcatggatagaaatattgagtgttcttttaggccgttcatacatccattgcacaattagaaaaactacttaatagtatcccgtggaacaggaatcaataaataacaattcgatctgatcaattccgtcctctctccgagcctttcccttctctcttcgagccttcatctttctaccctgcctctcctactttgcccctctttttcccctcccctcctctttgctggaaagagcttctctatacaggcttggcggcgacgaagtaggcccccaaaaatggacctagagatctaggccctcctcactactagatctgccccgagtgcatgttagctacaaggtcatgttgcctccttcttcgtctcatgcttttgaggcatgggcaaccatgggatctagttcccatgacggaagggcgcaaccaggaaggagagaggatgtcgggatgaatgccgaccagcgtgtacttctcgccctccttcttctaggcatgtggtcgatgtgatggagggccatgaccagtgaagattctgggtctagatcttccattggaagtgacacatattcctcatgttttgttctcaaaaaactagcacatacaaggctgtcactcatgtg

SEQ ID NO: 108516 - DNA, 4424 bp, Oryza sativa
ttaattaaggtgactacgcctgatacaaggagcctacctaattcacacactattcttgcctacctaatattatgagcaattttatatttcttgaggagataccatgatgtatcactgtttctattgtaaatttggtacctagatactataaaatttttgataccacataatatctcctcaacaacagtaaaattgctctaatatcatacaaggagctacctaatacaagtactgtactgcaaccacatgacaaaggacaacatgatttggaaacacaaaataactgttactgtagcaaccaaagaagtcaaaagcagtactgtcaaaattttggaaagcaaggaaaggaagcaggttaatggcatatttttatctatgtttggatagctgcggcctaacatagcacattgtccgctcctaacagagtgtgaattctggaatacgttacgtacattgagagagttttttcaattattgaatgagaaaagtccaatgtttaggccacaacttggcgcttctgaaaagcatagagctgctgtcacttgattcagggtacgatgccatgacacttcaccgtgattcactattgtatcgcccttcgcccccacaaatacttgtgataaaaacagagagagaatagatgggctagctaacttgggattggcctattctgggaggggaagaccagaacaggctgctttgtgccgggagtgctaataggcaagctggttgtgtgccagccatgacacatgatcgtgagcacccgcttacgcacatccacccaccacaataaatttcaatcaatttaataagttttataaaaagaaaatagtacctaaaagaaaaaagttactatatatacttaaatatattcgtgtacatgaggcacaaggatgaaggtagcatgatatgtatagcacataatcacaggttttattgtctaagagttttatgaagggtcaaatcaataaccttaatcaaataaatcaacagttataaatttcatataaactatattttataaattgaagtatataaatatctcatcaacatgtatagcagcacggtttggacatttcgaaatgacagcatcgaagatatctatatacactgaaatgcttattccggactgcgttccagaaaaagtagtaaaatattagaatcataatacgtgtacgtgaggttgatgggaagagaagaaaggagaggagaagtaaaagaacaaggtgaagcgccacttatataatatatatgggtgtcgtaagttattttttattattttcttcttactgactagaatgccacgtcagtgaaaccaagcatccatcctgccatggcacctaatttaacccggttttgcaagttatgcttttcggtatttcagtattttagtttagagatacaagctttactggaagatgagggatgtgaagtggacttagtcctgctagaaaagacaaggagaatgggacaaggcgttctataattcgttggaccagttcaatttgcttctacttgtaatagattagcccatacaccaacccatttatgcaaatctggaatcaaaaaatccacttatcagggagccccggcccttgtccttggaagcaaatcattttcctttacatataaatgactaaatttcactctaggccatcttttattaccgatattttgctttggatcgctattttaccaatgttttcactttgaactaggtaatctcatctttctggcactttggaccacactcaactcttttattcatctatatcaaaattatcatatatcaaatatattgtacatataaaatagcgtgagtttactgtctcttttaaccatcaatatcaaacttatcataaatcaaatatattatgtatataaaatggtgggagtttactgatcaatcggagccgatgtactcgaaatcattcatcatctgagaagagagttgggtgatccaaagtgcataagattacccggtccaaagtgtaaacattggttaaagggaaacaccagtaatatataaaaggtgacccgaactgaaatttgcttgatataaattgggttgtgtttgtgtcatagtttgactaacagttagttctctttgagaaaaccaaattgtttattagaatagcttagtgtagttgcttagtggtttgctcgagagtgctttcaaatatatacgtgcgcaggaatttgcgatgcactgttgggattatgtgtgtaagatatgctggggagctgcagagcatagttgagatttggcgaccgagatcaatgcttgctgcttgatgatttgcctggctggctgcacttgtctgcacgggaccatattgcagggtaagctggtgctatgtttgtgcaagtatgcatatacctctgtctaatcaagtagcatatagtacaccaccttaatctctttagactttcgggcattctcatagttcactacccaaagcacgtgttgatattcctcattgcatgtgtcttataaaaagcctatagtgccatattcttctgatactcccatgtcaggctgcaaatggagcggatcaggcccacctggcaccaataccccctggcctcatttgcttttctttttttttttgggaaagggaaatatattactcaacaaagctttgacgcctgaaatttctgttgtgtaaagcatcaacaacaataaaaatatagtcttcaagatcgaatatacagaaatttcaaatttctgttgtccaaagcaaatcaacaatactaaaaatgcagtttgaataaatacagtcaagaacacatacacacaatcaccagttacataaatttctgttctaaaaagcaaattaacgcctctaaaattcagcctttcaggatatcaaatatcatgcacaaaatatttgacgttaaacatcagaaatatctagggcattaaattaagttcaaacaaaatgcaaccttctaggtcaaactggcagactaaaaattaacgaagctagaaaatatcatctatgcatttccatgcttgcacagtccattcactccattgacttgtccagcttctgcagaaaaacagagagatcaaattaacaaatgcagaaaaaacatgcatagcaatccatctattcctgtaagaaagattcccaaggtaatatttactctagtccccaccaccttctttctttgagctgagcactttacgtcggctgtggtcattgcctaccggtaaactcccatacttccttcttttgttcgagggaggtcgtacatcttccttctttggttggatccaggtcagaaagttactcatattatggactgctactcaaatcttaaatgcaattatgcaaactaagaaaattttgttaggcaggtaaaattaattacaccagagaaccaaattgtccatgaagccattcatgatgctcattcagaacattatggctgtgtttagttacattcaaacttccaaaaaatccgtcacatcaaatatttagacacatgcatggagcattaaatgtggacgaaaaaaaccaattgcacagtttgcatgtaaattgcgagacgaatcttttgagtctaattacgccatgatttgacaatgtggtgaaacaataaacatttgctaataacggattgattaggcttaatagattcatctcgcagtttacaaatggaatctgtaatttgttttgttattagtctacatttaatactttaaatgtgtgtccatatactttaattttttttaaaagtaactaaacatggcctatatgcctgcatatttctaccatggtcggaaaatcacgaagcaaatgaatcataaactatgggatataaattttgtttacttcaaatttatatgactttctttttttccagattaattctagacatcaagccgcagcactctcagttactacaaatcaccatgcataatagatgcgtactgcaagctaactgagcgatatgaaaattgaagtaatttgcagtaagtgcaaccttccaggatatgcagtcaaatgaccagatccttcatttggacattcataagcttccacagtccattgaatcctctatgtccaggttctgtaaataatgtcatcagcaggaaattaaacacacatgagatcaaataaacatgataggtccataggttcatggaggaaattaaagatagttaattgatagtacatgcatgagctgttaattaaagatgataattgattatgaccagaagctttgttaagtatctcccgtatgtattcttagtgactcaattacagaagcagtatgaaacagagcatctactgctaactgcctaaaccaataatatcctagacaaataaatagaagtaaatttactgaccacaaaattatcactgtaggtgtttcatttaccgagctcacatttatgttaggacctagcaatc

SEQ ID NO: 108517 - DNA, 661 bp, Oryza sativa
catagtgatgataaattctcatcctagtgatgagaaatgagactcgcccaccgtctgaatagcaaacatgaggcaacatgcaagtaccagccgaaatcaactctctgatggtgtgatatggttgccagccatcggtcaaataagcagccattttgtgtttttacatttatgaatcacaatcgtactgtaataataaactagttacatctatatttatatttatagatcgtttttactttaattagcatatgtttcatttatattatgctaaactcctatgatatgtggatgagccaattcaccgatattttgtttcctttcagacttcacttaagagatctactcttccaattcagcatattaaacttctaaaagcgcatctaaaacactgtggaaagaaattgaatttaatctaaatcggcacatatggaaaaacatggtggaaataataatacacagtacacacatttaaattttagatatacttaaaatccatggtacaaaaatatacttggatatatttatattaaattttacatccggacgtaacgacttaaaatatacttggttccaaatttaattaggaaataatgtactgtcagcctaggtaggcgagttttaaattctaataatctacagtacacacatttgaaatatagat

SEQ ID NO: 108518 - DNA, 567 bp, Oryza sativa
atagaaggcaagagatgaagttctgtacgttttggattcgtattcgttcagacctcctaacagcatcaacttcaaacaaatatagccactgatccagaaggactctcggggcccatgagtacttgttggaaagcttatggagtctactttgatatggttctagtcctacatcaaaattctttccaaggagttaggaaactacaaaacaagctatataccttatccagtcggagtctgatttgggctttgggctttgtaattgtttcgtgggctaaaccctatccctaatcatatttattcagtagtcgtcatagttcagagtgaggttttgcttagattatcttatctaatgtagtttcgctactagttcggtttgtggaacccaaaattcaagtgctaaatcattcatatgtaattgagttgtaatctaccttgtttttggttctgttcttcaattcacatgtttggattagccttgtcagtgaggtcaatcggaccgcgcactgttgataaaaggagacatggtgctgtggttgcaggttcgaatcgtgtttattggaaactgga

SEQ ID NO: 108519 - DNA, 514 bp, Oryza sativa
cattagcgcgtgattaattaagtattagctaatttctttttcaaaaatagatcaatatgattttcttaagcaactttcgtatataaacttttttgcaaaaaaaacacaccgtttagcagtttgggaagcgtgcacatggaaaatgaggcagatggagctgggaacttgattcgaacacactagcgaagggtggcccgatcttcacgacagtaggtagaaaccaatgataacttgctgtagaaacagtgggtaactagctttatacctgccaaggttggatgcgaccaagcgacggggagagagacaccgaaaccgtgaggacttcgactcgatctccgaacgaccgcaaaaccacaatccggtatatcctcacaatacggtgcagctgaactggaagccgtagagcacgaactaggggccctcaaagagatcttcctcacaagtccaagaagaactcgcaagaacaaaggggtgtaagatactcaagcagctcggctgcaaaaacgggggatcc

SEQ ID NO: 108520 - DNA, 887 bp, Oryza sativa
tatctgagactatttgttattaggttgaatctgagatgaactattgtttgaatgttgttgtatttggattgtatctgtttttagttgaatctgagatggtatctgccattatgtttgtatctgagatggtatgagaaattggattgaatttggtggtctcaaatttaatgggcctgtttagtgggctttgatatgatagttggttgataaaatgggctagttctgaaatgggcctagttctaaaatgggcctattttaaaatgggtcagttctcaacaaaataatgggctgcagtagaaaattaatgggctgttaaaaaaataatgggccataaaaaaataatgggccgttaaaaaaataatgggtcatttaaaaatatttgctgacattaactaccacatcatcagtgacacgtcatcacacatgtgtcaacgaccacgccactggccattttggccgccacgtggcaaccatccgtgacgtttaatttcatcacaaaggttgggactggctggactacacgagcccaaaagcgttttatggcggttaaaaaacgtcatagattgtgctgatccgtgacaatttcggagaaaacgtcggcagatttaatctgtgatgctcaatagatgacgatacgtagaatcgtcacagtcaaattactatgacgaattttcagtgatccatgacgaatttttttcgtcatagattattgtagtgctctaatctagacaccacgtctaagttattaattactactctaatacttgcgcaggaactttcttttttatccagagtactagaactggtgcacttagtacgaatactaaacaatgaacccacaaagatggaaatcttacttagaataaataattaaataacataagaaa

SEQ ID NO: 108521 - DNA, 594 bp, Oryza sativa
aactaatttcataactcgcctgtaaaccacgcgcgagacgaatctttttagcctaattaatccgtcattagcacatgtgggttactattgcacttatggctaattatggactaattaggctcaaaagattcttctcacgatttctccctaactgtgcaattagtttttttaatctatatttaatactctatgtatgtgtctaaagatttgacgtggtgtttttagaaaaaaatttgaaaactaaaccaggcctaatacgatttaatctaaataaattaactaccaaaatatctctatcttccatatcttccatagtctagatcaccgcaatacggcaccctgcgcagcctgatgcaatgcagccgagcgatcgatctccagcgtccatctgcacacgcccttccgttcgcatattccaccagcaaatccacacagcatgtgatcagaagccatgccttcatatgattgcagaaatcaagcaccaatacgatccggctaaagacacaagaaaccaagctccatctatcgctgcatgcactacacggcactctgcataggtatgcagtgctgctctgctctccatctcaaaccaga

SEQ ID NO: 108522 - DNA, 740 bp, Oryza sativa
tatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacagtagcccccggcgttatgccagggcgatcaccctcctcgagggaagcggtcgggcgtgacgccacttacttaggcctggtgacaagtggggctggtctctacagttgggcagaaacccaacggtcgcaaatcacgcacatcggcaatggtaactcgactgtcaataatgagcggcctcttcaagactgccacattactcgagtagcacacgaatcgggacgagccggttcgttttgcctggagatatggtgatggcacttcggtcggcgag

SEQ ID NO: 108523 - DNA, 862 bp, Oryza sativa
aggatgggttggaaactatgtcacgtcttccgtctgtataccgtggtggtatgtggcacgtggttacacgtgagaaagacgtgtcttgtgggtaaagatgtacacctctgatcagagtttaatctattcgaatagccgcgccctcggttatgggcaagccgagcaatgtacccaagttagtgttttaattcttaaaacccgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtttagtgctaggatcgcgtttacaaaatagccttgagcaactaaatgtctttaaatgctgtttactgcaaccctaaccctttatattataattcccttgtactcccttgcatttattctgcatttgtgggtgtgtcttgttgagtacggtggatgtactcagtcttgctcaatttttcccaagtccagaagaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgacaaccgtttaggcaggcccccgggcgggtttgagtatctgtatgtcgcgatcgacaagttcactaagtgg

SEQ ID NO: 108524 - DNA, 583 bp, Oryza sativa
ccatatacttatggacagatttataggtcctatatgcatcaatgacacacaaagatatactccattcgtcaaaaaaaccaaacctgggtttccgtgtacaacgtttgaccgtccgtcttatttaaaaaaattataaaaaaaattaaaaagataagtcacgcataaagtattaatcatattttattatctaacaataatgaaaatactaattataaaaaaaattcatataagacggacagtcaaacgttagacatggaaactcaaggtttgttttttttttaggacggagggagtatgtgtgcttatattagctaaaatgtggttccaaatttactagccaaacgcttggcaaattaggaaaaaaattaaatctagcttaggcaaattgagtatatcaaccaaacaggccctaacagctagaatgcattccaccaacccaaaatcgagtgtgagagcaagtgtgtgatgagctgtggtatacacgtacgagtattttatactccctacattctaaaatataaggcacaaccacacttaacccaaagactaagaaataattaatgtcacatcattgtcatgaatc

SEQ ID NO: 108525 - DNA, 1166 bp, Oryza sativa
cctcccgccgccgccggctccccactgccacaaggcacccaccgctgcggtggagctcagcccgggcgccaccgcggcacctctgccgctcgctgcggtctccgcccgccgcgagacagagagagagggagcggcgaggaaagagaagaattgagggaggggagagagaagggacacgtgggtcccacaatctatttttttgtgttaatgacaaatgggtcccgtacatattttttaattctaaacaccacctgaacgccacgtcaacaccacgtgtaaaggaaacccggtcaataccgccacgtcagcgaaaccgtcctccaaaaccgccaagggagtcaaattgcaccggttttcatagtttgagggtcaagatatccggttttgtggtttaaggtcacagattagatttcaatcacttttgagggtcaccaagtgaacttattcctagttaaatcgaaacggtagtaatggggcccagaaatctcgcatgttaatcagtgggtttgtcaataatcctggccatccatttagggcatgtacaaaggtagagtcagatatgagctctacgttatctagagactagcatcctacaacagttagagacaatatagtctctaatcattaatgtatcaaaatactttttcttgctcttctttcctttctttcaccaccatgaaacaaaatttgatctaataaatgctaagagtcgactctgagctgttgtcatgcataacaaccatactcctttatctttcttccatgtcatcaaatttacttgcatggcaatagagagataccactaataaaaaccgttgtgcatgcccttaggtgtgaccgaattataattacttcgattaaaacagaatccacatctgttatattgtgctatccgaattgtatacttcgattaaaaaataatctctactaacctaggtggaactgaattctaatgttttcagattaaagggaagtccacatccgaattgtaattagtgctaattttattaaatctagaattataaaatcaatattagagtccaagatgaatacaacgttgatccctccgcttcattgaataaaaaatatattcaattatgtatttttaatataataaaactaataggatattgtagatggcattatgtttctctataaatttgttt

SEQ ID NO: 108526 - DNA, 697 bp, Oryza sativa
catatatatatatacctataagctgaaccaaaccaatatataaggttcaagctaattaatttgtacccaaggtatgaaggaatagggtattcaatgcaaattggccataacaaaggaataggtccacaccacccgatgacattcgaaaataaatgcacagttgaaataaatagagaatttaaatataggatcaacaagctcaaaggaattgtgtttaggatctgtgtgacttgccttcgcaacgacggaaacgacaagctaacacgcaaaacaaagaaaaagactaataaaaaccaaataaacagtacataaaagttaacaaatatgtagatcatgattttagatgaattatgagacttgaacggtctcattccgatttcatataaattaattacgaattttacaagatttaattccaattaaacctattaaagaaaagactattccaaattaattaaaccatttataaatgatttataactgagagaaaagattaaaacaacctccggaaaatattagattatatttggtagatgacatatattaaaaagaaatatatgccattgaaaagagagaacgaatagaagtctcaccgaaccacatcgatcggagaggatgggatgatgtcaacgttccggcagcaacacacggagatgacaatgctagaccatccacggattggattatattggattaa

SEQ ID NO: 108527 - DNA, 712 bp, Oryza sativa
agagcactacaataatctatgacgaaaaaaattcgtcatggatcactgaaaattctttatagtaatttgactgtgacgattctacgtatcgtcatctattgagcatcacagattaaatctgccgacgttttctccgaaattgtcacggatcagcacaatctatgacgttttttaaccgccataaaacgcttttgggctcgtgtagtccagccagtcccaacctttgtgatgaaattaaacgtcacggatggttgccacgtggcggccaaaatggccagtggcgtggtcgttgacacatgtgtgatgacgtgtcactgatgatgtggtagttaatgtcagcaaatatttttaaatgacccattatttttttaacggcccattatttttttatggcccattatttttttaacagcccattaattttctactgcagcccattattttgttgagaactgacccattttaaaataggcccattttagaactaggcccatttcagaactagcccattttatcaaccaactatcatatcaaagcccactaaacaggcccattaaatttgagaccaccaaattcaatccaatttctcataccatctcagatacaaacataatggcagataccatctcagattcaactaaaaacagatacaatccaaatacaacaacattcaaacaatagttcatctcagattcaacctaataacaaatag

SEQ ID NO: 108528 - DNA, 653 bp, Oryza sativa
ctccagattttttccctgattaaattcgtatttaggcattacaagctcgtacggcttcggcgagcctccacgaatgcaggtgctctaccgccggaacggacggacggacaaacatgaggaagctgccactggtggagaaatgtattttactctcagttggtaaccccttatatttccggttttctaaccgggagtaaaaatctgggattaagttaaaataactgggactaagttttttttttctttttttttctattttgtatatctcacacatgttatctcagatcattcacagcaatatagttcatcccagatcactcgcagcaatagttcatcctaaatcatttacagcaacatattcattctcaaaatcattcacaacaataacacagatcgaaccacacattcaaccaaatcgaatcatttaacacagattgaatcatacattaaggaaaaaagaaaaaaaaatccacccagcagcgctggcctccaccgactgccgccgtccggccgcctcccctcgatctcctttgaatctgccgtcgctccccaccgctcgaatccaccatgatcaaacccaccagccccgctgctataatccgccagcgccatttgaatccgctgtcaccacatctcgccgccgttgatgacct

SEQ ID NO: 108529 - DNA, 525 bp, Oryza sativa
aattcctatgctctttgttatggccatgatgttgatttgatatccatgatcttttttaaccctagtaaaattataacctgactagtctagtactctacatgatggactgacaagttgctttaggtaaatgcttattgtgcttagttccaacctagaacttttggataaactagactatgttggttaacaattaaaactggtttagttattaactattgactggtttgtcaatagatgggggataaaatgttttgtgtaactaaaacttatttttgggctaagctcgacgtgcaagctagttactttggtagtcgcaccacggctaatataaggaccggtctgcgggcctctgttgcaaggcatcttcttgtaatcacaagtctagtgggtaaggcctgactgaaagtttagatcttctcaaaagagataccattggttggaagggtgtggggccaggattaaggccgattttcacccgatgcaagggagggcctgtctccttatcggggaccggtgggcaacgaa

SEQ ID NO: 108530 - DNA, 1181 bp, Oryza sativa
ttttagtagggaattatatatcaaattaagcttggcatatttaattagttgtgacatcatataatcaatgttgccaatctagcttaaactcttctataataactattttaattgtttctttaataagaaagatgatacatggggtgtgtgattgtaacacctaagatctcatgtttaattcttgacagacttataattttctctaataaccaagtttcttcttggttgtacttatttttataagcaagatgatttacgtcttcgacctttgtatataaggattttcacaatcataagattgtgttaaaaaaaacagttttaagttataggttcatagaaatccgtgatgtttctcataaatcatgcattactcagattcaagtgacctctagttggcaaatacgtgtaaaatatcggaatatctacgattggctacagatttcgtgaagaagccattttgggagaaaggttggccaaattgtctgataggacgaccttattcgccaactaagtatagatttgagagcctttttttaagttaataataggaatttataaaacccaggttccacaccaacatgggtgtatccaaccaaaatagatttgggagctagcaactgtaattatactgttaggcgaaaaccaattcagcaagtcttgtttttcttttcgagatgttggcttgaaggagctatctagctttctgtgctgcaaatgtactcgaactaagcgcggctcctatcctgaattcctgattccctgcctgcaaaagaacccgaggaaggcaagaatatatctttcggtttggacaaacgtcctattctctcaattatctttctacaattagacgaagttacatcaatcccctgaaaaaaagggaaagcgaataaagaagataggagtagtacttgtatcgaaaagcaacacccgtctaaattacaattccaactctgttctgaaaaacataaggaaaaaaaaaacaactgctcacagttttgttctattggaattcaattaatagaatgcaatgtaaacgtcatgatctctacctaaaataagtaaacccttacaaaacaacttaaaatatatccaaaaacaactccaacttctcgttcatgagcgttaaaatgatccatactttgctaacatttcttcccagctccagtagcagttgcaattac

SEQ ID NO: 108531 - DNA, 4071 bp, Oryza sativa
cccccgggtgaccgagagccatgataatcggaaaagtatttagagcattgtcaaatgtaaagtgactcgtgcttaaatttctcagtaagtgagggctagatctggctggcccaagcttgtgtggctactatatagaccagaccgtttggagcatgtgtacggactttggctactggtcacgatgagcatggttaaaggtaaggcatgccgatgatgacgtgtgatagatggaagatgcgacagggcaaaaaaaaaatatatgtatggctgccccgagttcagtgttattaattaaatccggatgctctgagctaagtgatgctggatatggtgctccggcccctccatatattggtgcctctatattggccactgtcggttccatcagtgatcgatgttcgatttaattcatcattgtttgaagcataatactgtgtcaaatatggtaaatagctgagatctaaatatccataaatttgaggttttacaaaatcctagggcgccataaaatctttgtttgtgccacatgcaggcatatatgctagtactgtctaagattgcaacttcacctacaaaatacaaatcatgctctccaaaatgtattcttagtaagttttattatttatcgctcacctaaatatttctcatttagtccctaaatttcgaattgaacttatgcaaaaattggacaaatttggtaaatcaactgtttcgtcagtcgcacttggtcagatccatatcagaggtgaagaaggaccgacgagggaatgcaagttccgctggtgaagaaagagcatagaaactagtggctgataggtagaaaatatgaatcattatttccctcaactgttacatgttattccataattaaggatagtaaaaatatttattctaaaaatatgtatttatattagagcatacctctccgtggccaaacaactcaaatcctatctataaatttggactagcacttgtctagatgcatagttaggatttgatttttttttaaacggaaggtgtatgttacaaagcgccaacgtacaatatccttggccatgcatgcatgcatatatggagacgaggaaacgctacaaaaataatttatgctgcattcggacgaatgaatgggttgggaacccataccctcagcatgcaaaaataagcagtgaattgccccctcctcccattttaattgcaattgtaggttttcgtatccaatatttaaccattcgtcttatttaaaaaaaatatgaaaaaatttaaaagaataagtcacacacgaagtactatttatgttttatcatctaataacaataaaactactggtcataaaaaaaatttaaataagacggacaatcaaacattgtacacgaaaacccacaattacacttaaaatgagatggagtaagtaacacatactccttctgtcccaaaatataaaagatttttttactgaaaaaatataaaagattttggatggatgagacatttcctagaattataaatgggacatggtgattaattaattatgtattagctacacgaattaaaaaatgtattataatgattttctaaaactactttgttatagaaagttttttaaaaacacgcatcagagaaacgtgtgtgtgggaaacatggttggagaagtttgaaacatccactacgaacgaacttagggtttgtttgggagcttttgacaattacagttttttttaagaatcagaagctttctcaaacagttcagattttaagaagttgtagaatctagtaaataaattaaaagttagaaactgaaaaacctaatttatgtagatttttagaaactgactacttaattaactgtttcttcgaatcaaagtgcggtgccaagcttccgattgttcacgatagataccccacataatccctgtagagcaaattattgggattggatgcctggatctgatcgaaggacactaccatgatgcgaattgagtacttctcggtcagtcgtccctggccccaaaactgcagtgaattgacgagatcacgtacgtgcatactatgccgccggaacagtgctagctagtactccctgaaaaaaaaaaaagataaactcttcattttcgtgtccaatgtttgactatccgtcttatatgaaatttttttataattagtattttcattgttgttagatgataaaacatgattaatactttatgcgtgacttgttttttttaattttttcataatttttttaaataagacggacggtcaaacgttggacacggaaatataaggtttgtccttttttttttaaacggagggagtagggcactcaatctgctagcatattcgtcccaaaatatagtcaattcagatttattaacttaaaaaatacttatgttttaagaagataaacagagtattttttgttccataataacttcatctaatacgaaatataacatgtctggatttatagcatagcatctatatggtatcatcctagattaattaacttattctaaagtactataaaccgcgagttggtcgatctacgtgcaattcgatcggtgtacatgaccgatcgaccggtcgataatggcgccggctagcttaatcgtcgatctagaaattactccctctgtctaaaaaaaggcaaactctagatttttatgtccaactccgtcttatatgaattttgtttataattcgtattttcattgttgttagatgataaaacatgattaatatttcatgcgtgacttgtctttttaatttttttataattttttcaaataagacggacggtcaaacattgggcacgaaaaccagagtttgacagagggagtagaatgcacgggaaaagaagcgagggaaacacgggagtaaagaggtgttcgtactgccctatactgcccgccgaggcgccgacggcgacgtgcaacctgaggaaacgtgtacactgggccggaatgtctaaacgtggcttttactatgcatgcatatgtgccacaccaattacagccgcgtttttcatcgtctgattttcggttttgttcatatagaaattgggtcgacagttttttattttttttaaaatttatagtcagttttctaaccgtttgatctgttttgagatgggcgcttccatccgactttttcctcgtgaagagccatggatgcagcaaatgagcaaaattaaatatgctaacctctgaagtcttgcaaatccgactgaaacgggcagctaaatttgtgctccatgcatgtatgctaatctagcattggcctgccttttatgcgtacattataactttggtataattacaccgtgattagatgttgaccgtaaaaaaatgaaatttgagtgaaatatgtttatatgaattgatcatatatcttttccagatgtatcaggatggcagactccaactttcaaagaaatatcatcaacgctaacatgctgataaattgttgatctgtgtaatccaaaggctagaaatctgactattttttgcccaaatatctgaatagaataccctggtatgtaacttggcatttgggcgcggtttcaaaaaaagttttaaaatagtggcaaacatagtaaaaaaatatttttccaagcaatgatattttttttctaggcaagtaggcttctcaatcggagctaaaaagccgcctctgaaaatgacaaccgtgggacaagacagacctcttaagtggtctgtctgattttcacaggcgataacttaagaggtccacctacaaaaaggataaggggcatttgcaaatttgccactggttttttcaattttacaaggatgcacgtattaaaaacgccacctacccaccaaaatcgctaagttagagtccctccggctctcccctcccacctctcctctcccggtgcagatccggccggagcagcggctagagggcggtggcggcagcggctccaggcggtagcgacgcgaagggtggaggaggcgacggctcccctccctcctcccagatctgatgaaggcggcggtggagggaggtggcggcttccctactctccctccctccctcccggtggcggat

SEQ ID NO: 108532 - DNA, 2557 bp, Oryza sativa
aaaaaatatatcacatacagtcctaaattcgtttttttttacacaggaagtactccatatccatcagtgtcctgatcacttggcatcttcctgtgatacgcgatatcttcacattgaaattatcgagcctttgtggattaattttagacgctagattgatcatcgagtataatttaattttttaaaaagacatcagttagtccaaggattcctgatgttggaggtgcaccacgaagggccctcggccgaacccgccgaaaccaaaaacttaggcggcaagcttataccagaggcgagcggccaagattgaaaaggaaaccgtgcaggcgaaagccgtgactcgagatacgtgggcttcgccaggcaaagatctcgtcagagggccgcataggtgaagacagtaaggcgaaagcctcggcacgagggcacaggcttcgccaagtgccgaaccccaccgtaaggaagcccagcgggctgttgcgcttttgggggagttcggcaagtagatggaccgagccattagagacccatatatgtaaaggacattgtgtgcccctaataatgttcctatcataaaggtaaccatgtaaattcctttataaaatactaaaccttagagggggaacctgtaacagggctataaatagccccctagggccatataatagggggatcctaaaaaaaattcaataagcaatacaattgttttttacttccaaccactgtggagataaccacgcctttcagcatgacgcagttgtccattcgataacacctgagaacaccattctgtaaagttcttatttgttccaaaaattctgaaactaatgatttttttttaaaaaaattataccttgatgattagttagggtattagatttgtcaattcacaccacagtcttgtcacacacacacacacacacatatatatatatatatatatatatatatatatgacctagctatgtcccgatgagagatcatcagttgacgggtgcgaccgtgaggtacaatactcaatgggatcttttttccggcccattataggtagggttccctcttaccctttttagcggggttaccgcaccctgcggtaagatggttaccgcgtaaatcgtgtggtaactgtgagacatactgtggtttcaaaaactgaaaaggttaccgtgcatggtaaccacgataaccgtattacaggtgacgcgccgctggtctctatcacagatagatagttcatgataccggctgattctacttagtgattctttactgcgacagcatctaagcatctagctagcactctttacagctctgaaatttttttcaggtgtagtatttgcacttcattctgagagcccgtcaagaaacattgtgaaagtacatgctggcgcagtccgataatagtatacagagatgttcagtcagcatcatcactgaatattttacctttttttttgcggggacactgaatattttaccttgttcatcaccatatctggccaggctgagcaacagttgtgttgtgccggcaatttggcataggataccacacgtttgttattgcttaaatttgacctatagggatcttctccagcgcggcaactatagcagagaacaggcaacaaagttcactagtgaactacatctaggcaaatgtggatgtgagaacttctgctgcaactgtgtacatatggctaccaattattcgtggcttcgttcggccaaaaaaacacacgctgctttggagatttcctaaggtaattaaatctatgtaaattttagaccgttatttttatctttgaacactttgtcaatatttggagtataaaaatcctttcatctctcaagtcaattttaatttccatccaaccatccattcatgtctaatcactggtagagaaaccatctttggtcggtcgacctatatccacaatagtcccggttccattaaaaatcgagacaaaatgatttttagttccggttaataagaggaagatctttagtcccggttgttgttaccaaccgggactaaaaatcatctttagtcccggttggtaactccaaccgggactaaagtttatttttagtcccggttgattccatgtcaggctgtgtcagggccctatgatctttagtcccggttagtaacaccaaccgggactaaaaacctatttttagtctaagttttcagggcaggataatacatctacaatggaacacattagccgattcttagcacaatgggggaggcatcgactgaagaagctctgaaagttagattttttttttccattgtctttgactggatcggctttcacatggttttcatcattatcatcaaattctatcagaggataggccaatcttgagaagtaatttcatgattacttctttactggaatcaatgagttgaatctttcagacataatatcggttgagcagcaagaaggagaatcggctatggaatatattcagagatttcataatgtctgcagcctatattatggtttgagcctaaatgatgagcagctagcagatcttgcatttcatggattgt

SEQ ID NO: 108533 - DNA, 941 bp, Oryza sativa
ttctaatcatctcattccatttccaaattgttaacattgcaatgtaagtttacatgaaattaagggctcaccccaccattacaattcatgcatatgcttatgtacacagcagttagaggccattgccaccacatccccgcccacagcaaaacaaattccattacacaactagcagcacatgttattccgcattacatgctcgcacggtgagagttccttcatgctggaggaggcgccgttgtcgcccccatcaacaaggcaatgcagcctgtcaagacagtttgtctagctacaggaacaaggagtggcactggagttgtagcatcaagcagctcactaggaattgatgccacagtttttggttggctcatatgcagcaggtgcctggtggcacctcatcttgtgaggtttgcacgccattctccagcagcaacagctcatctaaagttgttcctccttcatgctgcataaacaagggaaacccaatggaaaattatgagttgtttagcaaccaactgaactaaacatcttatgataggtagtaatttacaacatcatatgagattagacaaagtagtaaagatactaaaattgagtccattaagcaagattaaaattgagtcaatcttaccaaatatagggaacacaaaaattcctttgttaaaaaaaccaaatttcatatatatttgtaagaaaacaaatactttatcaaaattgcatcataccaaaattttagtaatacatatagcacctagcagtaacacaattcgggtaccaatccaaacgtatattttgcatttcacccaaccaaaatttgtgatggcatcaaaccaaaccaatctacacttaataaaattgagttgtggaatatagattgtttaaggaaacaactaagataggtcctaaagatgatgttacatacaaacaattaatcatgctat

SEQ ID NO: 108534 - DNA, 1271 bp, Oryza sativa
aaaggtgtaggttctaagaatgaaaaaaagaaaagcaaaaatcccggcttggtgcatcgcttcgaatcgagccaatacatcaaacagctctccatcatcactgagatcaacatcatctccatcaaccaaacacaatgatatcaccgtcatcctatcaaccaaacacgatcacaaactcaacaaaatcacaaatacaaatacatagaaaacgacattgtcatcatcgtcgatcccgcctcccccgtaagcacaacagtgatccggtcgcctccgtcgtcgtggcggcgtcggtcggatggagaagaggaggaggaatgaggggaggcgacggttaaggaggaggagtgacggatctagaaagaggaggagggaggaaaaaggaggagcggcggcgagggctaaggaggaggaggaggaatcccttcttacgactataaagttatcacacggagttctggacaagctctcgtcatcattgaattgcatgatgtatgatcgctgaccattcacatgatgtcacactcgagcacatgaccaataatttatcacggacctcctgttctttcagaaactgtactcccgcttcttttgcaggtcatatcactcgcaaacgccagtgaagcaactcccattagttacaagcagtgcgtgcgtgcattatcacaagctcttgggctgatgcacaattaatgtgggaaggtaaggaataaatgaagttgtacaattatatcctacctcttccgttccataatataaaggattttaacttgttacttgtactgtttgactattcgttttattcaaaaaattttagaaatattttttttgatcgacttactttattatccaaagtactttaagcataaatttttttttatataagcacaaattttttgaataagacgagtgatcaaacagcgcatgaaaaagtcaaaatcttatattatgggatggagggagtaatattttagttgcacgaaacttaactcaatcaatcaactactccctccgtctaaaaaaaagcccaaccttgacatggatgggacatttcgtaggacaacgaatcatgacagggagtagaacttaatatcaaaaagtgattaaagtttgtgaccattttcatgttattactcccctcgtctcaaaatataagagattttacaaaatgtgacgtactccctccatctatttttgatagtcatatttctgaaaaatttatttttgataggcatatttcaatccaacaacctatcatcttaatgactttctcg

SEQ ID NO: 108535 - DNA, 813 bp, Oryza sativa
aattcctgcagccccagctcgaaattgaagtttactctgtaggaagcagagatttagccttgcaaattcctgcagtatattgagccatcactttcttttacagcaataacttcgctcaaaacaagtttgccttttttactaattgttgtatccttgttcatcaggtgctaaaattcaatgggcaagaagcactgttttctgctcttcagagagtcaaagaaggtaatatcatccaagttcttatagttagaatgttagattgctgcctgtacaacaatttatttcttggatacaaaggacaattttcactctgtttctttcacatattactgccagcagaacctgaaaagatgatcttatcgtcaccaaatgataaaataaaatgcttcatgacacgatggccagaacatttcataccagtttacttatgccacaataatttgtgccatttgttcactgcctgatccagcttgttgattacttgtgcagagttgatgcttctgggtttcatttccttcctgcttagcgtcttccaaaaatttatcaatcacatttgcatcccggagagtgctgcacatctcatgcttccatgcattactagagagacgtccgagaccacagaagatgcttccaaactttgcaagcgaaaggtaggatgtgaactatggagagattttcttaaacttttgggaatttttgataaactccaccacgaagtgtgcactctggattgtttagctttgttatttttcactaaagaatttgtttcttgtgggtatcttttctttcttgaagagtagaacaaacaagaaa

SEQ ID NO: 108536 - DNA, 1371 bp, Oryza sativa
aggttatggtggtacaaatttggataggatgtctctagatgcttatagatgatgggcaatctcaagaagattcccccatatccctgcccacaaatttggctggccttttctggctcatatttcgtatgtattacctccgtcctaaattagttatcactctaactttttttttatcattcgtcttatttaaaaaaatattataaatataaaaaaagataagttatacttaaagtgcttttgataataaagccaaaaaataaataataatttcgtaattttttgaataagacgaataatcaaaagttacaaacaaaaacttaaagggctggttttgtttgaggcctaaattagacttaccaatatttggcaattccaatagtgtttagtgtctatttggtttgaagccaattttggcatgcctaataaaataggccatttcaatagtgaacttaggctatttttacttcaatccaaacataattttaccttaccaaaattagtcatgccaaaacttaccagaatttggcattgacaaaatttggtaaggcctatttaggccacaaaccaaaccaacccaaagcgacgagtattttgggacgaaggtagtattcaaaacacatatattccgaataaaaatagatggacagcattggacatttggtgttgactttagcactgtgagaaaatgacaactcagaccagggtttcaaaatgcgaacgatagtcgaaaggcatatccctatcaaatttatcagtaaccgtgataattaaacggttgccgacgaacggcggtgaatctatatttattttgagcttggtttaaacttgatttaggcacgttcgtttgagccgttcagctcgcacgcgaaatgagacggggtgattagcaagggtaacaattataatttttaaaatatatactccctccgtcccaaatataagtatttttagttatgaatctggctaaatgtgtgaccagattcatagccaaaagttgttatattttaggatagagataatacattatactatatttatttcacaaaacggtacgttaagttcggttgacttcgtcaatcccaaaggatttatcagcccagtattcgaagatgtttatagaggtagggattacatgcgtgcgttcataggggtgagtgtgcgtgtattgtgagtgtatgtgttgtactatataatttttttttaaaaaaacaccgtttcgagttgctgaaaagaactcggtcttagtcttattgcctgttgggtactgaattactaggatttagcaattttctcgttttccatgagcactcttcctgaagttctagccagtgtattcttttcaagaactttttatataaatgttttctttct

SEQ ID NO: 108537 - DNA, 2929 bp, Oryza sativa
ctgcacccccaaatctcatttaggccacctttggttattggttgtttaggtgacccagccggagctcgtgggaagccaggaagtggttacggttacggtgttggcgtccgtgtggactccccactgggacctttgcgtcttgagtatgctttcaatgataaacaagcaaggcgatttcattttggggttggctacagaaattaaccagagtatcattgtgtttgtcggcgtgatccttcatttgattagctgctgttaggagatagtaccattacttccatttctttgcggtatcaatatgtgaaagccttttgcaaagcaaattttgtctgtcccaattcccttattgtaacatatttgtacatttttttcaatcctccctcttctcatgtagatgttcttgaaactgaggagaaaatgatcccaccaggtaattactcatgacttatggttgggtgaagttccctgggataatttaaacaagttttgtcgttgtcgtaggacaaaattttggatttgtatcaatgtcaccatttgtattgtaatgttagctggagaaatctgagcctctgctattcagcttaaacaaaagctatcataatctgtctgatgacattgcaagttcgctccaaacaaaagctgccactttgagtctgtccaggaccaaagccacgtccgcacgcatgggcctgtattatgtgtcatgagaagttgcagcatgcatcggatttcctcagatctcaagatgaatgaaagcttcccaaaccaataaaaagctggactgaagagcactcacggaatcttccatccatgcaatggggacatgctagcaggtacgcacaatcagtgtctcatcctgtcattttccagctacaagttatccttttatcttaagatatactcaatacaatttcccgagctgaaaatttcaagaaaataattttctctcttgctgtctttggtaattttcattcttcttacagctacaacttacaatgttgataaaagttcaaaagattgtttgccttcaaagaaacatctgtgctgttttgggttcaggacttggttattgctactctgcttcatgccatccatgtgctactgcaaaatgctaccagtgtattagcatctcgatacatgtaatcatgcatatgtccagcatataatggattgacaattcttcaagacctacacctgcacaccattctgtcggcattattttttccatctctagaacttgcagtagcccaggcgcccagctgtccttctgcacactagtagatcagatgactcacctgattaaattagtttgctactgaatttgttcatttggtcccagtttacccctaccttcctgccatagagtttggtttttaatcaaacaagtcatcttgcaatgcattgcctgcatgctgcaggttagtcatcattgcacaggcaaccatcagcaggctgtcccatgctgataatcaaatacccaggagaccaatctttctgggattcatgcatgcatgatatggcctgcagatataagctgacaagccagatgcagccaacgattgacagtgtgtaatcagtctattatgggaggagaccaacctgagcttatcatctccagtttttcagtggaccgatcaatcggcgattttcgcgtttgtgatcatgaggtttcctgcagattaatctcccctggatgcatctggggacaacatggatggatgcttctgctgctcagctgctgtctattcatggtattctctcttgccttcttgcagcggttttcagaggtcactccagtatccttcgttaattcgtaggaactagggaaatcaaatcttagtacaccgtaatgctatgtttccaactaaaagaattggattattgcaccaaatatgggaactaactagctaggagtgcctcatgattactgaaaaacccaagccacattcttacagaacactttataatgtcaataattacacttcattttgcctgcctagctaggtagctagatggcatccaagaaaatcgaattgaaagaaaaaaaatagcaagatgccaaagttgtactactacatgattaatgcaaaacaaggtcacaacaccaacttttccatgattaattcaaaatcaagatgatcacaacaccagcttttccaagccactgttgcacttatctgtccatcagggacagaaagcatcaccctctccacatcaccagtgcacgaaccatgatcttccatagattggcatatcaaaaggcaaaagctagaagccagtagtagtgtaccaccaccaccggtgtgtgtgggtatcttgtagtacttggtgtgagcgtgatatgatgcagcattgcagcttatctagctcagcgtagcctcctagaaaaggaaacgggaaagcagcctctcatccagatcgaagctctcgctatcaatcctgggtatctttgtgtactacgctagctgtggcgtgtgtgttcatgcatcatgtgatataacagtgtagtaccatttgtggtctactcctccttcttactcttactccctctgtccatataaaatcaaaccctcctcttttttactcttactccctctgtcccttataaaatcaaatcctagcatcccaatgtaacattagtggagagtgaaaatgaccaaaatacctcttattattaaaaaaaatagtaatgatgatatgtaggtaaagaatgttgaaggaataaaacttctcattttacttgctgggagtaggtagaatggtagaagttggtttttttttggacaaaattcaaactccagaagttgagtttttttggacggagagagtaaaatataagagattttaaatatatgtaatatatcatagtactatgatcatgtgttcagattcaaagtatgtaatatatcatagtactatgatcatgtgt

SEQ ID NO: 108538 - DNA, 1299 bp, Oryza sativa
cttagtataaggtggcacctagttgatcattaggtctacaatatagcatatattaagttaacacttgcctttcagttaaagttaaaaacggaggcatcaaagaaaagcaaaagacaacaagagttccaagtcttctctcagtgattaataaagaagtgctatgtgaaattcctctgcattctgctgagagattaaaatttaaaagaagcagggaatgttagcaacgattctgtcttgtctaaccattaccaagccccagtattttctcctgtagtattacctaagttttgatatggtaaaagaaaatttagtgatgtaaatcttgatatggcaaaagcaaataatgtgatatcactataagcatttagcagattccataaatcatattttgtgctgcgcctctgcgggcagcaccccagccatctatctacctccatagatgtacacccactaatttccttcaagatgcttctcaattttgacaaaactgaatatagaagcaatcaatcaatgcctatcttaccaaaaagtacacaagaaaaagaatataacaacatgagccttctttttagatccactgaccctctaatcgaattttaattcgagtataaaatcaaattcatctgcttaaaagtcataaaggtggtatacatcaatgcaacttgatgtcataagcttttaggtgaaaacatgatgtctgcaagaaataaaaacatataaagaatgtttacatgtgtatctgttgagactttttaaattgttagtcattaatttctgatgttttcttccataactgctgacaaagtgacagttatttttaaatgtatttacttatactcttccttgtaacttctataactcgcagaaacattggtttctatcctatggaagcaggagcatattttgcttctcttctgttacaagttttactaaatgcaacgaaacatcaatattcagaagactgaaaattatgctgagaattaatctgccacatggggtataatatcaatatgcaaccataaataaaggattgggaaaaagaaaagggacttgcacaaaaacaatggcttactgcctcaacaaaaacatcaaacttaatgtttcaattaaaacaggagaaaatagaagctgcatgttcaatgcatcatctaataatttgtttttttactattaccttagaatcacatggttatagtaagcatttttttttatagatgaggccacattgataacttccagtcccgatgaactggttcactatgaaggtaagttctcagctgtgcccagtagaataaatct

SEQ ID NO: 108539 - DNA, 1987 bp, Oryza sativa
ttaattaattaactttctagctgcctccttgttagagtatgcatgataaggaagattgatcatgctctaccataaaagctttagtatacaagatatgtatattggataatgtggatccgacctctgggctctaacacttttattaatttgtctctacgaaaattgtattctttaattagaaacagtatctagctagtagcgaccaagcttattaattaagaaccctacaaaaagatacatatatactagtcatgtatgtttccagttaactaactatatatataagcaccatttgatagccagactctatatgaccaatctgtggttcgtatggtgtgctgcacgactgtttgaaccaattaaatacagctactctgcttgataacaactaaagaatttatgtttgattttgaaaaaaaaaggtactatcaacagccattaattttataaaaatatatacctgcaaaataggagtaagtatgaaaacaaaaggtacaaaaatatgtgtagaaaaaggtagaaaaattatgataactaaatacactcagttaaacctactcacccgaggtgttcgatcaagccctacatattactgcaactaataattctttttagtggtacgtggtacctttgtcaattttatatgtcgatctttcgaaaagtgctatacagtaggttatgtgttttgagaaagaaaacgtagtaattgcatgtgtgtttttgctcgttcagtaagaaatctgcctttaatttgtgctagcttatgctagctggccgatgtgatgttacgtgtgcatgatgcttgcattgctgttggcaactgtgtgtacacgtatgtgtcaagaatggttaaagaaaatggatggatgccaccaaatatgtcatgatcctatcattgacttatgtcatattcggttaatttagtttatactagggcaaatcttttgggtcaaacagtactttgcctttggcctttttggagattttgcatgcgtttttctgctctaattaaccaaactatacgttaaattgtttaggagaaaatcaagcttgcgtatgaaaaattctgcaaaatctccggaagaatatatgagataataattagccctagaacaatgtcacatccctttggccacaaaatatatacgtcagtaattaattttagaacttgtgcaatcaatagatattaattactccctccgttcgaaattgatctacatatagtttttttaggttattcctaaataatctacatatttatgttcattcattaagtctatttgctatttatgcattggattatgcattggagtaaatagacattgatgcatacatccatgcacacaagtatttataacccacatgcaatatcttaatttgctattggctaggaaatagcggggatggtgcatgcatcgagtttgttgctagagtaaatataatatgagataattattagtttttcttaatcttggtgtacttatgaaatatgtagatcaatttggaatggagggagtaactttgacaaaaaaaaatattctaaagtgtatatatttttggacatatggaacgatacacgagtaattaaaattttttttgttcatatatatgtttataataatattacatgtttatacatatttttgaatatataatatacatatcatgatacacagttgagtgatcaaaataggtccgatatattgattttgaaaagtcaaaatcagatttttttttctagaggttgtagatgtgatatatatatccaatgactacagatgacgtatgcattgatcacaaaatcaacaaaatttaaagaaacacacatatatatagctaggaatcacacaaagatattcacaaattaaatttagatagtcatcatcagcaaaaagcctttttcatataatattgtcagcaaatacttagtagttagtcagttatggttaggtaaaaatgtacagctatgctgctgcctgctgatgtg

SEQ ID NO: 108540 - DNA, 586 bp, Oryza sativa
ctagtataagggcttacacgtcaatcaaccttatcaccaactctttatttttttctttaagaaggaaaaaggattgtgggggctagtgggcccagagagatcacatttaagtaacaaatatatatatatatataaactaaaagataatatttatacaaattaatggtactgacgggttaatgatatttttttaataaaatcctgttacatatggttgtaattgtacaggtaatattatatatatatatatatatatatatatatatatatatatatatatatatatatatatatataaatgggagcatatgtaataccttcaaagaatcatgtctactatctttacattaaatgtaattctttatattttaactttatgctaaccgtacatattgtcgtcactacatatatacgcaaccatgcatgcgggacgtacaaggaaatgaaaaagatatataatagtcgtactagctgtttacatacatctgaaaaatattactctataatccatttcaaaatattaggacacaactattttttttctatgttttataacacaagacgtgcatatatgcatatacatata

SEQ ID NO: 108541 - DNA, 1715 bp, Oryza sativa
ctgcagccctgtcagttaggtggtttttgcttacgtgatgctttttttccctagaaattcttgttggaaaaaaactcctgacgcttagttgattccaatatattggagttttggaaaaaaatttgaaaaattgtcgttggagcactctaacaagagtatagctcgctctaataggcacaaattccatgggcgtggttcttctttgtttcgaaagataaacccggtttattcaggatccctttgtccaaatgacacaaccaacaatagtcgggtggattacaggtcggattgtcctgacgtcctcaaactgccaattgccagtaaactaggattgtcgccgcccttgagtgttagtggaactagcagaggatggggcttgcggacgtagtcctgcgcagccgatggaaggagtttgtggcaacggcatggctctcctccctgcatgtttagctccagcgaactccgtcttcccgcatggtctaccccaagctcccgttcgccggccaacccccattccttcacactaatgtttgtcattgacgtcacgtcaccggactcatggtccttagttcctcacctagcacatcgtcaagttcctccatcgtcgacgtcgacttgtgaagatccatatatgctcagtatcctcgagcttcagatgtgcgatgaacatcgccgccgagcttcatccttaagctctatcatgctacatccattgtatgcgccggtagaaagagacaacaaagatagcgtgggaaggaagatggtgttgacaaatgaagttcactgttttttatgttttaaaaagttgattcgactaccatataaatagcacgtaatcaaagccacctcgatcttgtagagggtataagctgaacggtttagatacccatagaggggttagtatccagttttgaagattagaggtgagcgttagacaaacgcaatagttaagatgggtcaatgaacttacggctctatcttttcgcttatgcttatacttattagccaaaatttgaatttttaaccttaaatttggtgttgattttgggggtttttttatcgaaatttattttttagcctttagttttaggttgctaagaacacgtatataatttttttttcacaaattaattttagcaaaatgatggtaccttatccgagtatttatgagagtcagatagatcgatatgtgtgcagcgtggacctcactgtagagtgtaaccgcaaaatataccgtggttttaaaaattagaaatgttaccatgcatggtaactacgataaccgtgtggttttgtaagtacttccatctcgccacctttctctctttcatctctcttcccgagctatggcctacggccagcgtgagcttgtgactttgcctctccattcatctgactttgacgagattgggcccttttttgccatggctgtgaatgagaaccgcagaatccttgttcgagaaagagagtaaaatcgatacatcatatgcacagaccagccagctgtcgatcggcaaatggcccgatccacaaacttcaatccgagcaagcacacccgtccttggaaaatgactcctcctaattacatgcaaatcaccatgctttattaattactaattacatgctttaaacgtaattagcgcgcatgcaacaaacgaagagatcgaagcaaagtgatggatgatcgatcactcgaggggatcgccgccgtcggc

SEQ ID NO: 108542 - DNA, 7430 bp, Oryza sativa
attaaaaagatgtgacggaaagttgaaagtttatatgtgtagtaaagttttgatgggtttgtgtgtaggaaagttttgatgggactttcttacacacaaacttccaactttttcatcatatcgtttcattttcaaccaaactttcaatttcggcattaactaaacacactctcaactccacattttctttagaattagactgacctccacattttcttttcacggaaaatatacacgatgctaaaattatttgatttatagaagtatatcttttattttgttttttattagacttaatagtaaatgaaaaaggaaatatgtgtgcccaattgtcatacttataaaacccaataaactcaagaaaatgttgaccattcagtttttaacaattttgttaataaaaatttgaattttcatctattgtttctaccaaaattgtatttttaaaatatttgaattatgttacatctgtcaccaaatgtcttgttttagtttttttctcaaattcaagcctaacattttttttaaaaaaaaaaatctagcaccaagttttgaaagtaaaagaaaccatgttcaaatcgaacaaagctctacgccacgttcactatctaacaagttatctagtttaatattacatttcttgttaactcctcttacccgaattggtattatgatcatgactatgattctatagtacaacttttatggagctagggacctcaaccttaaaggaagttttttttttctttccaattcatttattggataattcaaattttagcttagagaacggtccatatggaatgagtagcatgtacacatttaatagtttaagatttaaaaatgtatttgagaaacctacccaagtatacgaaatattagacaatcatattagaaacatgtaaaatatttgtaggaaaccatcggcatccaacaatttcgacaagggagcttgggaatatgtagtgtcacagtaactaatatgatttatatttttcttggtgaatggcacaaataatggaaccatcgatggaacctgtatgttctgaccactttctttatgtaaccgtggagggaacaatacaaagttttacatggaacacaccatttaaccatttaagaatgttctaacgaaaaatgagaaaattaccacagctaaaaatcacatcccaaggagccctaagaagggttactctattatatgcgtcgttgtgtataagagcaagtatagtagaagtacgtctgccggcgataggagcgcctccttagctttactggtgacctaaaagagataataggagaaagagagagcaagtgagcaactaagagcagggaactataagcctactataaccttatgtggaggagagaggtagaagacagttggctttcatgcaagatctagctccaagacaaatatattaaatgtataagtgagagaaagagagatgagaagaaaaaaattgaagtaggaagtgagctctacgattatacatgttagctttaagataagctaatagtagaaagtgagctctacaattatccttagtctaaattaccgctacctcctcacacactccaataagcatgattaactttcacttgcatgcagcaaatagagcaggtggatgagtgaatgatacaactatcactactaaaagaaactcatctttaatcccagtttgcaacccctttagtcccgggttgcaaaccgagatgcccaattcggaactaaagatgctcatctttagtcccggttgaaataatccaggactaaagtttttttttctttttttcattattttttttctgcatgcatattgatttccaaccaaactcaacaacaaaatcacccacattcacaaaaacatcatagaatcatccacaatttcaacaacaaaatcatccacaaatttacatcacaaaatcatccacaaatacctagattaattagatcatcaattatcagcttcattctccatctctagaggatcaaatacctagatttattagatcatcaatcctgtagcctaccgccgccgcactgggcgccgctgccgcctgccggtcgaggaggaggagaagaaggagtggaggaggatgggaaggagtggagaggcgtgcgggcatgcgacgatgccgaggagataaggaagagagagagagagcgagagatgcgtgggagagagatatttagtcccgcttagtaataccaatcgggattaaagatataatctttagtccaatttgttcggaggcctgacagctattaaaccgagactttaaaatgatcttgttaccaatcgagactaaagatcaaagagagacgctgaacttttgaactgggactgaagaaagcttactacactattaaacttgctctaattaaagtataaaattttactgctcataagggaatcttttcctaccgatatgaagttttagtgcatatgtagtttcgtacgtactatataaatgtatcaactgtagtttcacagtatccctttttggttttggataaatttgcaattctaatactgacaacaattacttatgcagttgtagcctctaccgtttgagctgaattaaacggtacagactatccagagtgctgtagcaaaagtactatataaaagtttttttttttttgattctgctgtttgatcacgtagctgtgaatctgaattgttgatcatcaaaatatcaaaatgaagggctgaatatatatatacagtcctaagtgcagtcatagttatggctggaactaatctcaatcctcgaggaacgacaatacttatttttctttgaaatctgttagcacgttttttaaacatctaaacgatgtgtttcgtataaaaattttatctgtaaaattagctataaaataacatataaagttattttttaaaaatatgtaataactaaaaaataattaatcatacgttaattccctttctcttctttttacatgcccaatacccattaactctatctccatcttcaccatttcaaacacctctctgcggcgagaaaatggacatttagccacgtccaaaacagggtttcactaaaatgttatcccgaaaacgcgtttcgctaaaataccaatatgaagcgcgtgctcaccgccactttgccagtttggaccttttgtgcattttcgaaatcattttcactcctccaccggatgatgagacaaaattgcccttcatgtcctccgtcgccgtcgttgagaaagaggagctcgtcctcgccagccaatctccatgtccaccacgagcacctcaccgtcttcctcctagacggcgaggtggccggcgagtccttcgacatcatcccctccctcaacctcgccacctccgccgactacctcaccgcggtcgacgacgacggctagggtttcgaggaggccccatgacctcgccggtgacggaggcgaagggggacgcggtggagagacaacagcagttgctggcgggcctcgccggcgacggagggttcaccggtgacggaggcgaagggggacgtggtgaagaggcagcagcagctgctggcgagcctcgccggcgacgaagacggagagggacgcggtggagaggcagcagcagttcctggcgagatggagcgcaagccgccgccgccgtgaggcctcctcgacgacctcacctccgcctccgcctcgtcaatgtcgtccgacggcggcagacaggggcagccgccggtggttccgttgctccgcgcacccgcgcacccaaatgccctcgtcggcagcggcagtgggctcatccggcggcgttgctggccatcccgcccttgtcgacagcagcttcggaaggggaaggatgatggatggaagggcattttcgtctcattacctactgaagaagcgaaaatgatttcgaaaatacacaaaagggccaaaatgataaagtggtagtgagcacgtgcttcatattagcattttagctaaaccctttttcgagatggcattctagcgaaaccctgttttgaatatggctaaatgtctattttctactccgcggcagtgcggcacccacacacccgcaacagggaaaaaaaaaaagcgctctccaccgcgacaccgctggctcgccacttctccgtccgcccgcccgcgtcgcggaggtggcgcgcgcgtacgcgaccggaccacacgagcgcagcggcgccagaaaaaaaaaacccaaaaatgcgttcgattcttcgtagtacgtaccaacggccggcgaaagccgcgacaccaacacccacccatgtgtgcgcgcgcgcggtgccgcgtatcgccgtgtgccgcgcggcggcgcccatgtgcctcaacgtgggtcggttcccccctgcagtctgctcctcgatccctttctcctcgatcgatcgctcgtcggttattatccatcgagctttcggtggaagcgtgcgcgcgtccagcgcgatccggacacgcacgcacaatgctgtgctgcagcgcatgcaattgcaagtacatgtgcgcgcgcgtccgcgaccgcgagcgccgtcgtgcgtgcgtgttcccggcaagattcttccggaacatgctaaattattgacgctaccaacggcccgaaaagcaagttcatgttgttgtctaccgaaatcatcaatctaaaagccctctccaggctcacaactccagaggttcagatcgacatactgctgcaacgttgcatggttggttattagaaattgaaatcgacagaacagaagagtcgtagcagcaacagcagcagcagtccacgccaaaattttgttcgatcggttcgcgacgaacgagcaatcagacggcatttgagacttgagagggataaggatggacctcgcattatcagctgcatgcaatgcacggcgacggggtcctcttattaaatgttgtggcagggtgacatgcatcgtctccactctacagtgctgtcagtgcgtgcatgcatgcactggtggtggaccggtgcaccggccatgatctcttatccacaaaactgaaagtagcagcggtacagctcactagatatcccccccccccctaattttgacagttctccgtaataatttttgggactacctatacatttgtcgataaattttctcttaaaaatttatcaaatgtaaatacaatataattatactataattactctataactacaaaataattacactataacttacatgtaactacactgtaactatagtataattatattgtaactatagtatgactacactataattataataattacactgtaacttacatgtaattaaactgtaactataatataacttacatgtaagtgagattctacctttagaaaacttatgtttggcactgctcacgtgaaagagggattatgaactcgcaatgtatgtttgtacgatgcgtgcggaggccatcattcatgcatacatgttcggatatgccctgccgctttatctctgcccttcatctgtcatctacgagtgcatgagccgcgcctgtggccggcggccggcggccgtcacaagaaacaaatcaaagcgtcgacgcaaaagcacgaatcccgagattcatcaagcagttcaaaaatcgataaattctgaggaaggaatttgtcaacagatttatagcaaaatcgcaattttttcttgttagagtagtatactcagtctttttctttaaaggatatactcagtagtatttctaatgtacattcgtgctttgcgacgaaccaagctcatatgtaatcaaaatttgggtggaaagttatgctttttcgatagatcagaccaattagagattgattgggggatgaataattaaggataaatcagaatggttatgtacgtatacatgagaagaagcgaacattatggcggggaacggaaggagaacgaaggtagcaatagataacattgttaagtttcgaacatgcatttaattgcttcttataaaaaaatatactaatcattatttcttttattgcgatatattttatcactaaaagtaatgtatgttatatttgtacaaaattttttaataagaaggtggaaaacatgttaataatcacaacgctataactttaaaagcataagcacttcattcttccatagggacgactatgtttttcaattctactagttaattaggattcacgctattttttttcattttaacaaaccacaattaattatttcttttttattcaaaacaaagtacaatgtagacacttataaatcacatgtacacttatccttataaaacgagcacatgagcacatgtacaccctattctaagagcaactccgagcgtctgattaacatattttgatgctgaagtcatcataattagctcgttcgttgtcgacataactatatcgcttaccattaaaagtataattaatcgtaaatacgagtacacatgccaagtttttaacttaatttggtgaacggattccaccgtgaataacctaaccagctaaacttatgctcaatttgtcataataactactccctccgttttaaaatgtttgacaacattgactttttagtacgtgtttgaccattcgtcttattcaaaaaatttaaataattatttattcttttcatgtcatttgattcattgttaaatatactttcatgtatacatatatttttatatatttcacaatcttttttaataagacgaacggtcaaacatgtgctaaaagtcaagggtgtcaaatattttgaaacggagggagtaattattttcgtaataagtttttactagagttcgattaatatatccaactccaaaagtcgttgaattcacccacacctgcaaggctacaactgagatgcgcaagtgtatgaccacaaggtgagaaatacataagcacttttaacctgcggtccctccaacccaagatgtcgctgggcagccggtctcgtctttatatataccaccactcgcttcccttctctcctcacattacccccggccgcaccacccccttcttctccaacctcttgcagctgcagacacaatcgttaaatcgcgatcaccgcagcaagccatgtcgtcgcagcggcccggccgtcaccagcggagggcgtcgcagagcgtgttcgtgctcccggataacttcgccgacctcgacgacgtgccggccggcgccggcggcgccggcgaggacggccggaagggcgccgccgcgacggcggacgcggccggcgggcagcagcaggctcgcccatcgccggcggcgcgccaccggagggcgatgtcggtggccgtggcgtcgtccagggagctggagatgatcaaggaggacatgggcagctacaagatcggcgcctgatgcagcatcgatcgcacacacaggggcgccgtgcttagtacttgcggctaaatcgtcatgtgtatggccggttaattt

SEQ ID NO: 108543 - DNA, 739 bp, Oryza sativa
gggcgggggaacgcgacgcgaaccgattggcgcagcgcagccgtggtgctctgccgctttgagagcggcgtccgagaatgctaatgggcgggtgatcgctctcccgtccgctcagcgatcgcccgcccgcctcctcccctatacgatacactactccctcctctccctccttcctccttccattcttctcttcctattacattacaccacacaaattttttttaaaaaacaaaaagttagaaaaatttatgtatagaaatactatatatatacaatttgaattcaaattcaaatttgaatcgggtgtgtaaacttttgacttataaactttgggtctgtataaactttaggtgtataaacttttagatgtatagaaatactatatatggaaaatatttgaattattcaaatttgaatcgggtatgtaaacatttgacttataaactttgggtctataaattttaggtgtaaaactttagatgtatagaaataccatatatagaaaatatttgaattcaaattcaaatttgaatcggatataattcaaattcaaatttaaaacgggtatgtaaacttttgacttacaaactttaggtctataaacttgaggtctataaactttagatgtatagaaatactatatatatatatatatatatatatatataaatatttgaattcaaattcaaatttgaatcggatatataaacttttgacttataaacttttggtctctaaa

SEQ ID NO: 108544 - DNA, 655 bp, Oryza sativa
gtctgagctgtgtagtaatggtagctgaatgaaaagtctgagctgctgtgcaattctgctgctctctagtgtgactgtgaggacatgtttagagctatattttttcaaaagcaaactatagagataatccagatggccgtttttatctccaaggtttcggatgaacaaaaagaaacagccaggaatttcaaactacactggcaaaagcacagatgaatcacaaaaatcgccaattttgagctattcaagaccaaaatacaaatccctatatacaattagcagaacacaaatatgtgcatcgtctgcatttgcaaactctgaggaatatgaagtctatgaagtattagtgagtataggccttaaaaacataaaagtataacataatcttttttttttgcgaggaaaagtataacataatctccgccgtagaatcagtgtatacatcgattccttgtcctccaattgcaggcaactattcttgaatcttcaacaaaagctagcaagtataaaaggaccaaaataaaatctgattctatccgattcacctcttcttgtcacaactacttatcatccatgccctccttttattttcagtagtataaaccattcaaacatacacttcactgattagaacttaaaacaaattaattcatca

SEQ ID NO: 108545 - DNA, 1558 bp, Oryza sativa
gtggtgtgcaataaacaataaattttaacaccgcggttggaccggtgaaccgaggcctcaccagttcgacgtccggtccgagtttttatactatggtgcagatgggtcaatatattcatgtgggctacatttgacactgagaaggcgaagagactcactcggtgactaatgggttgggctctatgttgtattccatccaacgtctgaaaagcgatctaatgcattcatccaatggttaacaatttgatgatgacgggacttgattaacatcaatttgttagatagtaggtacaatcatcaatttgttagataggagctacaacctcaagaagaaacaaatatgtttcttggagaaattctttttagctgccctatccaaaatttgtagataatttaggtagcaaattctttttagcagccctatccagaatttgtagataatttaggtagcacatatcaactgaaggtcctatccaaaatttgtagataatttatatagcacatatcaactgaaggggcgttcagccataaagcactggatacatgtagatgtgtgtggagatcacagtagaaaaaatcggaccggaccggcggttcaactcaactgaaggggcgttcagccataaagcgctggatacatgtagatgtgtgtggagatcacagggaccggaccggcggttcaactcaactaaaggggcgttcagccataaagcgttggatacatgtagatgtgtgtggagatcacagtagaaaaaaccagaccggaccggcggttcaaccggaaaaaacctaaactagggacctcgccggttcggtgtgtttcaaggactgttcatgcagttgacccagtgtgaaccgactgaaccggacggttttcaggaaaaaccactgaagcggggactcctaaaaccggctggcccagttttcaggaaaaaccactaaagcggggactcctaaaaccgaccggctcatacgagctgggccaccgtacagcatcttccttaatgggaagcccaagtcctaaggcccagttttattttattgttcaaaaatcgggtgaagcatgggaatcgaacccaggtttgctagatggagcgttaagttccccaccactacaccacactgaccattgtggtgtgcaataaacaataaattttaacaccgcggttgaaccggtgaaccgaggcctcaccaattcgacgtccggtccgagtttttatactatggtgcagatgggtcaatatattcatgtgggctacatttgacactgagaaggcgaagagactgactcggtgactaatgggttgggctctatgctgtattccatccaacgtctgaaaagcgatctaatgcattcatccaacggttaacaatttgatgatgatgtggaagcacgaggtttgagcttttggccttaactttatagaaagaatggataacacatcttagtgtcgatttcaccgcgtacacgcataaagaagatatctgctatatatatacacacacatacacacacagacacaagtaaaatatactgttatagtaaaggggggatcca

SEQ ID NO: 108546 - DNA, 612 bp, Oryza sativa
tgaaagaaaagacattacgatgtttagggaggttaataggcactacattgacctgatatgtttagggaggttaataggcactacattgacctgatagcttactcctacgttttgttcagagaggtaaacaagcgatttcaaaagcacttgtcgaactgttaccatcaacctcttgtgctgctgctgttgtttgctgctcctgctgctgactcgcgttcagaggaggacggacagcttgtccggttacttacctccggtgcaccccctcatatcagcatcaggccagttgtgcagagcgagagctttaaaagaataagcacaagtgttggtcagtacataaccccctggcttaagaaaagtcagcagcaataggaaggcaactttaacccctacggaccccagctttggtgtcctgcaggctgcagcagccagcagggcagcgaggagaggttgatccgttgatgcaaatgcagtactagtagtacacatgcaaacaaggtgcaaaagcattggcagggaaaggtacatggcagcataaacaaatacagtacgggctacacgagagacttgccatcgcttgcgtcgatcgcttaagaaaagggagctgtcagt

SEQ ID NO: 108547 - DNA, 1157 bp, Oryza sativa
gaaaacgatttagaagcaggtactgcagtagaatccaacgctgaaatggcaggctattcaaagagcgtaacatacaggaaaaaggtactgaaatcttaccatctgttgctgaagcttctgattttcttctactggatattctctctctgcaaccagcattgattctacagagacaccctgaacagccacacgcaaatgcaatatgagcaaggcagagcaaactgatagattaaagcgtcagtttactgcaaaaaaattctgagtataacccgctaaatagtattgtctcaaccaaccaaacaagacaatacactgaattataacatacaggttctttgttttaggtatcatactgctgtactgacaatggcatggtaccaaacaaggtcacttatctacccagacaaaacaaactgaagaaagaagttgactactaaacttttgataatgacatcaagagtctcattctgcaggagaagcatcacaaggttgttaggtaaaacacgttagagataactttgacatgaaaatttttagtattacattagctaacatgtgattgtgatgaacctgaaatttttgttttcttttaaaatcggacatcggctcgtgtgcaatgtgcatttttactatagaaaaagcatcagagtacactcaatattttttaaaaaatgtaaaacccggatgccattatgacaatgcaaccaacaagactatgcatcactcatcttagtgactaaaaaaactttaaccgagcaaatggttacctcagcagatgaaactttgtctgctgacctatcggtgagtgtggatacctgagaaggaaacatgtatgatattgttttctctgtagcaccgaataaacatcaatgcatgatattacttacagttacagcatcaaacactgatgtcattttcactccatggctcatgacctctgactgaggggatgcatcctcttcctcttcctcttcctcctcaggcactggagagggaggattagcagcaacatacaccacccgcagcttgaactcctcgatcaccctgcctggcgctttagttaactagaaaccacaacaccatcagctctaaattttggttagcccccggctagagatatcagatatccatgaagattgctacaagaacttaccaat

SEQ ID NO: 108548 - DNA, 1027 bp, Oryza sativa
ggaataggatattggcctgaactttatggtgggatcgttgcggcaaatatcatatttaagggataggattagaatgctcgtcatggtaattgcaaaaacctccaatccaatcgcattcgttggatgcgacatcaacgttgccgatgtgagtcctctggattttctttttggtgtcagctttgggtatgcccttttttatatactagtatattactactactactaatctaggatttttttccccctggaatgtgtagcctatttcagttaactaactgcctaatgcagaaatttatagaactcataatgggcacactagtttgttgcaaaattggctaaaatttccatctgcaaagtgcatttgcagttctctactctgaatcaacatcacctgtcaaacaacctccacaaaggataatgtatcatgtagctagaactgggtaatccaagatttggtagagtgtggtagggtaagcctaactaaaggcctcctcaactgcctgcctctgcagctgaaacctgaaacattcagctaattgatattcctgagttttgtttccttcttatcttaaaagtgcacattcggtagtggttgggcaatcaattattgttgagatatcagcttccaagactatacgagtgcgaaattgtttgggcttgtttagatatcgactggatttaccataaacgggggatccacaacgttcaaatgccccatgtataattcagttgttctttctctaattcagtttatccatcataattcacggccggcttgacaggccaacaccacgttgaggcccattagttgtccatgccccacatggccttcaactgctgcgaaccttcataaaagggcccataatagctctattggaaaaagtccactttgactcccttaattgttcaccgaatctaattcgtgacccttaactagaaaaccgggcagaatgactcccccaattactaaaaccaatacaaattgaatccctcagcggttttgaagagtggtttcgctgacgtggca

SEQ ID NO: 108549 - DNA, 752 bp, Oryza sativa
gaaccataaaacattctgcatttatgcagtcgtgcataaataagcagagacgcgaaagggcacatagtcaagtaagtaattgtagtgacttgagtagcactacaaggttcttaattcaaatattcatagaagcaaatttcagattgaattatttaggggactaacttcctaatttaaaaacgttgcatatatccgatttgatgtaaagactgaataaaaaatatccttctctaaaaataaatgtaaagaataaataaatgagcagagacgagaaaatttcccgatcaccttcgcaacaggccgtgaagaagacaatcttaattggcaaaccgagacgagactacagcctggtctaggaataagttcattttgactcttttaactagtgaccgaatttgatgcgtatcctgaaccacagtaccggatatctcgacccccaactatttaaaccggtgcaatttaaatttcttggtggttttggagggcggtttcgctgacatgacgcatacgcgacggtgttgacctgatctttatcctacatggcattgacatgacgtttatgtggcactagaattaacaaatatacgtgggactcattgtcatttacacaaaaaaaaatatttgtggaccccacatgtcatcatctctccgctttcccttccccttcttcctcctccctctctctctcccttatctatttctctttctctcccctttttccaacttcggccggccgcggggagtggggctgg

SEQ ID NO: 108550 - DNA, 549 bp, Oryza sativa
ggatcccccaatgttttttacttactgcaatgttcctcgtacaactttcaatggtcgcaccatcgacgatggaagctcaacaataattctctcatcagcatcactaggcacatatccaggtgcaataaccgtcgaccgaaccaaattgcgatcagcagaaatgccagaacctcgtgaatctattgatcctttcacagactgttgatctgcttgttggagtcgatcgtcaacactgctttgagttgtgtctgattctaactgctcattgtcctcatttctgtcatccactgacatggcctcagccgttattataggtgcagttgatggaagtgtgtctgttactaaaggttctgtaccctctgggttgcattcatttgattgtgcaacattacttagctttcgctcttcataatcagcagctgcacccaaatgatcagaccccttgtggttccttttcataaatcttctcatccttgaagaactttcagtaaaatctaatttccagaaaatctgaaatacaggaaagaaaagaaacatcaaaagatgtcc

SEQ ID NO: 108551 - DNA, 697 bp, Oryza sativa
attcctgcagccctcgttttagcagcccaaatatcacaatttatcgaatatctcacaaccaggacgcacaatctctctcaacaaacttcaatgactctaggctacaaagtcaacatgaatgcatatgcaaactcaatgaccgtaacaaggtacgtaacagttacaggatatcattccgaacaagcagcatcttcgtcgaatagtacggggagaaacagtaatagtaaccaggacatggcaaggacactgccaatccgcaagccagaaaattcagagaaaaatacagcaaaacaaggccaaaaaaagagagagtaacaacaagcttaagagaaggcaacaaacgacaatcgaagaatttgatacggacagggaagaagagattctagccatttatagtggcaccgatcacatagtcatcaattggcataaaacggcaagcgcggtgctcaaataaccaaacaacttcataagaatcagcaaaggcaaggtgaccaaaaaattgcattgagctacgggaagagctttgcactaagaaacccacaaattcgcatcaaacaacaaaacaggcacgaagtcaaccctccagcgcgtgaaaaaaaaaagaggagagagagctgaatcagacctcgattcaaatatactccaaaggctcaaatcgaacatctacgagggagacagattttgatcattacccagc

SEQ ID NO: 108552 - DNA, 521 bp, Oryza sativa
tggtgagatgctgatataaaacaagtcaagacacttatccggttgctccttgtcaagtgctggagttttcttttccgacctacgggacgacgggaagcatgctgagctgctgctgatcagcgatcaattcagcatcgtcactatggtcgatcgaattatttgtttccgcgactccgaggacaggtcggaaccgaacctcccgatgagacgagaagaaaacggctccacgactgcaccacacatgccagtagccacgcgtccacgccagtgcacagtcccggagtacttgcctgctccgctccgtttcgtcggacgaacgtcggtctgtcacgctcgaaccggcgcgcgagtgcatcccctcgcgggcgcggtgaaaactgagcgcgaccggccctagagattcgtcactccgccaagcgatccagatacgcgcgctgccacgccgtaagcgtaacgtcgctgtacggcgttctcattcaagagttgcccgtccgcgcgcgcgcgtggtatctctatcccct

SEQ ID NO: 108553 - DNA, 808 bp, Oryza sativa
aatatgaagccctaacgtggcagttcctcgtatttctcgattttcggggatagaaatagagttagttttggataatagtaacacacaacgtaaatatttagacatcctaattcaactaagcggaattgctagggctatggctatggcgaacctgcacgtcctggactccctcgacggatcgaggtgcatcatatacaccgacacccttttggaagcttgcaatcataatgctctgtgtctttcaccaagatagattatgttcgtctcatgtgccgtacgtgcagccacgcctcgccggatcacctgactttcacgcatcacttattcaaccaccatcgcagaccggggagaatcgatcggaggttgaaggtccgttctctctcttctttgctcattgatccagtgattcctaggtgtgtctgcttgactgcttctaggtccttgcttgttagtgatcgcctgacgttaattggcttacctacaccataaaaaacagtatacaacttaggctaattgggtcatatgtttagctttatcacttgtcgcactcaacagcgaatttgcatattaagaaaataatgggcagaacatgagccacaagattgtagtctttgccatggccctacagttgtggggctcaaaagaagatccggtagagagcataatattagagcacagggaatatccttgttcagaagaatatcctatatctatatctccccattctctgtccctggcatttgaactggccattagcaaaatccacctaaccggcaaaggtaggtgtatgcttcactcccggtatggg

SEQ ID NO: 108554 - DNA, 1146 bp, Oryza sativa
ccaaaatctcttatattatgggacgaagggagtatatggatgataatagagcattgaagtttttacagtttaaaaaataaatttcatctaaatagaaatataattatctatccaatgtaattgtagatctagatcatagatttgctgtaagaaatcttgaatatggaaccgtatcaaaaatgatctaactataacctatgctcaatgtactgggatagccatatgggtgttcactggtagtagaggatggaattgaattgccatattgttagtgctatactggtggttaatcatatggtcttgttcgattaatctccggttaatcctttcaaagattaaaggggattaatctcacacctattgaggtgtgaaattaaatcctcctcaatttcctttggactcttcctcacatgggttaatcaaacaaaacataatgggtttaattgttcaaagagattttctaactctgccattgtacgtatccttacagtgccttttcaaggagtcaaacatatgtgctctatggtaaatatgcatcgctttgaaacgtagtactacaatagttcatacgtttaggcgacacatgaaaagcatgagaatttaaaggtagtaggagaaatttgtagcgcatgacctatcctctatatagttccctgcagttttccacccatagccaaaattcaggtgaccaaactcaactacctataaacccggtggaaaaggaaatgagcaactatctgtctcttcaacatgtcaaagcaagacttgttaagcccatgtcctgtcaacgtattatccaggacttatcaaactaaattttttttccctaaggagctgcaagattctaagggaggacaaagtagcccacctgaataaatcgatttcttcagagataattaagaggccaacacaaattacaagtggcgagaatagattacaactcacatactagataaccacttgagttattacacattgttagccgataagaaaatgaacgtcaggttgccaatctaacaggcgtggagctgggaaatttcgccctgtggtgttcaatgtcaccgctttatattttagcaggatcatttatgcacatttcaatagatttacatgtaaaaactgagactaggaaaagtgcttgtgaaa

SEQ ID NO: 108555 - DNA, 1180 bp, Oryza sativa
ggtgaacccaccattcagagcaggtacaatagcagactattagccagctataaacatattttaatgagataaaatatgagagagaagagcagcgggttacaaatttgtatggactccaagacacagtgtgtgtatgacaggtcggaccatatattaatagtatagtaagcaactattgtataaattcgttattagatcggctatagataaattagagctaatagtggacggctgcaactacaagggcaacgaagccatcacacacgttacctacttacctcttctggttaagagtaggtataatagcagactataagccagctatatttaaggagataaaataagagagagagagagaagcaacgggctacagatctgtagccagctacaacacgaactgcaagatgcatgtatatatgacaggagagaccagatattaattgtgtagtatatgtttatgggtaactattgtatgaattggctataaaattaactatagatgatttggagcgatagttagctatactattaagagcaggtaccatagcaagctaaaagctagctataaacatattttaaagatataaagaaagaaagagaagagcagcgggctacagatttgtagtcagttgcagcacggatttcaagacgtaatgtgtatatgacatatgtgactatgtattagtagtatagtacacaactattgtataaattagctattacattgattatagatgatttcgagttgatagttagctgtactattaaacttgctctaagcacgtgggccggagtggcctactgacctactcgtccacccggctctcggtacaccgcaggggcgcgcgcgcccgggctaatacaccgcggggaggtcttgtcggctgcggtggatttcgtaggtgcaccacgaatccgcgcgcgaccatccttggctcgctagccgggtggtggaccacgtatatagttctcgatccatcagagaaacaagttcggtaccgtattgattatttatgccgtgaccgacccgcaaagtataggaggatccaaagaaattcgccgtccaatatcgcaaggatatccggctacaaaacgcacatcagcttatacgtacatcccttaatttgtaaggtatgcctgtacatgcacgtcggcccaacgcaaaaaacttgggggatcc

SEQ ID NO: 108556 - DNA, 680 bp, Oryza sativa
ggatcccccgcgaaagaatggatgtgggattcttgtttcgcaggtgcccaagaagtctgaagcctttttcatgctgagaggcccatcagaagtagtgatccttcctgtcatgcttaacttttttgctgcccttctgattatgcctagttaattcaaaattgctttggtcatttcacttaacaattgccatgtaggtgatggaatttctcagttccttggtgagatggaaggaacaatcaacatttgaagattgacagcttagccaatcagttttagttgggatagctagctgacgctagcgtttaagcattccctgggcgacaattttacagtgcccggacgtggagctggatagtagctagatagtttagctcccatagttgcaaagaaccagtcgatgctattccgtttcttctaatatttatcatcagaggcagagttctagtagttttttttttatgaagtgaacaatctttcagttctaccagtgaaaattcacaagcattacggcactgtgctaatcctgatattttctccattagtctccatcttggttaggtaccaggatttgcaataatgtcaactcgcatcccctttctcccctgaaaatgacagggaaaaaaagaagttcactggacccgccgtagacggcgacgtgattctctatatctctaagacta

SEQ ID NO: 108557 - DNA, 774 bp, Oryza sativa
gagtgttttgttcccattatgtatgggtgtcgaaatgtaaactttgctttatatacagtggaaaatgtaccttaaaaacttctccgaaacctccttctcccagcttattttctgccgagaagttccttgttgcagctctcaacactgttaagttaagggtcggtgggtcaacatagtcattgtcctcctcattgccggtgttgtctgacaaaaaaaaaatgtaacgcatgagtgcgaggggacgtagctagctgaggccaaagactgatatttattgcacttccacaatctaattgatttgaaatttctagggagatgcaaaaagttttatttcaattgagagtttcagagcatttttttttaaaaaaaattgaaatcgaaaggcttttcatagaaagtttcattttattagttgaaagtttcatcttctgtgttaaaagtttatctcggtgtcttagctatttcaatcatttgggttacgaaacgaagaaagggaattgggggcacgcaagattacattgtgaatcatttgcaatcacatattttgtcgcatcagaacttaatattgagcctccgatgtattactttatatgagttgtcttggcaataaatcgtacattgcaccgtgctatctggacactttcgtatactgaaattcagaagttacatgcacgctgtgtaatgggtatatttttattcctctggaaggatttcattttataaatccactcttacaataaagttgtagcacactaatttctaaaacttaacatg

SEQ ID NO: 108558 - DNA, 565 bp, Oryza sativa
ttttctttcttctttctgcctttgccttctttttcctcaaccgttgattctttcatggaaatcacggcttgtgcggcgaggaaaacatggccggcgggtctcagtcgtggtcgacgacggggtcgtgcggcagcgaggccttgcagcggcagctcggctcggcaggacgtcgtggcgtgcggcggcggtgggacgtcccggcgtgcggcggcgagttcagcgcgcggcagccaggtcagcagcaggcggcgtggctagggatggcaattttccccgcggggccgggtcccctgcggggacccgcccctacgggggcgggggcgggggcgatttcagacccgcgagtgagtcggggtcggggccccgcatttgggcggggaggggacgggggagacgtttcacccgcgggtgacccgcggagccccgaggatgtatattagacttaatcatagtatgttgtaagcccaaaaggcccatctggcctatcatatatatacatccaaaccctaatttccccacccctccactgctccacaccctatccccaatctctcacccaggcagc

SEQ ID NO: 108559 - DNA, 3744 bp, Oryza sativa
taatactaatttactgtgcattccaaaagaatcgtagcgaatatatcttgtaaacttacagtgacattcaagcgcaatgttttgttcacggatgaataacatcaattatttttgtcactcgtgctcctcatcttccattcccgcttacggtgttttcatagatagctcggacactcatcgtcaaagtcaggaacgaaccttctagtgcctagtatccatgttcatgggcagaaacaatgaattagcatgtattatttttctctttcttccccatgactctagattcttcttttaatttaagattttcttagatttcttttacctcagaaaatcatggatttgtctgcaagctcattgaagccacgtggcccaataaaattctggccaaacggccagctttagataagtagatattgatacatattacgcaaccctcctactatacgaagtagtccaagagggtcccgtaattcgacaaaagtggagacacaagatttaggggtgagactctcttctcattcatcattctatcctcctcaagcacaagtgtacaatatgagcacccctctcctccttatataaccttcctccacatatggaaggtttcagtgtgggcctaattagtgtatatgggctgggccttcatgggcccaagcccataggtttcctaacactcccccttgggcactcaccgcgtgatgtctatgcttcatcaaaactccacaaaaacccagtggaaaaaaattggagaaagagtacatagcatacgcgtgcaatgtcgcacggattgcctcattaaaaaccttgataagaaactactaggaaaacttatccaagggaaaaagagtacaattcacctaattcttcgttcaatctttctagattgattttgggtacttgattttctatatcaagattctgaaatgagttagcgaaattctccccctgaattttgcatttctctaagtttcattattccgatttctcgggcacacctattcaagggaagatgtaaataatgagttagtggatgaatctgcaagacttccacatgacttagttcgttgcttctatgcaattcatgtacatagaagagcttgggggttcatatgcttagtgagtttgcttctcacataactcaattgcatatgtgcgacatatgctgctttaatttcataaatggtgggggttgagatagttttcaaatcgcgattgctgtcgcgggtaaccatctctcaaaactatgccgaggctctgaacagttaacgatgcttagtttggtttagttcatttagccaagttttcatgtgctgctatgacactcgtgtttaggaattccgtcccattttggcgataatagactattgcaaaagctatgcaccatgaacattcctaagtgcagttggactgatgtactagacttccatctgtcgcatgcctttagctgcaagtgtaagcatgatttggattcggccaaatatttcaaatcaaactcaaattcaaaacgaacgagtttgttttcttcaattcttttctggtttattctattcttttatgttggttcgggacctagtatttattcatgtactattatgcaagtgtccgatccaaactcctgaaatgcgttcattgattctatcttcaatgcttatcaattattcaggttgaattcttcatttcaacttctagttcattaattccattcaactcctggttgactgccaatgagttttgttgtctaaaagagacattgcccatgataggtctcattgccaatttctactggttgtatgagactttatgcgagtatccatggatatacgaggagatgcacttttcatatgcttcttcttctttttcttgcttaatacttcttgatgtgggcatgtaccagcggtagtgtgcactccaacagctagttttcttccttgatgggaaggtgcagtacgcctattcggaggttccgtaccgtttgccagatctcaaccggctccccttctattcggtggggtaccttttgtgactttgagtatgatagtccctcttgccctgttttcaccagacgtctccggttactttaggggtgtgagaagcccaagtttcttgtccaattttttttgttcgaggcctctagacaatacgaggggtacctttactttcttcggtatcaccctcccccggtgcatttcattcatgcaacttagtcaaactcttcgaaatcacaaaagtatttacaatgtgatttggcagttttaattctttgtgcaaactgcattcactagtgcggtgtaacatgcattagtccctttctgctgtaatattttctgacatttcctatctagtggttcattctctccccctaaatgactagaaataattcttatttgtcaaggaatttaggcttcataatcatctccgtaaaaagttccccaccttcggagagagccttttgcaacgcattagtgggatatgcacataaaccacacggatgcaatagcactagttgcaggatgcatgtttatgccgatggtctgaattttctttcagagtccgcagctttggggactacatgtccttttctactacgggtattacaacaatgatatagcatatattgcaattcatagcttatacttggtccattcatgcggatatttggtacttgtgctaccaattcaccaatcatcaaatgcaatgctagtattgtcctcgcggacttctaaagatgatttagtgagttcaattgatgttcacgtgatcttgctggatcagtcttggtagagacacggtgtctaagagacactagatgtttgctgctttggaagcgcatttatccatatagtaccaaatgggagcccagatattcctcacaatccagttcagggatgctaaaaactatatgcgggttatgcactaattttctatcggggcatactgtgacacaaatcttcatgatttaagaaaattatgcatatatgtgccacgatcatacgagttgtaatatttattcttataattctaagaccggaaatggctgaaaatccattgctaaaagggtgtagcctaaatcatcacactttttagagagttcaacggggttgacggacaatagatgcttctataaagtgcaaaattgttccataggtaatatgactgtggcgcattctaggccgacaaattcagttgttgctgttagcaacagtcataataatattttcagttctatgggtctggaaaatacatttttctcttaaagtgttatttgtggttatgcggaccacaattcattctttttctcttatgtttgggcgctacacacaattcaaagcattataactatgtgctagaaaagagcaacaaaatagtaaatgccttaaatatgcaattttataccgaaaataattctctattgcagggaaaatgcgtgctctacttgggcaaggaccatttttcgatgcaatgctctattcaaagattgcaacaagtgatgacgaagtatattgattcaacgaggtatctcggtacttcggattcaattaacttcatagcgagcttcttgctcgacagctatggcaattatttactatcctgacatcaattttagggccgatccgatatagcataggagattcttcgtccatagccatgcaaataggctaggagctctcctcctcaaatcatgatgagtgtgctattaggattgccattttcttttaatgttcatagttctagattgtttctcct

SEQ ID NO: 108560 - DNA, 724 bp, Oryza sativa
tactttgattatgaacatattttacttgtcacaataaattataaaagggtaataattatccatgctctatatgttaaattcgggaagtttataatattatagatacatattatctcttaatgaacaatccggagttacaattgaactatgaacatatgaggtcaagatttataattagtacttatctactattcatgtttgttatatactccccagtttaatatatgaaaaagataaattaattgtgtaactataatgggatgtacaatatatgtgtgcaacaacgtataaggttttggtcgctactgtacatgagcttatttagaaagtgtactacccaatgctccaagtgattcctgaatatattgtagattaattatacattagctagtttctatgagtgatattgtatatgtgatgcgacaagtttaagcactggttctattgggttactaataagtggtaatcaatttaggcatatataagctattctatatggtattgcgtcgattaatttacttagtgattcctccacatctagctctattattattctcctaaacaggttaaagattcatctatgtgtgtttatattttagttgcataatcataaggctacacttgatttaaataacctataagccatggccatcgaatattaaataagtactagtattttcctatacatccattcatttgagacatcacataaaattagtttgtg

SEQ ID NO: 108561 - DNA, 2793 bp, Oryza sativa
ggtgtctcacagcaaaggccacaatctttcggtgtcctgtagcaaattttgccgtgtaagtaatactatgtacattgaacaaggtaggttatccaaagtagcgaatacgaataacaaggtggttatcaaaagtagcgatttctaataacgaggtaggttatatatcaaaagtaggtaatatagcagttaattaagatagaactatgaactcacaccaaaaaaagtaggtaagttcaactgtcctttgcctcacgtgctctaagagcaggtacaatagcagactattagtcggctataaatatattttaatgagataaaagatgagagagctgcagcacggactccaagacacagtgtgtgtatgacaagtgggaccatatattaatagtatagtaaacaactattgtataaattagctattagattgaatataggtgaattggagctagtagtgggctatactattgaacttgctcaactgtgttggctcatcagacaaaacatgtcgaacttgcatgtactaccgcgcctggaaggctgcgttcgagactgccgtatgactcaaagtggctgattagtcattagcggtatgattaattaaggattaacaaacacacagctctaatagattgatgttatgtgtacgtggtgtgcatatgatcgatgcgcactagatactcactctagatttatcaacaacacaaaccataatagttttgtgtcacaaaaaaaataacggaattgctatatgtgtcgccacaattttgttcattttataggaaggtagcctgcgcatttgcgcgcgcaggcaagcatgttagactgtgtttgagaaacttataaaggtataatattaaccgaaacttataatagataatttggcttgttaagattattcgaacatatttagaaaaaaatcataaagtaatcataatattttctctaattaaaggcactcaattttttatgcagtggctcagattattcttatttcagttagttaatattgcttatgtagtgtgcgtttaatttaacaatacatgtttcaaaacatgtcatgttgttgaattatttatttttattttggtaatttgaatatgtaatttttattttgattctattgatttaatttagctatgcatgtttgtagaatgattcattatgacataatatttattgtcaattctttaagatatttagatggtgtgcaaaatgcacgggtggactggcatatgtataatgtatcttatacattgttagtttaattgaaagagagaagagttagatataaatcggacatgtagcttttaaaaaattatagctgtttcaacattttagcagctaaaaagtaaggaatgggaaggcagtgatatatctgcatgtgagagggaggaggaggtggagggagtttattattctaaataatttaaaacatattataagttggtccatttctctccaaatttcttttgttgattctagagtttttaaggcataacatgtgtcgacttaagactttttttaaaaaatagatctaatgaaaataatgaatccatcgagttaagttgaattatttttgtaatttttaagatgtgatgcttggttaagaatcatcggttatatgaataaaaatgctaaaggtatgcttataattacaatattttatttttttatcggttatagttgtttagctgctattactttattaataactaaaaataaaataaaagctttaatgattgattaaaatctattttttactcgtatgtacctacagtataaacatagttgatattaaacatgtgaacactacaaatatattttttaaaaggagcatactacaaatctaataatctaataatgtttttttttactttttattatgatagaatggggggctaattattttttaatattattcaaagttatgttcattttaatctaatttattttttagcaagttatatacgatgataaaacataaattatattttttataattctataatccttaaatggcacgcaaaagtcagaaaacttagccctaactaatgtttctgctctaagttgaattaaagtggatatgggttttatgatttagatattatattttcttaattgtttaacataaaatttttgcttttctaaaaacgtgaaaataggagaataagtaggtgaaaaagaggggaaaaaattcagaagggaggaacagcgtacgtacgtacgtacgaacgtatatgccatcaggcctaggtgggcccggatatgaggagatgattctttttgtaaatctaatggttgtaaataatgggtccaccaaatttaatgaaaaccaacagctagatgttttggtttttttaagaatttctttaatttatcagagtgccacatgacgactaaggagtgtttataggatgccacatgtcagcttacgagcgtttgtagaaagtttaatggattttaagtatataatataaataaataatagatagatagatctcagatcatccaatgctgcattgagatttgcatgttgcagtcgattatctttaaaattcgtgctagtattctcttttaacttcgagattaaactgtatcacttatggataaattgctcatactaattacatcgtacttatagtataattacatacacacatatgtaattttgggatttagaattacatttaaatatactaaaattacatatgtaatttagtaaagccgactatttttgatgaaaaatatgacgctatcgatatagctacacccttaccgtatgcacacttgtac

SEQ ID NO: 108562 - DNA, 625 bp, Oryza sativa
agctcaacatgcaagcatataataattattatatctacgatttatttcattctaaaactaaacgtacatatgctaaatcatcattctcaaatcacttttataatatttcaattcaaataatttcatcatttctccattatctatttatctaacatacttcccgtagaaagcacgtcacttcatctagttagataattaacctaataacagtgtattaaactctctccaacccttagttctctcctatgtctaaatcgcgattcccccactgtcggcaatgctatcgctgtcggttttattagctgacactcactacgccagatcctcacacctctgacgggatacctgtgacgggcaaacgaattggtcagtattgaccattacctttgacgggttatacgggatgccggcacccgggaggcatctggccggggcccgtcacaggtattccctcacctgtgacgggccgaaaggaaaacccgtcagaggtataccagtgacgagtttttctttccacccgtcactggtatcccctcacctgtgacggggcgatacattaaaagccctcagaggtgatgggccgccacctgtgacgggtttcatttctggcccgtcacaggtgagc

SEQ ID NO: 108563 - DNA, 3678 bp, Oryza sativa
ccccccccccccccccgccctcctcgggccagatctgggagggagggaggggccgggagccaccgcccgccgccaccctccgcctctcgccggtagccgccgccctcaccccgcccctcttaggccagatctgggagggagcgagggaggggagcgccgccggccaccgccctccgctgccgcctccatcggtagccgccaccctccgccgctgtcagcgccaggaagaggacttagaaaaaatctagggtatgtagcctctatttatattcactatgtattttcgcaagcggaccacctaagaggtctgtctataaaaatgaagggtatttccgcctacaaaaatgaattttcacaggcgggcagcgggtttcaccccgatttacattttttaggcggctatttggctccgaaggtcatgtccgcctgtgaaaataaatacccaacgtcggtaaaaatgctttttctagtagtgtttcgctggtatatgtgtcggtaaaaataggttattgacccagcgcctgtaaccggccagttcaggatcaacattctgatccatgagtgcgagtcaaggttaatgaaattttagttttccaagtcaaaaagaaaaatgcatatgttttcgcccgtttagtagtatttcttgatggagatttaagttggaagaatggaaattatccgtgtggttaagagcaagtataatagtgagctataagtctactataagcttaggtggaggagagaggtagtgaaaaattaaggatgctgctcttatgcaagagctagcttatcacaagctccaagacaaatctattaaatgcataagtgagagataaagagaggagaagaaaattgtagccaaccttatagctattctattatatatattggctttaagatgggctaatagtaggaagtgggctctattattatccttgctcttacggttatggttagatgaaattagagtctatggtgcaacaatctccaactttattataagcatggatattaactaccctctgacaggagctacgtaatctgggcgtgagagctaattggcacagctgcgttgaccgtgcatgcttgtctcatgcctatggcactgcgttgggcccaataggcatacaagtatatcggtttagctcattagcttatcagtctcgtagcaaaaacttaaattttaaaacctaattttagaactaattttgatgtttttgttatggtagtttatttttaacattgccttttaagtcacacacatataaagagaaattttctttgccaagttcaccagtttctttatacgtcaacggaaagttattatttctttatatgccattggttgaactttttcttaccctatatgccatctatatcaccatcttttatacttgttttgactttagtcaaagtcaaactacttcaagtttgactaagtttataaacaaatataataatatttccattagcaaattagttttattaaattaataattaaatatattttataataaatttatcttggttcaagaaaatcactatttgtttctataaatttggtcaaatttgactttgagtaaagtcaaaacatcttataacctgaaacggagggagtaatagggacacaaaattacaatattacccttttaatccctcgaggggatgtctactcgtttatttgcgtgtcatccaaataattataaaaatatatttttcaataagatagaataatatgtgatatatcgcttcacaaatatgaaactttaaatttcacttttacaaatttttttagaaaaaaaattcaaatttggttatgagcacacgtatactagtttcaattaaatttattgtttttattacaacctgtgaagatcaaatttgaattaatttattgatatatcaaatattaatttatcttatcatttattttttaaatattcataacaattttaatgactgtaataacaaagggacatcccatggatggactagcaaaaatgatagaccaactataaggtgaaaccattatgcttaagtgcgtatgttaataatggctgaacagaagcaattagaagaatatatgagggtagttttattattttgctgaaagattgacaaggtgaaagcactttgaccgcgatagtggcatttaaaggatgaaattttagttcgatggtttataaggaaacagtaacttttcagtggtatataagaaaattcataaactttgagtggcatataatgaattttctcatatataaaatttttactcataaactatttttgtcgctactaagctctaccgctaataatctaactataggcgatacaatatgacttacaggtttgaaatttttgtttaattttgagtttttgaaatattcttaaataaactaaaatattgtaatagagcctttgtaacagaaagttttatttcccccgaaagagaaagttttatttaaaattttaaaaatccgagtaaaatttctaaaaaagtttaatcgtttagctcatactttagaactttcaactcagaaaacttttatagatatttcaatgacactaatgctggcactatttctttacacaagcaatggattgtttctttcttttgcaaccgatgttggataagtctgcttctttgtctactattaatatgaaaaccactgccctagcagtgttcatgctaaaaaaaatatgaaaattacgctatactctcttcagaccattttacaattttttggctacttgcatgctggaaggggcaattaacttggggaaaggattgggggaagcaacactggtgcgatgatggaatcatggacgaatgaccgcacccaataggatttaggctctgtttggggagctttagattctgagaagcagctgtttggtagccagcttctgtgaatctggaaaagctttgaaacccagcttctccagcttcttgcttcttagttcatttttcagaatctgtaactacagattctcagaagctatggattatttggggtagcttctagcagaagcagcttttggaaaaagctgcagctgggagaagctcccccaaacagggccttaaatccttgtgctctcaaaatttatggccatgtttgaaaaaaggaaatgcatagttctgatcctttggaatggtctcgatgcctcctatttcacaggaaataacaaccaaagctaaatgaaaaattcattctgaggaacacctagaggtcttccgactagctccacaaggtggtgggctagctagcctgggttcggagtctcaccccttctatttatttgatattagatcatttcttaattaatattcgcgtttttatgaaaaaattccttctcgctctcccctatgtttcctgtgatccaaaaaaaaaaaaacctcaggtttcactgtgatccaaacacctcatgtttcactgttcctgtgttttgaattgcttagtttttcatttacactcaaccacattcttatgtttcttccctgtccctgtctttttcattttttttagtgcgtgttaagggggtgtattcgtgatcatgtgcgtatggtgtatatatgtcttcaatgtaattaaaaaagagaggaaaatttaggtaaaggagtgtccaaattaatatacaatacataacctttcttactccctccgtcctataatataa

SEQ ID NO: 108564 - DNA, 1494 bp, Oryza sativa
acgtggttcacgtaaggaaatgtgtcttgtgggtaagatgtacacttctgatcagagtatatctattcgaatagccgcgccctcggtatgggcaagccgagcaatgtacccaagttagtgttttattcttaaaacctgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtgtagctctaggaccgtagttacaaaatagctttgagcaactaagtgtcttttaatgctgtttactgcaaaccctaactctctatattatggctcccttgtactcccttgcatttattctgcacttgtgggtgtgtcttgttgagtacggtggttgtactcaatcttgctcaattttttcccaaacccagaagaggagttcctggaagatgaaggctttggtgtctagctcgtgcctgccgtcaagcgcctgtggtcgtcgccctagtcttccgctgtttttcgtttgtcttcttgtgtgctgggccttcgccgcccatgtaataaattaattaattacgcttccgcctgttaaactctgaattgtatcaacttttgtgtaccttgcctcctgggacaaggaataaggaataatgcacgcacgtaaggaacgcccgttgggttatttccggtcgtgacaagttggtatcagagcccccttgaccctaggacgagccttagatcccaagcctttgcaatattttcaaaataaaaatgatagcgaaaagaaacataaaaacacgcacaagctccatcgggcaaaagcacatatgtgttatacaaaggagcaaaaaattacatcatccgtttcagaacatttttgccccgcccctactaagtcccgcgaacacggttcgtcatctatactgtacacgactctaaggggggaaggaagtgaaatacacaccgacgtcaagcgataacaacttgacgattagtcatttcgaagtctaaccaaagtgtggcaatgtcatcgcggcgctggatgtggcaccggccgtaatcctctaaggttcgaccgggatgtcttcgcctccaattcgccattttgacaaccacagctacataaaaggcgaatgcttgatcgacgaaaacgccaggggggcaaaacgaatcggccgaagcatcgctcgccgaacattgaaaccgcaacagcttgtttcggaataaagataccgaacgccgttacattcaacttacgcaaaacacaagcgtttttcccaacgcaaaatgctacgagtcgaaaacggaagtcgaaagctaaaaagtcaacaaatcttttcgccaatccccaaaagggggccgaacgcatgactttgggcaaaatccccgctaaaacaatagggaaaaggggaaagaaaaaaatacaagtcaagaatcgcgcaaagca

SEQ ID NO: 108565 - DNA, 585 bp, Oryza sativa
atattttatctttgatgtagtttaactagtataattaatctttgatgtagtttagctgtgtttgattacggactaatgttatcttcaaatcatagaaaatcccagttttaaataccatttacttttccaaataatgctaagtgtgcacgtatcgtttttcgcatcgaatgtatatttgtttagtttatttctgtctaactctccatatatacatggggagttggatatttaatggcctaaaataccgtgtttaccactttaatgtttgtgaagtactcgttctggtttttaatggtttttaatgtatgacgtcattaaattttgatatgacatttcacaatttgcattaaaagaaacatataaatgatatttgttttatcatgacttgttttatcataaaaaaatctataatctcaatttataattttacatatttatatatttttaataagaagaatggtcaaatgttatagaaaaaaaaagaggaagtgatatattttagctttctctgagatgaaaaaaaatctgttgaattttattttccaatcatactacgaaaaatatgtagcaacatggacaaatcta

SEQ ID NO: 108566 - DNA, 529 bp, Oryza sativa
attttctctaattcgttagagtgtcacgtggtgcgtcacgtggtgacatagaagagtttgtagagtagcacgtgttgccttaggagtgttggtaggaagtttaatatagtttagtatgtaatactccctatgagttgataatacttgtcgttttgaacaagggcacggtctttaaaaaacaactttgaccattattttttattataatatgtataaaattgttagcaaatatatgatcttattaaagtactttttaagaataatctatacatgtagtcaccatatttgaaagacaaatattttaaaaatgattcataatcaaagattctaaagtttgacttcacccttatccaaaacgacaagtattatcagctcggagggagtagaaatctatgggttataatggttgattttattttctatttcattgtctaaaagaaatttaatcttaaattttgagggggtggacggatagacggacgtaagtacgtacatacatacgtatatacgtggtggggagaggaggccc

SEQ ID NO: 108567 - DNA, 750 bp, Oryza sativa
actccttctgattcttacacttatggcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaatagtgtgcaaaacataggtgcaaatgtagtatgacaaaaaaaaaacattggaggatgaagttgcaaaccttttaggcacctccgatttgtatgtaatcaccaaaataaattcaatagaaattttggcatgacctcccctcttttttgaagtaattttgaagcttgctcgggcagctggaggaggaagaagacatatatataggggtgggactttagtcccggttggtagcaccaaccggggctaaagatcaccgggatcatta

SEQ ID NO: 108568 - DNA, 534 bp, Oryza sativa
taccggggttaactactttaaaataactgtgcatctaatttccaactggtttgtatatttatattatttgtgattaaattaataatttaagacccatgttaactatattttgactatagaaatgatatgccacatgggctaattttctacacatcatgtagctaaattagatccatgataacaatgatgacgatgctctacgtattttcatggggtctataattttttatgtagtgtcaaataaccaactacacgcatcaaatttaaaagatgaaaaatgtatatatacaactaaaatttgatactataatttaagtgtaccaattacttaataaaaaatgtgtctccactaaataaaaaatagactaaaaacttccgcgcaatgataccctcacgaatcccatatattcttttggtcttccctatcttccctttgtctcctaactcttctcaccgtcctcctaatagtccccaattcatcccataataaactatgataatatatatgcaattaaaaaaataccttacttttac

SEQ ID NO: 108569 - DNA, 589 bp, Oryza sativa
ctgcagcccatacgcttattaattagagtaataattgtactctattatcaatttgttattgtgtgcctcggctgattcctggacgagggttcacacacatgtaagcgtttggaattttggatagaaattccgggcgtgacaagttggtatcagagccccttgaccttaggttatgccaaatggttacccatagaagccctctaaaaatattggaaaagtagaactgttctcctccctttctcttttaattaaaccaaactaatggcacatgtactttataatcttttttaatggttctcattcaaaatttattccagtgttattagtactgtacatctattactgtactaatggctcattttccagcaaaagttttacaatgttgttttatttaatcctgctgcaataaaataaatttagcatgatgattttataacttgattttatttcttttggaacctgttattcaaaagtacaaaacttgtgaccttgttttcaactatttcaacttatcttgcaagcttggtttactttatttacttacctttttactttgactctctaaactttattcaaattaatcccaaaa

SEQ ID NO: 108570 - DNA, 1447 bp, Oryza sativa
ccatgcacccaaagcccaccatgcagtcgcattttagttggataattacgaccatgaagcatgggtaggtgtctagagcacgcagctcattctgatactaaaatggtctaatattgtaattatcccatcaactgaggtagtgttatttaagcagggctaagcatatagttctagataggtcacataagtaacatgaactagtttatttattacacaaggttgacaaatgtcacgaccggaaataacccaacgggcgttccttacgtgtgtgtattattccttgtctcaggaggcaaggtacaccaaaagttgatacatttcagagtttatcaagcggaaacgtaaatagttattttattacatgggcggcgaaggcccagcacacacaaagacaaacgggaaacagcgtaagactagggagacgaccacaggcgcttgacggcaggcatgagctagacaccaaagccttcatcattcaggggctcctcttctgggtttgggaaaaattgagcaagttgagtacaaccaccgtactcaacaagacacacccacaagtgcagaataaatgcaagggagtacaagggagccataatataggggggttagggtttgcagtaaacagcactaaaagacacttagttgctcaaagctattttgtaaacacggtcctagagctatacaagattattaatcaaggccgtgaactcacacgaacctgccttaacccaaggcctacgatgattcagaccgaactggcaacccgaccctgggtcccagctcgtcccaagccaacccaggccaaccattccacattttagttgttaagcaggtgttaagaattaaaaacactaacttgggtacattgctcggcttgcccataaccgagggcgcggccacataccaccacggtatccggacggaagacatgacatagtttccaacccatcctagccataaacaagagtaccaacccaaccccaccaacaattaaaatgtgcaaagttaaaagccaaataaggcttagaggatttttgtaaatttcctaaaagcttaaaatgcgtaaataaattttagtggaattttcagagcacaaataataattattaagaaataaacaaagttgaaaaggttttaaaaaagaaaaaccctaaaaatccctcttccctctcttgggccgaatccggcccatctccctccccctttctcctctcccccgcggcccatccagcctcttcctgcgcgcgcgccgctgacgggcgggcccgcccaccaccctcgctgacgggtggggcccacccgtcatccccttcctcccgccgctcccgcctctccgcccgcgccaagcgccgtctccgccgccgccgccgaatccgccgcatcccgtcctccccgcgtgcaatcaataagggggaattattccccgtgattccctctccctttcccccca

SEQ ID NO: 108571 - DNA, 680 bp, Oryza sativa
ctttgccgccgcccgggcaagctcggccaccgctccatttcccctctccacctccgtagcgccgtaccacgcgaaccacctctctccaccgccgccgccgactccagccgcgtcgcgccaccgcttcagtcgacgccgacccgtgccgttgcctccctcagctccgcaaggatgaggaggacctcggctgctgcccctcttcgccggaaatccgccggagctccttcttcctcggtcgccggtgagatccttctcatattgtcgcggtcggccgtcgttaccggtcaccacgcaccagtcctcccctctttaacccctcctttatctccctcagatcgaggctgagcccgtccgccccatcccgagcgacgcccgtcgccggagctccgtcgcgtcgtcttcctgaggagccccgccgccaccgttccttgccgtcggccgccccttcgccgtcgtgcctctcggtgagcactcccctccctctcccttttcctccccttcgtcggccgcctcccgggcgtcctcgcgacgcgctgccgccgccggtggccgtccgaccgggtcgctgcccggcgcgccttccgccgctctccgtgccagcgccgttgcggtggtgccgggcaccggttgctgcctcccccttgccgcgccgggccgctgctctctcgcgtgcgccgctt

SEQ ID NO: 108572 - DNA, 933 bp, Oryza sativa
tcatgaggggtcatcgccttctctgaagagaatctcagattccttcaaaggtgaggacttggtctggcaagctattcttctgcaaactttttgagtttttatactgtttgtaactttgtttccatccactaaggaagctcaaactggttaggcataggacaagcatacttagctgtaagcacatccaccaatcatagtgacaggcaaccagtagccaatgcaccaagcatagcttgtggtcctttcagatcggaaggatcacagtaaattgacagttgcagatacacatgtgagtgtttgcttgtgccaaactgttagagagtacaattccttagctgcctgctgttgttcatgtctacagtctgcacctaacatctacaaggaaccccacatgttgcacttgccacgaaggaacatgatagtatgttggttaatgtgcagacatacttatgtagatgagcccaccaattattttgatttttatagatgagacagaatgtcagatagacaagaattatcaacttatcttttctttctttttttcacttgttcagacggcgagacgcatacttcagatgagagttggaacccaacaagcctccctgatacaccaccttcaaaggcaagcaacgatggcaaccagataaaggcagaaaacatgaaagccctcatccaaaagcttgagctcttgcaaatgttgagtgaggaagctctgaaaaccgatgacactttttcatcagttgctgccaataaagatcaccagtacctctacgagatactttcagcatcagggatcctacacaacaaactaaattttcaaatgatgcctcatcagctgcgaccatcaagctacccgattaatccagagcttttcctcatccttgaacaagcaaaaccagacgaagaaaagctgcaccgtaggctcatatttga

SEQ ID NO: 108573 - DNA, 825 bp, Oryza sativa
ccgaaaacatccagaacgatgttttggtgctggaaattttcggacttatccgaaaaatttttggaatgtctgaaaaatctttcgttgactttgctattggtgctgagctggaatttttggacttgtccgaaaatctttcgtaatatccgaaaatctcaattattgtgcataacgggcagaatttgggctgtggctataaatagccccctcccctcacttgtgagcgcggctggttccattccaatcatttgtgcccttggcttgctctctctctagcacttttgaaccttgctttcttgtttcccctctcacccgtgtttgatttggatttggtgtgtgtgtgagagttgtggattcgagtttgtgtgagtgcttgttgttgactttgtaaagatttgtgagcacttgcatcatctccgggagttctttgcttcatttgttactcttggaggttgaggactcctaggcggctaggtgtcactcccgagccactgatctacttgtggttggccgggagaagtttgtgaaggtcggatctcacctccgaaagggaagagatacccttagtagaaggagtgcttagtgcaacctcttgaggaaagggttagctaagacccggctcttagtgagctcctcaacggagagtagaatcccctcaaggattcgaacttcgggaacaacttcgtgagcttcatctttggtgactttacttcctctctctccactagctttgcttgtttgagccgctataggtctagtggctgtttgtgctagcatattcttgttgtacgcaactagatctaggatttactttgctatttgtgc

SEQ ID NO: 108574 - DNA, 731 bp, Oryza sativa
tttgatttatcaggccgagcgataatgctctttgttgttccacgtgaactagggccaaagaaaccacacaagtaaattagcagtgttctcagactatttgtttcaattaccgtgcccaattattccaatccataaattgcatgggtaagttaattcatattgttttgagactttggtctggtctgtcccttccaacacttacacagcttcgttgtttcgcttattcacttatccgaattacttattaacaaataaaaaattatttgtgagtaaaacttttatatacatgtccttaagaactcaaaagtaaatgttgtaaaagaaaatatgatagaaaaattttaaaaataaattcaaaattgagttctaaaatttaaattttggtttataagaataagcataagggaaacttaattatgagaccctagttgttatcaataaaatgttttgaaatgagatgaaaggcataagggaaactatgagaccctagttgttgtcgataaaatgttttgaaatgatatagaagtagccgaaatacagaagaaataaggccgtgtttagattcaaaattttttcgtcaaactttcaattatttcgtcacatcaaatatttggacatatacatggagcattgaatgtggacgaaaaaaaactaattacacagtttgcatttaaattacgagacgaatcttttgagcttaattacgcaatgatttgacaatgtgatgctac

SEQ ID NO: 108575 - DNA, 758 bp, Oryza sativa
tgaaaatgcccctcaccaataacgatcactctgttaatccacatttaatctcaaccactgatgcgctttaactttcgtgctagttttttttctggacgagcatagaagcacgccatcctccaaactgaccactcggccatcaccagggactacacgagtaacaattcctcaccgacattcattttgtcataaaagtctggttactgaatctgctcccgtgcgcaggcgatccaggaggcgatcgcgatcccactctcgatttaggccgccatcgccggcgatcttgattagcaacaccggcgacaactccgatcacagtgcccacaccccgttttccgacctttgtcggcgacggccaccgcatatcgtcggttagccatttctggcgccaccaaacacaatttctcactaggggtagcgccgctaggaaccctagagtgggatcggttttggtgtgctagcctccaatcggtacgctgcatatcctatttccctccgatctgtggccatggccgcaatcgggagtggaccaccggtttatgccgaaagtgcacgttgcagatcagcttcagaacctcaacctgactacagaagaagaaaacgttgcggaattcagcgatgatgatgagactggagacccccaggaggttgaatggatgcttgttggcaaggtcctctcgccagcaatagtgcatgccaccacagtattccgggcgatgaaaccggcacgggggaatccctacggattgaagatcaga

SEQ ID NO: 108576 - DNA, 1187 bp, Oryza sativa
gttttcgtttgcagaggtacttgcttgggcgaaggaaaagagaccgagcgtaactaatgcatggatgattaaagaagttgattggggaccaaaccaagaccttttccaagtcttccttcatctcaccacgtcacttttggtccatagaagacaagagataaagttctacacgttttggattcggattcgggcctcctaacagcatcaacttcaaatggacctagccgctgatctagaaggtattttggggcttatgagtacttgttggaaagcttatggagtctaccttcatatggttttggtcccacgttaaaattcctaccgagctgccgggaatctgcaaaacaagccacgtatctcatccagtccgaatctgatttgggttttgggccttgtaattgtgtcgtgggcttagcccaagggggtgtgcgccctagggcaaccctaggacgtccctaatcacatttatttagtagccgtcatcgtttagagttgggttttgattagattattctgtcaagaacagtttcacccctagatcggtttgtggaaccccaaattcgagtgcataatcattcatatgcaatttggttgcaatctatcttgttcttgcttgtgttcttcgattcgcatgcagggattagccttcttggtgaggtcaaccgggtttcggcatggttgataaccagaggagacgtggtgctgcaattgcggggctcagtagcttgttcgttcagaagctggattgagttgtgtcgcgattccgctcaaatcaattgtttatctatacctatcgaaagatcgggacctaactccctcataagttggtatcagagcgcggttgcccgttaggtaatttatcttcccataaccagaaaattgccacacaaaaaatttattctttacctagacaatttgagccgttgcattgttctattagattttgctttgttgaattctaggttgcatcgtcatgtcgagtgctggtttagttttagatttaatttttagttttgagtattgcatctgttcatcacttaggtctagggctcatcactcaagtgtgtgagttgtacgtcagttttgggtccagtttttcatctcgtcagttgttgctgggaccttgaaaaattgaatcgtcttgtcgtcgggtttccgtttttgtgatttagagaaatttttatcaa

SEQ ID NO: 108577 - DNA, 791 bp, Oryza sativa
tcacgttagcagcaatccactacaccaccaccatgaactgtttgttttagctgcggtcagaacggccgggccatgctcaatgttcagacttctacggcctcagctgatcaccaccaaacgatgtggatgctctgcatgcccccacaggcaaccacccgaagatttgttactccgggttttgccgctccatgtggcactgacatgtgggtccttaaaggtgttacatgtgggtccttaaaggtattacaggtagtcggtggtagcgagacggtctgtttgattaggatgatggtggaaaagaaaaaaaagggatagatttgcttgaacgatgatgatagggtgtgtatgcctgggccctcgcatgtttgcggatgcaggagcatgcaaatggaaggttggcactatttttcggatgagttgtaagcgctgtacttgagcaatttgatgggtgagctgtgttagactgttaggcatctggtttttgcaaaaggacaacttgatcaacgtgctgtttgctgttcggtcatctgttgcaagagcaatttgatcagtgtaggccacgaggttaattcattctgcaattaatctctctctgtatggaaccactgttcagtcatctgtttactgtagatccccgtactactcactcattgtggcaccgcgtttgccacctcaatttgaggcgccatgtgtaatgtagctaagcctaattatacagctgggtccttgactcaatttgtaaatggctgccaaacaatcctatctctcagctggtttatcagatgaggtcc

SEQ ID NO: 108578 - DNA, 629 bp, Oryza sativa
ctgcagccccatggtggtcaactggcaataatcttcagtttttttttatgtaaaaacactatagaaaagattcctacagtgtatatattataaatattaacaaaaccatacagaaaccaaaacttcaggtaacattatggtagttcaggttttttgggcgatttgcagcaaggagtgaaaataattgatctttatttaggtatgttcttgctggcgcttaatgctttttcgcaagctcacgatgtttgggtcactaatattctttgatatgcatatttggatttgacatgcaaatttttatgcatatattttgattcggaagttatttttaattttccttaaataccatattatcgtattttgtctttaatatatttatatatgaccataatcgaattaaatcatttcactaagtgtaattttaaattgatatattatttcccgttgcaacgcacgggcacccaactagtaattaatatgtgtggacgattgcatcgatcacatgacggaattaagcgtgcgcatggagattagctgtctagctctcgatcgtgtcgtgcttatagccatgtctcatatggtctggaaaaacaaatgattggacaatatcatgcactacttgcatcggg

SEQ ID NO: 108579 - DNA, 634 bp, Oryza sativa
gcacattatcaatgaaatagaccctctaccagcctctctggctttactcctgatattgaggaacttttattatttttttatgggtagtataaagcttgctcttgctaggttgtggttattaaacaaaatttagaagcttcacatctgatacatgctgacatcccttactggatcattttgacatgattgctatgagaatatggccgagtttagttccaaactttttattcaaacttccaacttttttatcacatcaaaactttcctacacataaacttccaacttttccgtcatatcattccaatttcaatcaaacttccaatttcggcgtgaactaaacacaccctgtgtgttggaattcttttcaggctgttttccatatagccaagtaaaactcgtaggcaatgtaatggtagtaacaagtaatgtattcctcacagtgatatttcaccatgctatcattctttacgagcatcttgtgaatggtttcaggaacagagcaaatggattgcagttaagaaatgcttatcgatattcaacatttcttaggtcagctggtcagaggctgggtcactttttggcattattgagcagaagatgttctcgcaattttcccctttactgtactgaactt

SEQ ID NO: 108580 - DNA, 762 bp, Oryza sativa
gtgttttatccaatcaaaattatttatattttgggatagaaatcagttaaaatcatttatatttatattgagatagagagagtaagtggtgtttttttaaaaaaaaaacacttggggctcagaagtgagtgcaggctagtcatggtactccttttatttcataaaaaataatcattttatttcataaaaaataatcttgatatgatgtgacattttctactaagtctgactagaagttatctagatttataatactataatatatcacattatatttagatttaattttaatgaaacgagtcagcctcgtttggtaaactctagctctcatctccaacttatctgaagctgatcctctgtttttgggagtggagttagcagagctattcctttaaaaaaaatacaaaggtgaaactgaatttttttaacatatttacataaaaatgccacttaaccatcccaagacaactccttacccctctctctcgcgcgcgactggcgggcaggcagtgcgtggctgatggcgcgtgcggggacggcgtatggccgacgcggggtaggtgaggacagcgcgtggcctgccgctggcgacgcacacgggacagcaacctagggcttcacgaggtattatggattgttttttttccatttttttttccgaatactaggcaaacactttttagttggtctcccacataagagtttagagttaggatttggaatttaaagcccaaccaaacgaagcgagtagacatgtagcag

SEQ ID NO: 108581 - DNA, 776 bp, Oryza sativa
gctaacgtgacgagctgacttcgatcatccagactgagtcagagaccgagacccacatagcatacatacaaaatattctacattagaccagttcttcctctaccacctttcctccatctctcttctctctcctcagctcacgattttagcgagcaagctatgccgatgatcattacagaggcctgacgaggaagcacataatatgctgcaggaggtacacagcctcgctaagctataacggcgagtcggcgattaaaaaaaaaaagtgttccagtgtacaattaattcgttctatatagattcatttttcaagtgaaaaagagccttttgtaactctttatgtaacaccttgactaccattaatacaatagttataaggtagagtctctctacctttttcagtcaaaaaaaaaagtgaaaaagagacatatcagcgtttttacaacagcagctatatttgttacagctccttgcgtacaacactttgattgatggattgcacaaggaaaaaagataaggcattgtttagatcaaaaaaaatttagccaaaaacatcatatcaaatgtttggtcacatgtatggggcattaaatgtggaaaaaaacaattgcacagtttgcatgtaaattgcgagacaaatcttttgaacctagttgtgccatgatttgacaatgtgatgctacagtaaatatttactaataacggattaattaggcttaataaattcgtctcacagtttacaggcggaatctgtaatttgttttgttattagtcta

SEQ ID NO: 108582 - DNA, 533 bp, Oryza sativa
catggagcattaaatatagattaaagaaaaactaattgcagaattaggggggaaatcgcgagacgaatcttttgaggctaattagtccatgattagccataagtgttacagtaacccacatgtgctaatgacggattaattaggctcaaaagattcgtctcgtggtttccaggcgagttatgaaattagttttttcattcgtgtccgaaaacctcttccgacatccggtcaaacatccgatatgacacccaaaaattttcttttcgcgaactaaacagacccttacttgatgttttagagttcaaaacaatttagtgctaacaaaagtatgtatggttcccaagttctcccgcaatatttgaagaaatggttataaaggaattattttgttgcttacaggggaagctaaccatcttggaattaagctttgaataatggacgttaacaactattgacccacaagaatatggatatctttcatggttcaaattgaatgtttcaattaatcaattctagccgtatttgatgggtga

SEQ ID NO: 108583 - DNA, 916 bp, Oryza sativa
acactggcgccatgcccgtgccaccgtggcactagggctgtcatggaggtgctgactgggcagaatgggggtgccagccacactggcgccgcccctcctagcatggcgccagcatggctggcgcgcccctcctctgtgggccgaccccttaaaccccgtgggccccaccacctatctactccccactcccattttcgcccgagcaccagcccgagctgagcagcagcagctctccccctctctctccccctcacctccccacctcaaatccactccatttgaactcgtttttcgcgggattttttgtggaaatcgaagagaaaggtagactccttcattcacccctcttttttttcgcttttattggttgaatttgtagatcggtgggtaatcctagaaccccttttttacccaaatttgtgatttttagcatttgttcttaggattggcttgttgtagtgctacatgtttgcaatgtactcattggtgtcacgatttttttaaccatatatgtggtaatgttaatttttggatggtttggttggatggatggatgaaaaattatagttgaggcatgaaagtaattttaatttgatggacttgatgctatagtctataggttaaacttttaaccattaattatatgaaggtgagcaaattttggttgcattatataaattgattatagttaactagaactaggttgggttgtatgacggagtatttgtaatatttcgatgtgtaatgcactagtaaacttgttgatagttgtaggtggattaaatatttttttggagtagtagctttgggacaatttaagttatgcattggttataatatgtcggtttggactacgtttaggaatgcaagatttaatttttgttgcaaagttacatttgattttttggggctgcag

SEQ ID NO: 108584 - DNA, 591 bp, Oryza sativa
cggttttgtagttaaggcggtttccaggacggttacacctggcttttgagccctctcatccataagcttgcttaggagtgaggttttctccactttctctttattttatttgataaattcctgcaacatattgttctccaagtataagtggaactatattatttgaaaacaaatatgcattgtaagcatagctaattctccattattttagttatattgacggtcaaaatttgtctgtaacgactgtcaacagttacacaaaatcatagggattttggtgcacgacacaaatccacatcattaaccaattttcacgaaaccacatcattaaccaattttacatactcctcaaaattttaaaatgatttagttacatccatgtaaaatttctatgatggattaaaaaaactcataaatttatcaatttaagatgtaattgtagaactcaaaaggatagatcaaagtaaaatgatcaatagtttggttttgtgcaacttagatcacagtacctagggttaagtgagatttacttttaaaagaacacattaagccaccgttggtatttcttaatgtcacagataaaatttgcaa

SEQ ID NO: 108585 - DNA, 685 bp, Oryza sativa
ttagcatttggctcttgaaagcattttttgccttcggggttcttctttggttggctaagtcattcatggctaattaagctcctatccgctgaaccctcttggatcgcattgctatcttctagcgcccctccctccctttaagtaggcgtctaattgagtggcaatcagatggtagttggagatcagctttttagaatgaaggttttcatatctaatgtgcgttggaggttaggcttactcatctagttgaaaactgggtagcaagctcttagatcatatcttggatctactcatacttctacaacgacccacctttgaagctatgcccatcatctcccctcccctcaaagggttttgggtggcatcggaaagaacaacaacctaataggcaggcttagttggtttcatgaagacatgtttggttggtttcatgaagacaagtgatgtagccctcaatttttcagtattaagtcagcaagttgatgttctcaaaagtggtgtaaaccggtgttatgagcccttaacattagtatcttcgtggcttcatatttttttcttcatgtttgtgtgctatgttgtctttctcttcatcccttatgttgtgcttttaatattctatccactcccttgttctaaaaacggcgctatgtatctttataatgatcaatacaagatttaggtgggg

SEQ ID NO: 108586 - DNA, 1285 bp, Oryza sativa
aattttcattcaaatataaaaatacttatgtcatgcttaaagaacatttaatgataaatcaagtcacaataaaataaattataattatataaattttttaaataagacgaaaggtcaaacgtttgtcaaaaagtcaacggcgtcatacattaaaatacgaagggagtactaggaataggaatagaatgtatcgagaatatattagaggtgaaccaagtttgtatagaacagctcgagtagatgtcttgtgtgccagcaacaggtaaccggcacattgtgaaaacaccttattccgattcttggacgatcagaatttgggataatacacggctaatgcatcgtgctatggtagaacaaaacattatacctatggtgcaacatagtgaactgctcgttactacagtgaactgcctatcatggtcctctaaacaagacaagatgtctagcttcacagagccatggattcaaccccaagtaacacgtgtgaaaaacgggtgccgatcgaatccatttgaatatctttcctcaccatttttttctagggtaaattaaggtacctccttgtaactaaacctagtttcgaggttccacaggaattttgaatatatgggtacctcctcaaaaccattaaatttctcaaatttggtttttcatgctatcttctcaagtaccgtgaaaatgttaacggaaaaggagaacaaaattaattaatttttctttagtaacatttttatagataatagataaaatctaaattttcttttaactatgggccagtttggattgctaccctaccaaaatttgccctaccaaatttttggtagggtagcaaaccaaacacctctattaaaactctacctatgccacaaatttggctatgcccatgaatttgtctcttatgggcaaattttggtttcaatccaaataaacattttcaactctaccctaccaaaattttgatagtaccaaaacttgcccaggatttggcactaccaaaaatttggtggggcattaatccaaacatgccctatatatagcacacacttgttacaaaacaaagttgttaggtgaagagaagacaaatttcaatcccgccaaggcgccaaaagtagagacaatttattcatacaacaatatattctggtagtaagtaaatctgcatcccactagttaaatagcccacgatcagtcgatcagaggcataaactgtccgtcaatctttctgcaacaaagtgatcagtgggttgttgaactagaaaattattattaccacagcattattttc

SEQ ID NO: 108587 - DNA, 1005 bp, Oryza sativa
ggccgccccccgcgcagatccggcggcagcggccctccgccgcacagatccggcggcggcgacgggagcgggcggtggatccggccacggcaacggcgacgacgacgggaaggaggcgacgggtagggttagggtttcgttttttcaatttcgttttttttttcgattttttgtttttgcatgtgggcgacataagcacccgcacgcgaaaatcggattttcgcgtgcggttgcgccacccgcacgcaaaaatagcgattttcgcagacaaattgctctagacgggccgaagctctgcacgcgaaaatctaaatcgaccgcacgggaaaacgatatgtgtagtagtgtaattatgaaacttacatatataattttcgaacttacatatatatagtgatttatattgtaaatacactaaaattacatatataatttagggatttacaatataaatatacatgctgactatttttcaaatatacatgctgactatttttcatgaaaaatatgatgacacatttatagcaaatccgtataaggttgcgttcgagagagcatgttcggaacgcttgcctcttgcacaaaaaacggagcgatccattagcacgtgattaatcaagtattagttgaattttttttttcaaaaatggaacaatatgatttttttaaataactttcgtataaatttttttttgaaaaaacacactgaaatagcagtttgaaaaacgtgcgtgcggaaatcgagaaggagaggttgggaacctggacaaacgaactgagcctaagtatctatgttggaaaaaaaatccagttccttaattaacagaaaaaaatattatacccttgtcgagcacggcgcgcactggtggagaaatgctttctagtcccggttcataacccccctgtagtcccggttttccaaccgagactacgaatccgggactaaagatcgctatcattagtcccggttcaaataaccgggacaaaaaatcaatctttagtccc

SEQ ID NO: 108588 - DNA, 1508 bp, Oryza sativa
atatctagccttttcccaacagagctagatttcctaggttgactccatagcaaggtggtggtgggatcacccttgcccttgtttgcagccgttcttagctaactccacatgttgggtgtaacgtgcgagtggcatcccacgcggtgttgtggcacacaaatgcacgtcggcaaatgatcagatagttgtgtagagcaacagctaggaagtggagttgtggccatctgcacgtgtgacctaatgcggctttgaccaagcaacatggtgcccatggtggacctgaggtcacctgttggagttggagcttgcttcggttgccacatggcctgagtgagctagggaaatgctaggtgtgttagaggaggagcagtagtcatccattgtagcgcggaggaggtggtgttggtagaggcttgcgtggaggttgcatccaaagaagcaaatgccaacgctgcttagaccctaacagtagtggcaactcatctccatgtcaaatctgtctccaaatcaagttcgaggggagctttgtggcatcctagcagatctattggaggttttttgcaattatttcatgccttttccaacatggagttgtgaaggattggtgtgaaaaagcatcattctccatcttgaaggcgttttcgtgggtgtcctatctcctccactatcaaaggccctctagttgaaatcctagatatagtttatcaaatcgagttgtgatgtcaatattgtcgacaactcttccttagaggcatttctttggtgatcctaaccacatacatcatacttgggtgtttgtcaagttgctagcaatgtcaattatattgggagcaacgatgaaacctctcccccatctgatggaacacgggattggctttcatggtttgttgggcttcttttgtcctgcctcaaccctatcataatgaagttggtggtcatgtagtcagagttgtggcatcgccggagcgtgacatgttgcaacgatggcataggtccactggagttgggaatgtgggttgggttccatggcatgctttgtttcctagttcttcttagtgaagtcagagttgtctgatcatgggtacgatgttgagatgatgatgatagttcgttggtgtctgtatgcaagagtattattgccctttaacattgctacccatgttttcatgcttggattaacttgttaatgaattggttgtgtccatggttttagttcgggttcccttgaataaatattatggttggcctcgtttcaccctaaaatgagtcaccttcttgatatatcactgacggttttgctatgatctttaatgaaagagtaaaatgcattggcggtccttaaacttgtagggttgtgtcatatacattcctaaactctcaaaatgcatattcaggtcccagaacatgtcaaagtgtatcatctaagtcccaaattgacacatcccctgtaggatcctacatggcgctgatgtaccaatgccacatggacgtgacgtgtccttttcttt

SEQ ID NO: 108589 - DNA, 1482 bp, Oryza sativa
aagtttaagaaccgcccgtaccctttacttgtaatgaaaacatatttgacacctagccatttaaccattggtccacaacttctttagggttgtgtaagctctacctatggtgtactagtattttagaaaaagtaaggttaaattttaagttgccttttatttggttacataaagtaaaagtaattttgctatctatacatataaattataagacggtgactgcacaccctgatctactaatgctcgataaatgtgttagctaggtcaaatgactttgggtatcaaatgttgtatactccttgtattctcatggtatgtgaaatttgatcttattgttttgaacaacatttatttccttgagtctatacctggatgacttgaggatgccattgacttgctttagtatattgatggtcttcttgtttgaagaaccaaattgtccaataagcccctgccatttaataaaaacaacttcacattctattcatcacgaacatataaataacaaataagcccatattatacccctcaactatcaggcttaacttagaaaaagggaaacattccatatttagtccctgatgtatatatggtcttgattcgattttggtctctcgactatgaaatcaatctttaagtaaaaagtgaaaaataggaaaccaatcactattggtctctgaactcttcaaagtgttcatgattcgtccttaggcctaaaccagggtggtttataatgatgtggtgccacaagtaattctagcaattcaaaaatatatgtataggatatgaaagaaaaaggaggaaactgagcttgacatgtacacattgtagtattttcttctcttttttttgtttgttttgttcttgtttattatttatattgaagtcatcactatttgtccatgtggagttgtggactctatgtaggcatcacatcattgaaaaaacactatggacctagggggctttgagatttgaggaactgtaatgaatgtttccatagataatggaccatatcttgctaagtataggtggtacataagtaaaacatcaaaattttgattttaaaattgtgaactaatattaaaaccagattgtattgcacttagaggggtattttggccggttttgatagtagagggggtgtaaacttttatgtttcatagttaattggtgttttttttacacaaactcaataatttacgggtgtagtatatatagatttatacctataactaaatagcactaatttcttatgttacttatttttttaaagagtaactataagttagaggtggttagcaatggcaggacatgaataggagtgtgacttttttttctcttaggctaggtgatacgcatcttatatacttatatagttcatccccacttagttaatgttatttctctctactctcattaagtcacatcaaatcaattatttctagcctttggatgatacatctatggttcaaattttct

SEQ ID NO: 108590 - DNA, 626 bp, Oryza sativa
tttcccctacagaaatttgttcatctctaatttctcaacatgtggcctttggaagaagaggcccagaaatcactcaccacattccatctcaacgtcggatcttggatctcgatcatcagctggtttgcgaggtgagcaccctttgttgtccagctcaactctatcaaccctctccactggccattaattggtccatatcttcctcagctccttaattgccttcactgaatgttgaccatgccacaacaggtatggcgtgaacaaggcagttgaaatcaactgtgcagaggtgtccggttaggcattgagtcgagcatgtggaacacggcggtgtgcagaggtattccagtgttggaaataggacacgagggatggatttggcagaagagtagcctatcagacgatgtggatgagtagggatgaagcagaggagccgagcagtactacggaggggcagcatggacattggaggatccatacagtgttgtggaggtgcggcacataaggttgttggcaagcttggttcctcggtctcctccccctcttcgtggtacttggtggtgcgctcctcaacaagggatgagaggatcaaaatgaccaatggaaaggagccaaaaaaaggagaa

SEQ ID NO: 108591 - DNA, 993 bp, Oryza sativa
ggggctgcccgccggcgcgtgggcttgccggcaacgcgggggctggccggctgacggcggcgtgccgcttggcggcggggattcctttttttttctttttttttttcagatctggagctaaaagtttgccaaacacttttgatgggtctgtaactccaataggagctagctccaactggagtaggagtttggagctggaagttgaagtttggagccctaccaaccgggcctaataagagttactcccaccacctgaagcggatggtggtttttcctgcttttagccatggggcccacctgtcagaccacctcctcagctcgcctcctccctcgtaggcgtcgacccttcccctccacctcaaagccggcggcatcctttcccggtgatggcagcgcccggcgagctcgcaaacgacggcggcgacgcaagtccggtgactcccatgcccgctgggggtggcggcggcaatgcagcttctcttccccgtcctcttcctcccgcgcggcctccccctatcctccctcgttgtggcgtcgtcctgcggcagctcgcgagtgcatgcgcggcggagttcgaggcgtggaggatgtgcgccctgcccccgccagatccagctacgtgtcaccggcggcgtgctgtgtcgcccgccggcgggtgcgggtccaaggggatcaggcaagctgctgcgctcggcatcggcctcgtactaatcgtcggggggaaaaatggctgtgcgctgacgagcatgtggacatccaggcatgactcatgaggcgatccttccttcttttgcctcgcagtcgcaggcagcgatttcttgcaaattactccaaattgctgcagatcagctgaccttctagcgtacagtgacatttagttttggttccttgattccttgtgcaggaagagggcagggaagaaccgggggagacgacggccatgctggagaatttcgtcccaaatgtgggttctatcaattttttttagtatat

SEQ ID NO: 108592 - DNA, 1261 bp, Oryza sativa
gaaaaaaagttaagcgtacggcagcatgatatttctgggctccaataagggttagtacttatgctaacaacaaagcaatagacattgagtcgtggtccacgtgaataaagaaataaaaacaagttatttattattatagtagtggtccctatgtatttaagaaaagggtttaaccaatggaacgagaacacaaacttgagtatatgataatatgacatttctcggctccaacaaagccttccactatccgtgctctgtcaacattctctatatatcatggcgagaccaagacctcgtagctggctggcttgctggctctgtttccttgccgtgcgcccatgccagcatcgcattgccgccttctagccttctcctgctggtgaggttcctctacttctaggctcgagagcactactctttttttaggggaaaacggcaggagctctgcctattcattaagaggaggaaaaagagtttgatacagattctgggcacctccaagagatgtcacaacaaaacatgaaaacatgaaatctgtgaaatctaggctcgagagcactactcttctagttcatagcttcgtaatgcaatctgtgattgctactagagtactatcataatgttatattgtcaatttgtgattagtgaacatgtgaatatgcaatttgtgattattgtttagtgattactgattagcttgcctcattgatcatacccatggctaattaattagctcataacttaggctgctgatttgtgatttgtgaatgattgaatgtgaataaataacttatgttattgtaagattggtattgttttatatttggtaaaatatgaagaggaatgggattggtattggcttaccgtaatatttcaacattttgtacttgcttgtgcacattttggacttgtttgttaaattagtcgattattgatgttgatattattgctacatttgcatcgtcttttaaccaaatttgtaattatatattgtgtttgaggtgtttgcaaaattttcatgtgtgatgtgaacttcagaagtaggactacccaacgaaaaattcctggctgtgccaatgcctttctcaccctcgagcccatgaattcgctggcgaaatcgccacctagcaccacacctttggttcggtgccttccctggccaccccctctaagccgggggaacctcatattcatcctccttattagggcaatagcaatgcgccacggatttttacatttcctcacatgccacatacactaa

SEQ ID NO: 108593 - DNA, 1218 bp, Oryza sativa
tccgccgccgccatctccccttctcctccctaggccgttgccaccaccatcttccttctcctccccaggccaccgtcgccgccatcttccttctcctccctaggcctccgccagcacctcgtcgagctcgacagatccgaccttgggtttgccagaactggcgagcggcaccactttaggggcgacacacttgctcgggggctacagcctctcaatgcgccgctccacctgcgcgcctcgccccgcgcctacaagttttgacgaagaacgcgtgacttagtttggcatctgcggtcttgagttgggaatgccacgcacacatcttgagttgggaacgccacgcacgccacctgcttctcgcctttgagcccacggatcattggcacaactagtgtcctacgactggtttggtgcctcctcttgcaattcctctaatcgcgagtaaccccttgtctatcctactcatgcaaagtcccgacatgaaaccttaattaagggggctcattagagacaacaagaatttggctcctcacacaagcttcccaatgcaaccttggttcatgaggtaggcatacacattttagaaccagtgttattaaactctcagaatccaggtattcaaatcaatccaagttttatacaattatcagtaaggtactaagtcctgatgccacaatactaatcacaccgtgcatgtaacagcgagggagttgtctctagataccatttatgggctacacacctacataatggatcacttctgctttcaaactgattgatggaggcaatttaaactggtgttaattaaatgttcagaatatggtataacaccgtaatatgtgaataattattcctttcattcatcaccattctatactaaatctccgacaatttagaaactactgaaaagtacagtgaagtggccttacaactggcatttagcaagtgctctacccttctagtgccgcgcatgttaatccagcttaaggaaggatatgtggccgcttgtatgtgattaaataaaaggattgcaatgggctgtgtatatacaattttaatgataacaacaaacactgtatctgcaaaagaaattaaattagcattggcataaatgtaactagcatgtattggcaaaaaaaaataaaattaactaacaatgtgatagcataaaatgtgtatgtaacacaaggtgttaatttctattttgcaaataatgtt

SEQ ID NO: 108594 - DNA, 4090 bp, Oryza sativa
gagaagaagattatacaacttcttgttgatggaaactattgcttcttctctcttcttataatgagatggttgttaagagcattaggagaccaccactgatgtaagaaaagccacatgttgtatacattagaatctaatctttgtgtttctttcatgtttggatcttttctccccaagatataatatcacagatataacaaaataaaaatgtaagaaatgtgatatttattttgttatcaacataagtgatatctgttctctcattgaaatgaaggtgcataaatttgtcattggccttctttttcaatccttaacaagtgcaccccttctcttaaagggggaaattagacctttaccacttaattgtgtgtgaattaagtacttttcacttgatggaagttaatttatttagtgtattgcccaatctatccaactgtcatgcacatcaaaagcaaaaacacatgctttgatcggtagcgcgtggtgggaggcaagtgtgggccccatgcaaatgtgtcccatgcaaatgttggaggagggcagagttatgcactgggtacatggtgcctcgcatgagtcccatggtgtgaagacgtcacggatgacattcattttctagcatttttctaagaaaaaatctataagaagttgaacatctttgtaacaaggtggcagtaggtgagaaaagcctataggggttgagccgtggcaccccgtgcataatgaaataatacatgtttttttttttattatggatgtggtccctacatgtttaaggtggcactcggtgagttaaaaaggaaggggttgagccgtggcaccagtgaataagaaaattaagacgtgtcgtttattattctagtggtggtccctatatgtttaaggtggtagtaggcaagaaagaatgacatgggtttagttgtggcctcagtgaataaagaaacaagagttgtttattataatggcagtgttcacaacatgtttaagggaagagtctaaccaccgtgagaaaaatagacttgagcatatgggtagtgtgacatttctttggctccaacaaggcattctattactcatgctctatcattatcatctgtataacgaggaagggcaacatattgtaccacattaacctattttctcctagccgctttaggttctcagtatgcccgctgccttggccacccgcttctcacctttgagtccatggatcaccagcacaaccaccgccttgcatagtgtattttacttcccctagtgtcccctactttgatacactcacaatgttaactacattctattttgcaaatagtgttaataacattttttgccagatattgtgcttattacttttttttgcccaatacagtgttagttacacctattttgcacatatagtgttaaccatttagcattatcatcaaaactgaaagaatatagtactttgattaacatgcagaaaaatgcttatttcttttatttaattaaaaggattgcagtgtgcatataattaacatgacttattatatgttcgattgaacatatgcatattacatgtcttgacatgcaagcctacataatatcccaagcagcgtccaacttagtgaaattagttatgacatgttttttagctttggtttgcacacactaaacaagtttatacaccaaaataaatgatttacaagttcatgtactaaatcgcacccacctcgcaagttcatgtaccaatagtgcaatttactcataaagaaataaggtatggtgagttgtttattgagtaaattgtactgttggtacacgaacttaagagatgagtgcgatttagtacatgaactgcaaattgcttatttcagttcataaacttatctagtatgtgtgaaccaaagccaaaacaacatgtcgtaactaatttcactaagttggacactaattaggatgttatgttggcttgcatgccaagatgatgttgcctaaatatgcatatgttcaatcaacattcaataagtcatgttaattatacatattagaaatgtacatgtcttcaggacaaaatgtccaaccactggagaactaaatggttacatctatgtgcatgatgtggcatctttttggtttttcacaccggttggttgtatacttgtatgcttgctttaataaccttatctttacaaggacaggtaagcagcaacaattttcatcaacaagaagttgtatatcttttctcccggtcaacgacaatcttgataaagacaaggttgcttcttgatggtcgatgatgggtagagatgaagatgatacaacttcttgttgatggaaactattacttcttacctcttcttataatgagaaagttgttaagagaactaggagaccatcattgatataagaaaagccgcatcatgtgtacattagaatctaacccggggaaatcccctttgcctctcctcctcctccacccaccctccttgcaccgtgaccccaacctcaaaccctaactagtcaaggccaccaccagatattgcagtcgaagagtcgttagagttgctggtgttggcatatttgggggcgagaccgcgagaggcttggcgcatgaatcttcaagtgaattggatgtataaaatatcataaaacttctccttcaaaatttttttttgtcaaatgttagttcacaaatccaaaattttaagtagaatataaatctcaatccttcacaagcattgcccttctcatattgtaggaagttaaatattacctcctaatagtgtgtgatttaagaattctccacttgatagaatttaactttaacttaatatattgccactttgcttcttaattgattattttcatcgtattttaccttcccctgatcacctggccaactagcagtgatgaagcatcattctctcagccaaagaaaaaggaattgtttctatttcctttctcccgggcccaaaggatgtagtgacacaaccaaagtgttaattcaatcaaagtgttaactacgtacattttgttttgcaaattgtgttaatgacattttagcccgatattgtgcttataacattttctggccaatacagtgttaattccatttattctggccatatagcattaatcaaagcattatcatgaaaactgaaataacataacacattgcgattcttttatttaattacatgcaaataatcactgcatatcctttcttcatctggggatgcatgtggcacgcgtgagcctaagctttttgtcaaccccataatcaagggacaccagtgaacatttgtaaattccattataaattagtgttttcgtagcatagttgtgatgtgatcccatggagtaatattggtgacatcaatggtttcttatcgtagttctgccattattgttacttctattctttagtatgttggggtctctatcccaccaatggataaatgaacttgcattatagaattacactctaaatgaagctaatagtgaaagggcatgtagcttagtggttgtagtgagccagtgacctgagtagcaccccaaggtcctaagttcaaatctacatataggaacgaattttagattgggttatttgagagctaagttacctgttcgataggctatgttcctaatttaaaaaggctgcatatatccgattgtatacagaggccgggtaaaaatacccttctctaataaaaaaacataaaaaagtgaagctaataagaaaaaaaacctaattaaccactgcttttgcgctgtttttctagttaacactgcttttgttcctaacactatatttctttttataatgaaatttaattccgacctttcctttattaaaaaaaggtacacccaaccgtcacaaagtatatatgcacaaataagactgaaaaacatttcgggatatcgcacggagtctaaaaaccaaaacgccacacatatatcggattaaaaaaaacaccaaatagactaagacattattaataacattttcttttactaaacctccatacaaggttgacgaaaaatacataaccaaactccgatgtacaaactgtattatgtccttttgttcctaacactacataaatagttg

SEQ ID NO: 108595 - DNA, 1020 bp, Oryza sativa
tgcaaagagtattaaatatcgataaagaaaaaactaatggtccagttggcatgaaaatcgcgagacgaatcttttgagcctaattagtccatgattagtcatatatgctacaataactgacatggttaatgatggattaattaggcttaataaattcgtctcgtggtttccaggcgagttatagaattagttttttcattcatgtccaaaagctcctttcgacgtccgatgtgacaaccaaaaattttcttttcacaaactaaacacaccctaaagccataatttggaacgtgagaatttggcagcttgagaagtgcattgtcttatatactatatccatcccaaaatatcccaaaatatagcaactattaactatgaatctggacatacagttgttcatattcagtaaaaaatgctatattttaggactgagggagtactattttaattgataaaaaaccagcacgtttgagacctacttccttcgttttaaaataaacaaactaatccagtacaataaacagctatctagatttattgtattaaacttatgttgatttattttatgatggagggagtaagaatttgacaactgaaaatccactgcggattcatggtagatatccaaccgtgaacaagtctgtttatgaacaggacgttttatgttgagaagctatgtaacatatgcaccataaaaaaaatatacgaacaagacgaaccatttggtgttctcaaaaaaaaaagaaaaaaaaaagaagagagacgagccatttggagttgctgcacccatggccggagcaagtgaagaaataggaaaatagttgaattcaaacggatttataagtgctaaatggatgaacatatctgaatgctactacatagctagcctagaagtcatctttcgtgatagacacggcgaaggaaacaagattgcacaatcgacccaagagaaagaaataagtaatttctaccaaagatttcatctgtatgcagaaggtacatttgattcagaactgggta

SEQ ID NO: 108596 - DNA, 1289 bp, Oryza sativa
ctgtagcatcacattgtcaaatcacggcgcaattatatgcttaaaagatttgtctcgtaatttacacgcaatatgtgtaattagttattttttcgtttatatttaatactctatacatgtgcctaaacatttgatgtgacagggtgtaaaattttgctagggatctaaacaagccatttaaagaactttaaaggttttggtgcacacaaaccacctaccctattaacattgtttgaagcaaatttctttctttttcacatgtttgattattttctttgaaacaatatttatttcaaatataatttaggactgagggagtaagagccaatgaaccaatctgatgggaaaagaatgtgggggtgtcagtctcaggctctcagccaaccaacatcaggcggagatgacaacatcgacgacaggcagctatattgaagctctgaattcatagatcttgtatcagagcaggtacaatagaatggttaagcaggcttcaaaatttctaatcctaaattaagaaaagataatcaaagagagagatgcaagcgggcgcttgttctaggcgcttgcacggccccccacatgcatgcagctagcaggggtcataaaaagtgtgttatgtgggtcccatagagaaccctctcaatcctctactccttccattttacctgtgtttgctgtggcttttgttatgagctagtgcccactgctacactgttggtggctacaaagatgaatagcagcattgatcctaatagttgatatgcccatgcaaaatattatacttgtcattgccttaacttgtagctagcttatagccttatagctaacataacgtataagttagctctaaattggcttttaataagagcaagttaaatagtatagccaactaccagctccaattcatctatagccaatctaatagctcattcatacaatagttacgtactacactattaatacatggtcccacctgtcatacacacactatgtcttggagtccgtgctacagctgactacaaatctgtagcccgctgcccttttctctccttatttattttcttaaaatatgtttgcagctggtttaaagcctactactatacctgctctaaaataatgataatttggagctagcagccagcggtactattgaccttgctctcactgcaattgaaatggtagcaggcggaaagaacatatcgacggtcattggtggggaaaaagccagaaactgaatgtgggtttggtggaggaagagattaagaaggagaaatcgtggaagacgaaac

SEQ ID NO: 108597 - DNA, 1908 bp, Oryza sativa
ttttttttaagcggatgtggatgacgtgcggatgcggatgcggagcggattatttcggacgtcggattcggtgcggagtcggtacggggttcgaaaatggataaaaagttgtcggatgtcaagtttgtattcaatccatacagcaaaagggcggcaatacaattagccttaatacaatggcaaaacatcattagttcactacgttcatttcaatagtataactataagtgttcactgttcagttcaatagttcactagtcaaaataatccaagatgcatccatgatccatcaaaaacataatataaatgttcagttcaatagttcactggtcactgcgttgcttagaatgtaaaaataaaagtcatcactcatccgcatgaggcaagccatacaagcatacaacacagagcagtagagcatacaggatcctaataaatgaataaatgatgaacaattaatcaaattataacttgctattgatgtaatttccgcaagcaaagctcatctttacatttctaatacccaaatttgaaacttcaaataatcaaattggattgcaagtgtacaagaaaacaatacatcaatagttcaatacctaatctatcgttggccgtcacctcgtgtcctcgtcgatacaggccgacgggccgacaactgtctatactggggctggcggcggcggcgccagctggagctgaagagaagcggctggcgcgccatcaccttgtatcctcgtcggtacaggctgacgggccgaccctggggatggtggcggcgccgagaagccgacgacgagcagcggcggcgccaactggagctgaggaggagcgacgctggctggacctaaaaaggaccggccggcacgaatggaggatcggcggcaccaccagccgacagtggcgctccggcggcgcgtgtgggaaacagggtgaagaggaagagacagacggcgcaggcatttggcagagagagagagagagagagagatttggggaggattgagtggattaggtcacaatagatgggctacaatagatgggctacaatagatgggctgaaagactaaaagttgcggattatccgccaaatagtacatcggataatccgatcaaaatatcggataatccgcatccgtcggatatcgttgataccacatccgcatgataaaatccgcatccgcatccgcatctggccggatatctaaaaacccttaccatatcctcacatcggacggattcggagcggatcggagcggataatatccgctccgttttcacccctaagtctatacccccttcttgttcaaataaatggcattactgactttatttagttaagcttttgaaactttgagcatcaaatatatggcaaactccccaactacatatatggagtagttttcaccggtgatggacacaaatgtgattacaaacgcccttttgccaccggtcatccatggatgtgcgaccgtttcttcatcgatcgatctcccaccggataacctcattcaaatacctatctagtttgaccttcgagaagttttacggtccttgagaaagtacctcgaggtacctaaattttacactaattattttttacctcgatgtacttaatacctgaaggtttcaagttttatacttaaaaactttgatatatactttccagtaatttctcaaggatggtaatattgtcctggctccaatcattgcacatttgcatgactagttgtgtattccatccgtcccataaaaaactcaattctaactctaaatttggatacttgcttgtcaagattcatagctagagttgatctttttttttaaacggagggtgtgtgtcactttcatggataggtatgtacatggaaattgtcaaagatagagattggttccaactctatagatgtt

SEQ ID NO: 108598 - DNA, 1071 bp, Oryza sativa
cccgtttcacccctatatagactaatggttgttggtttcatttagatcctattttacctcattgatgagtttaactcaaataccaaggagtcctgtggtcatcattctctagctggatagctgcaacctgtacacttagcatcaaccattcctcaaaattcaacgaaacacccttcttaaaaaaaaacataaattcaacaaaattcaccatcaaacagtagactgactgagccctctgttttcaagattgtttgtatatgataacatgtttctgcaggaataatgtgcaaaacctgaaggtacccaaagacagtggtgaaaggaagattcaacaataggtcttccttcatccaaggggtggatcgaacgtttggaccagtggagtcccactagcctcccttcatgtttattggtcatggaaagcttggtgtcttttaatatgttactatcctattatatttagccccctttaatacattttctggacccgcccaagcctatattaatctcctgcaatcaagaaaaacaagccactagtcacactattgtatcagtccgacctataagttgtaaccagtgcatctgtgcatgagaatctgtttataccttcggataattgcttaacgctgtcttgaccaccctggcacggagagcccttcccctcccgtccctaccaccacacaggattgggtcaagaacgcagaaaggttgtatcatttccttctcagtcatgctagatgaagaaaaaacagaaaggaaaggaactaaaagaaaataaaaatgaatgatgagaaggatgataaaaaaaagcatattatctacgagaaacatacattaatctataagcacatttgcccctttgaatcgcaggattaagaaaacatagaaataggaaaaacgtaaaattttggtaggaatgtaagtgtaaaacagaggattgcaaaacgcaggaaaaacataggaatgatcgtttgattgaactataggaaaaatacagaaattggatgagagagatagactcaaaagaaagttaccaggaggttgaagctcttgctaaatttccttcaaaat

SEQ ID NO: 108599 - DNA, 678 bp, Oryza sativa
actgattgtaacaaaacatttactgaataatactcctatgtgacatcatgttgtgtacaaaaacaagatgaaacccaacaagaaaaactgaacaagggaatatgataaatgcatgcacaagcctgtacaaatagaagcccatacattccaatcctgagatagaccaacagcagtcttcccatatgcaatggagaaattgagcattttggccttcctcctctcagcgccaaaagcatcctaaaaaaatagaaatagaaacatcaagtttggtttaactccatacctattagtatatagccttataccattctaccgggggtccagatatatataaaaaaataaatacatatggaatatgtatgccaaataacaattgataaaaagcactatatgcaacttgccaacttcttcaaagcagaaagaaaacatgaggccctaacatatatttgtatgacaagtgaggttatcaaaattaaattcgacacttttttgtgtaatgaagtcatgttatccgacaaattatgtggagcactaggcacaactgtcacagaattcacatgttcaaatttctttaaaaaaaatgccacaaagatatatttctcaataactaaaagaattaaaatttgactgaatgaactacaatgaaggtaatcatattccatcttatcacaataagca

SEQ ID NO: 108600 - DNA, 501 bp, Oryza sativa
caaaaaggccacacctttaatgtccctcattgcaaaattaaaagattaagctggcttgtgggcgttagcgggtgctaagagattgcgcgagcttatcccgcaccttgtatagtgtacagtttttggtttttgccttttctttgcccctaggggctgtatttttctcccactatattcaatgaaaaggcacactctcgtgttggttccattaaaaaaaaagacaagctagctgtgtccattttctttcttctttcttttaattttctttcttctttctttttttctgcggtgcatgttaacacggccggtcctaacttttcagggccctagcgcgaaagtaaatatagaggccctttcatactatataataataatcaatagatacatatactgaattattatgttacatttaaattgcatttagaataatatttatataaaaaacatatgttacctcaaaagttattatagtactttaactcatataaattacactacaaa

SEQ ID NO: 108601 - DNA, 559 bp, Oryza sativa
ccaacaaaagtttcctcataaagtgaccacctgcaagcaagattcacagaaatatcataaataccttcaaagcccattaagagaaagaataacatctgcagaatgctataacaaatttgagcataagtttggctagtagtaaataaactagacttcacattgacttccattgacattaacctatgtagaagtagaacagatatccatagactacgtgagaaatccatctcagaaaatattctgttgcacatactgatcatgtgaaatgaatcccatctggaatcacagctagcaatataatcatggcatttcaggaaatacggttgctgccaacatgacattcagaaatttcattccaccatacataacaaactataaattgatgacctttccttcttctctgaccttacttcaccccaaatttataatttattggctgggtttagttccaaagtttttcttcaaacttccatcttttccatcacatcaaaactttcctacacatacaaacttccaacttttccgtcacatcgttccaatttcaaccaaacttccaatt

SEQ ID NO: 108602 - DNA, 656 bp, Oryza sativa
aaaaaatccatctcacaaattagccgtaatgtgtgtaattagttaccccctccatttcacaatgtaaggcattctagcatttcccacattcatattaattttaatgaatctaacatatatatctatctagattcattaatatcaatatgaatgtagtaaatgctagaatgacttacattatgaaacggaggaagtatttttttagcctatatttaatactacatgcaggtgttaatcttacttaaaatgaatttggccgattacagaactacctaagatgaattttactgtcttggttttttttccctttgaaatgtggctattgagtaatactaatcaatataagtttggcaattaccgcttgcaaagtctgctttgtttttgtagctgacttgtaaaaattatgggcagtagtatttttttttccttgatgaatggcaccgcacaatctatagactcttcgtgcacctcaatgtcgtgtaaaaatgatggccaaactagaagaaagagagggaaaaaaaagagagaaaagaatggacgcttcggcttcgatgtctgacaaatacagttaaattctctcgacccctcttgttcttcaatttaaaaaaattcaaaaaatcttcacatcttgagattccaaacttgctactagtata

SEQ ID NO: 108603 - DNA, 1605 bp, Oryza sativa
gggcttggtgtgttgggctgatgcaggaaaaagggcataggtgagtgtaggggtattttaggtactacacaataaaatgtgcactttagaagctacaagttgttatattttgggacaaaatttaaaccctataagttgctatattttgagacggaggtagtagttcttttgttctaattgtgaaatgatgacatgctaatcttcattacagttcttgtgaccaggagatattgtctaactcacaccttttgcaggcattagtttgagattgctctcaagaagaatactaatgagagcaacagtgttttatggagcttcagtagaagacagtgtgaagtaccaattgataagtctgacatgaaagcgagacttggagagcattttgacctaacttagagctaattctttacttatttctttcattccaaagaactttaatattgaaccaccaccatctttttcttgaaaataattgctgtaattaacataaaaaaatctttggatgccgatgggggacccaccctgtccatgagaagtgcacgatgcgctgctctaaaatatcgtagaaatttcgctatagagtatgtttgggttaatggtcgcggtttttgttttcttttggtgttcccttgtactaaccccggacttaacgggcttgtatgagtcttcttagactctttccttatcctaaatataatgaagcccaactatcctgcttgtttgagaaacaaaatcctagaaattcctgatgctgcacatacatgttataaaccccatgtattaacatgctttatatgcttataattcgtctatttatgtattatacacaagatttgtcatcaatatggatgcagtttacttttagttggtgtttttggtgaaaactttttttcggtttagaactaatctgaattatctacatcttggtctggtttcatctatttaacagacaagatatattctaaaaaatatgactgcaatgctaatttcatttgatacttggatcagcataatctacattttggacttctttttttgacgaaaatactgtcaatttggacttgctagctagatgtatattatatatctgaacagttcctgcactgatcaagttagtaccagtggcaataaccactcactgatattcttattgggggatttccttgtggttattagtgttgtatacttgcttaaacatattgtaggctgaaattgtaaggtcaatacttgctatcattgttgttatttatcaggtagaagttgactacttgtggtctttccatctgaagtttttgttttactcatagtacatgaaaaattttaaatttgcttaatcttcgcttatgctagtttatcatgaaatgaatcaagatgttccataagttgtaacatgtcttgctggtggtccatgatttgtagatttctgacattgaaagcttaattcttttatttttgtggttagttgacaatagcatgtgatatactcaccttattctgctgcattatcacatgatttgttaacacaccattctacttcaaatttatgttgcaataacgttggataatctcagaacaattaatgtaacctatttgtgttgctgccaa

SEQ ID NO: 108604 - DNA, 2585 bp, Oryza sativa
tcaggttgtgaagcacacctcccaacatgacatcaactaggaataaaaattgtactgattaaatagaggggaagcatggagaggtaatggaattgcattccgcacttctcactaaacttgagcagctttatttgcaaagctgcaggattgtgtaattgttgcagaaaaaagtgcaccagcaacgtttaccatttgttcgatgcatatggttcattacttctatatatgtccgaaagtgccatgtcttggatcatgtcttacattttagctgcctacctttaacattatacaacttatctgcatagtctgataaaacatgtgcctgcatctatacaccagttaacttttttggggggttggggactttgggggagggggggggggggttaaagaaaactttatgttcactgtcaagtctgatactgtcactgtgtcacacacattgcaaaaaagttttaactcaattaatatcatcattatttcctactgcaacaagagtcaatggcagatacttgccccctcatttatctcttgagaaggggtattgattatcatgatccatctaattatgttgagcattatccattgatacccattgggaaaattaactagactactagcattagctagtgtgtgaaagatctctactcaatgctattgtgaacatctctcttttaggcttttaattagccatctaacctgttagtaatgattaagtacatcgctttattcagaggaaatgaggcaggaccaccgacattgatcagttctcttttttaggggatacaacactgatcagttctggcacttcaattcatggctacatcaatctgcgatgtacctttctgcttctgtcgtacgtgtttaacattttcttttacatccacaatctatgtgctatgacaccctaaggactactgtggtaatcaggagcctcgcgaggaatctttcttgtgcgcagtgatggtcatggtttctcttggcttttcatatgatcataaagcaatacaagacatatatcttcattttcttcaaaaaccaaggattagcatatgataatggttagtaaatggtaagatactaatatactttagtctgttatcaactgaagattgagcctgtatccaaggctccattttttttttcttgcttacaagttcatgcatgtccattgcagaaggaacagcaagatgttgaacatgtaatgtatgcactaatgcacatgcagagctgaagagacatgattctgaggtaataagtcagtctttaagcattgcatacttactcattcgtatgtatcttggtggaaatcgtcggcacaaacaagctacggtacagatggccctcgaggatgctcaagagccaaacgctagaagaagagagctaggtgtagccaaggacagacttgccggctaactccaaggcgcttcagcaaagctgagattcccccaataccaggagccggcaagtcatccttggctgcatcccgttctcctcctcacagtgcatggcaacccagcagaagctgcctcagtggttctactgcatactgaacagtacaggtactcttcctacttctcttcttccttcccctaccatggctgcttttctatcatgtggtttgatctgcaagcgtgcattgcaatcgggaggtatggcctgcatttataggcacaggcacaggcaagttgggcttggaatcatatggcgatcactgttcaatggattctttattataaatatttcatcaatcatagagtttgccattttagggatgtgatgatgactcgcgattggttggcctgatttccatttttaaattgatatagtgggccctgaggatgtggcatcctctcgatatgggctgttaggctggcatgatcccctcgggctgttactggggagcctcattggttggttgggactggggattgagctgttcgcctgttcctattggctgctcgcacgtgagcatgccttgtgtgatctcgatctagtgagttttttttgtaacaacacctcaacagtcctctttgtaccccagtgttgccagcaaaagccaagttaattacctctagatacacacacattgaatctttggatatccatgatcttgtaagtagtactctaccttcaacctaactcagtacaaataaaggcattgatcttcgatcatctttataactccattatttgacaaaagaacctagctagcttttgttatattaatttcaatagcttcaagctactttttcaggcatgcatgtgccttcttttgcctggaaatggatgggagcatttggttcatcccgcatataagaatctaatagttacatcaacagatttatggtacatcaccgtgacatgcatgcttatgttaattgtcttgtttttataagaaatgtttgttttattgtacttctattcgaaccatttatcatatccgaatgattttgttaacatagtgtagctgtgaatatagttatggataattaaaatcatgtttgaatagctcatattactattatgctcaatatcgtagattcaatcagtagatgtgttggaaaagacatgtgcgtgctgct

SEQ ID NO: 108605 - DNA, 1058 bp, Oryza sativa
gccatgagagagagagagaaagagagaatgtgactgtgttgtagagagagaaggagaggaatcttcttgaggtctcgtctttggattccagcggcatgagcgtccaaaagcgccggctttggctcccatgggcccaacggtatcctgtgttcttctgctctctgttcatcctgtgagtacacactcacttaattactgctgcttaattactttgtctgctcaagctaatcctattcacttaattaatgccagtgtatattgcccacattctctgttggtgatcagtgtaggtgttttgttactgtcagacaaaagctttttttcattcactggggttaacaggtaacagccagctgtttttaacttgcaaaactgtggttagcttttctattgacaggcttcgtgctatttggcagctcatgataaatgtcaatcatttgtgtcactgtgttaattgcatgcattgtcagcatgctgtactgtttgttttcctgcacagctaattcctgattggcaattgcctgcctgccctagagggcatggcgatgaacattttcagagtttaatgttgctactgtttactgaaacccttcttgtactaccttgagatcttcttctcctttcatccatgcatgcttgccaagtgtctatcttatcttgtttgatcatctctagaaataaaaacaaaagagcaatatcaaattactacctatctctccaggaaagatgagagaaccccaaaaaatgcaggtgtcttttgtgtctgcatgaatatactagctagctgctgattggaagatgacagattcagattcctccaacgaccagcatgctcaacttacatagaaagatgtagtatcatccttaacaagcctaccagtagtagctatttcatttatggggctcgctgaacttcttgacattttcagtactgtctggcatctatgtcgatctcatactaatgctaatttccaagttgctgtcaggctaaaagcagctgatcatctcgaccttgttgccaagtgtttggacatcaaaattaaggcactgaaactttt

SEQ ID NO: 108606 - DNA, 514 bp, Oryza sativa
gccgatcagcctcgccatttccgccgcgctccgagccgcgcggccgctgatacggaacgccacgccgacgccctcctcgaacgcggcggcgacacggcgacggcgaggtctgccttctcttctgcacccatctccaccacgacaaacgagcctgacctcctcacgaactccatgactctgcgccaatgcttctcgccgcggcggcggcacttcgccatggctcgcagagaaggcagcgagagctccggcgagaccttgacgctccgacccaatccggcgacggcgagctccgcctgaaccgactccagcgtgcagcgcagcgcgccgagctgccgctgttggccgtgaccacgacgccggtgacgttgagccgcaggttgggcacgacgacgccattgacgaattcgccggcgagccgcctcgcgctgcatgatctcgtgctctgaaacggcttcaagaagaggtacacattttgctgctcactgaccaccgagctggacagtatcttcacttg

SEQ ID NO: 108607 - DNA, 684 bp, Oryza sativa
atttgaaagagggacagcgtatgattgatatcagttaatttccccatcataaaataagttgattcatagagttccaaatatatcctataataaatttgttcttacctcttaactatcgtctataaaaaatcaagaagttatatactcctcaataccattacacattacatagtcactattagaaggtgcactatagtttatgagaaaatgcaataaatatcattggcaaggcgcacaattctaagaaatataaaaaacaagtgtaagttccataaaatgttatcgtacaattgactttatcccataaatactatcatggttaaggtcgaaatgatataggatgaacaacgtatttaacaggacaggctgacaaaaccctacaacgataacatttatgaaacaaattagtttgtaagatgatattttacagaatttacacccattgatgacagtttttaggctcgtacatttgtcaattacattatttggattttctctagttattttttcctttgcacctaaagcttacacgaatatttatgagctactagtaacaaatgggcccttggacaccatgtgcttagcccacaggccctgccacggtggacaaagacatctggtggggcccccctcattatgtggacaaggcgcccattcgatgcgtcatccaccatccgcgctttc

SEQ ID NO: 108608 - DNA, 1345 bp, Oryza sativa
tccaaaactaaaaaggatgaatagaaatgatgtcatgtcattcaagtactgagtagtgttggtgctatttagtgacatggtttaaaaatgattctttttatgctacattaaagtatattcggactcggacatacactctccatactaaaataagtttaattttatatataaatctagaagaacatgttaaaatatatccaaaatcatatcaacaatcattttatgtatatattaatgcaaacgatcgacaaataactacaaaattcaaagtataatcatacgaggggcgactacgcatattagagtgaacaaaaggcgatttggtgaggccaatctgccactctgcaggatctgagcccagccgtgcttaccatatatatgcaggctgggtgggcgtccgatatagtttaatgcggagtcatctccagatgtaagctaggagttgaaatagttgactacgtgaatttaccgttagtttcttttcaggaatgactatattacaccttccttgtacatctcatagaaaaagatgctcactgtagagtattgaattaaacaattttgtttttcattaattgattttatatactccatttgttcactagttcatgttgtttgggaatacatatacagcctgccgcatagtttgatcttggctcaatcttttccatcctcttaattagggttttgctttaattattccttttatgctcttagttttctacttttgaataaacattgaacaaaagcgttaagccgcatgaattaaatggatatatcaagtatagtcttgcgagtatatatatgcaagggagcatctttaatttagtacaccgttttcaacaaattattttaggcgtctagatatttcaaattttagaatgaaacaaagtactttggttcctcctataaaagaaatactttggttggaaggcacataccgagagcaatttgtgcaggtagagggaacttttggctgcactcgtctatcttgggaccgcctcctctaggctggtaacctgtgcgacatttgcagtgataatctcctacggtgtttctgcagtccccgtggcagggatattcatccgagcgagcgcactcatcaatatctgcatatatactgttcgattcaatggcgggtgtacaaataacttaatttgaatttttttaaaaaaaattgtattggtaaacagacatagatggcatgactagcgtgggatgcacaatagtgcaaactcaatactccctctatttcataatataacacattttgatttggtattataaatgttgctattttttttaaactaattttgtcaaacgtaagaaaagtttgactttgaaa

SEQ ID NO: 108609 - DNA, 2178 bp, Oryza sativa
tgtattgaacgattgttgtttgattacatgggttcaggttctatttatacccgagattacaaaatatgtccttgctggacatgacacttatctctaacaaactctaagataccataagtctttgcggcagacttttgcccaaatatatctctaaggaaattacatgaaatatcctaattaatagatacaattgccttatccgagagctttatctccatcgtggcaatcctcatgaagcactttgaacgattctagaaacacccttgaaaccatcttcatcggaatcggctgcatcacctctatcggttgtatcggctatcctctgtccgatccatctcagctgatgcagactccagccgatgccttcgcagccgatgcatactatgttcttcgaatcgatctctttttcgaatccgcctcgatcccaatgtcaaacctggttcacaatttaccaaatttggtcgtcaacaaatggtgtgggtttaatgttcatgcaaatgattgctctatatcgatcgcaagggtgtagagtagtatttaataatgtaagtgcggtgcttagattatcagatttcactatttgggcttatatgccacgggtcagtagaggtgggccactgatggtgacaactcaatacgggtattcctccacattcgtatataatcctaagaaattttcgtggtatgggtactcctccgtattcatttccgatcagatatccatgacttattgtcgtaaggaactcgataatcagaggtggtctctcgaaacaccaggagggcatagttagggggtattggctacatgattatatactagtaagtgtctggtggcatagttagggggtattggctacatgattgtatactagtaagtgtaaattactgatatctatatactagaagtatatgaatgattattttcttattctttctccacttagcttatattatattttagcagagtaatccttagttctttcttctgtgtcaaccttatcgtacccagaattgattaacccacgcttagactttggtttatacaagtaatatatgaattattagaatagtactctcttatcaaatcttcccttggaattaaataaatacgataccttagattactccaaggtgaaatgctacaatagaatatccgtgtgcttgcggatcatatctgtaaccataaatataccaagaatattttagtgtcagcactgggaattatatttctagtaatatcgttaagaaatatcaacaattatactagttcagaccactcgcaaggtagtatacctaatctagtttatatgggattatagaagaaaccacggagtacaacagagaacaacaaaacttcgagattactgacgagatccttgtcgtgagaacttcgacgagatctattgacgaattggcttaaagtcctctggatttattttgtggtggtgggtgtcttgcactaagattcagtgccctgtacctctctggggtgtctatttataccacatatcatcttggtctccaagtagaacttgaagacaacagaccccacacgatatgacaacatccttatcccctccgagtatgactctgatatctcctattcgtagagattatcccctccgagtatgactctgatatctccgattatttccgtaagaacttatcaatttccttaactcaataggatcatttccatatatttgaggatatactatatccgtatatctcttgactcctaggatagaaggtatgccttattataccatatccgtatatctcttgactcctaggatagaagatatgccttatccgaaccctgacaattatatttctactattgtcatataaaacatctgcagcaatgcatgggatcccatgtagttaattattccatctgttctttaatagatgatgccgttgatttttagacacatgattaaccattcattttattgaaaagttttgtggaaatgtgtaagatatcaatcatgcttacactactaaaaggacacatataagtcagcattataggtgctggaatagctaaaaccagcgaaaaccggcacctatagtgttttccccaccttcgcaggctgaaagtacaaaaaatggtacgagtataagtgccagttgtagagaaaaacccttttttaaaaaaaaattgacacctttatt

SEQ ID NO: 108610 - DNA, 1286 bp, Oryza sativa
gccccaaacatataagtgctgttaaattggaacggagggatgcgactgatggagtagtatactgtgacgacctgggttgtgctatttttttttagtatagtttttccctttgacattgagatggcataaccgtaacagtcgcagttttcctattgtacaatattaataatgcagccatgcatgcgggcaccaccaacgacgatttccgtcggcgaaatttgcccttacgacctccgacgacgactttgcagaggccttccacattgcagccgtacgtgccgacggcccgacgccatgtatgtagctttccgtttcctaactctgatcgcaacatatggccccgttcggcagtcctactaagcttaggcacgcgaaacgaggaaaccattgatgtttgattaattattttaaactcatgaaatggatatatttaatattttaactcaaattctatataaaatatttttcacagaacgtaccgattattagtttgaaaagtgtgttaataaaaactaggacacaatttgtattttaatgaaaactggaacatactaattattttcacttcgtgcatgtgtggtagctacgtgcagtaaataattgactatactcgctcctctgttgcatattataagttattttttattttttttcatatcaaacattcttaaaattgattaagcctgtgaagaaaatatggcaatatttttaacataaaaacaaaatatcagaatatattcaatgctattttatttaatgaaactaatttgttgttgtagatttcgctaagtttttctataagcttagtcaaatctaaagaattttaacttaaaaaatatcaaaacggcttatgatataaaactgagggagtaatatattttgcaaacccctcattgagtatgatctgataatggattattacatgtggcgattaacaagtcacttgataagaagtgtaaattgtctttaaatgaggaaagcacagggcatgttctttttacttgtcctttggctcattttgcttggaatgtaattgccatggtgttgaatttacatactgtctctctatctttctgggatggtatgagagctatcaaaacaaaaatgaaatctcaagtgggtatggtactgtttgctgggatgttgtggggtttatggattacaaggaatgagtgggtgtttgaaaacaaactaatcaaaactcctttgcaagttgtctgtacatgtctctgtccctgatgcaaagatggaggctgctactaaaataaaaaactgcgctgacttgg

SEQ ID NO: 108611 - DNA, 547 bp, Oryza sativa
tgtgtatatgtttctctgaacctctggatgtaatcttgcgcggtttcatcatgcctctgcctaactgctgccagatcggagagcttcatctcatgggtcccactgtagaagtagctatgtaattgcttctccaaatcgacccaaccttgaacaaaattgtaaggcaatgaagaaaaccatgtgaatgctgatccggacaaagacaaaggaaacaactgaacccttaaagcgtcaaccgccgatgcctctccacactgagccaagaatcgactgacatgttcatatgtcgaaacattgttctgtcttgagaactttgagaaatcgggaactttgtatcggtttggcagtggaaccctctcaaaccgctcagggtatgggtgccgatacaaatttccggtattctttggcttaagtctaaactgttccctcatgacatctgcaatcaagtcggcccatggcctctgttgaggtactccttgcacctgttgttgtatcggctcgaactgattgagttgaggaacatattggggctgaggtaatcctcctt

SEQ ID NO: 108612 - DNA, 1940 bp, Oryza sativa
acatttgtcaacggttttattggataaatttcataaaaccctatattatatattttgcgttcaatgtagaaagccaccgaattatggattgtagcacataaaacccgttatttaaattctaaattaatttcagcatatcttaaaaacaatatttttcatagcagtgaatagtaaaaccaacaaacctcaaacaagaattcaacaattaaaattttatatagactccatattttaaaaagttagtaaatgcatgttcatgagaattctggaattggctgggttgttcagtttaagaggggaagcaacttaacatggaaattcatgaaatatctacggcaggctcctaacacagcgtagaatcttatgtattttcctagacttctctctcttgtcctatagtttggagtttgtcaagttctactccatttatacagtacgcatcctaatttcatgaacattctaattcaacagagtgacatggattctaccagcaaacactaaacatatgcatacttatgaaatagtagaacaattttcacatttatttacattttttaaagacttctaatattttttcactaaggtggccaagatctcattcttctggcaattctgatatcaatttcaatgctctgtctgcacttactgttcatctacgagtaatggttcacctcccttagcgccatctaactaaacgagtactggttcacctcccttagctagccatcgaactaaactccacaacgaaccaagcatcaagttgatcctctacatgacttccctatctactcccatgccaatcatgcatcaagaattcaagcagacaataaaatttagattcttctgtaacaggtgaatgaaaatttagattttcgtggcacgcttttcaaactgttaaacttattcaaatccattttagttccgaatctatttccgaatccatttatatatcagttcgtacgtaaactatatatatgaaagttgttctaaagtatcatattaatccattttttaagtttgtaataattaaaacctaattagtcgcacgttattatcacctcgttttgcgtaaaacacttaatctttatcttcatattcatcttcatctttagaagattcaaacactgccaaaatataattcctattgcaatgacagacagattaactcagatgatccatatactgctcggcctatacattattcagaaaggtccagctacaggagtgaccacacttaaacagtgaaactatatatgagaatctgaactacagttgattaattgagactcttcagtcaattcaattctcacctgtcagatttttaactggataaataaaaatgactagtaattgggatgctataaaaaatgggcccaactggtagagctagtggcatgtacagcaacaatttattcaattttcacgcagtgacagattgcatttctgctgacataatggcatatacttcctccgtccctaaatatttgacgccgttgacatttttaaacatgtttgaccgttcgtcttatgaaaaaacttttgtgaaatatgtaaaactatatgtatacataaaagtatatttaaaaataaatcatatgataggaaaagaatcaataattacttaaattttttgaataagacgcactggtggagaaatgctttttagtcccggttcgtaaccccccttagttccggttttccaaccgggactacgaatccgggactaaagatcgctatctttagtcctggttcaaataaccgggactaaaaatcaatcccggttggtgttaccaaccgggactaaagtttttttctttttttttttctgcttttaatattgaatattgatttcacaccatcccctcccatatcgaaatcatcacatatcacagaacatctccaaatcctcaaatcctcaaacaaatcatctccaaatacat

SEQ ID NO: 108613 - DNA, 819 bp, Oryza sativa
actttcatatctttccttattttcccatgttatttttccattttcccctctcacttcttgaccttttcctttcttcaactattttctcttttctccacacacaccaactcgtgcggccattggcccttcttccattcctgctattctcgctccctcagccgtggcacgtgttcacaagccgtgaccagcctataggccactatcacacccattccgggccagcaaggcctaccatctgattgggctgtgtttgggctcaggcattggcacgtgggtcggcatgtcacaaaatattttagcagccatgtcttaagggtattaacttgatgagccgtgccagatgatctatttggctctaccactatcttatattatgagatagaagtagaagtagattagtatattccttccattttaaaatatagcaacctttggaattttatgttgagattaagaagtgtgtactagaatcgaatagggatgagtgttgagatgagaaagttggttgacaaattaaacgaaagatgattgatgcgtttagaggagtgggtaggtgaagaattagttatattttaaaataaatttgaataccaaatatagctataatagtattttaagagggagggagtagatcgtagcaggtggacaaacacagctctgctccatgctatctataaatatacgtaccccccacagacaattggagctagcttattgaaggaaactaaaggaagaagcagctacttctactcatctaagaaaataaattcctaactagttaatgttgtacaacttacatgcctccatggcattctggct

SEQ ID NO: 108614 - DNA, 4755 bp, Oryza sativa
ccgcgtacgcccgctatcccatcgccgtgtctccactctccattcgggctccctcgtccatctagctattggcgctgccctccctcttgtgtcatcaggcgccagcgccggcgccgccgcactccattcccatagccagccgccggagccggtgtctcctccatcctcccggtcgggctaaccgccacgacattggaggggaatgggggttgtcagatcccgccgttccctaccttggggcgactggatccgtccagcgccccatggtcctcccgcagatccccattttcagtgataaacgggtatttccttttaattagtcattcttactttgtgcgcagtagctagcatgattagtttgatgcgtttatgctcaggtgcgagggccacacctccaggggtgggcaggcttgttgtacttcccctttgcggcggtactcattctcgctgaccctggcatctcctcaatatacaagctttacaggtttggtatattaattatcactgctttggatcttaaataactccgacaaatctttttaacttaattattttgctgatcaaaatgcatttgttatcagttttcaagaaagatatataacttgattcaagaatttgttaatcctgtacaaagtttagattttgactatatatagtgcatcacggtcatctttgcttgcctgatcaggaaacgtagacagggatgttactccactagaagtcttgaacataccttataggtgttgagctcagcagaaaatttatatgttgaactatagaatttggataattacttactcagactactaaattaagtatataaaatttgtggattaatgttcattccaatccttttaggggcatttacaaatgcagagaatgcaagtacttcatatgttctgaatatatgcaaactaaagtattttacagaaattcggtatgagtatattaattcaagttggcatttttatacttactgatttgcacttttaccattttgtgtccttatcttcttagcctgaaataaattggactttaattaatgcaatccatctatgtacctctgaagagcatgcatccagttgagatcactgatcattaggtgcggaaaatcttagcacttcttttctctgaaataaactcctatttccgttgtcaaaattatatatatagaaaaatgctttgcaggttagttcctgtagatcttgtttcatcatgtactcagtggttttgcttcttgaacatataataattctcggtttctatactttcctttgatcactaaaaattccagaagtgatggtggcaaacgcatttggataagataaatcttaatttgggctatgatggagtgagtggtctctgttgtttagctatgttttagctgcttaatgttctgtgacaaaatactttatgttaagttcctgtattgcaatttagacggtcttgtcttaagggggcataataatctttagttcctgtatgatgaggtgatctaatcatctaaggcttcctgctgcaatattgaatagtagtgtaaaggacattgaatgtgggcaggttagtatttttgaatcttctagtatgtattcacatttttattgcactactaggccacctcagtttatagattttagtaaattagcaatatacacaatgaaaagaaaactgttgtgttaaggaaattctttatttgccatccagaatgaaaagaacatgaggttcagtgcatccagttaatgtgttgcccctttgttttttaagatcaaactagtatttcacagctgagtttaaagagggaataaattctgatttactcggtatacatacgctattttgtttggccaacctgtgctgctttttacccatgcatgctgttctagttgcggcatctgctatgctctgattaactggcacagctactctggtatgattagctattttggactttggttaggattggaggctgtgctgtttggctattggttttgcaaaccatgactattagagggcagcaaacatctgattatacactaattgcttttgtatttccttttctttaatcttatcttaacatgcactgttcaagaactaatgcatgtacctcacttgttttcagattcctcatactggatagtgtccttaaccttggtggatatggggctgtagcatatgattaggtctgaactgctaagggtggtgctactgcctctggtttttccttagttcaattttatcacctcttaatcaagtgatttatgtgaagccaaaaaggacttgccacccttaggatcgtcaatgtacaaattctttcttagcttttttttttttaattcacaatcctctgttaaaatgctgaggagaatggtcaattggtcatgtacatgatgaatgaatgaatgaaatgaatcagacatttgagggtggttgtcattgtgaatgtcattagctattgaaattggtatgctcatgtaaacaggtgtaatggacaataatgtgaaatagttttctttttaatggtagcagagcttgctgtcagacagtgtgtcggcaaatctacttttttcatcaactcgtctgtcggtaaagatgtttctgtcgctagacatgtctgtcgttgaaggtaatataggggtcagttcatctgtcggtaaagatttatctgtcggaaaagccctttgccgacaggctttcgcctgatacacgtaatctgtcggaaaactctctaccgacagacaggatgatgctaaaggtggtatttaccgatagatgagctgttgcagctttcaggtcatggtgtagtgacttttgtgaagtatgtaaaactatatgtatacataaaagtatacttaaaatgaattaaatgataggaaaagaattaataattacttaaattttttgaaaaagacgaacggtcaaacatgtcttaaaaaaatcaacggcgtcaaatatttagggacggagggagtatatggtaagacttgtttgcgactctagggcagcagagattatcttacagaacatatcccagacgaccgtcagggagcaccattggtaccatcattcgagctggtgctggtcctctaccatatatcatgggctgtaacgaaaatgtccatagagacaaatacaatgtaacagcagtggcggatgcagacaaagcatttgaaaacgaagaaatatttgtgaataaaatttttacatgtgtgttcttagaaatctaaaagcaaaggttgaaaaataaacttcaatgagaaaatttcaaaatcaactctaaatttaagattgaaaatttaaattttggctgataagcataagcgaaaagatgaggcttcaggattcctagcattggtattcggagttacttaaatcatgtttcatagaatttatataaagatgtgttaacaaccaaatttggaatcatcggtgtcaggaaagaagattagatcgaagcgaagcggaggcggagatcgagttcggaaacagagcaagaatcggctggagtccagatcggctacgattaggatcggctgggtctgagtcagactaggtaagccggtacagccgattccgacaatgcaacttgatgtatgatattgggttgaattgaggcgcttcaaggtgattgccgcacatggatagagtcctgagaaggcaattgtatctattaattaggatgttttatgtaatctccttagagatacgcttgggcaaaagtctgccgcaaagacatatggtatcttagagtttgttagagatagtagtcatgtccgttatggacatatcttgtaattctcgggtataaatagacccgagccctatgtaacttttaacacacatgttcaatacaatttcggcgcatcgccacccttttgctttagttttgtttcgacgagttcttactttcaggttgagctgcatcggtttcgatcttcaacaagaggtaaaacttgttatgacggcttgtattctcgggattagtgctttcatctttatgacactctaatcttgtttatgtaattcgtcgagttatcatatatcttacataatctctggcaatatcgctatctaacctacaatcggctaagatctatcgaagagggcagccgattaggttagattttgacgttgattcagattatataagatatctaccactctatgaaacttccagcggcttgatttttagatattgttcttcttttcatatttaatgctgcatcagttgagtttgatctattaagtcgtgcttagaatatcaatctctagcctgccttctggttgccgattagggtagcatcagagtttcagccgatcttatctgatttaactatatttgctctatatgcttcattgacatgttaaatatgccctttatgtcaagatattgtggtatctaagtacattaggcctttgtttgatatattataccggttttaatatcctgatatagagtagtatcggagtattagccgatacatgctagatctatctaatgggctatgctataaacatacatagtcctattattaatatatatttggatctaagtgatttatacggtctgggcatagtgaccgatctatcccaatcacttgatttaagtatatatcgatataagaactatatattggaaatatctacagccgatggaatagatttagttgtttattgtctatttacaactgccgatcgattcacatatgacatcggctcaaagataaatggtatgtcatcggcacctagtcgatcaac

SEQ ID NO: 108615 - DNA, 675 bp, Oryza sativa
cctgtttaaatgattgattttcacgggttattggttataggcaggtggaaaaacatccatatatataaattatggaccacctaaacaaacggttttttatgtaccgatgagtgtcaaagtctaagtttagaatttaaactatttagatgggtcaaaaaaaaattcctaggagcgtttgcagcagaagttccaccaaatagggccccagcgtagactggtaattgggacggatggccaaaacctccaatattgctgcaagacaaacttggctcatccccttaacatagaactgtaccattatattatataggaatatactttacatgttcagggtattaacattggggttactggaatgaactttgcttcaagggttatcattcatgaaaacaaaattttattaatcagaaaaaatgatgatctttcgatatttagaatctactatctgggatatggttatgataagtagggatatatgactgaaccaactctgctgtgtggaggatgaggggttcccagcccctctctcccgtattccacgtgcatgcttttgaaactgctaaacgatgcgttttttaaaaaaagtttctgtacgaaagttgcttaacaaaatcatattgatccatttttaaaaaaaaattagctaatacttaattaatcacgtgctaatggacc

SEQ ID NO: 108616 - DNA, 936 bp, Oryza sativa
tagggtttttatcaaattgcctggatagtttcaatggacaaatggatcaactggagcaaagtattggcactagtaaccgggaacatatcctatgcacactccgtgcataccaactagcaaatgccacgaaaattctacaaaacattatacacatacttcgaataatattacacctatatgtgaaattttatcttcaaattcattatattttggtcgtaataaaaaagacaaaattctgacacatttttaattacctagaaaactgtcagattttttttgttacggctaaaatataatgaacttgaatatgagactttatatatatgtgtagtactaataggagtaaatgtttaattttatagaatttttcgtgatatttgttagttggtgcgcacgagaaacatgtgtacatagaatatgttcctggtaaccatatatgatctttagtgagttacaaatatcctaactattttcatatttttcattcgtaggaaaaaaaacaattctttagcttttgcatgtcagtcgtacatgcataatatatataaacattacactgttgatatatagtaatatatattcatctcaagtgagcattcgttattattttctattataagttgataacaacaaaatcacaagtcaaatgtatttgttatcgttgctaatgagaacttatgatctttgtaggcataagcctgggattttctttcctgatagttgctgcactttttactctaatgatgctccaaaagagaaaaattaatgagtatttcaaaaagaatggtggttcaattctacagaaagtggacaatatcatgattttctccaaagatgatctaaagaaaatcacaaagaacaattcacacgttattggccaaggaggttttggtaaagtgttcaaagggacgcttgaagataatacaatggtggcag

SEQ ID NO: 108617 - DNA, 918 bp, Oryza sativa
ggatctttgttggatttttttttgttgatgtggataatgattttttttggaagttgattgtgcgattgtgttcgagttgattgattcaggggtgattgggagctacatcgaacggctttttttatttgtcttggggcctcaaagatgccggttttagaaccattacctttgatttctctcattagtaccacctactatgtgccggtttcccaatcggcacctgtgcgggggttttcaaccggcacctatttgtgtttatgcagtagtgttaaagtatttttagtgataaaacaattcgcattaaaataaataataattaccaactttttgagtaagacgaatttaacgtccaaaagtcaatgaccaaggtactctctctgtcccatttgaagtgcaacatttgatcatccatcttatttgaaaaatttatgaaaaaatttaaaatgataagtcatacactcatacataaaatacttttcatgttttaccatctaataacaataaaataatattaataaaataatttcaaataaaacagatagacaaacattgaccatgaaaacatatagggaaaatttcgtttctacccctactctgatctctaatattgattttacccctactttttagagttttcgtttttaccctcacttttttgaactgaacgcttgttttgcccctactttggatggtgaagttaacggtgttaagtaattgataaaatgacatttataccctctcatgtatgctcattaatattgtttttgtccccattttatgcatgtagctttagaactttatttttttgagtatatttcaaattacatgaagcacattgactaatatttaaagggaacagataattacattttacaaaatgttgtcaaatttttgtttaagttctatcaaaatgctgaa

SEQ ID NO: 108618 - DNA, 506 bp, Oryza sativa
atacatgtaatcgcacgacttcgatcacattcaagaatttcatagagctaaagtagcttggaatgtgtatagaagctttttatttgtatagtaaacactatatatctaatgatctaaatcgtttgttgacaagctacaaagctaactaatatttgcttcatcatcaaatgaaatgtctgctgaaaattatattgtcctgatcaatactatttatccaatcctgcattgatgattttatagacaattttctccatacgatcagaaaaatcgtaggttgttaaatggctttacgaagagaattcgacttaagaaaataacataatattgccatgactattcatcccccatggtagccaaatgaccattttgcttgccgtttctatttttcttcttattttctttctattgttagatataggtacataacaatcatgacaattttggtaatttctccccaaattttgaattagtaaataatataaaaaaataattgagactctgaacca

SEQ ID NO: 108619 - DNA, 1482 bp, Oryza sativa
atcaatctgcgcactgcgacctcaaaggaaaagttttgcttctcacctgtcctcgcttttatacagattaaattgaaatctaaataaacacccagtgatttgcaggatgaaaacatacacatgtatggagtttatgtgacggctaggagagtgggagagtggcacagttgcttgcaagacatcttttcccttttgaaacaaaaaaaaaaatattttatatagtgcaagatatttggtcagcgagcaaataaaaatggactagctctgcactttgattaggcctttgcttttatatataaactctttttagcattctttttgtactgctgcttcggagtgacatttctcattcagctctgcacattatctctgattttttttttcagaaaagttagtaattatttttaaggtaagctagccatatgaagttttaaaggtataacctctattattaagtattggttctctctggtaaaaaaaatacaactaatcaatctgtgcacagcgacctcaaagcaaaagttttgcttctcacctgtcctcgcttttatacagattaaactgaaatctaaataaacacccagtgatttgcaggatggaaaacatacacatgtatggagttcatatgatggctaggagagtaggagagtggcacagttgcttgcaagacatcttttcccttttgaaacaaaaaaatatatatattatatagtgcaggatatttggtcagcgagcagataaaaatggactagctttgcactttgattaggcctttgcttttatatataaactctttagcattctttttctgctgctgcttcggagtgacatttctcattgagctttcagcgctgcagttgtcaaactattaaagcgacttgatagttctgcatcatgggtagtgtgcctttagactattatgtttttttttttgccttttctgcaagcttagttcaatttttttatgaaattgtgcaagatgttaggtcagatccatgcttactattgcacaaaataattttaaggcacctcttatatctatatttaggagtatccgtcactgcagttttttgctttagtgccatactgattacttcacattaaacatgcctcgtgcatgattaatttttgtattgtgcaattagtattcagtgcttctaaaacattgcgtattgatattggagtttggcttttgatattttatttatggttgctgtataatgtgaggctattactacaacatgctcccacaatttcatcatatatggctattcattcatgatactactgcttgtctgtatatacataccgattatcttttgaatccattatgaattctggagacattcatttgctgtatatacatagggttttgtttagtttcatcttatagtgtataaagagtagaatcagctgtatagcaatttaatcatgagaccagagggaggttcaaggccctggtaaagaaacattttctcatgc

SEQ ID NO: 108620 - DNA, 515 bp, Oryza sativa
tttgggacaccggcttcaaagcggagcaaacaaatggtttagatttcgatgcccatgaccattcggctacacacatatccacattctcatcatccgatgacatgagatcatcgtctacaaaattgacagggcgactagatttatcattagacctctaaaaactcttggactctttagcacggctttcttgagccagagcttgttgtaatacctgactaacatctaaaatgattttaccctctaacttttctttaaagtgtggaagtaatccagaatgtgctagttcagcaaggtccttgtcagataatgctaggctaaaacatcggtttcttgtgtctctaaatcttctaatataatcaacaacaggctcattatatttttgcttgaccgatgtcaggtgtgctaacctcaattatacatctccagtataaaagaactcatgaaatttctgctccaactaagaccatgtatgaatagaattgggtgcaataggggtaaaccatgcgaatgcagta

SEQ ID NO: 108621 - DNA, 653 bp, Oryza sativa
atttaaaattaagagtacttgcgttgaaagtaagtgccacatccaatgataaaagcttattataaatcgtaacgactaaatcattttttatctcttaaaaagttaataatgaaaaaaatcacattaaaaacatcaaaattgctaaatgttagcttttacttatttttatttctttatatggcaatcactagccctaattctacggggctgttcaacgatatatttaaccatattattttttttgacaaaattattaaaaaattcttacatttagtttgttgttaaatctttttaaacacataataaattatgttaaaattttaatgatattgtcaacttataaaaatttaataagatttattttgacaataatatgaacaaccttctccaactttctcaggagtcaaccacaaacaagcaacaggttaataatctagtattctagtaataggtaaaatgggacacgtggcacgccgctatagctctctagactagagttggagacgttgcccagttcccctggaccaccggcgccaccttctgcttgaattttttcctcgccatcgcagtgcgccatctatccatctatcgctagacattgcttttttttctttccaaaataatagacttgaataaacctaccgcctattatt

SEQ ID NO: 108622 - DNA, 1350 bp, Oryza sativa
ttgggttaaatttatggacgtgacagtgaggatgccacaccctcacaaattaagcccttgacgtttctcatgatgagactgtctggtgatccaagaacccagtacactcaccccattaccttcacaatagccagtttgctctgggtatgaacaaagatctttttagtaatcaaggtgagctagatgcttagcatgaacaattacataaaactagttatactcagccgcgttgctgtggaacattacatgccaaatagctaccattcttttaaagatgcacacactaagaactgggcatgaaaaacataaaagaaagcaaaggcaatgcagatgattgctttatgtaaaactcgatgcatgtttacaaaagaaaaaccgctcagtattagtatgctgcaatggaagattaatcatttaattttttttttgggatcaacttactcaatgtatcgtgagaacagtgaagctacaggagaagcaggcaggttctgctgttctgcgtcgaagatatatacttagggatctcggatcagccatgatccattgttaaattaagggcaagataaaaatatactccatctgtcggcaagataaaaatatactccatccgtcccattttaagttccatccgtcccattttaagtgcaatcataagtttccgtgcttaattttaaccgtttatcttatttaattaatatttttattgttataagatgataaaatatgaatagtaaaatttaaataagacggacagtcaaagttgtgcataaaaaatcatggttacacttaaaggagggagtaagatatatataaagggaaagatttaattgctaaacttattagccaacttgaaaaaagaaaagaatattaacattagctaccaaaaccaagctgacagcagaaggaaaaaatagtgaatctttttttagatgaaagatcattattactccacagattaggggaagcgatgatgactgtggaaaaatcaaactctgatagcaataagaatgagaatgtatcacatagaaaatgttgtgcgacaaaagaaaatccaaggaatgatctgaccttcatgaacactggatgcaaattgactgggacgacggtgtgaactgtgaagtgtctgcggcagcagaggaagtccaaaagccaagctaagaaattgtctgcgagaaggatggaaacctaggcactctatcaagtatattatgtgcgtacgattttagagttacctcacccaccggcaggcaatccaattcgaatgtgcataactcagaccagaagtccagaaccaaaacttgattatagcaaaataatagacatgaatttctccgagcgcccacatacgta

SEQ ID NO: 108623 - DNA, 1122 bp, Oryza sativa
ccaggattggttcgccgaaccaacctggggctggcccaatccagcccagtttcggctggtggcctcctctattgctccatccgcagacttgtgaatttttggcccaattcatcgtgtcaattctgagttcttggcctattcacacacaagtctggttctcgacatcgtccgattgatttattgtctgagttgatgtcggttctcctctactttatgatcattctctgcaaaaggttagtaaacctaatactagtggaatattattattctgattaacatatgcattgcaagcatcactagttctctcccattttagtaatattgactgtcgaaactgatcgataacgaccgtcaacagccaacaagggtagggctattacctgattccgatgaatacggggcccgaacctatataaaaatcagtctctatctcttttacctcaaccccgcatattctgtagtaccaacaatccccataccatgcaaatatcgtagtcgtgagaaaaaacgtcgacagattccaatccagaagtggtatgtttttgttagcaattaactaaccgattcaccttggagggatatattttaattgtgtgatttggtttggcactaacaagggaagactaggggcacatgagctgcatgctcaaagctttgtaaaaaataactttgtcttacattctcatcactggctcccaatgtggcatgatctaatcgtcatgtgtcacaactggagataactcaatatgcattgcatacgtgcgtgcattattccatgttccaggaggcgaggtacataaaagttgatacaaatcaaagtttaacaagtagaagcataaatagtacttattacacgggcaacccaaaggccagctcatagagaaatatgaagaaacacggaagactagggcgaacacgacaggtgtttgacggcagacacgagctagacaccgaacccatcctcttccaagagctcctcttctggggtggaagaaaaatgagcgagactgagtacaaccaccatactcaacaagtcataccggcaaacgcacagtaaatgcaaggaagtacaagggaataataatagggcgttaggttttgcattaaagtagcattttaaac

SEQ ID NO: 108624 - DNA, 729 bp, Oryza sativa
ctgtcggggtctcccttgcaattaattaagatagtctgcacgcgcgcacgcactgcacgcacatggttactgcattcaggggaagctcgcacgtgataataacttgttttcatgggtcgcaaatgctctctaaaacttgcagtgcatcataatttaaaattacaaattaattccatctgctatgtataaattaaacccgataaaaattttaaatacataaacatttagggcgcccttcatattgtactgccagtacataaacatttagagcccctttaatttgtagaaaaaatataagaattttagaggatgttaatcctattgaaaaaaaaaaatctatgaagtcctttgaaacaaaggattgaatcctctcgaatcctttaaaattcctatgaaatgggtaattctatatacattttggaggaaagttagcaaaaggtttaacctgttgaaaaattttctccgagtctatctttctaatctgattcctgcgtttttcctatggtccaatcaaacggtcattcctgtgttttgtaattctctgttttacaattgtatttctgtcagaatcctgcgtttttcttattactctgttttttcatttctacgattcaaagaggcccttaagataggtgatttttcatatcactataagaatccagaatttttatgggactacctatccgacatgcaacataaatctaggtaagaaaacagtcaccttccaca

SEQ ID NO: 108625 - DNA, 904 bp, Oryza sativa
ttgacatcgtccgattgatttatcgtctgattcgatgtcgattctcctccactttatggttattctctgtaaaaggttagtaaacctaatactagtggaatattattattctaacatgaatatgcattgcaagcataactagttctcctctattttggtaatattgacggttgaaactaatcgcttacgaccgtcaacaatgagtcagctacggtcttcaacataggtaaatttgggatgcaagttacggggttcaagtttcgtgacttaaaatatgcatgcaactcaatttcacgaaggctagcagcaaccttatcacattctacaaggagctccgaaagaccaagtttcctatgaaatcttttcttgaagacgttattcatactttcgcaactttgagtcgaggtcatatcagttgtaaaagagtcacggaacacaatagcccacttcttcctcaaagcatacagatttgacatccatacgttatcctcaaacttgtattcactcaacaattcatgctacatcttgttgaaatgatactctgatctgtcctgatagacacatctcttaaaatcagttagaaacttgttaggatgcttatgaattacatgaccaagatttttacaaccatttagataaatgtgccacaaacaaagacaatgacttatatccgggagtacaaaagcaattgctgctgcaatggctgcgtcttgatcagtgaaaattgtgctcggatgcttgcctgacattgctattagaaaggtttcaaagagccaaacaaatgattcaatagttagtgtggataatataaggtaaaggaagtttataacaaagggaaatttcagtctatattgtagcttaccttgcatcccaaatctgcattgtttttttcaaagtttctgtg

SEQ ID NO: 108626 - DNA, 717 bp, Oryza sativa
gaagattgaaggtaaccacatgccagcttggtttatcagattaagttgcttgcaccatataaatttagaatgtgttgcttgcaccataaccacattacagtttctcttcataatgaaatgaagtgcagtcctgcgttttcaagaaaaaaaaaagtatgtttggttcaaacaggtctatgtacttgagagatgcatatttatattcctacagctgcatatgtgggtcagcttaaattcaattgatcatggaatggcagcctagcaggcgctcatgtggctttgatgtgccatttttctccagtctcacccgcagcaaagctcatctgtgagaaagccctcccatgctagtttctatccccacacttcccttttctcctcctccagctacaccagcagcaaagctcacctgtgagaaagccctcccatatgcttttttctgtccccacacttttgaagcactatttactccttgttttccatctcttctgccacactcattttacttcctttttctcctacaatataaagccatgattgttttctctctggcgaaccacagtgactgataagtgtgtttctggattaatttttcttcttcacacgtatcctctactttgcctgttgagtgttgagggccccaattctaacgtatcccagtgcctgaggtcactttgtcatggtggttcaatcttaccagctagccagctatgttttgag

SEQ ID NO: 108627 - DNA, 796 bp, Oryza sativa
ttgaatcgccctttgcctagcacgtcgtctatttcagccctggtgacctttgatcactgacgatcgtccccaccctaatcgtcgtctctttgcctcttctcccacggctgcagtgggagtctatttgggggcatactattgcagagggacataaatacataactcttgactccgtggatgactacattagtgcccgagctgtgtcatttgcactctagacctttagttatacattaaaccaagattagggatctagatttgcatttttgaggttcatggaactacatgacacctcactccatgtttaaggaccaatagtgtattttatactttgagcaatgaagttttatgcaaaatcctttacaattagtatattgcatgaaattaactgccattggctgctcattaattgtcaagccacagccagaatttgaattttagaacttaattgtagattgattttcaatttttttttattttcaaccttggcttctgaacagctagattgaagtataaaagtctagccctaaaataacttttacttggttcatttgtcttggatgcatcttaacctttaccgtgaaaatctaatgtactaatttatttataattaaccagcaagatttttttttaccaaaatcaacaagcttttttggtacatagaaaatgatacacaaggtcaaaatcatgtttttcactcatctactaatggtatgttgacggaggaagggaaaataaaagataaaatttgagaatgaaggacagggagcagatttcatgagggcaaatgagagaa

SEQ ID NO: 108628 - DNA, 3928 bp, Oryza sativa
aaagatgttatatatatagatataatctattagtaccaaataatgggtatgtatagatctaatctaacggtataaaataacggtccatcaatttaaatgaaaattaacggtgagattagactatgccacatggtgacttaggagcgtttgtaggattgccacgtggccgtttgggagcgtttgtaggaagtttaatgtacttttagtatataatagatagatagatagatatgtaataaatgattaagttttttttggttaatagtaataacgcagctcatattgtaaaatttataactaaataacctaagttccgttttaatccattcaagttgcagtgaatctgttaaaattggtttcttttgctgtttcagtagccttattgcttgtattttttgtatgctttgtttatcatttagattctgacagtttcggtgatccagtttattttgaagtggttgccgagattccgtcagctcaagagtaaggcaagtcatacacatgttaaacctatttttataaaatcccctgctttctattaaattgtattgtttcagaatgtcatgtgggatggatgcctatcgtgctcagccaattgaatatcttatgccattgaaaacttgggttataattgactagatgattggtttaggaatacttagccatgcttagatcaattagttcataatggaattcattataatttagtccttaattatattatgacgtaccaccatggttatggtttaattaactaaaatatgcttaaatggtgggttgggggtgcatgattttggaagtcatgcccatggcaattaagaaccagttctcaggaatccctggaagatataatcgtacttaccagctggtaaaataacttgaactagctgacatactatggcaagggaaaaggcgatggtgcagttcggacctggatattagtctctgcagtttccagatttatctagacacgagaggagattgcctgacttggaacaaggaaggggtggaacctgaggtgggtatgttcggttagggagggttatatgaagggtttcgtcataatttccccctttgtagtatcgcggtgatactttggagcatggtaacatgtgtggaatcgtatcttgtgggtaaagttgtacacctttgatcagagttaaaactattcgaatagccatgtccgcggttattgggtggtcaatcagctcaccgtgattagtctcagtataataatatgactcattaaactagtgtagttcagatggtttggttgggcctgttgcaacatggttttagcgttgaacagtgatgatttaatattgcttaattacatatattgttttacttattcaaaatatgatttataaatgctgcttttattggaaatatccaatgagccattcctttgtgaatatcttacatcatgcatttccgttggtatgacttgttgagtatggtggttggtgctcagtcttgctttatttttctccaccccagagagagacagagattggttcagatggtgagttctatgagaattgagcttgttccggactatgagaattgagcttgttccggacgttgaggatgcctgtggtttatggagaaagctatgcttttggtcatgaagattaagtctagcttatttgtttttccgctgcgtttgtaagaattatttattatttttgtaaggcgtggatctgtttatcaaattgtcgtttgtctactctggctgatcctagatagagattttaatacacattctgcttgaaattcgggttagcaaatttctgggcgtgacaagaagaaaggatcagcaagcttcttccacggtttttcacggttgatgagcaaatagaaagaacaggggagaatggtgcacaaggctaactagagctatttatgcactccaaagctaacggctagatgaggcccgatgtcagttgatgcaaacttaaaaaaatatatttcaaatggcagatttcctacatttttcctatggtatatcggaatgcacattttttttacaattccttaggtttagcttcccataggattggacttcacagctatccttattccttcatttttttagggcaacagcaatgtataatgctcaagtgggtattatggtgggtcctaggtgggacccactactacatattgtcaccttatcaggtcctgtttgtcgtgtcttctaatttacttaattttgaaaattagcattcgtgtttatttgcctaaaatagcttaatggaaatttcataaatgaaaaaggtttaatttgactaaataaattaatcacaccgccatttattttatcgtttgttaattagagttatttggtttctatttgagttttgggagtggagctcaattttggaagtatttattctcaatccagagaaattcctcaacagtccaaaatctctaaatttctatttttccagaaaatcctattatccttcttgttcctcctttccttccttttcctctctttttattctttttcttttcttttttcctttcttactagttaggtgtccgtgcattgcaacgggtttaataaagtatatcgtttatatattgcataaaaaggtgaaatgatattctttatatatattgaacaatgtaacaatgtaggtgttggaacaaaatccaacatgcatggctagagcatccctccaatgggagggagcccaagcttagccctatgaggaccacaagagtgaatgagagagaaagagaatcaatggaatgggggagagatccctctcacttgcccttggaggactccttttattcatatgtaaaagaaaattacatctttgctcttgattggctacatatatacaacatcctcttagatgtattttagtccttttatacattagtttatacaacaccctaagtatggggttattcctcaacaataccccctcatctgctggctccgaggttcggggggagcagatgatttccagcccctgcttcttagggtgttgatctatgcctgcattttgcatcggataccctcatgctcagcaaagaccacactgaaaaggcgacaccgtcttgagctcttgagatgtggagtccggtccaccccctctagcggtgaaagccgcggtgctcgacggaggtaccaccgtccagagcccgcgagaaatggaggtcagtccatcccctctagcggtgaaagccgcggtgcttgatggaggcagcgccgtccgtagtgcgcgaaggcgagtgccgggggtgccgcgcgaagccacgcgtggctggtggagcttggctttaaggcaggcgtggccggcggagctgtgcggggccagcggaaggactgtagagtccgccggcgcgagcctctgcgccgtggcgtggtccagcggaaggggccgagccagaggcaaaatgcgccccacggggctggcgccgggcgcgagtcggcggagggtgtggcccgcggagtcttggccgtaggcgcgggggcggcctcacgcagcgaggccggcgtaggccgcttagcgattacgcacgatgcggaaccgcttccgcagcgcagagtcgtgctgtctttcttgcctccttttctccttcttcttcttcttccttttttttcgtcatgaacagtgccatgcgcatgcatgcagcttgcgcccgtgcatggcacttacactcgcaggatgggaatcaaatgcatgtgcatgcaaccgaaccacacggggctggaaaccgcttcggccgttgtcgacgcggagatggcgactcgcgacaaaggcgaccgcggggcttgcccacgcggaggcggcggagcgggggagccgcgaccgagtcggcggaggcgcgagggatcacgtggaggccacggagcctcgcgggtccacggtgttgaaattatgagcacataatgatttaatttatt

SEQ ID NO: 108629 - DNA, 912 bp, Oryza sativa
gagccacgggtttgacctgtagcactggcggtggttggtgaaggacgtggacagcgcctggtaggccaacgccgtgcccgtaggcagcagctgcgccaggttcgccgtgctggccataaccttgtcagtcatctccggtgtcggcctagccgccggcagcgcaggcgcagctgtcgccttacgctcgccgacaccgttgggcatcagcgtcgtggccatgcttatatctgcctcaggagctgcctcgccgtcaccattggtttcttgtggttgtggcatatcaatcagcttggtctcaagtgaggattccattacttggttttccttgtgcattaacgaaatccggttgataattatgtataatacgttacgttcttgaggatttatataggtgaatcgtttgcagttttttccacgcgtggttggtacgcgtgcattggattaagaggaaatggtcaaccagagactaagctgagctaggtagttggaaagttggaatcattcttagctttggaattggtatactagttgatcctcctcccatcctaaattattgggcgccccatttttttttaaaatcaaagtcggtaatttttaactaatgatcatactaaccacatctataataagtattatatatgttatatcactagatttatattttgaagcacttacatatgatgttaatttcatattcatcggaaactttacatagaataaattaaaagtcaaagtatgctgctcatctctacaaatggattcatgcaatccatactgaaaccaaaccttatgtttcatacagacttttcgaagtcttgaaatgtgatgtccatgcttcgccgatgcatccatgggcagagttttttcccatatgttcttttaccgtgccaacgcatcattttaacttgagct

SEQ ID NO: 108630 - DNA, 1062 bp, Oryza sativa
ttgtgattcactgatatgtataatatgtgatgtatttggtttgtgtgtaatttttttaagatttgtgatgtatttgatttgtgtatacaagtaacttaagatttgtgatgtgaatgttttgggatgttagtttgatttgggaatatgcatctcactcgatttgggagaaaatacagggaataaactcgggctaaaaaacaatggaaaaaaaagaaaatgagacctattgggactgccgctaccctctaaagataccgacaccaaccaggactaaagattgacatctttagtcccggattgctagtcccgtttgaaaaaacgggactaaagaaagttaccaatcggagtataaacggtttctccagcagtggtagttttgtgataactctagtattaaatctataactttgtgatagttggcttaaatatgtaattttatgataagtcatgtattaaatttgtagttttgtgatgcaacatcttaaatcaatagttttattatgatctgatcaaagtaactgtagttttgtaaaatttactcaaaaagtattcagattcgttgtattagttatgtcacatctaattcaaagtttattttatgtgatgaagggagttggtggttaactagcaaaacccacttatataccaaaataagccataaacccgcttattttgatgtatcaggacatcctcaatgtagtgcaaaaatatttcataggtaaaaaatattacattcagccatatatataaagaaaaaataataaaagatatccatatatatatatatatatatatatatatatatatatatatatatatatcatttgacagaaaaccccctcacaaatcttgcaaattttggaccatccgattgctttaagattcgtgcaggcaaccaaaccctaaaaatcctctctcctctctctcccgattcctctcctctcccgattcctcacgcgccgccgctcctcagcgtctccgccaccgccgccgccaccccagcgcgccaccgcctggccttgccggctggccgaatggtgtcaacggcgccggcgaggcccg

SEQ ID NO: 108631 - DNA, 953 bp, Oryza sativa
cctaaatagcaagattccggagggctatttaataaccctccggatccaaacagggcctatgttgaatggacgatggtgtagatgttgaagttaaccatgtttcaaccataattattaggaccggaccggaaaacaaagcggccaagcctcggttcagggattttctggtccaaccggttgaaccgtaggatagctttgtgatgtagttcttttattcaagggaaggtggagggttcgaatccccatcccaacctttttccccccattttctcaactctctctcctctcggttccctcctgccatccttctcatcatccacgtgcggacccaccagtctagaggccctggtttcggttttttttcagccagaccatcgatctggttcaatcctaataattatggtttcaacctagtcaactagagaagcaaaatctataacctttagactagtagtacaaagaggaatacccacataagtgaaggggaagtgcccggtgaatagctaaagtcgtcggctaagttttcagctttatcatggtacaaattaaacggaaacatgcattaaatatgtatcatgataaatataataaaatcaggttacaaacttcatcacaaatatttgtgaaaattcactttcagaccagtagaggcaacataccaacccatgatgatgatttcccaatcattcaatacactggtgacactttgctctttatgaattcttctcagaacgagctagtttcacggcagtttgaaaaatcgactagcaacataataatcaaaatttggatttatcaatcacaaacaaaccaacaattacataccaacatacaaagaaagaatatcatccctgaaatttcaactatttccaaggtggtgtactactacatccatcctctcatgcacgttcaaggagcattttgcttcggcggacctgcagcttctcttgcca

SEQ ID NO: 108632 - DNA, 4441 bp, Oryza sativa
gaggaaggggacggagaggattgcttggaggcaaccacggtggtggagcttcggcaaatctccaccatggcgccagtcggggcagcaatggagtggcatgatctggagggggtgtcgatggcagagtgtagtggagggcacgtgggagtggtcgtcaacggcggagaaaagcgagcgatggccggccggccgtcgccgccgtgagggcaagagagagagcaagaggggaacagcggtcgagtggcggctagggtttgggggaggtggagcctggagggatgttcggtttcgcaaaaagacccctcactttacgcttttcagagcgcactcctgttttccgaattttctcttcttagcataagatatttcatatttcagagggccggggcgtaagaatacatggctgaggaatgtacgtctagggatctataacaaattatcggtaaaatcaagaggttttttgaaaagtgatcagtcccacaacccggcgctcgctcgcgaaatcttgctacctgggcgttcgggggcgacgtggatagcgcggcgatcgaacacacgactccaaatcgctgtgggagcttcagttgggggcaggttttaatttaaccgattcttgtgtcctcctccaacacctttcatctctacgagggttttcactttcgatttcaccgaaaattttgaccttttcgataaaactgatattcccaaaattttgagatcctcggcactttttggacaaaaagtttatgaaattttaacacaatttaattgaattaaactaaaatttgaccaaattcacaaaaaattgagaaaaaccaaaatttttggtcgagatagtggcttgccgaggagagggggtatccaaaattgcaatcactgatccctaccaccatgcctctcccatgcactaccttcgctctagccacactctctcaacaggccttctccgggcgtgtagccacccacacggtggttggtctgggtgtccatggagtttttatttgtcaaggcaataagttatatgcggtacttcatctgtttataaatattttgatacgtaaaacaagatttagtcaaaagttaaaacttagacaatcacttttgtattacagtaagtttataaagaatctagtaattaagtttatgatattacatacaacaatgcttttcaaagcaaatatactcatactattttttttacttttaaagtaagcattatatttgagaaacttttgatagctaaagttttaaaagttcgtcctaacatcaaatatatgaatggagacagtaaataaatactccattagtcattattttttaataaacggtgccattgacttttaggataacgtttaaccattcatctattttttaaaaaaaattatataaatatcatttattttttttggcatgttttatcattaaagaaactttaagtttgtcttatactttagcatatactccctccgtttcgtaatgtaagtcattctagcattacctatattcatatatatgtctagatttattaacatctatatgaatatgtgcaatgctagaatgacttacattatgaaatagaggaagtatatgttaatttttaaaataagacaaaggctgtgttcgctggtgctcgttcccagcaggaacagtatgcacagaaaacgaaacggtctattagcgtgtgattaattaagtattagctaattttttttaaaaaaatggatcaatatgtttttttaagcaactttcgtatagaaattttttttaaaaaaaacacaccgtttagcagtttgaaaagcgtgcatacggaaaatgagggagagggttggtaacctggaggtctgaacacagccaaaggagcaaacgttatttgaacacagcaaaaattaaagatgtttttgccggtacttttggtacgtcatccgtgtatgagtcggtttttaagttcattcacttttagaaatacaaatccgtatttgagtcggtttttaagttacttcatttttgggaatatataaggaatcgtataaataatctcttaaaaaactcgcatgctaacttaagatgatcgggcttctaattgtagcacatgtttttctaacaaaatatatatccaagcgaatttaacacaatgaatttcaccttaactaaacctataataataataagattaaaatagtcttcacctattgcaacgcacatgcatttttctagtctactagcaaatatgcccgtgcgttgcaacgggtgaaaaaacgtaatgataatatacgtttttcatgcttaaccatgtcgataacaattagaaaattagaactacgaaactttattttctagataacaattagaaaattagaactacgaaactttattttctagcgcgttttcttttatgctttattctgacatttttccctcacgtgttttttaaaccgtttttattttctcgcgcatttattccttttttaatatactgtagaaacttctctttttatagttagataagattagattagagataaagaagatatataaatggactaaaaaacgacgaatataaatttgacttttttcctccgcgcttttttccgtccttttaattattttctcgtgcatttcttttacgaagggtttttttcaccactttcacataatgtcaaaccttactagatataataggattccattttttttaccgcatcacgtataattcctttttctttaaaaacagacaattttatggcccttttttatcgcgtcaacggagtcagaattgttttgattttttcccctttttttggatcggacagattttttttttgcccggtttatttcgcccgatcgattttttttaccgcgtcacatataattccttttactttgtatttttttcgccctttttttaccgcgtcgacggagtcggattcgttttgatttttttctccctttactttggaattttttcgccctgttttcaccacgtcgacggagtcggattcgttttgatttttcccctttttggctttttttgataggacagatttgtttttttttcgccccgtttttttatcggacttttatcttttttttcgcctggtttttttattttttttaccgcgtcacatataattcctttttctttatcggaaagttttttttcgcctttttttaccgcgtcgatggagtcagattcttttcagctttttccttttcttttatcggacaaattttttttttcgcccattttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttctttttttttttgctccacgatacatataattcatttttctttggaataggacagttttcttttcatttttttaaactctttttaccgcgtcaatgtagtcggattcgtttcggtattttttccttttttccctttttttttgtcggacatatttgttttttttccgcccggttttttttcgccaggtttttttatcggacttttctttttttttcgctcggtttttttctcccgttttttgacggacgacagaagcacctagagaagtgttttttttcttttctccaatccaatacagatcggatctcttccagggaaatcagattttttttctccagggaatcggactctttttttcgctttttttattcattaaacggtttgtctctcggacttttttttcctttttaagggatcgggtgtttttttgccagggacgggtgtttttttcgcccggttttttttttcactttttttttggatcagactttttttttcgtccggtttttttgatcagacaaacttggttttttctgcccgttttttttcacccggtttttttgacggacgatggaagcacctcttattttttaagtagatagtagatagatagattaaaaagatgtagtaaaaacacgtacgaaaaaagtggctactttcaaatgctactttaacaactgttgctactttcaactctggctggaaatagttggcatatgtgacgtggtctcatgtctattcgtgtattagtgtattctaattctactaatcggattaggataggccgatcatagagttgatatatagcctcttctccaacggtaatctccctccgacgatgcactggtagagaaaccatctttggtcggtcgacccattatccataatagtcccggttccattaaaaaccgggactaaaaatgatttttagtcccggtta

SEQ ID NO: 108633 - DNA, 585 bp, Oryza sativa
ttctttccgaactatgttacacccaatcctataccatgccagattaagaaagccactagtagccaattctttccaagacatgatctcttaatgatttttactactaattgaagggaccgtctgttggtcgccagaaaaaaattgaatccgtcagtcaatttgtgtgagcattcgatctgcatccaacgggcgtgtgacaaagaaacaaagggagttagtgggcccgtagcactccttttgcggtcccattttggggtctgattttttattctccgtattgggcttttgtctttttctaggcaatgtgcaatgggcctgtatgatgttttattagtggaaaaaaaaatcaactttaactcccttaaagtaggctgaatctaactcgtatcccttaaccagaaaaccgggtagaacgaccctgagaaactggtataatttgactccttcgatggttttggagggcggtttcgctgacgtggcgctttaacccgatcaactggttgactctgtatgtgggacccacatgtcagtgtcacattttcttctcccttttttttttctctttttctcctctttctagcccgg

SEQ ID NO: 108634 - DNA, 538 bp, Oryza sativa
gtcaggaagccgctcaaccccaccgtgatggcccggctgtggagggtggtggcatggcccatgtactgcctggaagaaaggattcaggccaatgtcgttgccaatgctggcgctggtggcgaaaacaacgactacgacgacgacgtagttatcgtcgaggagccccaagtgcacttcaaggtggtgagaaaaacgtccggtggcagcaggaagaggcaactgacaatcaacgtcgtcaacaacggcaaccgcggcaccggcagcggcggcggcggcggcggcggcgcaggttcttacccccagaaacaccacttacacttgcatgcatgcaatatatactgatctgaaattgatacagtagcttcctgcatacatggtccgtgtgacgtgtattgtaggagaaaagaatccgatgcaataaattctttttgttttttctttacttccaactttgaaacagtattttataaacgtgaaattgcaaaaaaatatgaaaaaaaagtcgtttaaacagattgtgcattatcatttttaaatc

SEQ ID NO: 108635 - DNA, 570 bp, Oryza sativa
tacacagtcaattatttaaagctgtaaaatgtcttttcccacataaaacaaaacaaaactcttactgcatttactccttgtcttttccagtggtggcgacgcactccaccgcaagcgctggtctgcgtgccctctccggcgacaacgtggtagaaatccaagccatcctctgcgatgtccacaaggtggtctcctccggcttcgacttccgccgcgtcgtcgagtccgagcttcgcatccccgtcatctaccgtaagcacttaccattctcttcatccaatgatcgactataaactatacatgaggttttctctcatccgtgaagcaatatatatctcttgatatttgagatgtactttttcatgaacgaatttaaaaaagtaatgctaaaagttagaatggagttgaaaacttatctttgtaaatagtcttgaatttttatttcatttttaaggtataagtgtatgagttagttgggaggtagatacctccaccctgaaggaggtatatacctcataactaatactatgtggtatttatctatatacttccaagactcagaaatgccta

SEQ ID NO: 108636 - DNA, 1151 bp, Oryza sativa
cgtatatatactggagtaccttttatatagttgtaaccagtacattaaacaactttgttttggaagtagtacggtatatatatactactttttatttagtaggagtgcatactttttattatttaataccagtatataaccttatttattaatgtcagtataccgatctattggaatgagtatgtactgctctttccttggaggaagtacatactgatatattttttgagtaagtagaagtatatactgatctcctcttggaatgagtatgtactgatctttccttggaggaagtatatactgatatcttttttgagtaagtatatactgataacttgtaagtaaatttgaattgtgagcgacaatccaaccaacgtacgtgcaatatattttagccttagtgtgatgcatatgctactttttcatagataagtatatactgtcatttctacgtggaagtatgtactgtttttagtaaccacagttttttataggtagcagtttatatatactctttttttaagggttcaccagcagtttatatactagttctgtgtggtagcagtgtatatatttttttttatagcagtggtacatacatttttctttgtgtatagttgtagtttattactagtttttttatagcaatggtacatacatttttctttgcgtatagttgtagtttattactagtttttgtgtgtaattaagtacgtacatacttcttttgaaatagtaatggtatgtattgttgtttttttttaaaaaaaaatctggtactacgtactagatcctaggttggagtttatactttcttttttttttctttggtttacgaatccaatatatactgctctctgcttggacgagcataatatcgaaaatttacaatgcgcaggcagcgaagcacacatactgtattgctctttgaagtagtatatacctctatccattcaaaacctgttgaagtgttaggatatactgatttcttcttaagatcggtatatactgcagatttcttcttaaaatcagtatatactgatttcttcttagaatcagtatgaatcggtatatactgatttcttcttagaatcagtatatactgatgtcttccctgccagaatgagtatatatatactgatttcctccaa

SEQ ID NO: 108637 - DNA, 727 bp, Oryza sativa
tacacccgtaatattgccacaatgagtgacattagtaacaaatatttttattattattttgtgaataaaaatgagtatcagatctaccgtgggagaggtaaagcgagtcctactgtacattttagccggaaattatcagtatcacttcctgctcaaagttgaaagccccttcctcaattctgcacttatacgttaaaggttcttgtgcggccttctctaaagtgtttatgtgaatgatattcacatgaacagcccagataaatggcaccgtatgccaacggtaaattgtactacactctccttaaaaaaatatctcaaactcattgtactatacttcgagggaaacaaataaaatagacatccattttctcataaagatgttttcatctaaataatcataaaaataattttaaaaaataacaagaagattaatatagatatatcgctcaacaaacttgtaagttcgtatccaacttctacaagttatatattttttagaaaaagtacgaatcaacccttgaacccgaaactagacattgctcaccctaaacttttaataccggacgaattacaccatcgatattgttttgagtggttttgtcttgagcttgcacacgaggtgccaacgtggtaatccagtcgaaaaaactccctgggcccacctgtcatacctctccctccccagtctctctgtctctccacggtggcactctctctccgtgcacgc

SEQ ID NO: 108638 - DNA, 543 bp, Oryza sativa
ttttcattgatgagtggttcgaaccgttctcttctcacggcctttgtgtcattgtcaacaagcatgacatggaggcatcaatgaatagaaggagaacatctgttcctccattctcacacaagtctacacacggtgttactactcacttgttcactgatgaagtgattagaagaggggaccgaagtcactgaccaaggagaaggtagtgaggaaggtccagtatgggtgatgtgttgtgccaatattttttttcttttttttttggagtaaactggcgttgccacatttgaggatcaaaggttggctaacctatgttacggtgtgagcacgtgatatgtgttcttccaattgttcattttagccaagaaattacgagtggcatttctgcacaaagttgataaacttgcttagttctataggtatactttatgcatgcatgctgcttttaaaagtgtatgttacatatacatgatgcacacttggaaccatgtaaaaaagccattatgtgcccatggaaaaatgtacggtacacaattcaaaaaa

SEQ ID NO: 108639 - DNA, 777 bp, Oryza sativa
tggctagttcttggccactattcagaagtctctcccctagaaattatagcatcactcaagtagtacgaatcatcaagaagcaagagagttaatttacttgccacgtacttaattagcagctagatcacaatcagctcttcctccttttgtttcttacaattattttctcatcctatctcccttcttgttattgaaacaacataaagcaagaagccagattacaccagaggtagagcccctgatttgctcatgcatccccacactactacctcaattcccaagcaaaatgtaggaggtgtaaagctacacttgcaagcaagcatgttagcccaccaatgcaaaggcctaaagtgaaggggacgaaattgcccatttctgtatgggtggatcggtcggccattgcattgacaagccatgcagtggtttagggggtaaaggaaggcttagcatttgggcgtcaattgaataatggtccttggccatgtaaaaggggacatggatgtgtaaaggtgttgattttgttttgatccctctccctctgctgttgtatggtgcgccgttgtcattgttgggtgtgtgcgagaggattaaatttgatggcttggtggggctaacccgtggttcttgtccttttggcaccaagaaatgatggtggtgattggtgattagtttgtgttgtgtgtagatagagtactaatttaagcagaggagcccatctatatctgacctttggaggaagccactaatgcgataaccaagtactaggagataaactct

SEQ ID NO: 108640 - DNA, 1407 bp, Oryza sativa
cttgaaaatgggttggaaatggcgatgctgcccctctctcgatcaccttgtctgacggtgaaaagaggagaaaaaaaatgggggcgacaggttgggtttggttgtggttgtgggggtctctttcttacggattaagggaggaggagaatgatgcaagggcgtgcgtacgtgctttgtggttggggattgttagcggcgggtaagggagggagggtggttttggcttggctggcctaggtactgtgtaatgtaatttggagggtggatgcctgtctttaggttagggaagcttgcaagctatttcaagctgggatctactattatacacaagggaaaataggggtgaaaggttttttttattcatgtggaaaaatattggaggtaaacatggattaaattttactttgtattgtatttgaaggatctttaagattgcacatcgatcttgcttgatacggtttagggtttcgaaacgtgaagagaaccactcactaattgtccttttataagcactgttgttgagagatgcattttgctagtgtggtggcaaggggtgcttggtttcaatcccgatgtccgtgttcaatccccaacacgcttataatttcttcttaaaaaatattgtattattgagcaggttcgtatttagaaattgcaaatggaaacaatcaaatttaacgaaaaaaataaacaacaactaaaaaaaagtatttattgttgacaaatcaaatgtatagaaaaaaacaaactaaaaccgaaaatttaggcccctttgattcaaaggaaattcataggaattttagaggatttctttcctatatgaatttttcctatatagccctttgaatcgaatgaatggatcttatggaatcctatgaaattcctatggattgcctaatgccatgcaagttttggaggaattctaacatgaggtaaaacctcttggaaactttcctttgagtctttatctctcctctaattcctgcgtttttcctacggtccaatcaaacgaccattcctgtgttttacaattctctgttttacccttacattcttatcaaaatcctgcgttttttctattcttatgtttttttattcttgcgattcaaagaggccttattgaatttcaccgatatatccgtacatcacaattgagcactagtaaccacaattaccgattaaccaccggacaaatagcaaaattcagtgtacgatgttattttgttggattttgatttgaattcgtgtacaagtagctcagatggacgtcaaaattttccttggctaacaacaagttgcagcaccatcggtcaactcaaacgaacgtcaaacatgcctagtagtaccgcttaaaagtaaacccatactatgtactctttccgtcccataatataacaactagaatat

SEQ ID NO: 108641 - DNA, 1018 bp, Oryza sativa
atatcacaaaaactatgtggagtagcttgcaagtgggtgagttgagggctgaagcattcataaactagatcgaacatactactcgacataaccagggataaaactggacagctctaaatttaatatacttgtgctaccaggttgccaggggccatcttccataatgaatgcttgaataaaactagcttgatcaatttctttatgcataggacagattgttctaagtaatgcaaagttcaacacagaaactaaagtctaactaaaaaattatatcaatacattaaggaataaaagtataaaacagtactatgttcaataaaaaaacaaaaaagaaacaaagagagatgtttttccttttctttttttctgttttttttgttgggaaagggactggttctaagaagagtacaaatagatagactgctgtacagtcggagcttacaatgatgaagagcccagactaccgactaaatgccatgtccaaaaactagccctcaaatgctctatttgacaattgatcctcatccatggaagttatttcaaatctcagcaagtcctttcagatgactgaagaaaactgtttgctcaatgtgacgacagttcattgatctccaatacaaccacctccaagtatcagcatggtggtttatcaaattctggctccaaactccttcctcttttcttattttcttctctttttttgtattttcctgcttttagccttttttacaaagcagcatttttttccataaaccatcttccaagcttattatgctgattctaatatgctgtatgatgggctaggcaccaatttggttctcatcatataaactataattcatctcccctatgtggcaggaggaagcacctgttcagcagaaggcagtgccacggttgcacctgtatttgaatcagtaactgaaggctcccgtttccattgtaaacttctagcaccagctatcattggagcacgccctctgaaggtgctaccagggaggccaccccttgggtatgccat

SEQ ID NO: 108642 - DNA, 518 bp, Oryza sativa
tgcatgagtactgaattttttttaaaaaaaaatcaaaggatgattccagttataacccagttactgttcaaatgtactgtattacatctgtaacttttgttatttcttactgtaactgaacgtaaataaatagttctttatatattttgtaacataattagagcttgttatactatgggaaagtgtgttaatgtggctgcatgaatactaaaattttaaagaaatttaagaaatgattcctatacaaacccaatacagtttgatgtacagaagatacatctgtgacttttgttatatggaactgtgactgactatagattgatagtttttgttacgagattttttgaaaaagttacatacttttaaatacttgatctaaagaaaatttctatttcaagcacttttctccaaaagaaattcactattccaagtgcttttctccaatatttttacagaacttgagttgtttttgtttgatttaaaagatgactggcagaatatggtgaagtcaatgggga

SEQ ID NO: 108643 - DNA, 749 bp, Oryza sativa
acgtgtcttacttgaggaggagacagttggacacaacattttccctgcagtttcatttcaaccagcaagcactgccaagaggtcaagaacaaaggggccacgccccaaatcagccaattttaagcaagaaaaaggccggaatgactgtggaagcttacaagaaagtgttattgcacacgtcgcaggataagataaccatcactggaaaataggcaccaaaactgatcaaagttcagaggattattcatatgttccatgctgtatggttcctcataggaaaacaagatatgtctgatttgtttgtgtggtgggtaaagataccctggaatttaacctcaaccaagatctgaatggcctgagaattcagttgaaaaattgaccaaagcatgtgaagaatgaacattgtttggcaatcaatttagagtagaaacaatgtgcatgatttcatttgtcccttattttaaaatgtcacagaaatgtttaagcaaacaagtaaatagagattaatagggttgtttcagtaggctgatgcagaaattcacggtttggtattcacacttataaataaccgtttcatacaaaataaaattgttaaggataatacacatctagttgcaatactgacataaattcagtagaaataattcatattatagaaatctaaagaatttgagtacactacaaaatctatatccctattaaaaaaagtagtggtggtgacagttaatctgctaccccgcctactctca

SEQ ID NO: 108644 - DNA, 1067 bp, Oryza sativa
cagaagccaagatctttatgagacgatccaatgataagtttctattaattcttttttttcctaaaaaaaaagtcaatctgctatcaaatacaattattaggtaggtcagcactggcataatttctatcattctaatccccttaaccacccaatactatatataaaagtagcatgtatacttaacttcagagagggagatatatagacaactacatgcccttttctttcatttttaaggaaataatttgagaaaactatatcgactcttgcacgtgtacttgcctctgaattctgaaaccttgaaacactgaccagatcagcaattaatggaattggtcagagaatttattagatgacatataaggtcgttgagttcagttaaaagttcgctcaatataatgaattgcatttccgctagagatacacttgcccaatcttactactacatttattttcatcagtttcttgtcttgccagcttgtacggttccatatgcattcataatacttgattacttacttactgcagattgacccaaatgattgttccagtttgtttctcttaagaaatattcctgataaggtcgctcaaattcaagtccgaatcagaaaaataaagaggcaataatcctgtggagagtacaacagctcatagtacaaattgaactatcaaaattaaaagcaactaaatttgtcattttcagttgagagagttttatgctctatactacacctggcctttttttttctctggttaactcaatcagagatgttcactgaatgtaccttagctgatctatcctacattttattgcatcccaaaaacatactgaagaaataaaactcagttatctttgccactggaacacttatcctacattttgttacatctcaaaaacatactgaagaaagagaactcagttatctttgcattgagacacttaactccacattaaagctacagtactgctagtagcagacacagcaaaagcaattgcacaacttgtaatagtataacacacaagccctatgtatacagctctacactgtgattaggtgtcatagaag

SEQ ID NO: 108645 - DNA, 1190 bp, Oryza sativa
acaatcaaaagtccctaacagtgcacaaccttccttgctcatattcatgcttttgctgaaatggacattgatggcaaggtaaaataagacaacaaagacgcatgaataggttttgtgtgattaacagctgcattctgatataaccataccgttaaattactggccagggattgttaccattaattattatttggtattcctatgtttcacattctttctttaacaatggacaaccttccttgctcatatccatgcttttgctgaaatggatattgatgcttcaaccagaagagcagaccttggatgaagatagctagggctatgatgggggaagcggacctctggcggatggctagatcccttcgcttgttctttggtcaccaaatcattcgggagattaggcttctacttttctcttcccctctcctgtaccctgtccctttttttttatttttcaggcccgttctgtaaatacatttattcctcttcataaaaaatgcgcatctcgtgtattcccaaaatggccaaggtaaaaaaagacaacaaagacacatgaataggttttatgtgattaacagctgcattaagatataaccataccgttaaattactggctagggattgttacaattaattattatttggtattcctatgtttcacattctttcttttagagaaaccatctctattttacgttacaagacattctgagttttaaatagttaatacgtgtatgcattatgtgctaagagacggagaaaaacccgaaaaatgaaaagattaaagcggcagatcgagtctcgccgcttctcgatttctcacgcatacgtatgagccacgtccttgtggctcaggcaccagcagcccagtagtcgatggcccaaggcccaagccagctgcaccagccaaagctctcagctcccaggcacatgcatgtaacttgtttgtccattacgttgcaccaatgtatttcttccacaataaaaaataatggttagttttgatccatatatttttaaaaaataacatatttttcatgtcgaaactatatcattgaatttgtgtttcttttcttttttttttacaatccctagacatgtatttggaaatacctattaatttgtagtaaaggaattagtaaaaaaagggcctttttttttttaataaaatagactaaaaataattttaa

SEQ ID NO: 108646 - DNA, 697 bp, Oryza sativa
aaaaagaaatatgaataaagaattttcatttgcaggtagaaacttttccaaaagccaacatgccttgggaaaatggtaaaaattctaccaatccttgtcgacataaagtttcaaactcacaatacctcccttgtgacttcacattatttttcatgacaaacgaatgaaagaacaaacagggaaagcaagcagaccagcacccagcagcaatgttggtaattgccgcacaaatctccacgcatgaccgtgaggaactcgtaacgccctgagatttttttagtattttttaaaactttttaattttttagttttaaaataaactctccaaaaactttttttaaaaatatgatccttttgatcacgccagcccatctgatgtagcaaaccaatattgtcatgtcttgtatgtcatgccaaacaacaacgttgtcacgctaactagaccagcatggccaatgttaccatgctagccagattgtcgtggcaacactgtttcgttacgtaagtctgattgacgtggtcaaaagattaatatttggaaataggttttattagagtttatttttaaataaaaaatttaaaaggtttaaaaataaaaatatcccctccttttattttacgaagccatttggcgtgctttattaatctgcaaacataattacatcattcactagaaccttaagcaagaaaattgggg

SEQ ID NO: 108647 - DNA, 683 bp, Oryza sativa
tttttttcatcggttatttaagtatttttttatgccttgggactggtgagctgtgactttaatttcttagtccagaatgctctaaattttttttgctatttgattgtgaagtgcgaagccaatgacgctagttaattagccgttgtccgatggaaatactctcaagttttgtccaattaatgtcccaacaatggaaaaaagttcatttaacagtacgtttctcacctacgtgcagtaaaaggtacagcatggagaaacattgggttttgctgcagtagtgctagtattttgttcaggaaaaaaaagtcattaatttgttgtctttgcacaccatgaagaatgtttaattggatattacatggtgaaatttaccaaaatgattttaaaaagctgatatagttgtaccattaattaaggttgctaacatctgttgctattaggagaatgcaaaacagggaagaaatcgaaatggatcaaaatttaatgaagtgccatactcactacttagggcatgaacatggtatgtcgttccaaaagatgccatgtaggatttttaatgatgtggaggaaaaagaaagaggataaagagaatattgttgtttgttaattaacataaagtctaatagacaacttaatatttaatgtgattaccgtttataccactctagaagttgtctgtctgt

SEQ ID NO: 108648 - DNA, 929 bp, Oryza sativa
agatttgttgccagctgcagcacgaattccaagatacatgtgtgtatgataggtgtgaccaaatattaattatgtagtatatgtttatagctaactattgtatgaattagctattaaattggttatagatgatttgaagctggcagttgcctatactattaaacttgctcttatgggctgagttaacacaaaagccaacagcttttactcaggtgcatccgcgaatcacacgatgccttaattcttttccttagagtaaggataataatagagcccacttcctactattagcccatcttaaagtcaacatatataatagattagctataaggttggctacaattttcttctcatctctctatctctcacttatacatttaatacatttgtcttggagcttgtgataagctagctcttgcatgagagccaacatccttaatttttcactacctctcttctccacctaagcttatagtaggcttatagctcactattatacttgctcttagttccagccatgatacgatcgagctcaaagtgaacttcttccctaatccctagtggtccttattgtgcacgactgcttcccggttgagaacattcaatatcaacaagaaaactaaccgagcttttgaaaaactatttttacggactgtaggtaactgatattttaatacggtgtgtaatttttttacgcattcgtgaaaaaaaagatattttaatacggtgagctttcaaaattaactgagctcacagtaataaagaaattatatattgtatgttccacgggatggtgtgaagttcatagatatttttttattacataaaagatgcacatgactatggtactacacatgtaatagcaagtgcgtacttcctaatgcgcaatgtttaatgagatgaaagctagcggaaaatatatcttggcc

SEQ ID NO: 108649 - DNA, 538 bp, Oryza sativa
gtctatgccttacgttgcgttttttttttgcctttgttttgtttatctattcgttacgttatttaatcctcgggatgttatctccgaagaacttggatgttatctccgaagaacttgtgacgaattttatcttcagcctgacaagtcgaccaattgcgtaatataaaaataacttttttggttaatactactttcttttttggaacaaccaccatatccataccattaagtatagaaagcacaaggatcaaacccgaaaccagaagcaacgctacttcctccattcctctattggtaattcaacaaggtctgttcgagtaagatgcagtatccgacaaaaatgcaagttaaatttggtaatgaaacttgtgatgtctgaacaaatcaccggcatcaaaacttggatcaggaaacaccgtgaccactaggcatttagcaggaagacgtgccctattgtcatagtctcatagtcatcacattaggatgcaggatattgcagtaagttacaggcttacacccttacatgtgcctacaatca

SEQ ID NO: 108650 - DNA, 587 bp, Oryza sativa
gttaacatagttattaaattcgattatagaaatccatttcttcaagttatataaaaataataaattaaattttaattaatatacgcaaatgaacattgaatgccattctcgcattgaagttcatcaatctttttacaacgtgaataaaaaagcctaagaaaaacaaaggagaaatggccttcggttcctcgcctcattgtttcagcctcacgagcttgataaagatgcagaagtcatgcgcgaacgcggtcaccgcgatggtctccgtgaacctggtcaggtgttcgaccatcacctggacaagcggcgacacggcggcgagcggcggcatcaccaccaccgcgacgccgccgacgaccatgccgaggaagagcgccgcgcagttgagccacagcgccctcccctccaccctgacgtcggggcagtactgctcgccgccggcgccgcactgcagcgacaccagcagcatcagcccggcgacggccaccgacaccgcgcacttggcggcgcgcgccggctcggcggagttgtcggcgaggaggtcccgcgccatcggcggcagcgcgaaggggacgtacctggacagg

SEQ ID NO: 108651 - DNA, 2447 bp, Oryza sativa
ggtgtggtgtagagaaagaaggggagttcaaaaaatgttgtggtaaaaagtgtgagggtccatgtgctctgtaagtagcccgcatacgaaaatctactttcgcatgctgttttcgcatgtaaaaatagactcatttttgcatgcggatgtgttaagaggttcgcgtgcgaatttttgcatgtgagcctcttaaggagctgtatgcgaaaatactggtcgatttttgctggtgtgaccagttattatccgtctacaaactataggggtcctcgtatagaaaaatcatttctgtagtagtgttagaagaagatgcatgcaactgctctatgcttttgtgctggacctgtcccttactactaaaaaacaattttcccaaacggctaaaatgcattttcacatgctggtatagcaatcgtatagccccaggtgtatgtaaaaatagggatttttctaggcaggcaacacaattgcacgcaaaaaaatggattttcgcatgcggcatgttatgctgcctgacttcaaaaagaattcttgcacaataaaaaaaaatcaaaaacagaaaaatcgtaaaagcccaagctcgagagcggccgtctgctgtcgctggacccaccgtcactgacctcccaaccgtcggattcacacctgccgaggcccatcgccgcattcgttgtcgcagctcccaccagatcggcgcgcgatggtgggggatatgacactggatctgttgcgttgagccccaccgccgcagcgggcaccgagcggtcaagccctaccactaccaacccttgtgagggagtgagggaggagcactgggagaggatgtggttgagacttatccactctatggttagtagaggaggatacatatccagactagcttgctggataagtttttcacggctagtgctctttagcagtcgtctgcgaaaattgatttccgtaagtagtcgcttaagacattcgtatgtgaaaatagttttattttcacatgtagacgtgttaagcgaccacttacgaaaatcgatttttgcagacgaacatataccacaagagctttctcactattattacaaaaggatttttattgccccatctgaaaaaaaataaaacactggtgtctgcaaaaattgttttatagtagtgccaacaagagtatattttggttgtttttaccctagacgattcacatgcatatatatagatccatgagcgtcacttttaacatgcatttagacgatatatggagattattgataaatatatgatctcactaaaattttgcatgctaaaataaagtgtatgcgagtatgtgtatacgtatgttatgcatatcaggattcatcttaggcccccttcaaacaaatgatttgtgatgtggcggagccatctcctggataggtcgagcagttgccagggctccgtcgccgtctcctatctatagttgtcaacccctataaaaattagtcaatcattgaaaaacgctattagtgtcgttcgggcttgatgatgtcgttggctccgccattggatttgtggaataattttgtaggattcaaataatccaatagaaaattttcctatattgtcctttaaaacaaaggattggagcttcccatatcctatgaaattactaagaaatagcttattttggaaaaaaaatttaacaggagctctagcacctcttgcaaattttcctgagttcatctcttattcaattcatgcgttttttctatagtttaatcaaatgatcattccattgctgtattctccgtgttttgtaattctcttttttggatttgcattgccaacaaagtcatgtattttttttctattcatctgttttcttaatcgtgagttttaaagtggccgttaaagttggagcaatatcgtgtcgacgaattattactagcttagcttgggaagcgtttaggtcggcccgtatatgtgcagtgtatgcttgcacataaggggatacgtacgtcgataaatagtggtagaaacttgactggagctcgcatacaacaaaacgggtgaaagtttttcaacatgcagaactgacattaatgatgtaccgcatgcatgcatgccaatggtggcggcaatcgatcgtcatcctccgaattaccaataaatgtcaacactgtatatatgcagcgctagatcgattgtcgttatacatgtacagttgcgaacacagacacaattgataatcgatcggtagtcctaactggagtaattaacaagggctggagctagatttaatttacgtactgcttcatgacctgaaactgaagaaaacattggttgatcttgttccaccatgggttaacatagcagaacggcatgattacatcaaaatcatcaccaacacgtaattaataagttgatcatcatacatatgatcgatcggtgctatataatcatggtaatataccaccagccag

SEQ ID NO: 108652 - DNA, 1127 bp, Oryza sativa
agttgagttatagtaattcataggataaaatcaaactctatacaatagtgaactcccgattcgtgttatgtgctgctttcagttctgaatcttatgctgactcaattgtagattctaataggatattggtgttgaatttacgtgattctgaattaacattggccagtagctttctgtaaccaacagagtaaaaaggtcaaaaggtattggatgtctgctggagttcaatcagttcgggttaatggatcatgtgccaacagtgcatgtcaaaccaatatcgcacaaatgatacagatatgaatacagatggggtaaatgcgaactttaatacttacatattatcttggcacactcttcgggagaatcaacgcgacatggcacctaaattaagcagacaggagccagttagtacaaacatcctaacactgcagtacagtgagacaaaagatactgtaccaagggctcatggcaaaatatataaaggaaagattctgggaccttcagatcaacacaatacacaacattgaaaaatcaacacccatactcatttccagctcttcttttttatacagattcacaccagattacagaaaagaaaatctccttaaacaaacaaaacaaaaattaaatatagcttataaacattttacataagcaaattattctaccttacatccgctgacttctgtaaagaaagcaggaaattcattggttttgtaagcagcaaccgttactccttgagtttcctgccaatgcaatcagttaacctatacgattgagcaccaaacaacattgcattcattgaaatgcctagccagaaatacaccaaatttcaaatatagcacatttaacgagtaaaacctaaagaaataacttgtctataccaagaaacaccagaaaattgtcatgacttacttgaaaaggatggtcgtagattatggagaataaaatgaacaaacgtatgattctggaaaactataaaccctcagttgtagatctagcagttttacttgtctggatggagttatcatggacatgagaaaactttcaggttctgaggcaacagcattctattggttaagggaaatataccaccaaaaaatccataggaagtgagctaattttcg

SEQ ID NO: 108653 - DNA, 638 bp, Oryza sativa
ttccctttcgggaaacccgaaggtaggtacaagcaagctgttcttaccttacacagcgttataacacacctccttgcttcaatatactatgcaaggtaggctaaagtcactactactaagaacggtggaatggagggtgagagcgcgcttggaagctttgctctgaatggtgtcttcgttgttcttctcagctgagcaaacccctccttttataggagctctgaaggctcgactgtgcttcaagcttatcttttagatactgtattttcacgagctggctcgcaccatggagatgcttatcttctttttggctttactttgtccttgaattggccaaggtggagacacctctgtacctgcgcctttcttttccgccgaaagcaatattctccacagtatttttaacagtcaaatgttattcactgtccttgcattttggattgattcaaattcaattcatactttggtcattcgcaaatatagtcttcccacgcccaaagaatggatatttattatcaatttatattatattgctttattggtcaggctgcccatgaccacctaaatccatagtatctacatcagaaaaggagacttcaaatttttcatcatatgcttttttcatttcttcaaattta

SEQ ID NO: 108654 - DNA, 1536 bp, Oryza sativa
catatatatatatatatatatatatatatatatatatagcagtcagcagcatattcgtatttcttttggcgttacgcactagcagatacacatactgcgtgcatccaaacatctgtagcacggcacacacttgaaagtatatagaataacaatcacatgccacaaagttttttcatgtattacagtacagcttatggttcaccaatacagccggaatgcatgcatgaacaagcagcatccacttggtccatcagatgcacacatataaatgtactagcaatcaagcactccccatgctcaatcacaattcacacaccacacgagcagacaggcgcagccgcagacaggcgcagccgctgcttattcttattagctattctgatccgctgcaaacaggcaggggtagctgatagacacacactcgctcatcatgagctcagaccacaccaatcacacagacagaggcaggcacaaccacaaccagccgttgcttcaatacgtacgtacagtttcgtactcaagcgaaagccacacacactcatcactcggccgagcacacacggaaaacggagtgggcacacctgaagccccatatcctggctcgcagaacaaactgataaatcaaaacacgaggtagcactgctgtgctagtcggcaatccagtcaccgattagccagcaagacacgcaggcagacacttactgaagataacaagcgagcaagcaactgaagttgtagcagagcagatgcacgtacggttcaggatttcacctgggcatgcagagaggagatgatgagaagcaacggaaatcaagagtgagcaatcagtaagccgctgccttaattatttagtagtagcagatgtataataatcggatgcagtaatcagtagcagatactatatagatactccctccgttttttaatagacgacgccgttgattttttatcacatgtttgaccattcgtcttatttaaaaacattttataaatatataagatataaatcacacttaaaatactatgagtgataaaccaactcataacaaaataaattataattacgtaattttttttgaataagacgaatggtcaagcatataaaaaaagtcaacggtgtcatctattaaaaaacgggagaatagctaatatagtccctcaagtttcatctaaggctcaatttagtccttcacgtttcattttgtccacatagctcctctaaatatttgttttggcttgaaatcatccttggacccacttaatatgccatatggctatttctagtcaatatttctgttaaaaaatatccattttgcccttaatttgcatataactataactagaaaagagaaaaccaagatgaataaaaaaaattgcagatgtacttcctattatttcaacatgtgcacatgaaacttaagaaattgctatcgtatacactttgctagtacataatttattttcattttatatagtttactatgcattatctataaaaaaattcaagcatgcaatttttctcttatatatgtaaat

SEQ ID NO: 108655 - DNA, 3374 bp, Oryza sativa
agtatgttataatttcatccgtcaatgtatgtagagatcgatcgatgtagctatgcatgcatatgtaggttcgataacatacccgaggagggtgcccctgggcatgcgcttgttcttgtagtagcgcgaatgctggggcggctggtagagggaagggtggtggccggcgtccaccccgtcccactccagcgcgtcccacacatccttctccacctcgatggccggcttctgcttgccctgactgcggggcagacggcggaggctccagcatcctctgatcctgatggtctccagcgcgggcgccaccatctcgacggcctcgcatatctgccgcagtgacggcaagtcgtgtaggtggatggtggtcagttttgggaactcgatacttgtcgactggaactccgtgtccggtacaaagatgtgcctgaggtcgccgcagtggatgatgtggagggtttccaagctggggaaggaggggagcgccattggaagcgcaaaccggaggcttgggcaggagcgcaggtgcaagtgctgtagactttgcaagtaaccatctgaggacttgatgcctctgctccatatgcagtgggccttgaggaggtccgatgcccagatgatctccaggcgaccgtcctcatctgcaccctgaggaaagacgacgtctaggttggaggacctctccacgcggcaccacctgaggtaacaccaattttccgcagccaaggcgtggcggcaggccgagtcatcatgcacatgcagggactcgtgcacgataccattagctgaattaacttgttgctttcatcataggcttgcttcacttcactctccacgctgtggcttccatcaccaatctccatgtggcgatccagctgttgggtcggaggctgcgggaaggcctccattgtggttacggcatcgccgaccttgctaaatacatcaccatagatgcctgctacaccgcagtgtttctgaccactgggttcagtcatcttcttgcttgtttcttctggttgcacaactccgctactggatgccattgaagaggtgatactgatgttgaaataataatagtaattgatcgtagccagtaaggaccgagcgagcctagcatccacaatacaagcatgcacctgtaaccggaagtatttatggtcgacggcaagggatggccgagcacatccaagtaccttccgggcaggacgtgtgtctatacagagcaactccagcaaccttgaccgtccccatcttattgcacgaaggtgctcacagcctagcagaaatagccgcttgagacatgggacatccgtcaccatagttccaaagtcgagcaccttgattgcacagcctgaaaggtcccgctccaccaagttgggcaggccacgcaagaacagattgtccagctgcgtgcagccttctagggatatcacggatgttttcacatccttcatacgaatcataccacgccgaacaggacggcagctctgtagaggtagctcaatagttgatgcccgactgggcgctgcagatccatagccatcaaagctgaatgaccttagcgatgatggaagcctattaggcacaacaacatcctccagcgcgtcacaaccgtcaagaataagaaccttaagttggcctgcattggatatgcttgttggcagatttttcatctctttgttgccagacaaatcaagcaattgcagatccgttttgtctacgaatatgtcgttgatgtcagttgatgatgatgatgtctcagcctcattctgagggttgattatccggagcctctcaaggcatggtaatcttttctttaactgacttgttagctgcgagcacctaactccctctatgtttacctccatcagctggttagtcatgagctccatcttttcctcgtggaaaatctcaacccagtccgtgtagcgtaggtcaatcaccctcaagttttgcagacatgcccactttccttgaagttcaactgtactgttgctcttacagcgatctaatccaatgaattttaacgtttggcaatggaggaaaggaggcgatacaaagttgaaggcacaacaggagagaaccagcacgcagaggctactgcactgttcaaaaaaaccatctggtattccaaggaggccaccactgtacatttgagttgctaagaagattgatgatgcacttgccattttagtttgcatagcctcctctatggtatcatttgagatggcaaaaacccaacggtaaggcctgtttgaatttgaatagacaaacttattgtcgtcttccagtaataggaaaggggccttcggatccatcttcaacatttcaaccacccttttcaactcataagaacgacactcgaaacttacttctggatgcaatgcattactgacctccaatgctctagccccttggatgatcccatcgcacgtccaatagttggacgcatgagctggccaaacaaattcattggtgttttgtttattgtgataatacatgagaaacccatagagacaacaatctgcaactatttccaggtcgatgttctgcagacatgggcagcgacctatggtagcagcctcttcacgaaacagtgcaccgaactctgaacttgagaatttatcagcatcctggtagccatatatgaaaagatctgtgtatctgccttcctttattttcctgtaaatactatgtaaataggaaacatccatcacggtaaggaacattctactccaagtccatattactacgcagtcaaaatagtctgcaataccaaatgtgcttagggggatctcatcatcactcccgttaagaaaaaccatcagaaatctgctctggctcagtatcctgctaatcgctgctgaaacatttagtatggcatccctagagcaaatgtccactccactgaagtcatcctcctcatcctgcttatcaaacgatgccatggtctcattgtcaagttttagctcctctgctatttttctttgcatcacccttttgcttttccaccttgagcaatctatgtatatagtcctgtcgaagcgtaattctgggggataaggtttcatggatggaagaacttctgctatggatctaaggaccccggtcctcccaaaaccataccaaccctgaaaataaatcatcgtcatctttctattgatgttgatgttgctctagataagatttagtatttcttctctggcggcaccaacatctctcgccctgatttcctgaaatgcagtagcatatacattaagtccactagtcgctaacacgtggtgatcttcatctctactattataaaagttgaagatgtttttttgccatgaaccttggtacgtcaaccttttctggttctatttatatttttcatc

SEQ ID NO: 108656 - DNA, 904 bp, Oryza sativa
tcaatcatgttgtctagaaaacaagcacgatgacacatatgtgtgttagtgatatgccctaaaggcaatcatagagatgattgtatcacatactatgtttacatatttatccgatttgttccttgaaatagataactcatcattggttaatgaatatatgactctttcatgagactctttatgttgtttgttactatttttaaagtatccccgatcaaatatcatatgtggaataaatatatttaagtgatgaacacatgtattaattgatgatcatgtctcatggatcatagtatagagataccaaattaataatgtggacacatgttgttggatagacccaacatgagacactgcaagagccatatgtgttgtgtcatcagtgatctcatttagtgttggtgttgaatccttacatctgagattattatggttcccaatatgtgtagtagcttacttagggacagataaacgctacttcgtaattgggtagttataaaagtagttttcgggtatgctataaaacatgtagtgggatatgaataatcaagatatgatttgctcctcctatggagagatatctctgggcccttcgatattgtaggttatggaagtgcatggccataccaaaggtgattgaggagtcaatcacaagttatataactatcacaggtttgaatgaaatatttagctaataaaggaaggcccaaaaaaagcttttaagttaattcaaattgttaagccaaaggggttaaccagaacttaaaaggtccaccgaatttaaaattaaggaaggcccggggggtcaatacgttctgctaggggccgctgttgactcgtggaacaaaggtagttttcgggttacagcagagtgtacatgaatctacagggtcgcacgtttaat

SEQ ID NO: 108657 - DNA, 614 bp, Oryza sativa
agaggatgagatcgtgaaaaatgttctgcggcaataagccaataatgctaaatgatgattatttttagaagagctgatagcacagggaacgttctgaaacagcaacttagctgaaaaaaattgaggtgctgttgatcttctgcacaagctaattaattaactatgaggtgtcaacaccttcatcttgataacaggctataaataattgcaaattggtctatagagtaggtttgctatgggttggccttaatttccgagtaaatcactctcaaggggcatcagataatcagatatggcatcaactctagggcttattaaaagtacaagttggtggcggtgaaaattatccaaggagatcatgagagaactgtccatgtcttctagactcctacgacctttgctacgtaaacattttgttttgccatcattgtataattgtgatgagtgatgaaagcagtcttatgttcaaaagttgcctctgctagcagaggtgatgttggatgcatggataaccaactaccaagacatatcgagatagcaactagctagttgcttaattagcatcatggaatgaaaaggtatgggacagtcatcctatggtgacagatatttct

SEQ ID NO: 108658 - DNA, 1718 bp, Oryza sativa
tctccagttacagtgagaagtaacagaagttacatatgtaactacagtacatattgactgtaactgggatgtaactacaatcatgcttgaatttcttcaaaaaaattttgtctaatatacattatctaaattatattacaaataacctatctatgcaggttctgttacaattcgatctcaagtaacagtggatacataatcagagagatctgaaagagataacattaatttcgtctgatgaaaaaagaagcaagaagacaactaaaggtcataatcatgataacctagcattatggtccatatttgaccttgacagacaatttaatctagcacatatattagagatggcggctttgaaaaatctaaagacctatctatctatagtcagttacagtgagaaataagaaaagttacatatgtaactacattacatctgaactgtaactaggctataacagctttcatgcttgaatttcttcaaaaaaattcagtactcatgcagcagcattaaatattttcccctattataacaagttctaaattatgttacaaataatataaacatgcagggtctgatgggttacagtctgaaaaatcaggggatatgcaatcggagagatatgaaagtgacaaaattttgtccagagaaataagaagcaagaaaacattgaaaggtcagttatcatgctcacctagcattatgcaccataaaatgatcttggcagacaatataatctagcataaaattatatacaacaaattagagattgtagcgttgataaattttcaaggactatatatctatagttagttacagtgagaaataacaaaagttacatatgtaactacaatacatatagactgtaactgggctaaaactgcaagcatgcttgaatttcttcaaacaataaagaatttcttcagaaaaggagtcactttgtcacaatggactgaagattttcctcaggtgaaaatcatcttcagacagtggtgtttaacaaagcacaacaattagattagagcctaggataaaaaaaaacagagcattgtggtccaaacggtcatatctccagttgtgtacaaatttgcccatatattaaattttgtacataatttgcacatatctcaaacttctgtgcacatatattaaaatcactcgacaacaagatgtgacaagttagctgatgcagaagggaatggaccagacagggtgttgttgttgagcctcccgattaaatttcacagcaaatgagttcagtgactaacaagctccacacataattaacatgggaacaatattgggatgggacgatgggtcattcagaataaagaagaaaaaaaatcatacagatatttcaggcatgtgaatacctccaggcacccaagtgaccttggttttgctaccattgaaatgcattagatcaacattagactgaaaccctccaaattatttttcagtttgctgaagtatgagattttaaaaagctcatgtcgactgaaactgtgcaatagcctgctccaagattcaaaaaatactgacaattcaaatagatttacgagcgtgctatcccctgttcccaattcagaaatagtgccaattatgttcccaagttcagatatagcgccgattcaaaacaatttacgatttacgagcgatgggacaatgaacaaaagttcaaaagagaagaaagagcaaatgcaaccaataccccataatt

SEQ ID NO: 108659 - DNA, 514 bp, Oryza sativa
tagcctcggtcagagatctagagagaggcagcgacatggacagaagggggaaggcgttggagatggagaaaaggacggtgcaggatcggcaagtgtggagtcacgttgctgggttgtctgatactcacacacatggccacctagctatccagctgcttcacgcctactggtacacacaggccatggatcgattgactgaatggatggattgttcctttgatatgacccttcaaacagccaaaatttgcagtactggagttatgactgacaacctaggagttccacacggaaagcagtcgagagtagagcgtggcatggtttcaacgaaggagaatttcggaccgtttgattggcttgaagatttgtgcgtcaggctcctcgatccagctctagcgactcgtatagtggcaacccttctaccacgagaatatagggcctgttcactttgataaaaaaaaaccttatcaaattttgtcattgctaaaattttggcaagtcgcttggtaactatgct

SEQ ID NO: 108660 - DNA, 740 bp, Oryza sativa
gcttgccaaatgcctgcatttctgcaagcttgcagcagcagcgaggccagctggtcgatagtggttagcaacttttggattaagaaatctgagttggattaaagaaaagtgtgttcatattgtggatttagccgcaggttgtccggttctgaggactactagtaatgtttttaagattttttaagcatgtttgaatgtatggttgccagctgctaaaatggatatgtttgactgaccacaggtggttttggtgtcaggtgttatggacccatgtgctattgcttgcaagtccacaactccacatatgagtacaagaatagtagtaccagtagtaagcttttccaaaaatgcatttaaaaacttaagatttggtgcaattattttatttagtctttacattcatatgcagctgtttagttttatgccgttatgtggatatcattttttggcacgtctcgttataagtaaaattaaatgcctcgtcctatgcatgctaggtggtgtttggatccaagaactttagcattagagaatgtttacggtagcatcacataggctaatcatggattaattagggtcaatagattcgtctcacgaattagttcaagattaaggatgggtttttattaatattctacgtttaatatttataattagatccctattccatcgaatgtttggacactaattataaatattaaacgtagattattaataaaactcatccataatcttggact

SEQ ID NO: 108661 - DNA, 3319 bp, Oryza sativa
  unsure (1)..(3319): unsure at all n locations
acagtagtccatcattaagtatgtagggggttaaattaatttaaaaggaaaccaagggggggaattacctggattgggtggggttaaattttttattgaagtcctccttgataaataaccctctctataattttctggaaattttcacagctcaaatgctaattttaataatacaaacattatttcatattcatttaaacaaaaatctaaataaaaccctcctttctctctggctcatcagcctgcagcctagctggcctacttttctcccttttcctccgctccacctcggcccgcaagtacgcatccggccaggcaaggtactacaagtctaatcaacctccccagctcctttcactgtcacatgggtcacgtgggccagtgctacagggtcgtctcctacctccgtctatattgccgcatctacccgacgacacctgaatccgactcctccgtaaaatccggccacatccttagagataatccgaaattaactaagggattttgatccttgttttctcctctttccgttttcccaagaataaaagcaaaaccatgtcgtatagatgtcggaagcgaaaccctatttttttagtctaagtcagtttctcttaaaaaccacgcacgcatgcgcgagaggggagggaaccggaccatacggacgaaaaaaagtgtgacgaaaggaaaaatacgaatcttttaattaagttaagattaagataagatatattatcattaggtaggtatgtatgtactatggggtgttcttgtggcgtacgtattagggcgtgatctgagcgtagtggacctgaacgtgacatgggctttttttttttgggagaaacgtgacatgggcctaaacagatctaggagggtgtaggaaatcatggagctatcaaggaggaatcggacaaaaaaaatcgcacactacacgtgaagggaatcggattaaaaaatcgcaacaatcgcgctatatacggtagggaatcagactcaaaaatcactcgggacgatgtacgaaaattcatgggaaaaacatcttaaacttttataatagaaaaagatttaatgataaaacaaatcacaataaaataattaataattatgtacttatactacatttattgataaaataaatcacaaaataattgaatcctaacgttcacaggcctttcacttaagcatcaaagatttccaaataatcaagaatttttggggaaaaaaaatggcatgaatcgaacaatccctgccttaaatctcttatttacctccaagcagctagacaagtctagttttgctccctcttatcttggcctaacacctccccttcctccctctcccgtgggcctcttggcccgagaggcccagcccgcccaagtctgtttttgtccctccctcgttgccaggtggccctcgctacagcgtcgtcttcaatctcgcgacaagaccggactccgccatgngccgcatctcctcctctgaaaccgacgcagccattgccccctaattaaattcaagcccaaaaacggaatcccctcaaacacctcttcctttggactcggattatacgcaagagagcgatctgggagggtttttcctttgtccaagtggttggagaatcagaatatacttttgtctttcctttatttctgcaggatcggactcataaaaagagacttgcgaaaatctaaggacaaaaatatcttaaacttttataataggtaaagataaagatagatatagagtacgatgaaaacgttgccttctttttggaaggcttttttttgcctttttttattatttttcttgcttgttttcgctcttttcaatttttctggatggacttctttcacggactttttttcttttttatgggctgcccctttttacgtatttttgggctttttttttcttttttttactttttaatcgttgcatacaaatcggatctttttttttattttattcgaacaaattttttttcgtcgttctatgggaatcggactttagttttggtgactttttttcgctattttttcatttttttggacagttttttcatctcttttacggggaatcagaatcggatttttttcgcctttttttaattacgggttacagacacattttgttctttttaaggcccaattaattcgagttgatggagacataaaattaaaaccaattcaaacacagatgacataccaaattacgagaaaaacatcttcaatttttataatagtagagatagagatgtatacatataaaaatagaatatcgaaatttatttttattaaattattcatgattaatcacactaatttatttgaatttcttagggctaaattgctaattttaataatacaaaataatttcaataattaatttaaatttaaaacaaataaaaaccctctcttaagtcttggccaaatcttgcccattcttccttccgcctccccgagtcggcccgcttcatctcctccctcttgggccaccatcccgatgtctgctcggcctagcagatcattgctaattttaataatacaaaataatttcaataattaatttaaatttaaaacaaataaaaaccctctcttaagtctgggccaaatctagcccattcttccttccgcctccccgagtcggcctgcttcatctcctccctcttgggccaccatcccgatgtctgctcggcctagcagatcattgctaattttaataatacaaaataatttcaataattaatttaaatttaaaataaataaaaaccctctcttaagtctgggccaaatctggcccattcttccttccgcctccccgagtcggcccgcttcatctcctccctcttgggccggcatcccggtgtctgctcggcctagcagatcgctcccatctcccatcgcgtggcaaagaaaaaagaaaaacggaacggacgaaagaaaaaaacggaaaccttacgtatgttttaattaggtatagggactacctatacatttgtcgacaaattttccccaaaaatttgacagatgtaattacagtacaatcgtagtgtaattaaactgtaacttatatgtaattacactgtaacttgcatataactacagtgtaacttatatgtaagtttcacataattttgaatcgttagatctattacaagatttgttttggtgaggaagaaaacaaatcatagcacacacatatgtgaaagaatttgttcccaagacctccgttttaccgaaataacatgttacagagagatttttgaaagttacatataagttaccctataattacagtgtaattacatgcaagttacagt

SEQ ID NO: 108662 - DNA, 1536 bp, Oryza sativa
ggcacagggccggtgtcctgctgctaggggttcagtcttgcctccctgtcccggaggttccggccgtaggtgggattgggtcggtactcttgtctatggctaggatgggttggaaactatgtcacgtcttccgtctgtataccgtggtggtatgtggcacgtggttgcacgtaaggaagatgtgtcttgtgggtaaagatgtacacccctgatcagagtataatctattcgaatagccgcgccctcggttatgggcaagccgagcaatgtacccaagttagtgttttaattcttaaaacctgcttaacaactaaaaggtggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgtatttacaaaatagctttgagcaactaaatacctttaaatgctgtttactgcaactctaaccctttataatataaccctttgtactcccttgcatttattatgcacttgtgggtgtgtcttgttgagtacggtggttgtactcagtcttgatcaatttttcccaaacccagaagaggagccccttgaagatgaaggctttggtgtctagctcgtgcctgccgtcaagcgcctgtggtcgtcgccctagtcttccactgtttcttgtttgtctctgtgtgtgctgggccttcgctgcccgtgtaataaattaactatttacgcttccgcttgttaaactctgatttgtatcaatttttggtgtaccttgcctcctgggacaaggattaatgcacgcacgtaaggaacgcccgttgggttatttccggtcgtgacaagttggtatcagagcccccttgaccctaggacgagccgtaaatcccaagccttagcaatattttcaaaaataaaaatcctttgttatttgtgaaaactgtctagtctctctctgtcttgctgcttcatttatcgccaaaatctgacctttaaaatggagaaaatccatgaaatgccattgacaagcaccctaatccaagaaatgccattgacgaatgtaacttccaggaaatgccattgtacgagccattttgtcccaaaaatgccatcaccgtcacttttactctgttaggtgccgttaattttctcaaaatgaccaaattacccttctcaacccatgacaaattaatccccttctcttccaccgccgactactcctcttcctccccttcacttcaaccgcgcgccggccactcctcttccacttcttctcccgtctgcggcggctgtcaaggaggatcgatgccgccgccgcgcctccgctcacgtcctcacccagagtaccccggtcgccctcgccctcgagctcctaccgccgcccccaagctcctgccccagcggcttccccccttccaccaccgtgcagggcccctttcacctctctctctctctcctcgacgatgacctctaatggcgaa

SEQ ID NO: 108663 - DNA, 1185 bp, Oryza sativa
cgaaaaagccattttttctctcttaaattactttgttgaagtgtaattttacttctcagacaactaatgttttagtttgaaattttgtggggcgatagatgatactgtaatttatattgctaaacattttcaaaaatcttcatcactatttacatgcatttccatttattagaagacaaactggtcttctgtgctcaaaatctatacattctcgtacaaattgaattgaaaacacagcttgtgcaaggagaaacaaaaaaatacaaatgcaacaagggagttaatgaaacaagctttcagttctgtttggggagcttaagattctgagaagtagctggttggtagctagcttctgataatctggaaaagttgggtttttcaacttctggcttctataactacagattcttagaacctgagtgagaatgtagactatttgaggagctggaaattctaaaagaaactgcaaatactagaagctcactcaaacagggccttagtacttgaaggagtaaagtgaactagaataaagtctagggagttaaatgcttcaacgaaatatttaggggagtgaaatatacatctttcatttatttttatgaggataaccatgcttgcttctctaattatactagttttgtgattaagtggtttattgttattttatttgacacaaagcgtgtaatttagcccatatacaaatgatatatgtgggtaacttaactgtagtaaatggatactcaaattgatgtaaataaaatgtgaaattgttattccatcccttggtgtaaactaatacgtcttttattgacccaagcacttcctaacagcatgtgtcttgagttgtttacttgtatttcccgacgctttacttacttgacagttagtaggacctgcctggtggcccattattcatgccattaacatctttagttattagaattgttctgtgccttcaaagatctgtgagctccatgtttcccacatctgattagcatgtacacaatctaatgaaagaactcgcactttctctccaacatttagaattagagttcaagaattgaacatcactacccatgtttggttcccggctggctcaaattatgtttagattcttcttaactaatagcatatctagttcctcctaggattctaatttaataccttaataaattggagcttcat

SEQ ID NO: 108664 - DNA, 991 bp, Oryza sativa
tgctgattgatggaaactaacaaatataagcacttgaaattttggggaatacaaatccatttgtattgttgtccaaaattttcttacttttatcttttgataacctgtaaacttgaactttacagaaaaaaatactgtacagatttaataaagaagaattttttttgcaaatttattccatattcaattcagtagaattctttcgcaaattttgtttcactttgttgcaataagaacagagaagggaattattccacaaaactgaccgtgtcgtcaggcacaagaggactccacaccattcccagcgctgcatggctcagtcaaagcaggggaaaccattgcacgtgacatattactggtaggatagttctgtttgtcaatatagttctgtttgtcaatatctgctccatttcctgcaacagtagattccttatttgtcacaatttcagttggggtcgaatctgaatcttcttcatggccatctgctagatcaaccttttcaagcaccaaaacttttggcctattgggatgttccttagctgccctttcccatgtaactttagttgctttgttcacacatggatgaagaacgacttcctcaaggcgtttgagacaattaatgttgatctctgaaaggccaactagatttttacagagaagctggagtgatttgagaaacctcaaagcatttcctttgattaccgggaatgtaggacggttcagcacaaaacataggcttagcaggcttggcaatgcattatccttaataatgaactcctcaagttgatctgcaatcagcttgagatacttcaatttcctcaggttactcaaagctgaaagaagacctgtggtcaattttgtagctgatgatgaaatgcacaactcctggaggccacgcaatagtaccacaaatttgggcgattccagtaatttagcatgtaatttcaacgatcgaaggtagcatggggcttttatctcgtagaggaagtct

SEQ ID NO: 108665 - DNA, 833 bp, Oryza sativa
cccagaaaaatctataaaatagaggagcaagtatagtatttaataaaattttatctaacccaattttatattgagatttagcaaattaaaattagatcttctcttttaagcttttaaaattatttctaataattccttttaaacaacaatttataatttaaggattttaaacaagaaaaactcttaacaattataattagatcattattgatcacatatttactgaactgttctttgtatcattaaaattaataattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctattaataatttattaaataatttataaatcctgaaacgaaaatcagggtgtgacatggttggcagtccgaccggggagcacgacgattagaccgacagactccgggagggagtcgcttttctggttgtttttgtggattttctagtttgctttatggatatgacttctatggtttctatttgtatgtgatactattgtgcgctggtgtgagtccagttggtgtgaacttgtactccgatatggagtttctttgttgttcatgtggaggtgttgcttgaggccatggaagtatagccggtgatggatcgagactaggcttgggagaagttgaggtccagacggtaaaggatatcaggcgggatgctcaggctagagaacaatacatgtggtggtgaaggtttctatatggcatacacgtggtgttg

SEQ ID NO: 108666 - DNA, 2483 bp, Oryza sativa
aggtacaaaaatcttcttcatacgagtactcactgctggctggcctttttggcctctcttcccccttcccctttgtctatatatcctctcaagcaatagggccctcaaaataggcagcaaaacactgcagtatattactactacctcatttctaagatatactaacctagaaccagattagatatatcatagtactataaatttagacagagaacatgtccagatccgtgatactatgaaatgtccaatttaattataagttgttatattttaggatagaggggtactctactagcttaaggtgcaatgtgctactgcaagagaagatgaaatgcagcacagagctggctttatgcaaacatcaacacatgtcagtgttttttcctcaagaaaaaggttcctagaaattccttaagagatcctggtcgacatgcttcgtgtctactactctcatctctactcttctcctttccatttcgaatggaacatacatatgctaaggtcttctagcctgatcttttgcttctttatatcaacagtcggcaatgatgatggatggctaaaataaagttctagcctctagtagtgtagaggagagtgtacgtgacagatcatcaattaaagttgcttagccaggctaattaactagtagtactaagtactaacacggttatctataagatcaggcaatgtctcacgcactagtgtactactaatatgtactctcgaactgtcaagctagcatcatatctcagctgcaatatcggtgcttgcattacagtaaaggccagcgtgcaattgtgcaagtgcccttttagttagtctggttaacaattggtttaacggactcggctattaattaaattaaaggctgtgttaataagctagattaagagagatcgcgactgattaattagatcagccgcttctcattcaagtaacaccatcctggttaagcaaaccgcggcaggaattaattgctgttgcacgtactgcattgcatgcttgattagttttttctgtgagcacaacgaggcccggaggccgcacatcgatcctacttagagcaagtttaatagtatagcacagtattagctccaaataatctataaccaatataatgtctggttccacctgtcatatacacgttacgtctggaagtccttgctacagctggctacagatctgtagcccgctgctcttctctctttttatttatctctttaaaatatatttatagttggcttataacctactatagtacttgctcttaatgtgcacgctacacataccacaatttttcgactagtcgttagtacataccacgtatttgaccaaatttaagtacggtgggcattgctgcaaaatgacgggaagtaaccttcgatctgtatttttttatttgaatagttatttattaaaaaaactatttgaataaaatagtagtggttgcagtgacatgagtagcacccaaggtcctgagtcttcgtatgagcaaatttcagatttgattgtttaaaggggcggatctacaatataaggaccggtgtcaggcgacaccgatgactttcggcaaaacctatagcaaaactgcttatccatatattataacaccatgatctaaatataattagcatactatgataccgatacacacgttatgacatcaacgaatcaattttctgatccgccattgttcacataaggcattgctgtaatacagtaactaatatgtactcttagcatatactgtattcttgacatctggattttggacagtggggataaatgtttgtttggacatttgctgcaacaaaactgaacgagccttttgatcggcacatgatgctattgatttgtcgtctactaagcacgtagctaggattcgagtcgacgcgttggctgacagcggcatgtgtgcatgggaggagcctactatcaagtatagtattggccacactcacatgcatgattattagtgtgaggagcacgcacggccggatctagcagacatggcgtgtggattttgtcctgtcgaatgaacggattccattctaataactaatccaatgaccccaacgctatgcacaccggtacatgcatgaactgagaagtatcatcggtggagttgcgcgtgtatggcttatattccaggctctataaatatgaccatgtgtatccaagaagagaaagtttgtgtttagatccaggggtaaaaagttttggcatgtcacgtcggatatacggacacatttgaagtattaaacgtagactaataacaaaacaaaatatatattttgcctgtaagctgcgagatgaatttattaagcctaattaattcgtcattagcaaatatttactgtagcaccacattgtcaaatcatggagcaagtaggcttaaaatattcgtctcgcaatttacacgcaatctgtgtaattagttttttttatatactccctccgtattttaatatatgacgccg

SEQ ID NO: 108667 - DNA, 1279 bp, Oryza sativa
tttggggaatttggctgcatcatgggatctttttggaaagaaatgagatatgtatatgggatgcattcgttgccacaggagtatgagataattgtacttattactaaaggtgatctgatacaagacaatagtggattactctgttcagcgtcagtttaatttggcaggattgacctgggtgaggaaccattgttgcatagaggcgcacacgaatgaagactaagcttgataaccacttttgcttgctcaaacccatgcactaacaaggtacataactcaaacatggtgttcgtttcttctgcactcataattgtttgaaatatcttagcaaaaagttgcatgattcttcttgtccatgctcctacaagtttattgtatcttaagcgataggtggtgagtagtgactagcgagcaacttatgattaggcctgcactttgcattttgtatcttctcttttggtctctacacatcatgtccagattcattttagaagttatctttttttaagacagagagagtatgttttatagtacagattatgtccatcttgtgaataacaacctttttatttgggttcgtctaggccgtaggatcccaagcagttgattagattgatttcagattggatcaattatcttgctgagtgcaagatccattgtaggttttgttgggttccggctagtgagggtacaaacaagaacagtattaaacagctcatgttgtcacatatataaccaggctaccttttcccgagctccgttgctcagggaaaaaggtgctcacagacatcagcataacacaaggacatcaacataaaacaacgatgtggatcttttactagtttatgatctgatttgcataaaacaagaatctgaatcaaaatgtctgcattaattaaagatctgactgatcatgttttaatagcaaagatatctagttggtctggataaatcaattggttagtaaatagaacaagattggggtcggtatagagcttttgtttggtatgctaagctttcctgcactgttatcaatgccaccaaacaaatagggagtgaggtattcccaaggcgaggttaaacaacatgccatttttattcgtggccagagacacgcttttgtttacaaattttactagtttcactatctagattctctgagactctgagccgagtgtctaacttggtttcaaattatttatagaaaaaaataaattggaaacgcgtgagcggacacattagaaataaaaatggatcaagcaacgatcttggagtgcgg

SEQ ID NO: 108668 - DNA, 699 bp, Oryza sativa
gtgatcctgaccgtccgatgagggatcgaacggcgcagatcaggctcggcatctccgtagccgaggccattcgtctgggcctcttcagtcgagcctgttgggctgtaacgggcctcatgccttcgctttatatgttgggctgaaatgggccttagtcctttcttgttgggccttccagtcgtaacgatcctttattttttttcttttctgcttttttttttgtgctgattagtttattattattgcttctcccacggcgtcgggttgggctgtgctctctgggcgcggcgacgcggcggcgcggcggcgtcgccggcggcgggcggagatgagttgttgcaggtatacgcggccttctcatcgtcttccgctcctagaccctgggtttttgtgttggctggtgagatggaagcgctggcgtgatttgccctgcgacgctgcgtcgtcgctcaccacatgttcggcgaaatgcgcccccggccaagatttgtggtctggtacctttcttgcgtgtggcgacgctgggtgttgagctatatgagcttgtagaggtttctgtgcgtccctgatcttgggttcggctgtggatgtggtggtcggagaagcatccggcggtgccttagttagtgcagaaaattcggcgtttctttcggcatttttaccatttacggcttatttgcaccggtataaagttaggtg

SEQ ID NO: 108669 - DNA, 812 bp, Oryza sativa
tttgaatttatgcaattcaggcttctgcaaactgaaacttgataaggttttcagccttatagacaagctcgaaaaataggcttttcagcagtacaccttataggtgcatagcacactgagatatagagatcttccaaactgaaaattattatgctatgccacttttgaagttttctgaaatattcagttcctatgcaataggagataatatatatagctggttcttaactacatcttcaaagcacacactctccaatgggatcctttgcatctgaacttggtttccagtttgaagtttgcatggaagctcctcatatcaatgttggttctctggtatatttgttgcaatttggctctgctatagaactgcatagccttgagttgatgaatttttgctatagggtgttaagggcccaccttagaaatgttctttcatcctaaacatttcatttcaaacattttagtacatttttctcgaaatgcaatgacttcgtacaagtctcattcattctggtacgaaacagtttctttcctatcactattagtgcaatgatacacaagccttttctgtattctcccaggcatcaagtgatggcaattggcgctggagtgtttacatttgattagtaggcatactgctagccctaaaaaaatgtggatattgctaaattggcatgccaatctgtacaatgtgtggttaaaaatagcttgactgatcaaaggatatgaaagctaaatattttgcattaactgacaaaaatggaactacttgtctcactaatttgaactctacttatatctaactctaccct

SEQ ID NO: 108670 - DNA, 1940 bp, Oryza sativa
aggtggggaacgaatctgatcgctaccccatccccacggcgatcgatcgcccattatgggtcccctttcgtgtagcaacactcggctaattaccaattggcagtggtattaacatgtttacttcacgctagagcatcacttgatcatctttagtagtactaactaatctttacagtagcttgaagcaaaaatgttgagttgaatcccagaaaaattgcgaatctagaggaggcgaggtgagcgtctgttgtgcggaatgcagagacattcgtcatccttcccggaacgccaaaccgggattcgcggtgaagaatcttagtggagagagtgtgatgagctctccgagttggctgccaactgcctgctcatatgcatgctctgctcaagtcaaatttgatcccatctctgacacttccatcactacctgtttatttgcttattatatgctcctccatcttacaactcgatctgagagatgcagttattagttataaaaattgtgtatttttcagggttttaaatctctcgctatctcccgttataactgtttgagaagggttctaactatttgctctcatatacaatttagccgctatagctccatttaggtagctatagctgtttgagaagctaaccgctaaatgccttaactcgctatttaaaacattggtattttttgaactttcttaagactttttttctttttgcgaggaagaacttcttagattagtgctactatgatatatacgcttttctgtatctgtacttattgtgaaagagagagagagagagagagagtaacatcagtgttaacagtcatttggactggacaatacaaactactacatgatcttcctgttcatctgccaaatgtgtttgccgaatgctgttaaaccctatttcaagtttgtgatcagcagctcaggtgctacattaccactaatgacctcaagtactactcgtacttgtataatcagccggataaatttgtctggtcgcctcatgttcagacttcagatgggcggctgactgctcacctattcagagttcagacggcggggctatgaatatgccttagacaaacgaaccggtcgtacatgtttagtgctaacaaatactagtactccagtacctaacaggatattttgacaattgtgagattctactgatgtaccacatttttctgtagcggacggtatgtcctcatcgatcaagtttgattattttatcagtggactcaacttctgaatttggccgggatgaacaactcccaatgttcagacttcagaggcccaccttatcagccccacaagtagagcccatgctgcagtgcctgttcttctcactcaggcccgatccatgtctcaacaagaaagggaaatgggccctgttgcaccaactggcaactgactaaatggaataagttcctaaacggtgtgattcttttttttaaaaaaatacatatgaattttataaaacattgttttaaatttatttttaactttataggagtaaatttaatttatttgtcattcagccaagaacgacactccgtttttgctttattttagctactgtttcacctgacgccctctaaagattaaaaacaaccgacaagtgtaaaaggatccatttacaaagataatgtcgacacttgttacacagagtttttttttaaaaaaaagaaatagcatgatgaccaaacatggaggcttatgatgtgcgattagttgcaggcacgcccatctttttgcctgcctgctccaccgatgtttattcgacgcgctgaacaatcgaatgcagacaagataatctagctaccagcttaacacaccaaaccaatcaattcatcagcatttaactaatccacgaccacaaagaggatggaatcgtggcgtttgattgtttccaaccgctacagccatatgcccattttgcat

SEQ ID NO: 108671 - DNA, 2912 bp, Oryza sativa
tcttacaaaccatcgagtcactggaccgcttgtttcactcgtttgagcaactgttctggccaaagcatgaggtcatacgatcacgtaaccaagttaattttcttattcagctttactctatccccttacgttatgtggttatgccatattctcagttgttatttgccatttgcatttttagatattccattttttaaaaaactgcattttagattgggcccctgccgtcgatcgtctctacttgtcacatgaatgtcacaagactacaagagtttggttcaagttgtttttggcatttttctttagtacagttggatgtcacgtataaccgtgtcacaacaccaattataaggatatgtggggctagttttataattattatcaattctgaaagaatttcgggatgatataaaaatcattagaaagtagacttgatattttttttcatgaaatccagtactatccaaaatataatttgtataaataattcatatgaagtcagtgctgctctattggggtctgaacaggactaaaaaaccgtgatagttcttctcgggttagaatacaaacggcttacaacttatgcctcatttctctagaccgggatatttcactattttactctaagagatcctcaacttttgggggaatttttttttttggatgaaattctatacctatccaggaggtgatcaatcagagaagagaaatgccctcatgaatagaactgatgggattggcaagtaaagttgtatgataatggctcagttctggaccggggtaactctaattatcccctgcatgtctgtggttaaaaagagttgatggaaggatgataatttggtggaactttaacttcataatattttagccataacaaaagaaattaaaaagttaacagcttcaaaagtataagtctatcataattttatcttttttttcatctctatgctactatgctagtgggagtgagagactagagcttggtgacggcatggtggctgggcagtctgctccctccttcccacgctcacagttggattcaacaatggcaggaaacaatcgtagcacgacccgacctaacactacatcaatagctttgccaccggctgcatcaggaacagatgaagtggcaatagattggagtgggcacgacggagtgaccagatggctgcaatggtagagggatggcatggcggcggtaggtggtcgcccttcttcttaattagggttggccacctacggaagggagctcgagagggccgacaagtgttgattgattggttttccagacggatagaatgcggatgaggatttgcttgagtttgggctacttattgagatcgtcacaatatggttttgcgtggtagggttcgttgggcagcaaaagatcggtttttaacaagacaaatctggcatcaatttttctatataaacgttgtatgttggttattgctgtgtataacaaaggatcaagattgaagcgagctagctgacacaagaacagtgaagcttagccttctaatcttttattttttatgtattttgttacgagacttggagtttcagtattattgtaacttttggctatatgtatccacttacgtattgaaaggtcaaatttctattcattttattaaataataacaaatttgaagataaaactttatacatgtctataatgctattggaaatacatgtacaatttttagtgtatactgtgtgtgcaaccaaaatttctgactacttgataccccaatgtcagtatcccgtcgaaaccttttataacgagatcagccaagctaaccaaactatggaaggcttgacaaagttgtctggccacttttaacggtctattaataggccgaaaacattgtcttcagttcgggtaaaaaatctcatcaagaccgcctgtcacttttggtatgaactgacactgataatatagatccaaatataaaatttgggatgaaaaaaataaatatattttaatacttatagcatacttcccgtgtacatagcccgaaccactagtaccttttttttaagtcgaatgtaatccttgcaatagtggggattcaaacttgagaccttccatcacatacatatatctttactaattcatctatacataaattctgttagcaaatggatattttcttcttttaaacctcttaactgagatttgaatcatgaatttgagtatctaagagattcatatgaaaaggttgtctattacaaaatcgtatatcttgtcaaaagctacaattttgatttaaactttatcgcaattcaagttcttatgaaaaaaaagttaagtttatatccaaaaccgacgctaatatgatcaggatcatcagcgattgtacatagctagaacactagcacaactgaggtactcactagtgcctatttatggctagaaccggcacacataatcccaacacaattttaaaaactttaccaccgataattattatgtgttggttaagccattctaactcaagacgctagacacagtttctataaactccacatcataaaaaaactagtaccagacactactcttccaatgcaaacaccactattccacacttaaatttaatgctacttatctcacatgatgccttggatattgtgtagaaatcatgtctcatgcaagacatggtttccttctcttttctcatttattcacttaccacattatttttattctatgtggcaacttatttaatgctatggacaccatcctagtcattagtaggttgggaatggccttatagcaagggatcaacgttgataagtgggatatcagtgccggttagttaaatagataagcattgattgtccccccataatacgatactgatatggtcatcagtgtcattttttgcctagagagaacgcaacgg

SEQ ID NO: 108672 - DNA, 703 bp, Oryza sativa
atgccgtcatgtgcagcagccatcggattgagcagctggctgccatatttccatgctatgcgcacactttcgttcgatcgtaccacacaggattttccttgtcacgtaactatctgcgtacagtggcagggggccaggcagcatcgcatgcacggctagatgccatgccagagcacgtacaccgagtttaacgcgccgcgcccccaccagctaattggcagtggcaccggcgcaacatgggcaagcatctgctgcagcagaggcgcagagcccctggccgctggcacttgccccccgccccgcgtgccacggcgccatatgcgtagctacgcgcgcggccggcctgatcatcaacgcgcgaggcagcaaattcgcgcggcgaacgtggcgcacggctgccgagcagtgattttcccggttgacgagacgaggacgtgaagcggctcgtgcgcgcgcccgggatctccggatggtttcttcacctcgatcgatctcctgctggctctgtggcaggccgtctttttgcctggatatagcacatggccggtctcacagtgcgagctaggatgcgcgcgtgttgactcgtgcgacacctcggagccttgcatacgtgtcgtcgtgggtcgtctccttatttggtcgctcggctctttggtaggaaactggttcctcacctacgctcgaggcaacacgacgcacacgt

SEQ ID NO: 108673 - DNA, 728 bp, Oryza sativa
cgtggctatgtaaatgccttccaaacatgcttattagagtcagagtatttagatgatggtctcggttggccgtggattaaaaaaaaaaagaacagcccaaggcccatattttttttagagagggtattttccatatatgtaaaaagaaacttctggatagagaaaaaagaaaagtcccttattaatatattatattagtgatacgctttgatcaattatgttgttctattgtatatcaccgtgttatatttgtagtatttttaagtgtatatatatgttggatctcctatatccaaaatcctaggtacgtcactgcatatataattcaaatcctcattaatttcttttcaaaaaagaataagagaaacccaatagagatgctgtttcaacttatttttttggcacaatgccacgattcaacatacccgatcacattacaaagtgaaatatactattattacctttttcatgccatgttgtagtatccttgtttcttctctttgctttttttaacgatctacacaagaccatgggaagattcatattgatatagcatgaaaaaatactggaaaaaaaaaggagaaaaagaccattccaccatgtgctagaggctccaaacacttcctggagaagcacactagcaccaagtcgttgttgtgcgtgaccaatctcgctactctacaagaggatcggagacgcttccacctcaaaccaacttcaccaataag

SEQ ID NO: 108674 - DNA, 694 bp, Oryza sativa
gatatggaagaaaaggaatcaacgaatctttcagcacaaggaggctacatcatctttcctcttcgccaagatcaaggaagaggcgcggacttggacgatggcaggagcaaaacgtttgcgggaccttctgcccctccatatataatatataaagagtacaaagtttttcatttctgatccttaagagttgttttttcttccactatattcaatgaaaagtcatgatctagtgccgttttgcttaaaaaacaacatgattgtagttaatagttattactccataaagtgcactttttttaagtgtaaataagtaaataactgatggatataattggaatatcgtcgaacaacgattggccctttttttcttttcattggcgtttagatcgtttgacgtagcgacgtccggggtcgttgcgccattcgatttgcatcggacggaaaagagggagtacagcgatagaaggggctattgctcggtccgcaacaacaaaaatcaagccacgaagattgtcctgggcccatggaaacaatacgacggtagcattgattccgaggagttcctctacatccattctacaagtgcaaccgtatatatcatgtctaacctgaccgtccgtcttatttaaaaaaattatatacttttattattaaaaaatagtcacacataaagaaccattcatgttttatcatg

SEQ ID NO: 108675 - DNA, 713 bp, Oryza sativa
atatgggttgtttggggaactcaagattttgagacaaaagctgcagtagttagaaactccccggccccaaacatgaccttcataggggtataaatatagctgttgaccttcatctcatgagattttgtataccccgttcttttttaacggcatcatatattgttaccacgaattagttgctccggctctaaaaatattttctcatagtttatttctaccacattgcttatatcatttgctctaagcatttgataagtttatatgtcttaaaatatttaatttatccctactaagtatataatccacaacaaaataattcttcgtgaagtaatatttttcaaactcatggacttgatttgtatagggtatattttaatttgaaagtcatgaagattaaatttcaaccattgatttcttataggctgcgtgtgttcctaattaattatactgtatagttgcaaaacgaaatgttgcacgaaagcactttaaacagaatatgaatctatttatatatcttaatttaatgcactaattaaatagacatgtaatttgactcgtcattagtaaaaaatattaattaaacttaaaatttcagattaaaagacagtaaaaatcaacggaggcatgtaatcgtggttactgctcccaaaccatttcatcgtcgcccgtcattgtctatatatcttgatttcaagttttcaacttgttagtgt

SEQ ID NO: 108676 - DNA, 1423 bp, Oryza sativa
cgaagaaggagcgatgcattctgggacgtcatcatcatctttagagtttcatgcggtcaagccgaataatgtcacgtgagttgttactggttgtgacagttatatcttgttaaggttctatgatccgatgtaggttgagagagatatatatatatatattattactactacggagtgataggtttagcggagtaaataagtgtgaactgtcatatgtggttctcttagtgatctggggtgctctgctttgaactcgggagttcagaagtataatgttcttttatacttcgttgcagtgtctatgattactccgtacttttatgattactccgtactttaatggtgtgtttggctaatacgaaatggggggtgtgattaggattgaaaaatgaatgataggtaaggattaaatggaagatgatgaatggatggctaggatatttaaaatgtcttttaatgtgtaggaaattatttttctatcctgtttagttccaaaatatttcttcaatcttccaactttttcatcacatcaaatcttttctacacacataaactttcaacttttctgtcacatcgctctaatttcaaccaaactttcaattttgacatgaacacacagggcctaaaaagtagtatgtcagaaacacgcagtaaatgcatgatgcttttgccattatcgggatatggattttcatccctcgaagggatatcccgtcgttacacacgcaataaatgcatgatgcttttgctattatcgggatatggattttcatcccttgaagggatatcccgccgttgtgttaccaattttttttaaaaaaaattgacataatagattaatatgaaatatatcaccccacaaatacaagaccaaatttgatttctacaagttgtaaaaaaagaaaaaaataaattaaaaatagttaaaatatttttctaaagtgttgtacttcaaattaaactatcttaaaaaattctttataaatatttatatgacatgcacaaaaacgagaagatatagagggataaaatcgctttcccctattatggcttcgtacctaccgtaatcagatgaaggcagaacgtcaactggaacaaaaaaaaactagaatattagagaaggatctaatatcaaataattaggaggggtgaggctttgaacccaggtcgtctagcccactaccttgtggagctagccagaaaacctctgggcatttctcacgtcaaccggaaccagatgaaagcaaaacaccaggttctcggtctctcttctgcactcttctctctttttctggctagcgctggccttcaatccgatcagccatctcacccagtgggcagtggaatatggaaaatttttacaccgcgcccagagctcagagcaagaccttccagaggaataagaagaggagggaaggaggca

SEQ ID NO: 108677 - DNA, 1064 bp, Oryza sativa
tgggttaattccgcccctcatttttctaggtcattacaacctgctccactctctttttcagtacagctaaaactattttgttaagcttcagctatagaatagctggagctgaaattctgctaaactgacgactacatgttgtatcactcaccccttatttatttatttttcatgtcttacttctaaccattatctcatgttccaaccatatttcatttaatgagggctattataatttctcactccatccttgatttctctagaaaaagagctgggatattttatatttgtgaaggaagtacaattgccccctcccccgattcacaagatatgaagataacatgaaacataaaaacggaggaattgaagtggtcgattggcttgatgctgcatggtgatggtagccgcgaagcctgctgctcatattttaattgaatttttttctccttaataattttgagttttcttccattggatatttgaatacatataggggtgatgttgttgcaaaaggctagaatctagatatgtaagtctatggatccagatagtttaactggacttattttaatttttgatgtaaatttgatcggttctactataagtctccctttattgcattgcaaagagcagtacagtcggagcttatgtaagatgaatttcatttaccgggcttaattcttgttctaccacatttatctgaattgtgataaatggaccaataggctagccggtaaccggccagcttgagaaaagtagatagattagggttaaggctgtgtttagttcgtgtgcccaaaatttgtttgaattatacggacacacatttgaagtattaaacgtagactaataataaaacaaattacagattatgcctgtaaaccgcgagacgaatttattaagcctaattaatccatcattagcaaatgtttactgtagcatcatattgtaaaatcatggcgtaattaggctcaaaagattcgtctcacatttacatgcaaactgtgcattgatttttttcgttcacatttaatgctctatacatatgtccaaacacgtaatgt

SEQ ID NO: 108678 - DNA, 5662 bp, Oryza sativa
gagagagaagcgaggagagagagagggatgagatgtggggagaaatggtgggaggcggcctttcgcgtggcggaccgccgcccgcacgagccagcccctgggccacgcgagccgctgacaggtggggccgggaggggtgggcccgggccggccgtgtggagggtagcaccgcacgcgcgtacgcggagcggggcaggggtggtctctccggtgatggggaaattattctgtcaacttgggtcgcgtgggtgggtggacccggtccattggagatacgtagcgtggggcccggtggcagtgggtggtggtgcagtggaccagtcgcgggagcggtttgacactcgggggggagggtgcgcttttgggttccgtcttggcgtccacaaatggggagggggaggggaacgagggcgaggttgctgttgcggccaagtgatgcctttcggatacggcgcggcgcacacgagcgcgcacgaaatttccgacccaacggtaccgttttgcatttctactgtcttttttaatttattatatttgttttgtgttcatgctgtactccctccgtcccacgtaatataagcgatgcgacacatcttagacactctgtcgtgtatcgcatcgatggagggagtatctacgacgtcaataaataattaaattggtaaatcttgaaagttttttgacagaccaagaaatattctcttagaaagtgatatccttctcaaccatttttttccttagccgcacctcccaaccgtaggaatagtgaaaatcttataaatagttattaattactcatataaataggagtatatgatgaagttggatttttaataaaagttcgaccattcaacttattcaatttttgtgtgcaaacatataaaaatgtaacttatgtttaaagactgtatgatgataaattaagtcataaaaataaataataattatatatatatttaaataagacaaatggtcaaacgtataaaaaaatcaataatatcaaatattaattaatggagagagtactagtaattaatggatttcaatgaaatcctcaaaaagaatgtatattcaggtcgtttttccttttcattaatcatcctaaagatttttctttcattcagaaattcggtacgcatgcgtgtgcttctttcttcaaatcaaccaacgaaagagcattgtgttgtttttttggaagtattgaggctataaatcaaagaaacaaaggattctggttgaagttagttattcccgtgttttttttcttttgtctagtgtgatactacttgccagaatgaaattgaatgtgatttctcctaaatctacaaatttaaacttttaagttcactaaacataacttggtgtttttgaatcctccttagctctggacctatgccttgcaggattcgtggctaacaaaattttttagcaccggagggtttatgagggtccggttccaaagtaaataaaaaataccaaattatttaaattggggttcaacgcgagtttagttgtagagtccatgaagaaaggacgagagaggaagagaaaggtggtcatatgaattcgtagggaacatctcttcgtattattgtattcggaagtaagaataattgaattattcagtacgaagttacgctgaatcaggacacgtaacagggttgacttcaagataatagaaaaagaaaagaaaagagagaccgagatgccaaatgatcaacagctgatgacgatgtgctgatgcacatcatatcggtgtctcagattatgagactatatctatatgagactctcttccggggaaaaaagaagtggtatgaggatgtttatttattcacacagccgagtcgccctttgcatgaacgacaggacgttgcgtttgctgctcactggtgcacattgactagttaaccggggttttttcttaaacaaagaacatagtacaaatgcacgcacccacaacgcctgcacactcacctacccctatgagcacctccgaagactagaccagcatattttgaaattgacgaagtcaccacaggtgcctcgctgccaagaaatacgtcgcctaccactgaaagaataattagccataaatgcgagcacccatgtcaaatctagaatttgctccaccacaagaaaccgaactagttgagctacactcacttcgctagttaactggtttttacaaaaggaagatacgaattacctccgtgagctatcgccgtcagccgaattacacccctgaactcgaataccaaatattttacacccttgactattgaaaccggataaataaacctccgacttaatccagagtggttttggtcctacgtaccatacgcatggcactcgaattgaggttgtgacctcctccgttcaatgctgtagtggggcggcctcccttgtccaccatggccggcgaggtgaggtgggacaacgaccagtatgaccgcatcaccgccatctagattgatagctgcaacctcctcccgaccaccaccgcggagccacgtggcgagggaagccgaggatgaggtgagtgcctggaggccgccgagttcagggaggacggggagaagcggtggaggttggggacgagacatgtgatggccaccaatctcggggaggatggaagtggcagcaatggcgatcggggaggagggcaaggttgagaaaatttcgctgaggaagctcaagacgacggctggctcgtcgcttacttctcacaagctccggctccgctgccgttgcagtcgcctccgtgcaagctccggttccaccaccctccccaagcaactttgagctccgccactggccgccgcctccattgccttcaccgagctcggttgatgtcggtcgccgcctctacggtccttagcaaggggatggatctgggataagagaaggggagattgaggaagacaaaatggagagaggtgggatggagagatctaacagtgagccccaccgatattttttaaagaattgtttattagactgtcacacgtatgtcacgtaggaccaaaaccactctatattgagtggtgggttattcgtccagtctcaacagttgagggtgtaaaatatctggttttcgagttcagggtaatttgatcgaccatgatagtcacttttccctttctaaaaagcactccacataaaaaaaggacatattgaccaactaaactgtcatggttatggataccacatacctaatagtagttgactaaactcggcagggcccaccacataccatgtcttatacggaaacaaaccaacggtgaaaataaattaaataaataaatccctccattaaaaaacatatgttcgttcaaaataaattaaataaataacccctccattaaaaagcatactctcataatataaggctgtcaacgggagatactcatataccggatagtatgggtattggagtacgttggtgcaaggatctatacgattcgacatcaagcaaacaaagagacaaggattataccggttcaggcccctcgtaaggtaatagccctaatccaatttatatgagattgatatggaaatccacagagtacaatagaataactgatttcgagattactagcgagatccttgtcgagatagcctcgacgagatctaccagcgagtaggcttcaagtctcatccggattgcttctgtggtggcagattggctggtgttatgattcgatgccttggatctcttagggggtatgtatttatactgtgaatccccttagtctccaagtagaactcggagaccccagaccatgcatgatatggtataattctaacctctccgagtagaactctgttacgtacttgcccgtgaggattatttccataatctcttgtcgatttccttatcgtatacggaaatatatcacacatgcgaaggtatgccgtatccgtatattccataagtcacaggatagaaggtatgtcttatccgtaaccatgacaaagatgatttgactttttttcttagttaaatcttttttatgtttgataagtttatagaaatacatagtaacatttcaacaccaaacaatatgctatcaaaatatataatattaggtttagtgaaactaatttggtgtcataagagttgctacatttctttataaatcagatcaaacttataaaagtttgacttcttataatatgaaacagatggagtaagacgtgttttgcttcattgggataaggttttgatcaaactagcttttacataaaaatgcttgtcgaaatgacatgtattttagactggatgggagtagatattaatatgtaagttttaaatttgtacataataagtttcagagtcaaattgataaagcaaagattttgaataataaacttcctagaaacaccgaatcaaagcccacgtaggcggtatagcactcaatgtgcaatcacacaagtacactacggattgtgagccgccactaccaccaaacgcccaagcaaaaggtcccgtgtggcagggtttctggttggtaggagtagatgataaccgttatcatgttatctaaacaagactatatattatataatcctacgatgggattgactattgagttgtatgcacattgttttgtgatcaagtgtaaatagtatcttttgtgttctaaattgagaagtacatggattagcagttgtgaatggcagtacaattttgtacgccgatgaaaagagtagctaggaccaggagcatgaaatcatgaaccttggatacaaccactaaaccacacatgcacagccatgcctaatagcaccaatgagcaaggatgtatatcaaggctcacaaaacgacctgcaaaacaattgtctgtagggcatattttttacgtttgagacatgttcaaacatgtctacttttatatttgggagcacatttactatttctggatacatatttatagccacaggtttagatctcagacttccagtgaaaatatgtttactggttcgaatgatgtacatatccatatagccatattaatgaacactaggatttagatcttggtggataaagcaaccatgactctaccaccatagaccatgccaacgaggcaattacccttttaaggcaagttcttagctaaggtttctaactctcttctctcattctacgtgcacgctttttaaactactaaacgatgtatttttttaaaaaaaaatctatacgaaaattgctttaaaaaatcatattaatccattttttaaaaattagctaatacttaattaatgagtcactatgtttgaagtgcgtaagttcccaatactaccaaccgaacacagcataagagtgtattaccaccagaccaacttagaattatgttatattcttggctgtgattactaattcattattcctataccagaaatgaggggaacagaatcttcagtcacattccaatttatatcccattgctgttctttcggaggtaacatttatacatgctagaaaaagaattaactagaaaatcagtgcgcctatatttatagccaagtaaattgcatcaccgatacacgaacttcacaggtgggtgcaatctagtacacaaacttgtaaaatgctcgttttggtgcatgaacttatctggtgcgtgcgaataaagacgaaaaggatactatatggcta

SEQ ID NO: 108679 - DNA, 717 bp, Oryza sativa
atgaacagaggaagtaccagagtctggaacagcatgaagaagcatacatttcatttacattcatattttacattaagaatgcgctaactgctcataataaaaaaattctcttaaaaatgataatatcgatataaggctcaatatcaagttggcaacacagtgatatggatgaggtacacacaagaacatgaattgtaaactttaggaagagactaattggtcaacagtaaatacaagaagttgagtttaatcaagaatttaaaaatagtctgaatagggcatgatctgagaagtaatctttaacaaaattctaaaatggcatatgagtactatcagggtgtattaattgcaatgccaatgagtatacaagtttatggggtaaaatatataggttaattgtttgaaagtaaataaaaacgacatacatatgttttaaaagatatattacagtaaaagcattaaacttgactatcaaaagcatatcgcctgcacatttaattcttcacatggaaatctttcagttcactgcaaactagtcatggaaggaagcattgtaactgaaaaacttacttttttttttttgccaaacatactgagaacaatttttgaatccattgtcaaaccccttcggagcacaacccaaacacgatcatatgttatcatattagtcaggtaggtagcacagaaggaccatcgcttcgatgaatttccacatgt

SEQ ID NO: 108680 - DNA, 1921 bp, Oryza sativa
tcaaggaggagaccctctccttcaagcctgcagactgcagctccctcacctgatgaatgaacgaacggctgccgcttctttctggaagcacctcctgcattagctttgctgttcagttcaagcatcaatatatatgtcaggtgtttgtgtgtgtgtgttgccagaataacgcagctaggtggcatggcatgtgctgcggcatatgttgtgctctgctccttagtgtccagcattttccttcctgaacctatgtgcttgtatcagtttcatgtcaatgcaaataatacccagtgctgatctggagttcgttttcattccccgttgaaatggttcatcatatagatcattgtggcagaaataatgtcctaatataatgtcatgtggttttgtataagttaccataccggtacagtagagggcacacagaaacatgacttcgtacctcaaactcaattggcacattttaacagcttcagaatccaactgcttattctgctcaaccataacacccagaaagaccttcaaaatcaagcaggtcaagcatacaaatggttttaaaaaaaagttgaaacataattgtaagacatatctgttcacagcatattcgcatattgtcaggagactttgttaagatatttaaccatgcaatactgaacggctagaacaaatatgacaagtggaaatcttaacagtaatatgaggatacgtttgacaatgccaccttgaattctctgacaaacttcttccacagaaagccgcttcacactgcccaacttgtgctaattaatcaagtaaatgtagtcaactagacaaatggaagtagtcaactagacaaatggaactaacaattttaacacaaggattgtgaagcagtcatggatgtacactgtagtttatctctgttgacattctcatgaggacatcagacctaaagtttttttaaaaaaaaaaaaactaaagaagaggcaatgcaaaacagggtttaatgagtttatcctttcttgctctgagaaattcccctttcaacaagactcaaaagaagaacaatatatgaacagtatagtgctgcaggtttaacaaaatggaaagaaagttgatcaattttaatcataaatactatcaaatgtgcaaaaggagcatggtaactcaaacataaggatctaaaaatttggttaacagattcactgaataagagtgccaataaaatatgccatgcttgcgattaacacttactgtaccatacaattgcacagattaaagtggcaaacaatcagccttaagagaagtgagttccactaacagatatgctcagagggacagccttggcccatagaagttttattttcactggtttgtagtttgaaaaatgaaaacacagactactctaatggtctaataaaccaacaacaagcccacacaatttgtccttctctataggagatgttccagaacttccatctaaagttgattaacagtttgtaaagaaaaccaactcacagggtgtgcaatgaagtgtgaaatactaaacgaagctaacaaaatgtcacagttccaattgcacagaaagtatcaatgtgactaagcatagagctatagtataatgcattgaaacaacatttgcatttttggcataatcttctttctgtcattgtatttgtaaatttctaactgtgtgctcaactatacatgatgcatctgtgacctgtatgcaagtattagatatagctagagaatcacacagatattacatcttactcaatcactatccttatgcagcatagttattgctatgaagtgatgcaattgtgcccattggtagaacaactatgttgaaaaaggatagtagtacagttaagcttcaattttgcattttatatacatcctagacttatacaagccagaaatttgaatgttcagtgga

SEQ ID NO: 108681 - DNA, 760 bp, Oryza sativa
tcgtgattgaattgaataaattaatgatcaagcagcaggtgaacactaggtgacaaacatcacaagcctaatggcacataattagcaagcacttaaaatcagaacatgcaagtatgcacatcacatattcccctactgatgatctccactgatagatctagatctcactccattttagcttatttatgtctagcacaatttcccattctcaaaaacagaaaaatgtgccagacaattgcaatcaatatacccattggtgcctccttttcggtaggattataactagagatgggtacaatagttctatgaaacggacagcagcggaccaggtttctccaaaataagagttggccccatctctaacattttttttcagatcaaattcgccgaacatttttgcagtagtttcagaaaggctctcagaaaatgggtgacatgttgggcccgatctatatactaagatgcctatcaagacaatgacacttttgtttagagtggttaatattttttgtcaatctgacgcagcatgttggattactttattccaaatggcgccatttgattgcaacagcgaggcaaaagcagtccacctctcactctcttcttcttcctttttctgcagagattaattgtacccttttttgtgtgctggctttctggatgttctattgttcttcccgtggcaattcctccgagttttagatcctactgtctcaccagaaagcaattaatatcgtgtgtacatttctttttttatata

SEQ ID NO: 108682 - DNA, 737 bp, Oryza sativa
tgaagaaacaaaataaaaacttgaacagttgaatcagaaagcagaaacaatactttgttcgcccaaaaaattctacgctttcttttcctttttattgagctaccttctagtcttttacatattgcttcccaggttggttcctaggttctccctactgtcgaggagccaaaaagatttacacaccacgtgcttgcttatacacattttggggatataaaccaaaagggggaacactatcctatacagagcaaaaaaaaaaaggactggaaatctatatgtctgtatctgatctcaaaagtctagctatctgcctctgcactttcagctttattttctgcattgccctggccaggttctgctgcttcacccaagtccccttccgtccatcgctgttcaggaacaggcgcttcatttgaagcaactcccgaaccgtcaggctgcgcctggcaatgaggttgttctgcaccttcgagtgttacttcagtactgcccctgtttggtgaacctgacgtgttgctctggtggcatactgcttcgcacaagtcacctgacatccctctctgctcagggataaccggttcctgggaagcagctccagaactgtcaccctgtgcctgacaataaggttgctctacactttcaggccttactcttgtgctgtcatttggtgattctgatgcttctgccttatagctgtctgttttcatctcacactgctgctcggaaacatcttcggg

SEQ ID NO: 108683 - DNA, 853 bp, Oryza sativa
gtttaggtcctccaactggttcagatgtgtcactccggtcactaaacttagatttgaatatcatttaggtcaaataggatggttaaagactttatatttaaaaataattcataaatttttcataggaactctaaggaaggcaaactttatatcaaacttgtagccctggacgcgatctacaacttggtaccggaatttttttttattgtaagtcattttttgtcccaaaatgtaattttaaaattaaaatttcaaaatctataaacatgcaacaatattttgggaccctaaacagtgtttaattcaagaaaatttcaactacataagttgtagatcgcgtcgagggctacaattttgatacaaagtttgtcttcattagagttcacatgaaaaaattatgaattattttttgatataaagtttttagaccgtcctctttagggactggggtgagacaactgaacaagttgaaggatctaaacgagtgatctgcaagtttagagaccagaatgacacaatcgaataagtttgatgacctacatggtcgatttgcgagtttaggaactgagataacacatcggtacaagtttaaggaccaatgatgtactttacttaacttttaattttggcgtgaactaaacacacccttatcctcgtccctccaatcctttctagcaaggtaaaccctgaagacgagtcgctattccaccgcggatgcgaacggcacaaccgtaacatatctctccattcacacgtgtataagtaagttgcgagtagtaggctacagtagcaagagtactgtacgagtaggacagggacgtgatatctttgtttggatttcgtgggatccgtt

SEQ ID NO: 108684 - DNA, 1553 bp, Oryza sativa
ccaatttttttacttgcttcattcattgttgccgtcaacctctgatatccttaaaacagttggatcactgttggattggtgaaagccagaaataaaggctccccgaggacacccaacatttgctctagttcgagcttagtgttttctatattttggatttcctgaggtgttaatggaacaaaaacaaaataccagaagattcaaagcttatcttcatcatatattttattatgggtaaagcaaatctgtcttctactaaaactgcacatagtattatcagcatgtaagttatttgaaggagagtaagtaaaagaactgaaaaggatcggattaagttaaggtttcaaattttatgtaaattagaatggttctaaatatagtgaaggaagaatggaatacagagaaggatgcatatggccatatgggttgtgttttactgtcttaccatttaattactcattggcaacttctcttatgcctactcttacactactatatcaagtggatattgggataaaattacaatccacttatcattacccaagttcagcaagtagccacagccagaacattaattcttcttagctggggatgaaatacttgtctcccttgatgccacagacaacagcttccagaagaatcaacctaatcccccagtttttttttttcacatgcatgttcttgtcagctagggtgttagttttaatattgtcgaggaggccagtttaagatggatgaagtagaactgcccaataaaggaatatattttctgttgctgcttacgggagaagacaatcaatccatatgaacaggagtaaaaattccagtgccaattgaaagttttcatttaggaagcaactagtatttttgcagcacaactattattcagaatatcattcaagagtaccccattcggttgtagagaatgagctgccatgtactcctagtgtctaaccttggaagttggggtagtagtatcaacgatttgtgcagtcagtacagtagaagtcaaagagccaacatgttaaattaaagatgagtagaaaacaaaaacaaaaaaacaaaatcctcatctaataatcttaacagatgctcccacaatcccacaatatcaccatctaagcattgaggcaaaacaataatcattatttcaaccaggagcaatttgatcagatcatgcaccgacgctgaacgtttcgatccccgcgggaattctcgctccctcggtctcggaggcgcaagtgcgggagcgggaaggtggacggcgacgagaagaggaggaggagagagcgaaggcaacgccgtcgatggcgacgaggggggagaggtggacgggtgtctcgtcttctcacggtggtggggatgaggaggggatgctaatatgctattttgcggcggggatggggaggaggcggcgccggcgctcgcgggagagtaggcggaagcggcgggatggtgcgcggctaagttgaggagccggatatgggggcgctgatggataggaggaggcggaggcggcgaggggattcgaagcggcggcggggtgtatttcg

SEQ ID NO: 108685 - DNA, 2791 bp, Oryza sativa
tctgctggaagctaatttcccctcctttgatgtttgaggaaggagatccccattggtgcataaaatggatgcatcggaagaaaaccgatggtcattgtctggtgaaaaaggcctcacatgccttaattttggtttgtttcttgtagagacatgctcaatcgaagaaattattaggataagggaggcttaagctgatgttgaatatatggtgtgttggaggaagagcaagagacacacgctcttgctcaggtgttcatcctaatccttttataatttttgatttctcatgtgcaaaatattttcttagatgaaattgctactccttgtggcatttaaatctgatcatggttgccaaagaaggattcaagcaggcagcgccaaacttcagagatcaaacatgctgagaaatgtgaaaaaacaacagccaaaactttttgacaggaaaattctgtaattctgtaaagtggtagggttctgtaattctgtaggttaggttgaaattgacatctcattactgtaatgctggaatttcagtatgtaatatcaattttttgggttatttagaaagacaaatacagctgatgggtatacgatgtggtttgtataaagacaatttgcttctttcttctttatcggaatggttataattcatttctgcatatgtgcacgtgcatcttcttgtataaatgttgccgtagcggtagcactggcatgctactaggatagttaaatgggacaacttaagtgactattaatgcagtagtgtggaattatatccatatttaaagaataagcaagaaattattatcagttcaatttgataataaaaaaaactaaacaatcctactgctttcaagaatttttcatgtttcacttctaatgcagttagcacaccacagatattcagttttaatccattcggacactgcgacatatatgttcacacaatgatatgtgtgagttgggaactgccttaaataaattatacagaaactttattctcttttatgaagagataaaaggaaaaatatatattcagcagccacccaacagtacaaatagcagaaaatggaatgcatttaaccgagggagtaaataggtaacttgtttgttatgcaaagttcagataatacacaaattgtttcgtctactataatgttcgtcggagataccacgatattcgtataaaaaagaacttatagttctgttcaaagatttgtggaaacaaatagctttattatgtactggtcacagtaaaaaaatataacaggaaatcaaggcattatccaaagattatttaaaggaaattaagattgtgctaactgagggatcaagcagattgtaagcatgtccttactaaatcaaatttagagatgcaagtgggtagtcccgctacccgcataaaaacccgcttgttagtctatttcccgcatggtagtacaaaatttagaagaaaaaatgaactagaagtggaataagcgggacaaaaaaaccctcttgtcagccccgcttgcatccctaatcaaaatgtacccacattccgacatagcacaggaaaccagattcttcataaattgttgaaatcacattccctgtttagacaaaaaaaaatgcattagatgtttataaccgctcagattagaataaattgtacaatcctcaggagggacacatacctgttcagaataataaaaaaaggacgtaaaatatgttatatcgacgtgaaggtaaacaagtgccacaagtatgttctgccaatctacatccacacaatatacttagttacttaaacttacctgatcagcaactcagattggccacacaagtcgccgacgcatcataaaaaggccgacgtgcaaaatatgtggatttgctcaggaggatgggtgccaatgtgccatgccacagcgccggaaagtgaatttgtgcaagccgaacctgattggttacttctcttgctggatcatgcagaagtgcagaaccgcagatgatatcacttaccctcatgttgctacggcgagcatggcacttgcggaatgggattgagttcctctgcagtcgactgcagagtgccatcgtcagtgacatgtgggcccaatgacctccgggcccatatgtcagtgacaatggtaggggtgcagtgactgcagaggatctcatttggcggaatgactcttttcatggcaaaggcaacagctcggtagatggctctgtccagttcctgcaaaactatgcagagaaactgctgctcatccgacaaaaaaacaagtgatttaaagggcaaagcagacagctctctacaatgaccagccgcacgcatccaaagcctgagagcagcagagggtcaaagaagattaacaccttggaaggcgccgccaacaggatgggcaaagatcaacgttgatggtgcattcacggcatatctctggaactctgaaggccaagccctgctatcgtcgtggaaattcattcggcaatgcaaggctgcggaggaagcggaaatcctggcgtgttgcgaaggcctaaaaatgcgggtcgaattggaaatggactgtgcaatggtagcaacaaggctgactagcaaagtacaagacagatcgcaatggtcctttcagatcagagaagcttcggcgagcaatggcaactcttcagatggtgcgtgtgcatcctagcaaaagagagctggatttttcacattttggtccttttgaaaaacttatttcgcaagtagacccctagaaaaacttatcccaaaaatagtcctttttggggcgccagagtggctggcgcc

SEQ ID NO: 108686 - DNA, 682 bp, Oryza sativa
ttcgtgcaactatgaccatccttttatgaacagtgtgtaaaaaaaaaatctgcatgtctaattctgcaagatggcattacacatcttccccgttataagtgaacttgctaatgtagaagcagagtaaaaatagcacgaacagctcgcttggcagctctgtctgcgctggtcaatgttgatcagaattcaagatcgatccagcaagcattccctctccttgctggatttgaaaatggaggttgtaactaacccatgcaaagtgtaaatgttagccaaaaaaaggtaaattagcaaacatgcatgtactaactctgagatttacaggaagagtattactatgagaacaacctgctttctgaaagcaaataattagcttgctagaaaagtaagtgttcgtaaatcatctaccttacttcatattgtgaggtagttacgcaaattcaaagtgcaatttatcgaagtgtatagaattaggtatagcagtggaagtgtgtaatcaagaggattttcttaatactgtttaagctgacttaaagatcatttttacaatacaaagcaaatattaaatagattatgtgaaagctatgaagttgtggtgtaacatatggaaaacagaaacaaaatagttttggaatggtacagggtagcatcatctgaatgtcaagcaaagcaagcaacatat

SEQ ID NO: 108687 - DNA, 521 bp, Oryza sativa
tgcgacattcgctgcaatacatttgcaatactgtaaacattcagtagcatgcgacaagacacaagaaagaacttagcgtaatgtactagtattgatcaagaatattgcaatgtatagatcgtttttactgaacataaaattgtgttctttgtatttcattgcaatctaacatggatgcacaagaaggatgagaaatatgagctaattaatttcgacagtcctcacgggcacattacagtagcaacattgaagtgttatttaataatggatctatttaatctctatagttttatcattttcccatctgatctaagtgttttctaacattatgttataaggatcaggacaattaggacaaagtaagccgagatctccatttccaacattcacgaactcaattaaatccaacctttccatgtcagtgcttgtacaccaggtagaaaaaaaaagataatgtacatatccccaacatctaaaattgttccacaaacaaacacatgtgatccttttcgcagatcaca

SEQ ID NO: 108688 - DNA, 796 bp, Oryza sativa
attttaaaaaagagagactttgtttaaataagtaataaagggagtgataagaactactccctttgctctattataagtgcagccatagttttccgcgcctaattttgatttatttgtcttatttgaaaaaaaataaaaacatacttcctctgtttcacattataagactttctagcattgcccacattcatatagatgtgaaacggaaggagtaagtcacaagcaaagtattattcatgttttatcatctcataacaacaaaaatactaattataaaaaaaattaaattagatggacgattaaagttaagcacgtaaacttatggttgtatttaaaatgggagggagtgagtattagattgtcattcaggaggaaaaaaatgactgaagtactcgaaaattccagtcacatagtaaaagctgggcactcctttttctttctttattcacacaaacggtttgtccaaccaaaccaaattagtaaattacaatagggcaccctatctattggttcaatttaggactaccagagaggttccagaggggaaaaggagtagggcgtgaaggcagtgatggacttctgaaggtggccgcaatcatccattaagtggatagcgatggatcgtcaagggtcagctcggttaggctgattatcatttggacgtattcgtaagaagctagctaggagtacggtttaggtggtctttttactctaaaattttcatttacgacgatagatccaattatccaaacataattcccataccattctatcatattatataaaataattttcg

SEQ ID NO: 108689 - DNA, 586 bp, Oryza sativa
ttaaagtacgttttacaactaatctatacatgtagtgaccatatttgaaagacaaatattttaaaaatgattcataatcaaagattctaaagtttgacctaacccttgtctaaaacgacaagtattatcagcaaagggagtagtatgcttatgatgtaatggcttgtctcggttcaattatgcattacaattagatttggtctttatatcagagtcaataggtgatattttgatactcctttcatattagtccggccaatctaagtttgagacatttatctcacgagctaatggtccaatctgtacaaaaccacatgaattttgagatatggtacataaaccaaagtattatgatcataaagtttcacaagaccacactattaatcattttaactgtgatgttgtcggagggtgaactccactagcgggggacagtgaggcccccctttgttggttcggccgggggcagcgggtgagattcgaggactcggtgagaaaggcagttagaggggtcgaaccccccgagaacgatgagacaaaaggagtttatataggttcgagccgctgaaaagcgtaataccctact

SEQ ID NO: 108690 - DNA, 1234 bp, Oryza sativa
ggcgatgtggccagttggaattataggacaaaatggtcaaacacatgtaacaacaacatagaaggagggaggagctgaaaagaggaagcgacggcgacgatgcgtggttgtgcatgccctccctagccgtgcatgtgagcaggtggctagagtgtccgctgctttgctcctttgtacgtgggagcttggatgtgtggagatgggggatatgattcatttaagtaagccattcggagagcattgcgtgagctagttgctatcttctccggaatatgtttatatatatttcacaaaacaacaacataatgtgtaataaattgaaataaaccatcgcacttaaatttcaaccaaacccgaagtcggatcgagctcttcctttaactgtagtatcaccttcctgctttcttatttcttccgttgtggaggaggattttgatgttttatccatgttatccagagttttatcaaaccacttttacgtcattcaaagttgatctgttgatgatggatagtaacagagagtatgatcaaagaaaaaaaaatctgaagcttaatttactagtagctttctttcttggttttttagctttattctttttcaatattcggttataaggctgccttaaagtacatccatttatatatccatgtgtggatttgggaaatttaactatttgccacttttatgaaagataactctccaaataccatttttatgattgcctttatacatttgccataggagagagacaagtccataattctttgccactttggatgacgtggagcaccagctcgcatgccagcatggaaggcagtggtgaattgtttgttttgcctctgtgggctccacatgtcagcccattctctctcctcactccatctctctattttcaagtttcatccatcgtactaagggccatttatacccatcatcttaaaaaaattatatacaaaccaaacaaaagtcacttaaacttttgctgtagggccgttttattccatgacatttcatagtatccaaacaagttccaactattgttatgcaacttttcattggaaaaaaatcacaaggagatgtcatactatccttgcatgaatattcacctgtttttcttttatgactacattaagccacttgagttacaaactttcgatacttgtttgacagtacgatacaattttattttagctaattgcgtcggaaaatatggatacgttgtaagttgtaaca

SEQ ID NO: 108691 - DNA, 1035 bp, Oryza sativa
ttgcgagtatgctggtaatgcaactctttcccctctactccgtataaattataaaatgatctgtaaaatttatcacaccataaatgctccatgccaaatttgccttgttattgcaccagtgaatcgtaatgaggaaagcgatgtcatatgttaattcttttaccgaaagttgttgatttcgtttcatccttctatatccattagaaatggcggtgtagaaagatattacagaaaatgaatggtttgggagatgcctctgcgttcctatgcagctgggctctggttgcatctcaacatggcatagtagtgctatatatctctctccttgtattttaggtggttgtgttgttgtgttgttgctattcgatcatttcaacgcatcaaggaaatgagacaactcaataattagttgctcagagtgcagctcttttcttctcatatggatagcccatgttccattattttctacaacaaagataggttttaacattccttttatacatataatcctagttcttagagggcaagctcttactaatgtacccaggaattcatgtcaagagcatttgcagtcaggcatcataggagattaaagaatcatgcattttgggtgtaaatgtggttggaaataggtatcagtatacataattaaggttatagatttagactaagaaatatcaagtttccggcttatcggaacacaatagttcagacatgcaccggcaatacagctttgcaagaggtcacatggggatttacaattgccttgtcattatttgtgtactttgttgttaagaaaactgtagtttggaaatgaacaccctgggtcattgaagattgttgtgactgctcatcatctttatcaccttgccaaattcttatgcggttgccataggcttactcatgctttccatcagtattcattaggattaaagtgtcattcttttactaaaactgtaatatgctcattatttgtgctttactagcatttgaattcttttctgggtagggaagatttgcactgcaaattgttta

SEQ ID NO: 108692 - DNA, 509 bp, Oryza sativa
agtcataaatcaagaacaaattcatgtcccaaacccaaactgacacaaataatattgacccctatgaaaaattccgttcttctgattcgaaactccattacgcgagacgacaggtatctctcctgcaagggcagctctccgtcctggagtctcagctcttcaacctgcgggtggccttggcgagcgcgcaccccgacacgccgccgcagcacttcgtcgtgctgcagccggcgcactccgcggcgtccacgctgaaccaggtggtggtgaactacgacgacctcccgcacgccgtggatttcatggacgcggagcccgccgcgctgaggggactagagtctctccagctctcgcagccactgcagcgggaggaagacgagggccaccgagacatgaacctcttctcggacagtgtaggacaacggcagctgtaaaattacctgtgcaattgcatgattaggtgtctctgtggctagtacattcactcttgagttggaccacattgtgtg

SEQ ID NO: 108693 - DNA, 525 bp, Oryza sativa
tcatgttgatggtggcatgaaatatgttttgtccttttttggctctatgcagtcatctgttgacaaattggcttttttttaaaggtatatatattctatatccgcccttattttgtaaagttgttaggaaagtactctatttgcatatgtgatttaactgtcgcatatgcaaattcatggaaaaatcacatcagttcatgcacgattttctatattgtttgcaaacaaactttcctagtacatgttttcctaaatgacttatttgtccattttgtgtcttacgagttgtttccaatatatgtagcatggttgaagtatctacggagtatcacctattgacctgtccaaacattgcaatagtgcaaccgtggcatcgttctttaggtggtattggaatctacaagagataaagataaaaatgaagatgaagattaagattaagtgatttacgtaaaacgaggtaataataacgtgtgactaattgggttttaattattacaaacttaaaaaataaattaatctgat

SEQ ID NO: 108694 - DNA, 822 bp, Oryza sativa
aaagttggggaaagtgacatcggttacgtaaactaaatgagttataggaaattcatctaacagctaggattttagttatatgaaagttgtcagccaagatcttggtagtaaaataaatcaagaatcaagaatatttcaattaacttaaacattacatgacatcccatacaaataaatgtgatagaaaaaattcaaaaatatttacttgaattatataatccaagatattaggttatgttaggcatccccataattgcaattctgactagtcgcggatatatacgaatctatagtatgtacaactgtatattatcctttatagttcatcccaatagttattatcctttttattttttattacacaagatgtgcacatgcgccactatgaagcacatcacactcacaaacctgcgagtgcagccctaacacatgctgagggtaaatcaactggctagattttttttatggtggaatcaacttcacccggcttcaaatcttaaatttgatatggtgctcgtatttacggtaaattattctttaagtggcaggcgacgtactcatcgacaacgagacggcaatagtgacttcgtcaatctaaagatataccggtctagtctttcgaagatacttatagaggtagagtgtgtgtatgttcataaaatccactggtggtgaaaccatctttactcccggttgggaaccccctttaatcctggttttccaaccgggagtaaagatccgggactaaagatggacgtctttagtcccggttatgcggttgttaccaccaaccgggactaaagagaggggatctttagtccc

SEQ ID NO: 108695 - DNA, 521 bp, Oryza sativa
cttaaacaccgtaataataagttaacaaccacaactaagacatggcctaggctcaccacccttggccatataggcgaaggggcaaaggaagggcccctctggctggccatgcagcacggccgtgcaccacaacgtcacaggcagccggccgcagcaatcctccatcctcacctccacctccagcgacacgcgctcgcgccgccgccgctggctctccatgcgctcgtacagctcgccgggtatccccaccccgtcgctggtcgccacgatcggcacggagccgaccgcctgccccggcacgcagaacccgcccgggaggtcggcgtgcgcgagctgcacgccagcgtacgacaccgccgcgctggcccggccggcgcagaacgcgcggcgcgtggcctcgttgtcgacgcggagggtgagttgaagacgggcgccgctgccggcgcgccggccctctcgagcccctcgatgccgggcaccttcacccagaagtcgggcttccggtagccgtacatgctgtt

SEQ ID NO: 108696 - DNA, 703 bp, Oryza sativa
attcctgcagcccttacaaaactaatttaataaataaaagctaattcgcgagacaaattttttaatcctaattaatccataattagagaatgtttactgtagcatcacatagactaatcatggattaattaggctcaatagattcatctcgcgaattagtccaagattatagatgggttttattaatagtctacgtttaatatttataattagtatccaagcatccgatgtgatagggaattaaaagttttagtccgatctaaacagggcctgacttacattacaagccaagcaaggatgaccgtgaaatagcaaaaaaaaaaaaaaaaaaaaaaaaaaaaagggtgacggtgagtaaagaacaatcggccgttgatttttcaagaaacgcacagccgttggattagatgaacaacttctaccttctacctgtacaacacatggggagaggggagaccccatgcctctcttgcctgccttttaattgctggattatggttcaattcaaggctgttggttggtactctctgccacttctataaataataaaacaaaaaaaaaacacagtttgttttttttttttttgtgaatcctatgacaatatatgccaaattatcaaatttataacaatccacaaaaagaacggcgagaaattcgcatggattgctagatcaccaagccatcgatcaagctggcagagcaa

SEQ ID NO: 108697 - DNA, 558 bp, Oryza sativa
tttatgttgtccatgtcacattttctgacatcagggccttcgtctccttgtcgtcttcgtctgcaagcagcaagcctacgccggaggctagccagcgagctccgggaaggctagatggtggtcgtggatggcgacgactccacgcggtggtcgtggacggtcgaagagggagccaaaggagatgagcgcgaggagatcctcgacagacaaatcggcgctggagaaggagggcacagcgatagatgggggaggggcgggacaggaggagagctcctcagcgagggcagcggcgagcaggacgcgcatccgctcgagctcatcgatgagcgtgatgatgacaggttgggatctctgcctagatctggtgagagagaagccaccaccgagctaccgaggtcccgccatggctcatccgtcccgccgctcgctcgtcgcttgtcagtgcgggaagaggcggtgagggtggtggttgctcgtggagcatcgatgggctggagcatgggggcatggtagtggcgacgcgcgacgacgaggagctgctgtccaggcgcgacgacg

SEQ ID NO: 108698 - DNA, 3022 bp, Oryza sativa
agggattttttttctcgaagaggcaccagacatatgatatactttgtattaagtagtaactattaatttataaagctgaggcatggacaataaacacgggttcatacaacgtcttccgtcttttttaatcatgctataaattcaatgttgctgtaagaaaatactacattgtcatacactatacatctccataggtatcatgaggtcgttttccttgaaatcaaaattttaaaaaaatgtcaaagctacaaaaattcttcattgcggacaaaacgttatttcccattgaacaaagtcaatgcaagatcgaacttagattcaaagatggcacctataggaatatattgagcaatgctatcaacatccatcttacctccattatataaaaaaaaacatccatcttacctcaagaaagcacattactaacaagttgtcttttggtggaagatgaatttaacaaaatcatatgtcaatgttggtgaaaagaaaacaaatttgtacatagtggtccaaaaataaaagaagaggaaaacaatacattattttaaagtatcccttccctacccacccatcaatactactactgtttttctattaataagagaaactttgaaatttttttctccatttcatttattgtgggaaagagggagtacatttaagtacatactccctctatctaaaattttattttccattttttttctaaaggagatgttcatattggtagtcgtcatgcatccaagacttaaatgaagatattgtctctttgtttcgccgtgctagattaaattgctaacaagaatctaatcaaccatcttaatactcgttggttgcatgtgttcatttttttttatctttgttacatgcaaataatttgatttattggttttgatgacaaaagaactatgccttagagttttggacggagggaatacatcacaatttcggtgggctcacaagattttactccagtttttcctagttggcttaaactatataaagtatggatcccatgtcgtatgtacctgatttcaacctcacgttcgagctagctattattgtcatcgttgtctttagtgcaaaagatacttaatttgtagatcatggatatataaaaggctaaaaatgaacttatttgctggagagaagaaaataaactctaaaaatcaatttattttgagacggatggatttagcttgtgtgtaacaccatggtgagcacgagcctcatagcataccatcccccaattaagtgaacatcataatttgaaccgatgatgtgccatgcatgccatcccccaagtgactatcgtcaccatccagccatccagattccagagacaatcatctctttcttctcaacattaacaatatattgggccggccggtgtacttatccagaccacctagccctatccacgttctccaaaaaaaaaaaacctagccctatacactaaaacatagaagaatacatcaggtgctttccatttccaccacctctctgcgtcaggccctggacgtcagcacaggcagcgtgagcggcgtgacgtacgctccctcatcgtcgtccacccggcagccgcgcgtgaggtttttgcagcgaaaacaataggtttttccccggtttgtgcttgactcttaacggtatccgtcatatcaggtgtggccttttgatttttgatactggtgaacgggcgttctacgcgctcgtacgtggtgatcgatatacgcaaagcgcgtcgttcgtccccgacagccaccacatggtttcacactactctactcgactccgtttggatgagcttttgcggaatctgggcagcaacagcaacgagctggaaagcatctttaatttttctgaggtgcgtcaatggcggcagattcaccggatctagcaggcggaggccaagtggatagatatgagccgaggacaagtacgtacagtgcctgctgctatttggttcgtgttgggtttttctcgaactacgtattccaaccaccggttgcattccacggttgacacgtatggagtatgaacatctatcaatcaatcaatctattctattatattattaagtcagctcgaaaataagtcaccacgtttactggggaggctagaaattcccacgttaatggaagaaaaagaaaagaagagtccaagtagaaatacaatctaaaaatagctgaaattcggaattaaaatatacaatatgaaaagagaagtccatataggaacccaatacgtgattaattaaaattcgggataataataaaataaatatcaaaattagaaaaagaaaaaagaagagtttgagtaggaatacaatttataaataactgaaattcagaattaaaaataagaaatattgaaagaagagtccatacaagaatctaatacgagattaattaaaattcggaataaaagataaaaaaaatcaaaattagaaaaaagaaaagaaaataagagtttaagtagtaatacaatttaaaattaacttaaattcagaattaaatataaacaatattgaaataagagtacatataagaacccaatagcagattaattaaaatttataataataaataaataaataatctgaaattaggcaaattaaaagagagagttaaagtaggaatacaattttgaaacaacagagattgaaaataaaaaaaataaaaatatcaaaagaacataataataaataaaataaattctgaaattagaaaaagaaaaaaaaattcaactaggagtacaatttataaataactaaaataggtgataaaaaataagactattgaaagaaaagaccatctaaaacatatgacgagattaattaagtaacaatcctatagaggagcaaagtggtggcggttgatgaacttctagaaagtaaaaaaataaaccccaatgataatcatatttgatttttaaaatctcaattacaataaaaatgagaggcagcgggcgggtcgtgtaggagtacaatggtagagccgccgatgattggtgggttttctag

SEQ ID NO: 108699 - DNA, 4213 bp, Oryza sativa
ttcccgccaaatctggacttcgatttgggctctcgatcgactctggattttcggtttttggggtttctgtgggctgttcgttcggtgatggacggcccagtttcatcaagccggccggcccactatttgtatcaagagatgggcccaacccaaatagcccattacgcgcgcaacgacggccacgacgacggttgccggcgcgcgccgcggggttgcgtcgtcgtcgtcgtcgtcgtcgtcggcggcggcggcggatccttttttatattttccggcgtgaaggcagagctcgggcaagcacgaggggtccccggaggcgctggtacgtacgcgctttcctcccctgcgccatcgtcttaatttgtcctctctgagctcaccgaacgcatcgtccgcttgatcttcccatatcccgtggtgggtgatgccggtcgtcggctcgtcgcgatagggagtttgctgtggtaggggattcttctagggtttttgtagtctggaactcggtgtaggatttgcgctatctgagcattggtgccggcaaccccacgcgtgcatgctaggtgttcggggaaattccgatcaggcctacgttttacaatgcatctctgcggcggtgattactcagtggtaagctgatttctcagtgattgcacggtgatcttctggcctcacagtgcagtgcagtcttcatggatgccgactgacctggcatgacattgaaactgatctggtggtcatctcggactgggagacagggagatcactcgaccgctcttttttgtgggcttttgctcagtgctcactcatgcagtcacacggcactgtggaaacccatgataatgcagcaagtaatggttcagtgtccctccaaggaaagttgcatcattgtttggtcctgcggtttagaaaaggaagagaaaatccttgatatgctgtgtttggtcaagtttattgttgctacttgctgcctttgttgtaaagtttgcaatatttcttttagactggtaaagtttgcaatattctcgatgcttttgccaattgaaacttatttatattctcaaagtcagtatggtgtgcttctcggtccatctgcagactgcagggctgtgtttggtggtgttgtgtagactgtagtggatgtctcgggtatttttgcttacaaccagtccccattgacgttgagactctgcttctatggtttgtcattgaagtcttttttttcctagtggctgtcaacatgtacttcagcattgttgatcttctgagtttgcatttgaatgtaaggtaaaaattgattaagttggtcctgtttacttttttggactggaactggattgggtaactttttttcttgaatccctcatagtcaataaaaactccacagtccacagggttggcgaactgccagtagtgagctggttgtgtggtttattgcagcttgagaggcaagagcaacgtagatatagtggttgatggttggaaaactgtcacaattacatggctttggacaacattgccatgcatgaccatctgaaactctggatttctcatgcctcacataagcttcttcttgaaccagtgttacgttggtgtaacatatcccctttccttcttttcattctgttattgaatgccaaccttttggatcgctgagtgaaatatataatttaggtgggttggtgccttgctaaaaattctaaagttgggaaagtgaaatggcacacaagcacaaatgattaatgtctcatttcaaggaaactggtacttgaaggtgccatcatttttcagctagatcatccatcaaacaacagctaagatgtcgcttttgctttttcctttccggtgaaaaaatatggtctaagtcttcctgcctttgacatatttaagtttggtgaagtacttcctttgttctcaatgattgaggctgtagttttgcagtactgcaaatttctaaggcttcccaagtacaatccaggatccatcatttgttaatcaatttaacatctggaaacagatagaagcaagcactacaggaatgctgttataataagacacgtttacaagtacagcactaaccatatgatgtcattattttagggttttatgatagttttcaccatgttatgtgttagaagaatacataagttcactgtcttttggttggctattgagcacaaaatatgaaggccccctgacaaattaggaccttatcctctcctcctgtagctgacagtttttcggttccagtaatcagatggaaacaatgcaggtccatgacatccacagcgctagcactgctgcctgcacttgtattattttctacccctgtagttgagaggacaaaaatgatacggctgattgcattgtcgtccaatacagacagttttgcaagtgcaggaccatgcattatcgatgggaggacggtgatcagggaacgcatggcatgtgcagacgggcttgactgcatgttacatgtatcctccccagaagtttgacatgaggagccagcagttcttccactgataactgatgaacgaagattcccagtcatctgcatcagcaggtatttgttttgtttaatacgtagattactgcataattagttgtgaaactggatagattagatgcgctatacaattgactgactataacatcctctccattttataatacccggttcgaaactttgacagctaatgcatcattcacaaaaaaagaaaaagaagaacagactcatgtgatacaaatctgctccagttatttcctctgttcctattactgttccaaaattactgcttaatgcgttagaaaatcgcgataaattaatcaagatccttttcaatgttgcagcagatgaaccgaactgtgagctgcacagatggagccatggagagcactgcatctgggtcaatcaacaattatgaacgtttctcccttccattcgctctgccctcatctgaagaggaccacagcacctaacgaccgagatgatgaactgtggactggagagcaccacacacccctcccggatttcctggcgaggtgatgagcagatgaagcttggcgatgcagcggcggcaggcactgctctgcgcgtgaactgcagccgtgcaggaggagccagatcccggcacagtgctgggcaggcagtgccccccccacaccatatgcccggctcctgggcgatgatgcagcaactaccggggtcgccatcgcccaaccgaacgtctcgccggtgccctcccgcccccggccgagatatgcagccaccaacctacggtgtgcgcccgaaagtgaccacatcttgccatgatgggtctggatggccctccccttccataattttcacatttgcacacccagaaatgagtggtagttcgttttcgtttgacatgttaagaagatgcttagcttaagctttttgggtgaaccggtcgatgatatagattaacgtcgaaatggaacatcaataaaatatggatgtaaattgagtcatggttttataaatgagtgatagttcgttttcatttgacatgttaagaatatgcgagcttaaacttttgggtgaactggtcgataaaatatattaacgtcaaaatggaacatcaataaaatatgggtgtaaattgagtcatggttttgtaatggaggaacatctatgggactcctccatttgtaattttttggcattgtaattttgtcagagcatgagcttgggaaggaaattccttttgtcagtgtaatccagtgcataatacaccagcactgtccaccatatgcagatggtttcaactcgggttggggccacatgtacattattgttggtagtgctgtactgttcagtgtacatgaccatcctcgcaagtactctgcaatttgccaagatctgaagatctggagttctggacctcatgttcggtacactgttcgtgtttttgtacactgtgcctccttaatttccctgattactccctaacacaaagctgctttaccacttttgcacgggttcttaaactttaaaaccgtccaatcgtacggcaaaaaaagatgtatcaggtggggtggaacactacgaatacaattagtgaagtacaattgacaacctagaaaaaatgtggcagaaattagcccacggctcggatcggatcagatgagatgagatctccttgttctttgatccaggctagatccaaccccaacatgaaagagagta

SEQ ID NO: 108700 - DNA, 2265 bp, Oryza sativa
  unsure (1)..(2265): unsure at all n locations
gcccgggcttcccaacccctccttccgaacacaatcttattataagtgaaagagcttattaacaatttagaaacagattcagtgttacgttttccactttattttagttattattttctatgtgatttctttctcttctctatgtaaatatgcttttatttctcatatctcctcttccaagtaaataataaactacttttaatcctggctatgtttagttcacgccaaaattggaagtttggttgaaattggaacgatgtgacggaaaagttggaagtttatgtgtatatgaaagttttgatgtgatggaaaaattggaagtttgaagaaatatttcgaaactaaacaccgcgctaattttcttacatattatgttgaaaaactacagtataaatattggatcttacaatataattatagagtaagatttataatttaccgtgtaattatagtgtaagtatataccatgtataaacgatttaactattattttaagaaaatatgacatcataaatatagctacccttatttatggataagacttttatactttttagtgatttaaaagcaaatgaaaaaaataaactacaataaaaaaacttcaaaatcaattctacattaagttttatttttttttcttaaaattcaagttctaatctgactagcgaagagcaaactagcaaaacaaaagaacagacatcgaatgaaactacacatgttgtacagcttaagtagattctgctgtaccttccagagattagtactacctccgcgccaaaataagtgcagccatgagtttccacgtccaactttgatcgtccgtcttatttgaattttttttataattagcaattttgttgttataagatgataaaacatgaatagtactttactcgtgacttatgtttttaatttttttaaaaaatttttcaaataagacgaatgattaaagttgagcgctganaaccatagctgcacttattttagacggaggaagtagggtgaaaaagtgaatgagtactaatggggccatttaaagggccggaattttttaataagggtaccttaatattcaggccccggtttaataagggggttattaaagaccttttttattcataagaaagccctccttagagaacttttttcaaatcaacttatccatctaatactccctccattccaaatttatatatatatatatatatatatatatatatatatatatatatatataatttttttaggttatttctaaataatctacatatttgtgtttatttattaattctatttgttattttgtgtattggagtaaatggacattgatgcatccatgcatacaaatatttataatctacatgcaatatcttaatttgctattggctaggaaatagtgggaatgatgcatgcattgagtttgttgttagagtaaatatagtatgagaaagttattagcttttttttggtcttggtatacctatgaaatatatagatcaatttaaaatggagggagtaatacttatcataaactctttcttagaaaaaagtttaataataaactcactttcatccgtcttccatcgtcattcacattcagcgaacgtgttcgcaagctattgctgcaacaacggctggagctgcaacaaaaatgtctatcttgaattactgcagcctcaacggttgcgacaaccctcaccgccgatcataacaagaacttcaaaacgatcatagctgtgttcttctctcagcttttttaaccccggccctacactttcgtttttattcgttttttaggtacacgcttcccaaactattaaatagtattttttttaaaaaaaagtctaagaaacattatttttgaaaataatattaatctatattttttaaaaaagcttatatttaattagttactccctccggttttattttaattgacgctttggacaatgacatactctacaagatatacctttaaccttatttttctattataatatatacaataaattaatgcatgtttacttttattatagtgttttgaaagacaaatctatatatgtttttctagtttcttgaaactaaatatttttaaagttattgatggtcaaagttataaaagtttaacctcaaccttgtccaaaacgtcaattaatatagaaccagagggagtactcattccattccaaaatacaaggcacaactacttttaaaaagttgtttcataatataagatgtgcatgcatgcatgcaattaattaatac

SEQ ID NO: 108701 - DNA, 549 bp, Oryza sativa
gcaattgcgcgggtcacccagctagttatattattaaaacagctttgaaaggagtcaccacgttcgctgtgggggctagaaattcccacattaatccgagaaaaagaaaaaaaagaaaatggagagtccaagtagaagtacaatttaaaaatagctgaaattcggaattaaaaataagcaatattaaaagaaatttccatataagaacccaatacgagattaattaaaattcgaaataaaaataaaataaaatccaaaattagaaaaggaaaggagagtccaagtagaaatataatttaaaaatatttgaaattcggaattaaaaataaggaatattgaaataagtttccatataagaaccaaatacgagattaatcaaaaattgaaataaaaataaaataaaatccaaaattagaaaaggaaatgagagtccaagtaggaatacaatttaaaaatagctaaaattaggaattaaaaataaggaatattaaaagaagagtccatataagaacccaatacgagattaattaaaattcggaataaaaataa

SEQ ID NO: 108702 - DNA, 1907 bp, Oryza sativa
tttaatatttcttttttaattccgaattttctataaattgtatttctatatagactctatgctcttcttccaatattatttatttttatttctaaattttcatattatattttatatgtgtgttagttattaatcattttcaatatcaaattttagttatttgtaaattatatatattcctatatggactctagactcgtcttttaatatatttttttaattctgaattttctgtaaattgtatttttatatagactctatgctcttcttccaatattatttatttttatttctgaattttcatattatattttatatacgtattagttattaattatttttaatatcaaattttagttatttgtaaattatatatattcctatatggactctagactcgtcttttaattttttttttattctaaattttctgtaaattatatttctatatagtctctatgctcttcttccaatattatttatttttatttatgaatttttattatttctaattgtatttctatgtggactctaaactcatctttcaatattctttaatttttaatttcgaatttcagttacttctaaattgtattcctatatttgtgttcctatattgaccttaaactcttcttcccatgtttttcttaattttgaattttagttatttataaattgtatttttatacggactctaaactctacttttaattttattatgtttattccaaatttgagttagttttaaattgctatatggactctatactctacttctaatattccctattttttaattccgaatttctattttttttcttaatattatctctatatggactctatactctacttctaatatttcttatttttaattccaaatttctattatttcctaattgtatttctatatggactctatactctacttctaatatttcttatttttaattccgaatttcagttatttcctaattgtatttctatatggactatatactctacttctaatattccttatttttaattccgaatttcagttatttcctaattgtatttctatatggattctagtctcctcttctaatattccttattttttaattccgaatttaagttatttcctaattgtatttctatatggactttagtctcctcttctaatattccttattttttaatttcgaatttcaactatttctaaattgtatttctatatggactttagtctcctcttataatattccttattttttaattccgaatttcagctatttctaaattgtatttctatatggactctgccttttctttttctccaattaatgtgagaatttctaggccatgagagcgaacgtggaagctcctttttctattcctttaataatataatagataattggtgattttgtgtatgtaaaagtgtaatactactactccctccgttacagtttacaagacaagtcaactgaagctaatcagtaaccaaggaaatttggtggtctagtagtgatgtcggtcagtcttaagttgatcactaactttactttgatatattcttaagactgagctttgtactctttgcgtatgatcaaccttacctaccacaagtaggtaaggtttcgcagcagtgttctcgtgtgacatcttctccaaaataatcttgaaagtggtgtgcaaaaatgtgaacattagtctttcaagtttagcaatcaactttgactaaattaattgtgttaaccaatcaaaggaaactcatataacatatttcctcgttaatcacaaatttttttaggcaagtgaagaacaacttgcagttgcagcctctggtctacagaaaaaaacaaatcttatgatcaggtatgtgtgctgcaagggcccagctccaacggcccaatccaaatgca

SEQ ID NO: 108703 - DNA, 888 bp, Oryza sativa
cgggtgggatatttttgaccagatgaaataagttcaaagatcatccaaacatgatttttggacatattggagtgtattgggtgcgttcgtggcaaaaactcacttcgtgaatcgcgcgggtacttttgtcaattaataccaatattggcatatattgagccccacgggtgcgatgtttttggccggaatgaaaaagttcaaaaagcgccaaaacttgaattttggacatattggagtgtattgggtgcgttcgtggcaaaaactcacttcgtgaatcgcgcgggtacttttgtcaattaataccaatattggcatatgttgagaccccacgggtgcaatatttttgaccggattgaataagttcaaaaagcatccaaacatgaattttggacatattggagtgtattgggtgcgttcgtggcaaaaactcacttcgtgattcgcgcgggtacttttgtcaattaataccaatattggcatatgttgagaccccacgggtgcgatgtttttgaccggaatgaaaaagttcaaaaagcaccaaaacatgatttctggacatattggagtgtattgggtgcgttcgtggcaaaaactcacttcgtgattcgcgcgggtacttttgtcaattaataccaatattggcatatgttgagaccccacgggtgcggtgtttttgaccgcattgaataagttcaaaaagcatccaaacatgaattttggacatattggagtgtattgggtgcgttcgtggcaaaaactcacttcgtgaatcgcgcgggtacttttgtcaattaataccaatattggcatatgttgagaccccacgggtgcgatatttttgaccggaatgaaaaagttcaaaaagcaccaaatcttgaattttggaca

SEQ ID NO: 108704 - DNA, 1357 bp, Oryza sativa
ttttgtccattaataccaatattggcatattttgagaccccatgggtgcgatatttttgaccggattgaataagttaaaaaagcatccaaacatggattttggacatattggagtgtattgggtgcgttcgtggcaaaaactcacttcgtgattcgcgcgggtacttttgtcaattaataccaatattggcatatgttgagaccccacgggtgcggtgtttttgaccgcattgaataagttcaaaaagcatccaaacatgaattttggacatattggagtgtattgggtgcgttcgtggcaaaaactcacttcgtgaatcgcgcgggtacttttgtcaattaataccaatattggcatatgttgagaccccacgggtgcgatatttttgaccggaatgaaaaagttcaaaaagcaccaaaacaagatttctggacatattggagtgtattgggtgcgttcgtggcaaaaactcacttcgtgatttgcgcggttacttttgtcaattaataccaatatttggatgcgttcgtggcaaaaactcacttcgtgattcgcgcgggtacttttgtcaattaataccaatattggcatatattgagaccccacgggtgcgatatttttgaccggattgaatatgttcaaaaagcatccaaacatgaattttggacatgttggagtctattgggtgcgttcgtggcaaaaactcacttcgtgattcgcgcgggtacttttgtccattaatgccaatattggcatatattgagccccacgggtgcgatgtttttgaccggaatgaaaaagttctaaaagcaccaaaacatgaattttggacatattggagtgtattgggtgcgttcgtggcaaaaactcacttcgtgattcgcgcatgtacttttgtcaattaataccaatattggcatatgttgagaccccacgggtgcgatatttttgaccggattgaataagttcaaaaagaaccaaaacaagatttctggacatattggagtgtattgggtgcgttcgtggcaaaaactcacttcgtgattcgcgcgggtacttttgtcaattaataccaatattggcatatgttgagaccccaggggtgcgatatttttgacaggaatgaaaaagttcaaaaagcaccaaaacatgaattttggacatattggagtgtattgggtgcgtacgtggcaaaaactcacttcgtgattcgcgcgggtacttttgtcaattaataccaatattggcatatgttgagaccccacgtgtgcgaaatttttgaccggattgaataagttcaaaaagcatccaaacatgaatttggacatattggaatgcattggatgcgttcggggc

SEQ ID NO: 108705 - DNA, 929 bp, Oryza sativa
ttcctgcagcccttgacaaaaatacccgcgcgaatcacgaagtgagtttttgccacgaacgcacccaatacactccatgtgtgcagaaatcttgttttggtgctttttgaaatttttcattccggtcaaaaacatcgcacccgtggggtctcaacatatgccaatattggtattaattgacaaaagtacccgcgcgaatcacgaagtgagtttttgccacgaacgcacccaatacactccaataagtccaaaattatgttttggcgctttttgaactttttcattccggtcaaaaacatcgcacccgtggggctcaatatatgccaatattggcattaattgacaaaagtacccgcgcgaatcacgaagtgagtttttgccacgaacgcacccaatacactccaatatgtctaaaattcatgttttggtgcttttagaactttttcattccggtcaaaaacatcgcacccgtggggctcaatatatgccaatattggcattaatggacaaaagtacccgcgcgaatcacgaagtgagtttttgccacgaacgcacccaatacactccaatatgaccaaaattcatgtttggatgctttttgaacttattccatctggtcaaaaatatcgcacccgtggggtctcaacatatgccaatgttggtattaattgacaaaagtacccgcgcgaatcacgaagtgagtttttgccacgaacgcacccaatacactccgatatgtccaaaattcatgtttggatgctttttgaacttattcaatccggtcaaaaatatcgcacccgtggggtctcaacatatgccaatatcggtattaattgacaaaagttcccctcgcgattcacaaaatgagtttttgctcgaacccacccaatacactccaatttgtccaatattatgtttggatgcttttt

SEQ ID NO: 108706 - DNA, 1055 bp, Oryza sativa
gtccaaaatttatgttttgccgatttttgaattttttcattccggtcaaaaacaacgcaaccggtggggctcaatatatgccaatattggcattaattaccaaaagtactcgcgcgaagcacgaagtgagtttttgccacgaacgcacccaatacactccaatatgtccaaaattcatgttttggcgctttttgaactttttcattccggtcaaaaacatcgcacccgtggggctcaatacatgccaatattggcattaatggacaaaagtacccgcgcgaatcacgaagtgagtttttgccacgaacgcacccaatacactccaatatgaccaaaattcatgtttggatgatttttgaacttattccatctggtcaaaaatatcgcacccgtggggtctcaacatatgccaatattggtattaattgacaaaagtacccgcgcgaatcacgaagtgagtttttgccacgaacgcacccaatacactccgatatgtccaaaattcatgtttggatgctttttgaacttattcaatccggtcaaaaatatcgcacccgtggggtctcaacatatgccaatatcggtattaattgacaaaagtacccgcgcgattcacgaagtgagtttttgccacgaacgcacccaatacactccaatatgtccaaaattcaagttttggcgctttttgaactttttcattccggtcaaaaacatcgcacccgtggggctcaatatatgccaatattggcattaattgacaaaagtacccgcgcgaatcacgaagtgagtttttgccacgaacgcacccaatacactccaatatgtccaaaattcatgttttggtgctttttgaactttttcattccggtcaaaaacatcgcacccgtggggctcaatacatgccaatattggcattaatggacaaaagtacccgcgcgaatcacgaagtgagtttttgccacgaacgcacccaatacactccaatatgtccaaaattcatgtttggatgatttttgaacttattccatccggtcaaaaacttcccacccgggggg

SEQ ID NO: 108707 - DNA, 917 bp, Oryza sativa
catatgccaatattggtattaattgacaaaagtacccgcgcgattcacgaagtgagtttttgccacgaacgcacccaatacactccaatatgtccaaaattcttgtttcgatgctttttgaacttattcaatgcggtcaaaaacaccgcacccgtggggtctcaacatatgccaatattggtattaattgacaaaagtacccgcgcgaatcacgaagtgagtttttgccacgaacgcacccaatacactccaatatgtccagaaatcttgttttggtgctttttgaacttttccattccggtcaaaaatatcgcacccgtggggtctcaacatatgccaatattggtattaattgacaagagtacccgcgcgattcacgaagtgagtttttgccacgaacgcacccaatacactccaatatgtccaaaattcatgtttggatgctttttgaacttattcaatgcggtcaaaaacaccgcacccgtggggtctcaacatatgccaatattggtattaattgacaaaagtacccgcgcgaatcacgaagtgagtttttgccacgaacgcacccaatacactccaatatgtccagaaatcttgttttggtgctttttgaactttttcattccggtcaaaaacatcgcacccgtggggtctcaacatatgccaatattggtattaattgacaaaagtacccgcgcgaatcacgaagtgagtttttgccacgaacgcacccaatacactccaatatgtccaaaattcatgtttggatgctttttgaacttattcaatgcggtcaaaaacaccgcacccgtggggtctcaacatatgccaatattggtattaattgacaaaagtacccgcgcgaatcacgaagtgagtttttgccacgaacgcacccaatacactccaatatg

SEQ ID NO: 108708 - DNA, 1233 bp, Oryza sativa
cggggactttttgtcaaattaagcccaatattgccatatattgagcccccacgggggggaatgtttttgacgggaataaaaagttccaaaagcaccaaaacaagaattttagacatattggagtgtattgggtgcgttcgtggcaaaaactcactacgtgattcgggcgggaacttttgtcaattaataccaatattggcatatgttgagaccccacgggtgcgatgtttttgaccggaatgaaaaagttcaaaaagcaccaaaacatgaattttggacatattggagtgtattgggtgcgttcgtggcaaaaactcacttcgtgattcgcgcgggtacttttgtcaattaatgccaatattggcatatgttgagaccccacgggtgcgatgtttttgaccggaatgaaaaagctcaaaaagcaccaaaacatgaattttggacatattggagtgtatagggtgcgttcgtggcaaaaactcacttcgtgattcgcgcgggtacttttgtcaattaataccaatattggcatatgttgagaccccacgggtgcgatgtttttgaccggattgaataagttcaaaaagcatccaaacatgaattttggacatattggagtgtattgggtgcgttcgtggcaaaaactcacttcgtgactcgcgcgggtacttttgtcaattaataccaatattggcatatgttgagaccccacgggtgcgatatttttgaccggattgaataagttcaaaaagcatccaaacatgaattttggacatattggagtgtattgggtgcgttcgtggcaaaaactcacttcgtgaatcgcgcgggtactcttgtcaattagtaccaatattggcatatgttgagaccccacgggtgcgatatttttgaccggattgaataagttcaaaaagcatccaaacatgaattttggacatattggagtgtattgggtgcgttcgtggcaaaaactcacatcgtgattcgcgcgggtacttttgtcaattaataccaatattggcatatgttgagaccccacgggtgcgatatttttgaccggattgaataagttcaaaaagcatccaaacatgaattttggacatattggagtgtattgggtgcgttcgtggcaaaaactcactttgtgattcgcgcgggtacttttgtcaattaatgccaatattggcatatattgagccccacgggtgcgatgtttttgaccggaatgaa

SEQ ID NO: 108709 - DNA, 3757 bp, Oryza sativa
aaaccgttgggcgaaccaaaatgacgaagaccaagggtgtttcgccatcaagaatgggcgaagccgtgaaatgaaagccgaagggtttgcctccaggctcatcgatcaaccggagatccaccacgggcgagggctgtagggtgaagcacaaggccatcgcccgaagtagcaaataccttcggctaaaggcttaggaggcctagcagcctatagaggcccttcgccagctattgggccggcccaagggggctgtctcaaggcctatgaatgtaaaagacactatatacccgttgtaatttgcctgttatgagggtaaccatgtaaatttccatgtattagccaaaccctagagggtatgagcctgtactaggattataattaaatagcctcctagggccatgtaatgggggatccaaaaattttaccaattaatatattgacttactattctaaccacacatcgagtttaccacgtccttcaacgtgaagcagttgtcattcgacaataattcccaacaagagacaccctcggagcgttcctctcatatgtaacggctactactcttgaaccgttacagatgagtcttcatctgtaatggcagactcatatgtaacgagcctccagctaattattagccacatcgctgtaatgaatgcttggtaacggttggctgagccattatactctctctttctaaatatttaacactgttaactctttagcacatgtttgaccgttcgttttattcaaaagcttatgtgaaatatgtaaaactatatgtatacatatataagtatatttaacaatgaatcaaataataggaaaagaattaataattatttaattttttttaataagacgaacggtcaaacatattataaaaagtaaacggtgttaaatagtatctatcttgagccgttacagatagctaggattatgctagtgacgcgaccccgagaagaataacgtaggtacgccactgtgcgtatgtactactactactaagctatagagcagtatatatattgctcactgtttgttttggaaaaatgaacagtttgcaatgcacttaaattaatttaattcaattgacaactagacagacaacttgaaacaactttcgtacagcccaatttcttggaatgaactatattgttcagagaaattatatatatatgtttggaaggtgagtagcatttgctcgttgaacacatgcactacaagtcttccacgcatgtttttgacctgaccatgcgatccgaacttcaactataggacttgtaattgcacccatttttgtgatcccttctaacaaactgcgatataaagatgatgtctaacctgccagttttccaggcatgttgtttgacatttggttttttcttgtcttgtagtaggctgtagctagctagctactccctctgtcctagaatgtagctatttttaggattcaaacttgtcccaaaaaatgctattccctctgtcccagaatgtagctatttttaggattcaaacttgtcccaaaaaatgctatttctaggtaggtgagaggctgttatacctgttttacctctgctgactaccccgtgccatgggacccacgggccaccatccagtgcactgcacccccacagcactgacacaccacagaccccaccccagtgcatggaggagacgaggagagaggcaccagacttctttggtttgaatttcaaaagttggttccatttttttattctggatatgcaggtgccaggggaatagcagctgtgggaggaatgctgcgtgtccttgtgccagcatattcatgattccataaaagaagggcactatggtcataacacccaaaaccttaatccatccaaacaacctagaaatagctacattctgggacggaggtggtagtcgcttgacatttggaattatgcttggctagcttctatctggtcaaagataatgtttcttaattacacaaccacctaaaatactcccaggcatacctgaaaaataattcaactatagcattttcaatatttgtttattgtttactcaaactaaaaaagaataagggaaactagctaggaggatatatagagtgttatttgaactgcagtatgaattttcttactacctctatccctgaattttcagggttagaatgagtattaaggaaatagctaggtagaattaaatgggtagatgttgtgattgaggaagaagagaaagtaggtggagaatttaattggtggaaggttataattaattgagaagagaatataggtgaacaagttgttatatttaaaaaaattttaaatgttaaaagttgttaaattttaagaccaaaaatgtattgtacactggcagtagttagtacacgtcacaacaatattttttaggaagatcatataaaaataacggggccaatgtaacaggctcactgatagcagcctcatgacgtcatattcaaaggcacgcttggacgttgtaggacggagggagtatgcttcttatcacccgaatgagagaaagaaaataacatgtgaaccgtagttcgaatgggagatcccaacaaggtctacatgttcgacttaaaaaaaaaaaagatttccggacaactaaaaaatactacctccatttattttattgtgacttgattcgtcatcaaatattctttaagtatgacataaatattttcatatttgcacaaaaattttaaataaaacgaatagccaaacgttggttgaaaagtcaacggtgtcatacattaaatacggagggagtagcatcgatcgtcgttttgttttcttcttccaatagcgcagtagaatactgcaaagggctgcaagagcatccactgaaccgaaggaaaaggcaggagcctattccatataaatttactttgaggtgtgagttgggatacaattaaattgttgactggaattacgtgaccattaataaaattagtgtacttcactaaattcgtttgtagaccatgtgatcgaatatgcgcgtgatgcagctgtctctttctttcgggtgtaacacgtcgaattgtaatatcagcaatccgcactcacatgtttactagggaaaatgttccaggtttaacagtcaactataaaattgttcagtaatttttttcccattttttagatatgtggccagtttgtttttccacacgatcatttgaccggttacactatcatgagaaattttgcttatttaatattagaaaacacgtatttgatcactgggggagaaagcgtttatactcccggttcataacccccctatactcccggttgtaaccgggagtatgaatccgggactaaagatacccatctttagtcccaggtgaaataacgggatagggctacgtcatcgattgttttttactttttattgttttttctgcttgtacctattccccacctagatccacccaaccattcacaaattatgcataataaaatcatccacaaatcatacacattcacaatccacaaatcatacacatccacaatccacaaatcaatcacaaaatcatccccaaatcaacaagaaaaatctccaacaaaatatacaaatcattcactacaaaatatataaagaaaatcacacgctgccacctggccaacgccacccgccatgcgcccaggcaccgacgcccggccgtgcgcaaccggccacgctagctgccacaaccgccccagctcggtcgcgccctccgcgccggacgccgttcgggcgtgccct

SEQ ID NO: 108710 - DNA, 643 bp, Oryza sativa
actttctgcaatatcaccgcactcaggacagtcttcaatagatggcagcctcataccctcattccaacaaaatctaaagaactcacaaccccaatgaggatcaaagccgttatcatcttcttcataatgcttctcatactgcctgttatatttcttttgatacttgttataattttagccgaattcacctgaaaaccccttgcacgtcctccatcggctgttcggccagctgtatgcaccatattgacaggaaaaggattgccatcaaccttcatcggcctcttagaatcatcaaacttgattttgcctccctcaatagctgcctggatctgctacctaaagactttgcaatcattggtagaatgagacccagaattatgccacttgcaatacctcttcttgcccaattctttagccgatgggattgtatgactagcaggaagttgaatctgtttctcccgaagtggcacatcaaaaatcttatcagccttagtaacatcaaagtcatacctttcctcctttccagaattctttacccattggcatggtataactttcttgcttctaacccattcggctgctgctatttcggagtcatcctcatcctcatcatccgatccatatatgtaaggagaaacatgat

SEQ ID NO: 108711 - DNA, 616 bp, Oryza sativa
tatccaatgagtgggaaaaccaaggaaaggattccatataaaacatcgttaagtcgttataattgttaccattaacatacctaaaagtagagagggtatgtaacatatgtttaaataatgtttttagttgtgattttgatttcaagtatctccctagtagcttagaaactagggcccattgatatggatgaaatgcggatgaaagctaatgaatgatatgtttataataaattaaatatgatttattgtaaacctaaccaatagattaggtggtacgttctcagtagtttacagattatagatgatctccgccacacttttcaaactcataaacgttatgttttgccaaaaaaattcctccaataatttttttaaaattttttaaatcacctaatcaacttctaaaattaaattaattcattggggccatcgactaattgttaaactcggtttccatctatcataatcctattttgagagggcacattgaacaagtggtctgagcaatattgatttagaaagttaatggacaaatcgtatttttagaaacatgacgtgaataatctgcaaataattcgtagcaattaatctacaaagaacagggctgcactcatag

SEQ ID NO: 108712 - DNA, 692 bp, Oryza sativa
caagagaaggagactcccgtcaacaccaacggaggcaatactgtctcaaactccagcggaggaccattcttggggtatatccttattacattatttcaattagaagttttcactgtgtaatggtcatcgcaatgtcaacattggtcattatgtgattgttgatgcttattcaacgttaagcatcctcatgttgattacattcaccactatcactggatcaaatcctattgtaaatatcatgattattatcttgttattttggattaaaatatgccgaattatgaccaaatttccaacaaatgctaggcatgagaagtataggattttaggagtaatgatacaacatggatgccctgtaagtgtgaggaagcgggatacatggaccaattattgctagattcaggtggtagggataaagagatataaggtagcgatggaaactttctcgcatgccaagggtcatggggaggttgaagaggaacggctttttccccgtggaacccaccttattttctacaccacccataaatgtggtgtttgcaccactaataccacatgctaaggtcctctttccggttaactttcattgaaaagaagtaaatattctctatggtaaattggtaataaggtgtaatatcttaaaccacatttatcaacccgttattggtgcttctacgacgaaagtttaatct

SEQ ID NO: 108713 - DNA, 675 bp, Oryza sativa
aaagccatttgcatgcatggcctctcaaagctcaaagcctcaaagccatttgcatgcagccatgtacagtgccatgcaagcaaaccataataggcatcaacatgctaattaaaaccgcatgtatgcataacctatgttttttaatttgttaactgtgcctccctgtagtaagcacgtactaaggcgtcatgaactatatgggcaggtataaatatcaggaagagaaggcgctaccctcctgatatgaaacgaagcatatatgctttgtgtttagagagatcaactaatggcatcataaaggagggagtgaccaaatctgttgctaacgacatgcgggtggggaaactgtggagagttgtccaacgtgtatggcggccgcaaaaaaacttccctttaacgctaatgcactggtggagaaaccctttgtagtcccggttcgtaacccccctttagtcccggtttccagaccgggagtaccaatccgggactaaagatcgagctgacctttttttttttgaatggccctgttgctgcatggtttatatatatatatatatatatatatatatatatatatatatatatatatatatatatatatataaaaacccggcatatatatctttcaatacatatataggcatacatatatataggtatatatatatattatat

SEQ ID NO: 108714 - DNA, 1121 bp, Oryza sativa
tgggtcccacaccattttgtcacctgggttgccacgttggtatgccacgtgggcaaaagtggtaaatagttaagatgccacatctaagaggggcaaaaaaaaaagagcaaacgtaataagggtatttggataattgccaaacctaaaagtggtaaatagttaaattccccttaattgcaaggcatataactatgtgccgggaatgctcgtgtttatagggtagttaattgctagggaaaaaaaatctgctaggaattctctttcgctacaggactttatagggcagtttttaagtgccgagaatacattattgcccatctagggcagttgcattgaggggaatactaggtcatggagtagtgtatgcctgtatggacacagatcgatcgacgtcgtaactggtcagaggttctgacatgcatgggttgttcaaggaaatcaatgccatgttgcatgactgaccactatactgcaatacttctatgctgtatatatgctccctgtaattgtgtcgattttgtacattctagttccatgaaaacatttctgccttttgaataaaaaatatagggctagctctagtgctctacacactgttactgaaactaaaactttggctaggtagttaactagtactgatatcgacatacattgactgaaattataagttttcaatcgtttgttagcaaataattcttgtgcatgcagttcatttctttcttgtgttctgtttagttagggcatggcgcagcacgccctgatgtgtgggatggcacaagaagtggacgggcgtggcatgtgcagtgccatcaaggccacgatctagtttctgttttgtctatttaagttgcaatatcagataaagaaaagctgctgcttcgcagcaccaaaaactctccttgtgttccaagttttttcatcaggtgttccactgatcaccgtgtgtagcttttctctgacatcattgtgaatcttcagtttatctatgttgaataattatgaggtgttttacaaggtgataagcacctgaggagaaataaaatgtgaatgtagaacatgttgacatggcgacatttatcccttctagctagttgtagacatggatactagatagttctaga

SEQ ID NO: 108715 - DNA, 718 bp, Oryza sativa
atatagagtcgggtgggtcggaaacaaaatgacatatcctcaaactcaacatgtgcgccaacgtaagattccaccactctaccatcgtagtaaacactaacaagtttatccatctacaccaaaaaaaataaaatctgactttaccaaaaattacatcatccttcctaaacatagtccaaactgacaaattataaccaatgcataacttaaattgtcccaaagctactacttcacgaaaaatatttaatccacatccaacagtaccaacaagttttttagtgcattaaacatcaaaatattacaaatactccgtcatacaacccaacctagttctaattaactttaataaatttctataatgctaccaaattcgtccctccttcgtataattcatacctaaaatatttctttcatgtctcaagtcaatttttccatccatccaaccaaaccacctaaaagtccaaattaccattaccacatatatagttcaaaaaagagtggcactaacgagtacattgcatacatgtagcactataatcagcaaatccccaaattggatgttgaaaatcacaaatttgggcaaaaatggggttctagggttaccctccaatctacaaatttcaccatttaaaacgaaaaaaaagaggggggaatggaggtgtataccttgctcttcggtttccacaaaaaatcccgcgaaaataggcctccaaattga

SEQ ID NO: 108716 - DNA, 1537 bp, Oryza sativa
tattattgcatgattaattaagtattaactatttttttaaaaaaggattaatatgattttttaaaacaactttcatatagaaagtttttgcataaatcacaccgtttagcagtttgtaaaacgtgtgcgcggaaaacgagagagatgggttgggaaaacgggggaagaacaaagccttaagattggtttattagggaaatcatactaaacttatttatgagagtgcatgcagtaaaacatacttgaaaaaaagaattgattgaacaaaagtgcaatttagcccatggcacttaaacctttataaacgcttcacacatactaattaaatttatatgattgtgctattctttcaaatcaattttatttttcaaagaaaataagaaaacatatgaaaaaaaagagaagagagtagaagtaaattaatagaagttttttttaattagatgaaacattcctattagccatattttttaatagaaaatatattcacttaatatattctaacattcataaatatatatatggtataaaagcaattttgttacttaaagcatagaaacataaaaaaaactctaaaaaaagataagatatgctaaatattaaaaagtaaatacacatagtacaaatgatagttttataagaaccaactccattattatgacaacatattttctcatagtttcaaaacggcgtagttccaattaattttaatttagaatttaaacttccaagggtaaatataagaaaatcataaccaaaattcaaagcaatccaaaacaaattagtgaaaaaacacgtttacaatagtgtcaaagaataattttaagaaaagtcacccacacataaaacattcttaacacaatttaaaacaacatcagataagatgcctgcgcatgtgcgcgggctatcttcctagtttagtttaattatcaaataaataaggtaaataaacaataaaagtcatacaaagtctaactcattagaagcttgagctcggcttggcaaagcctatgaggtctagggttaggcttggccgggctcggctcatctaaagctcgagccgagctcgagtggttccggacctgagcctgcagactaatgctgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtaatggaggatggttcatggctagttgatgacaattagttgctctattcttcttcctattccattgggaacttacattaattactctttaattgattgttggttgatggttgtgtaatggaggatgggtcatgactagttgatgacaatagttgctccattcctcttcctattccatgactctaactcttaatctttcatccctcttataaaaggggaatggaattgatctccc

SEQ ID NO: 108717 - DNA, 785 bp, Oryza sativa
aagccacatcttagaggggcaaaacaatatgagcaaacgtaagaaggatatttggataattgccaagcctaggagtggcaaatagttaaattcccctgcaattaactggccttgatgcttagagcatccctggcattactctgaattagatgcaaccattacgcccttgtttatcagttatttccctggtagatagtagttttactggcacttgtttgtttcaataatgcaccaaagcagtacacatgggtccaatgtacaccaatccaaattagtaccaaatcagcccacaaaatcagtactgtgttcattagctttcttccaacaactttttatacacttcttgcaagggcatagtactatgttctctttggctaaatgggtaaaagcaaattgtataaattctttgaccccctgtatctatttagatgtgtgccctacagttcttttatggaagtttagagaagatcaatgaatggaaaaaacacatgtacgctacattaattgtcaggttactatgtacctaggaaggtccatccatctcttctgaattttttacattttggtccttttagaaaacttattttacaaatagacccctagaaaaacttattctaaaaatggtcctttttggtgcgccggaaaggctggcgccatcctccaacatggtggcgccaagttgacgtcatgcccgtgccaccccgtagatgagccggctgacgtggcaagagggggggggggcgttagccggtcctagggcgctcccattgggtgagacacgcggg

SEQ ID NO: 108718 - DNA, 684 bp, Oryza sativa
agggtacatgagcactgtgcaatgcacctggaccggaaagttaatgatgaaattgtcaccattggccacatttccttatcaatttccatgggagatttcatacatgatcgtatgggatggctacttgtgtttgaaaacaatgtgaagtgggtaaagatagtaactttgaaatcttttaagcataacatcaacttttcaacatacatgtctatatatatcagtaccagtatgagaacagttacttttactgtggaagttcataattggaacttggaagtaataataatttgcagtcattaaagaaccaactttcgccaggcatatatagtgtaggtttctactaggagtgaaggaaaacttcaaagccatactttgatgtttgctactagggctcttggaataaataacatgcagcatatggaaaggttcctgagaacctttgtccttcaatgcacctcttactacgttatgccgatgtacgtagtggctagtgttatcctgttaggttattgtaatataccataatgcagggtaatacagatggatattgcagtgcaccagtctggtggtgttcacatttagctgacaaaataaaacactgcttggatcaaacatttgttccttttatcaaaccagacgtagatacagagaacatgatgctgctcttttaaagggcaaatgcaa

SEQ ID NO: 108719 - DNA, 1085 bp, Oryza sativa
ttttttttttttgagagctcatattttgccaacagtttcattcagtcaattattgtgatacatgcgtaagatggtcagttatacaggttcaagatccctttgaggcagagaatgtatttcatcaattactttcttgactctttggagtacagtaaaccattatagggatgcttgtctgtcattgaatttataaaaaaaaagatcctttgatgcactcagtgggtgagagatactcatcggctgtagatggtggtgttttggtgtctgtttgatactgttggtacccctttactctttcttgttttgtttggatgttgaatgacataatgtgattgcttcactacggttagttaggtgacaccaatgtatcaaactatttgggtgtcatccttcaaacatttaatttttctctgataggcaatccaaaactgttcaagaaagaaagtatcaatcagagaatatttgcctcaataacttggcccattaaatgaaaatgcattaggcttgaaagacaatttattatatgaaaggaagtacatagatactttttatgaggcggtaggatggtcagggtaaatgtttatgtatttttcccatgaacagaatagattgtttcgtatgttctgttgccagctttgtttccaacttatatatctctgtacatgaatatgtctcttgatttgtttctttagataatggacatttcattaagtaactacatgtctctcgatgcctatacctactgagtgccatttgattcagtgggaagatatttttgcagctgcaattgtcagttgtttcagaaaccagaactagattatccattgaaaacttcagagtaacctcatgatccttcaataatttaatagtggcatctgaaatctatgacttgtttacaggaaataatctgttacccacttgcaatgcttcaagtaaacgtgaacaactggttcttgagcatttacctaactaactgtgttgaggtaaccatgcagaagtgcagaaactgttcataatctagtttttcagaccctgcatgaaagtgactcggtgatattaatgccgtatagttttggaaaacctgt

SEQ ID NO: 108720 - DNA, 575 bp, Oryza sativa
ctgctctgtagtctgtatactccgctagattgaagttgaacactatctctagccctgtacattacgatgctttcctgaataaactgcagcttatacaaagactgggaaggtacatttcattggcttggctccctgacatctgtctggcaacataaaaacaattagtccgtgataatcaaaataagaggggtcagaaaaacttggtaattaacatagatggaagagagccaatcttgacgtcaaagtatgtagtaaaaacttccattttcctattggctgcgaattcaagttcctagtagaagattaacagcagtaactgatttagaacttcttgatctcatacctgatgttatgctagaaggcacaacatgctaggaacaaaatgaaagactagtaaagaaacactgattttagttctttcatttgacatcaggatattttgttgtaaatttaacatgaatagaactagttgtcactatgaaacacattgaagaactagaaatactccctctgggttgataatacttgttgttttggataaggacatggttacaatggggttaataatccattga

SEQ ID NO: 108721 - DNA, 512 bp, Oryza sativa
agaatcacttgagattcatcataaaatcgcctatctggctgcactttacagcccctacgtcgcaaccaactgctccttggcacggctgtgtcgcagccgcagatagcgttgtaaagtacagccaagcaggcctctatattgccatatatagcacagacatttaggatccccttctgagcatccctataatgtcccctgagtaactggtgctatctaaagttcccaccatattaccctaggaaacagaattggcagaaacttccatctgtgtcattttccatttcacctatacacccttgcattgcatccatccatgtgacatcccagcccagattagatgatctcattaaagcccatgaggagggacaaattcccccatgtgttgagggtgtgaattggcaccaacttgctagttagtgcgcacactgaccaatatataggccagggtgcgaaagaaattgtccattaccctgagtagctggtgctatctaaagtacccaccataataccct

SEQ ID NO: 108722 - DNA, 615 bp, Oryza sativa
agcagatatgggaggctggaagtaaatagaaaactcgttacttttgaaatgtggggagacactggaaaaacagaaaactcagaaagaaaaaaaaatagacgataaatattttattaaacgcgaaaacggaaaaactggagagaatgaatgaaaaatggaaaaatctggatggttaatattttaccatgctctttgatgaagatgagatggaaaagagaaaaaagaaatacgaaaagtgggtggtaaaaaacgaaaaaaaatggacggagaaaatgtgggatgcgtaggaaaggtagggtggtaaaaaagggaaaactagaaggagggagcgttgtgcggagctcgaactaatattccgtgcgcagtgcgcatattagcgccaccgttatacctctttagttgatttgtgatgcttagtttgaggggtttttatatttcaattaatattcgtcaccttattcgtttcgatttgtattcgtgtcgcgtctgtattcgattctgttttcatatccagaattccgatttcgatttcaagaataaattataaaaataaatatgatagagctaatatttaaccatatccgatcctttttatcataatagcttatcaccact

SEQ ID NO: 108723 - DNA, 689 bp, Oryza sativa
aaaaggaaaaggtgaattttaattacttttccaattaagattaatcactgaaatgatctttgaattgttaaaaatacttgtattgctcaaataatttcaagaaaaatcttgaaaatacttggaccctcaaagtatttaacaaaattataatcagaccatttaatgattaatttaatatgtggataattactgaaatgttctttgtatgattaaaattaggagttgagctccgaaaaatccgagaaaattccagagagtatacttaaccatggagaatttaataaaaattaaatccatccatgctttatatttaggaaattttatttcccatatttaacttcacttgtaaattaatgaacatttaatataaattctaataataatttattaaataatttataaatcctaagacgaaaatcaggacgtgacagtgtgcaaccgaagaggaacaggggcggtgaaaattttttaggagaaacaacgtcgacaaatttttggcattgaatatggaaattgatgaagaagatgacggattacactgggaattgaaagaggtggtgtgaagcttgtcttgaagatgagatggaaacatgacatggtgtagacagcttcactggggatgacacaaggacgtgtgacgttagcataccgtaccttgggcctagccagctcaagtatgatgcgcaagg

SEQ ID NO: 108724 - DNA, 812 bp, Oryza sativa
atatgttaattaaacaaagtgtcattagcggcctaattatcggcttaattaccttgggcctatacgggttgaataggcccaacaaaggatggctgcaagcatatatatatatatatatagtcatgttacagcctgaagggagattggggggttgattttgttatcgtcgaaggctgctgctgccgagaccaaggagatggcgatcccatcttccactatctgatgaatgccacctgttgttagggttggaagctaagcaaggtcaggtgatcgtttctggttttgctgctggattctcaagtgaatcctattcttactgtttgtgctgaaagtgctcgggtaggagaattcatctagggttcgtttctgctattgtaaaccgaatccatctatattgtgatactatttgtttgctcctgagatatttaccggtctactatattttgggtgaattgctttattgattcaatcaattggctacggcgcatgcacacatatatacagtcttatttgcagctattatatatatttggtcgattgagacaaacaactagattctacatattttgtaccgtgaaagagaggggaaattagggtactcgctgtcgggtgctcatcaagtggtatcagagcgtggttgatcatggtacactggaatttttgtttgccaagaaattatcactgtattaaatggtgaagatgacagactacagcttcacgaaggagcttaggtttgtaccaatgctatgcacaagaacttctccgtcgaactactatgtatgggaagatgctatggaggaattcttacgagg

SEQ ID NO: 108725 - DNA, 628 bp, Oryza sativa
agttcatccatcgttgatgactaaatcatgtacttgagagcaacaaattattttatgtaataatcaggacaaattatttggttaataaaatccctaaaatacagtctgttcgacaaaagaaagcaagcagacatgtatataacacttccattttctagtaatcttattttccaaggacattttctgataatcttgaaaaatctaaggcttgataacatattgcatatccacagatgatttaacctgccatatttcattatcttggccctagcttatttgtattccacaaatttataaagtagaagcatatctgtatatctaacctcatagttcggaatatatacaaagataaatgcattcttcagtcttggtgagacaaaatgaacagttaagaagacagtacatatggtcaacatataaaatcactcacactttgttgtggcttggattaataatgtaatctgaaattatagtggaaggttcaagaaaattacaaggacaactggctttgcatagtataccataaaagtggccaaaaggaaagcgataactatttccccagtcgttaactcatgatggatcagcaagcaatatcactgaagtcttatatcttccaactcctattttt

SEQ ID NO: 108726 - DNA, 1104 bp, Oryza sativa
tggaataagttcatctggtctctaaacttgtcaacaaatccgattttcgtccttcaacccaaaaaccagatacaacggctccctcaattgtcaaaactggtgcaacataagtcccaaggtggtttggaaggccattttggtcaatgtggcgcctacgtggttcctttgacaaggtattcgtcccacgtggcattaatgtggcgcttacatggcaattcgatcccaaaaaaataataaaaaccgtggacccacatgtcagctacacacacaaaataattaaaaaatagtggggctcacgtgggccccaaatgtcataatcactcctccctcttcgtcctcctctctccccccatctcccctctctccaatcttcatctctctcccatttttgcacgtgatattgtagattgaaggtgcttaaaattagcccatcattatctccgtgcacttgcccgcgcattgcgcctccatgctcgggatccgcttctacatgcacaacttgacgcactcacatatgtagttctgccatgcctacgccgccggcaacatcgccgccatggcaaccaccactaccaccacaaatgttgcagcaactggggttcccgatatttcaatgagggagaggataacttcgatttgggggaggaaatgatgttagcggtctgactacaactaccataggggtgctacgtcttagcaaccggtacaccaactccactccattgtcattcttgtcgtgtcaagaacaacattgaacctgcaagcaataaaataacaagcaagaacaaattgataaggaaagaactcacggcacttgtcaattgatgaaattgaaatacatgaatgtggggttctaaatataggtatacgggtggtctagccgacacatgcgagtacaaggaagtagctgaagctaaacttacatataaacaaaacctatgttacaaaggtgattgctaagggtttatataggtggatgaccaggagggggtggtagggagcaaaccctagtctttgtggacccctaataggctatgtgaatacaaggtctaagcccaaatttctggtccgaatattatttttattattctaggcaactccact

SEQ ID NO: 108727 - DNA, 690 bp, Oryza sativa
agtttgtatcgaaagaaccaacaacagctagacggacctggttacataatggtcaacatagacaggcacattaatacatcgtgacatctatcattcacatatggcccctcatgtgtctatgatatatgggttcagtgtcaaatccttaattggcacttgtaagagtggcaaatagttaaatatttccattcggtctatctgttacgtgcttgtaaataaattgctgttgtgaaatatttttagaatgtgtatagtgaaacttccataacttttacaactacttgtacaaactgatcctatttagatttaccgtctgaggattttaaaattggatttgacagccctcacgatctttttgcatgccaacatccagtctaacctgattagatatgcagaacacatcaaattgtgatagtcaggtaatgtatacgatatatatgggtgggaacaccaactgtcattttggccacaaaggaattcacttggcttcaatccccttcacaccactagaaactgcataattcactaaaacgaccatgtgttactacgttgagttttagttattataaacttaaaaaatagattaatctaatattttagagcaactttcatatagaaagttttcgcacgaaacacaccgttagcagtttgaaatgcgtgccacgaatatctaaaattttatccaccctt

SEQ ID NO: 108728 - DNA, 519 bp, Oryza sativa
tctctgcttcatctctctccgcacgcgcgcgtcattaattaatttgatggtagcgttgaattctttaacactcaaacagtttacatgcttattctcgcgaataaacaaattaacaaacaaacaaaacacctttttacatcatttaacgacatcaaagctatatgctactccgtatatgccttttcgtgagctataaattaacacatgtagatgagcaattgtaccgaaggtcgttgcaacaacgacatttttaccccgtggctctagctagctttcacccagtttggtccagtgtcacatcatccccaattgaccccctctacttaattactccgtgccaccttatttgacatgattccacattattaaacaccaactcgatgatctcacacaaacattcatgaatgacaaaaaaccccttttaattatgccactgctccctttttgctaacctccttaatttgcacacaatgcaactagctaggagtagtactacctccattttttaatagatgacgc

SEQ ID NO: 108729 - DNA, 763 bp, Oryza sativa
tagataaggctcgcttagaggccgggcaatcaggctagtctttacatggcacatcgcattaacaacggcgtgtgatgtacgtgcgcttgcattatttattatattttggattttggatgtgcatgtcgttttaaaattttcttcttaggaaacttgggacggatcggtttcggtgtatatttctgggcgaaaggaacgggcacagggttgctggagggtaccttttgggggttggaggtacgagcaattctgcttaaaatattggaggtacaaattaaggtcatgaggttgatttggtttaagtactactatatatatgtcgacattttcttcttaattttgccattttaatagtttccatgatcagtctcgaaggaactgctggctttcacccaacgtccggttttgactttgggcgtgtgtgtaggcaaaagtggcaaacagctattactagataggaagctgcactacacaaagggaggaggagagatgcacaaaccacagagtgaggtaccatgttaaggtcagagtcgtcatcacaggtgtcaaggcattcacatacgattcaatcaacttctctgtatctcacttgtcctccgttgctgttgagccatcgaagaggtcagactctcatcagagtcggccaggactgtttaaaattaatctctttttcttttcatcgccgtgtttgagtgtcagggttgataagcatggcgatgggtgcggttgtgacttgataaatgcaagtcaaagggctgcagga

SEQ ID NO: 108730 - DNA, 600 bp, Oryza sativa
atgcattattgcaaattgcaggggccgtccagtcggttgaagacaacgtgtacaacttggtacaacttcactggccgtgatcgacgggacgatgcacgaggaaggagtataagtatacattcttgtgttaaagaaatagagatcagcaattatacttgaatttaaatcattgctaaattgtctatagaaaatactctgttaactagaaggaaaccataattaacaatgcgttttataatcggaattgtcagggagaatttttttttaattctctttgctttaaatcattaacaggacattcagaggaatattcagagcagataaagtaataatgttaagttaaaatgccaggaattgaattaataattttttcctctccctcctttggtcgagaaccatccccggctcactctccccgttcgtggttcgtcgtaaacgccaacccctttgccgccgcttgccgcgctgctgtgcgccgcagcttgccacgctgctcctgtgcaccgccaccgcactgccaccgcgtcgcagccgcattgccggctgtgccgcaccaccgtcgctagccactaaccgttcgttcgcacgtagtatagatgt

SEQ ID NO: 108731 - DNA, 590 bp, Oryza sativa
caaaaaaaaaatatccaagcgatttcatacaataaatttcatcttaactaaaccgtataacaataataagattaaaatagtcttcactcgttttaacgcacgagtatttttttctagtctaattaaaaataaaaatagtacaaatgaatttaacgttgtatataaattgagaatcataattatttatctatttaaaatttaaactattttgtaatgagttgttagaaaataggagaaaaggggacggtatatggaatacgtcacatatgtacctactccacttacgtacggtggcatgtacggcaagggaagggaagggtacaaattctgtgagatatatctaatagggatgtttttcttttttcttaaaatttctaggattttttctaatttattagagtgccacgtggcgacttaaaagcgtttgtagagcgccacgtgacggcttgagagcgtttttatgaagtttaatgcacttttaatatataatagatagatagatttctaacgacttcttttgtattttcaaaaagcaaaaaaacttaaaatccgactcaaacaaacggattagtatttccaaaagtgaatga

SEQ ID NO: 108732 - DNA, 736 bp, Oryza sativa
tcctgcagcccgaaaaaattgagtggtgaagggttgtgattggttaagaagagaatgtttgtgaagaagttgttatattttgggatggagggagtaggaaaaaaaaagaagatggcagtcgtaggtactgcaactctaccagcactaccagctgcaagtcgtctcctcaaatactccatacgaaaatatgttgctgtagaagaacgagctttcatactactcatcaatcaaaaaagaaaacaacaattggataccactgtatataattttgactaactcctaacaaagcaaatacaacaatttttaaaaatgccgaaaaccccctaacttccgtataacctgaaaaatggtccataaaataatagtgttgtaatatttctaattaagttcatatgcgtgtgcataattatacctaaaaattctattataaattaaaatttgaaattgtaaactctatatgttgtactctctcctttttaatatatgacgccgttaattttttaagatatttttaaccattcatctttttcaaaattttttaattatgatttattttattatgacttgatttatcgtcaaatattttttaagcatgtcttaaatatttttatatttgcaaaaaaaaaattaaacaagacgaatggtcaaacgtttgtagaaaatcaacggcgtttatatattaaaaaacgaaggtagtaacacttaacaaacaatgtgcaaggaaaaagagctatat

SEQ ID NO: 108733 - DNA, 838 bp, Oryza sativa
agaccaagataaaaatgtttgttggtgttatgaagctctggtactaaagctccgtaggtttctgttacttttgctagtagaaattgacgcgtgctagggtactttgtaagaagctctttatattaactagaacctggggcgcgccgttggcgcgccgcctgggcggaaagatggtgaaaaagaagtggataattaggagatacaacttcatacgccgggtgcaacgacttcattcaaccagctaataaactgatggtgacaatgtaacttgcaattgttagagagtaccgggccgcaactttatttaagtttcttgtaaccggttgcttgagcacgattacaatagtgagatcatatgccacagctccatagtttgtgtacagataatacatcatgaagcagaattggaaaaggaaagatctatttacagagatgcctatctcttctagaagggggaaaaaccttaattcctttcatgtgaagatgcttaacaatgcgctatttccttcatctgtacaacaaaagaaaagcaagcattaatctacgcaggagaaaacacatcagcgccatatatatatatatatatatatataaaccatgagaccgtaagaaaccatcgagggagcaaccatgtaaacaacaacgacgtgaaacctaaactaattaaatgaaacacaacatatccaactaagtgtaatccgcaaactaaataacaaaataatttaagaaatgaacatggcacccacaaaactgtcacagtgcatctcctcaagaagcaaggtccaataaatgatgattgcctgtaacgctccagcaaatcatccttaccctagctaaa

SEQ ID NO: 108734 - DNA, 530 bp, Oryza sativa
ataatttgaaggcatcctctcctaggggcgttatattgatatgggcatgtgaccgcttgttcaagtaaaactagttcatgtgggtatggggagataacacatccttccttactgggaaaggagtttccgtctttatttgcaatattcatatatctaggtatacctttgtgtgtgtgtataaatataaatatacaatactaagtatccagtattttcggtggttactgttaggatacgcgtaggctacgatagcataaatcaaaattttctatcacgtaaaccatgaaccatgcaagtatttgatcatagatcgttaccactcgacgtgctgcgcagcggaagaagacactgagaagtcgaaggaattctcgcgaagtagcgtgcgtcgatgtagaggaagtagtcgatcgcaccggctcgaccttctcctcctcgtgcgttctcctcgccgtactcccacgccgatcagcaccgcaaaccagcggcgcctctatcggtatccacacgtatagggacggaacgccacgcgc

SEQ ID NO: 108735 - DNA, 529 bp, Oryza sativa
attatatctatcggattttaattcaaagattaaaaatctgtgtgatacgatcataaaaatctttcgaatataggtactctcaaaaaaaaaactagaagctagatgggctctttgctcgcctctaatgcggactactcaacgctgacgttgaaaaaaaaaattgatcaatatataggaactcaatcggacagaacaaccaggacgaacgaaaaataggtaaatatatagataaaaccgattcaaatatgaatatgaatgatgtaacaaaattctagtaaaaacatctttaatttttataatagtagatagattttttttctccggtaatttttacgggattttttcttcatcgttttctaaaccgcggtttcttttttcgcgtgactttttttttacggtcagttttttttcatctttttctcgccatttttttttccgttctagaccggatcggactttttttttcactgtttttctttcccgttttattacaatgcgttttctttttcccctgattttttttcttccc

SEQ ID NO: 108736 - DNA, 693 bp, Oryza sativa
ttcctgcagcccgatgtaccatgatcaatggcactactggaactcgccttagatttagcacaacactaatgaggtaaattagaacatgaacaaccagacaactaccctacccctgcatcagaaatatgaagttgcatcgatgagtttttatctcagccgtcataagcagtgaagaaaatcaagaaaaacttgtaattgtaccaacaagtgagatggacagatggttgcacctcattaaaaataataaggcccaaacctcctctccccacctgatgctggcctcctcccttgttccccatcacatagctccagctgctgctgccatctctcctgcgcgacatgttcagaaatctggccaccctcactgtatgcaaaattgaagctcatcagaaaagactgcaacaaagaacaaccaagcaactcctctgagcatagccttgccacctcttaattatcattgcatagtgatgtaaacacattcatgaaacaaaaaaattatccacaggcagagaaacacgcaacctttgatcacgtgaacacgagaaaggatcagtcattctgtgcaactccattatcctcatatacataatagaatccgcacaaaattggaatcatgctgcatcagtaaagattcggggatgagaggagatttcttcccgtaactcaccgagatggccactgagaagagtcatg

SEQ ID NO: 108737 - DNA, 562 bp, Oryza sativa
tttttctagggaagggtattttttcacccgacactctacatccaacaaattatgttaaaaactgcatatataggacctaggacctcgatgaatagtttttttttttttgacaagggtatttttatacgtgaactcttcatccaactagacatatgcaatattttagttatcaaataacccaatctaaaatcgctcctatgaagatttgaacttagaaccttttagctctcaaataacccaatctaaaattcgctcttatggagatttgaacttagaaccttgggtgctactcaggtcactgcaaccactaggcaaatataggacattgatgaatagtttaggcacataaaaactataaatgtagcaatgacaccctgctctcacgacacacaaaaaaaagttcacgaatatgtgcttacgtcacctagacaggctgcaaaacaaagtgatagcaccgtcatacttgtcatcgaagaacattgtaaatattgattagatgttatgcaggtatcttgattcttgcatagttgtggacgccacaggtacccaatctcttgtggat

SEQ ID NO: 108738 - DNA, 708 bp, Oryza sativa
atcgtcggcagaagaggcttgttttccaagtaagttttgtttttttttccccaaaatgtgtgtccttcgcaggatattactgactgatgggtattgtttggtagagctttatattgaaggttaagtttctatattgttgatgggtattgtttctttcttgttctttacatgtagccactgttaggagtctatattggttcgtgacttttttttagttatgcttgtttaacatagtttgatcggaggggcagaatctttctgttgcacagccaattatttgtgttgcatttgttggggataaatcaacagtagcatctgataatactaacaataaagtagtgagttggtctgtactgcatctgttgatgctcatttttccacaagagtgcacaattattgtaggctcaatatcttgctccctccatctgcttttgatagtcatatttccaaatctgaaaaatttatttttgataggcatatttcaatccaacaacctatcctcttaatgactttctcggatttaatgcgtgactctccattctttctttgatagtcatatttccaaatctgaaaaatttatttttgataggcatatttcaatccaacaatctatcctcttaatgactttctcggatttaatgcgtgactctccattctttcacacaagattggctacatgggcatcgagaaatgcaaatattaatgatt

SEQ ID NO: 108739 - DNA, 667 bp, Oryza sativa
tgtagccttggaagtgtcctaatgggcctttctagcactcatgttggttcatgtagaatagttttcataccacataagttaaaaatctaatgcgtgcagcttgaattaaataatgacgatttcccaactccctatttttgttaatatgcttatatactccaacgatatctttattcatctactatatatttataatttcagaatataaagatggagctttgttaatctaggtgagggggagggggaatgggatgttacttcgttttttatatagtttgcctttaaatatagatctaatggctgaaataatgattttatcgaggtcagatgcttcgtgcttttagaatttctgtgatttttattaatttttaagatgtgatatgtagctgcttatgagagtagaatgatatatcaaatggttgaaaataatacgcctgccatttaagtgtgaaatgatggtaggatgttttgttttttctttctcatagaatttcaaggatatttcttaatttttaagttgtgacaggtgatggtttgcgtcctagatgatactcctatttagtgtacatatttatatatagaatgatttaagatggtataattattatcatttttttatattgtttaatgactgccacgctagggtctatgtccaaacgtatttcag

SEQ ID NO: 108740 - DNA, 1162 bp, Oryza sativa
tcactgcccaacactaaaccacgttgcaacatgcccgtccaaaccacttgaactacaccagttcattatgtcatattattaagaataagactaatcacggcgagctggttgaccgctcaataaccatgggcacggctattcgaatgttttactctgataagaggtatacaactttacccataagacacagcctcacaacacgttactgtgcgccgacatgctaccatgacataccagaaagaaactgtgacagaacctttcgcataaccctccctaaccaagcatacccaccgtaggtttcacctccactccttaaaaaggcagtggacagtcccctctcgtgcctaggtaaatccagaaacagtagagaccagagccaagtccgaattgcaccatctcctctacccttgccatggtatgttgattaggttaggctacactctagattcagcctggagcccatgctggcctttgataagtatgtgtttatcttctagggactcccgagaactggtctttaattgtcatgggtacgacttgcaaaaccatgcaaccacaacccaccattaaagcatattttagtttaattaaaccataaccatggcggtacatcatcatataattaaggactaatttatagcgaatcccattgtgaactaattaaaagtgcatctaggcccctaatgattttgatgattgattacaatgcgattagagaggactaacacttttattcaagcaaatgtgaaggttgttatgtcctcgacatgttgtaatgtgatgcatatctcgtgaatgcgacatcacgatgcaatgcggcaatgatcaaatggtatatgtatcttttaccttgcattgtgtcgtaggaatgccgtactattaagaggaataccacatgaatataattggtagaacactagtgctcaaaatgcttcatctttgtgtgagttgaaaaacctaagccaaaatttcaatcccgagttgtttcacttgtcacaacacttacaccgggtttctttgcaagtttttcaacatctcttgaaggttttggaccatgttttatgttgggtttgatagcccacgaaactagctttccatagagtccaagatcttagaaatcggagttcggagtaaaaagttattgctttcttacttgagcaac

SEQ ID NO: 108741 - DNA, 677 bp, Oryza sativa
tatatgctgccaatatgtccaggtggaccgttaatggcgacaactcagtacaggtattcctccgcgcgtgtatataatcctaagttactttcctggggagggtactcctctgtatttacccccggttggatggtcatgacggattatcgtaagaaactctgcaatcaggggtggcttctcaaagcaccaggagggcattggaaagagggtattagctatcgtataattaggatgtatgtataatgtgtatgtatattagaagtgtaggaacagattctttctattttcttaccgcttagcttagatgatttattatgagagtatatagttctcttgccgtgtgtcactctaccctattcattatcttaacccttgccgtatgagacattgattattcattatcttaacccttgcctagacatgtgtctagtttcattaacatctatatgtatgtgggcaatgctagaaagtcttacattatgaaacggagggagtataaattattagtatacgatacccttggaatactctcaggtgaaatactataatggtatatccgtgcgattacggatgaaattgtaccataatatacccaagtatttcggtgccattgctgggaattatatttctagtaatgtcgttaacaaataccaacatatacgtggtgtctaggttgt

SEQ ID NO: 108742 - DNA, 669 bp, Oryza sativa
agaaaaatagtccaatttaacttgatagatcaaatttgatttatacttctcaaccgtaaagcctagtatatcgactcctctaactactaaaataatgtaaaatgactttcttagcagtactgacaatggattttgctgatgtgttgtccacgtaattaacagcccaatcataaaagaaatttaaaaaataggcatcaggccaaggtgtaatagactttcctctctccgcttgtctcatctttttcctccggaggcggtcccctctctctttctcttggcggatgcagaaagaaaccataggtcatagcttgagctgggctagcttgaacattagcgtgctgtcatgttaaggtgtgccagcttgcacgtccttcacctccaccaccaggcatcgtctatcttctcctcgtccaaggcctcttttcctaggctcagcacttaccatgcgcggtgaggtgatgattgcgcttagatcctcgtgagcctgacggatacagatcgatgacgaggttgttggcttggatggggttggcgtcagctgctcaagcattagcgacacgcacgactcgacaaggggatggcgcctgaccgctacgcttcgccatgctccccaaaccgttcgtggtacatgctatagttccacttgtctgtgtccatgaacgcgaagtt

SEQ ID NO: 108743 - DNA, 1317 bp, Oryza sativa
gacagtgaagattgaacatgggaagagataaaggaagaatatggagcaggaagaagatggaagaaaaacgtgacggtagtaatacggttttaattttataaaattttaatggcatagctgtgaataaacgaattataatgatatttatctaaaatgatatatttaacatggcatggatcgaattaattaaccattttttaatgattgtagtgccacgtagatgcaagtcaatgcaacacgtggataccatatcacatatcagggaaaaccattgttaatattgtcgagggagtcattttacgctagttttaacaaccattatatcccgttttgtactttagggtacgaattagattgaacctacatgaaggagtagaaatagactttattttccttgtaagggaacatagggatgagatgggcttgcctgtagaaattggattaggtgggcttgttcgtaggaattgcgctgggctgttttggtggctgctaagtattgtcaattcaattttgctatatatttgtcgataatttttctttcaaaaatttgacatatgtaattacagtaaaatcatagtgtgattacactataacttgcatgtaacttgtatgtaactttcaaaaatctctccgtaacatgttgtttcggtaaaatggaggtcgtgggaacaaatcctttcacatatgtgtgtgctgtgattttttttcttccttactagaacaaatcttgtaatagatctaacgattcaaaattacatgaaacttgcatacaagttacactgtagttacatacaagttacagtataattaaatacaagttacagtgtaattacactacgattgtagtataattacatctgtcaattttataggaaaaaatttatcaataaatgtataggtagtccctggttaatttcaatcacaagtaagatcatataaccttatttctagcattaagattatgtgataatcaattaatgtggaatttgaaaccagcgcactcccataaactagccatgcgctcccattggttggttttggaagaccatgaaggaggtggtacgtgtttttccggcggtgttaggaaaaaaaacgaactaaaaggcgagtcttataagacatttagtgatctaggaccaaacccatttaagctagataacactattgtgttttgctccataatatatggatgaatatatttgggttagatgttatagaaatgatgaacggatttgggttaaaatattatgaatattacgatgtgagaagaaataatgatttgtcatactatgctaggtttaaaaatgcaataaattg

SEQ ID NO: 108744 - DNA, 529 bp, Oryza sativa
atataagaatattgtaaatctgtatcacaaaatggttgtacaaatgaaaaaaataccggctcaatcacatacgagtgataaaattactcgcatgtgaatcaaactagaaaaaaatgattcaactaaaaattcatcgtgaagctgggatcctgatggctttgctagatcttgctataaggatgaagagactgatctttgccttgtgactggtagtggagagggcatgttatgcccagaaattcgactcgaatttcaagcagaatatgtattaaaatctctgtccaggaccagacagagtacacaaacaacaaattgatacatagatccacgtcttacaaaaataataaataattcttacaaacgcagcggaaatgaacaaaacttctaaacttaatcttcacaaccaaagcatagctttctccataatccacaggcatcctcaacgtctggaacaagcttaatcctcgtagaactcatcatctgaataattctctacttctggggtggggataaataaagcaatactgag

SEQ ID NO: 108745 - DNA, 681 bp, Oryza sativa
cggctcgccattgatgggtgctagagtttttctgcggtgagtcacgcgcacatatacactactacaccgttcttgttgtgttcatcgatcgaccaaaggctagctagctagctagcacagtaatattgatttccaattccaacctgtggatgaattcaagaaagcattgccgatgtgtgtgtgctcttgcatgtatgtaccacgatcatatcagaaagcttcaaaacaagaggagaaaaagaaatgttactagctatagtacatatagtagttgtgttgaggagagaactaattaatggatatgcctgttcctttcaaaaaaaaaatcacatcattctttgctatttgttgtctagtttaattatctccattattacagccaaggcatcctttggaattaatgtgggattttatcctattcctacataagccgaactgatcactattgttcatttcttgtgtttcaaagaaggcggaaatatgtatggaataagaaaaaaataatgatatgcgcatgcagtgcacagtcgctgtaacttgcagtaaactgtaactatctcagctgtacatgttgctagctcaagtggcgtttttgcttcgcttcttgggaaacggtttcatggtcgttaagtgagttgtacgtcgcagggatggtaggggatagatcgatcgatcagattg

SEQ ID NO: 108746 - DNA, 1129 bp, Oryza sativa
ccatccaaacttgctcctccgccatgattttctgctggtggaagtatgactcacagcgattaatgaatacgagcggatcggacttgccattatacttgggaaaatcaagtttctggaagcgcggaggtggccggtcggtgttggtctcccccatgcccgccctgggacctgaggacgacgacttgtcggcggagagtgcgaggattgccttggtgttggccgccgcggtcgcctggagggccttgacggtctcggcgagctgcgcgatggtggtcttgaggtcgtcggtgtcgctcatggcggcagcgcaggaagcggatgaagacgaggtaggggatgttggcacggcgggcggtgtaggggaggtggtgcgggaaggagaggatcgccgggatcgtgataccaggttgtcaagtgcctcggcacccaacgacgctggaccgcgactacgtagctcgtagctgcgctccagtcctcaccgcaaggttttgcccctcggctggtggcttgcgattagtggagagagagattaggaatgacaatctattggctgcccttccaacgagactgattacaggattatatggccactggcctaaccaattatagaaggctatccttaattctagggacaccaaaagtagcagcagatttcttctttcctttcttcagccactggacgtcgccgtcgcgcgctcggccgctcggcgcatgtcacgcctgcgcctgtacgtgcggccgtacatgacatctccccctccgtcgaagtccagctcgtcctcgagctgaaacgctgggtaccgggcgcggaagtcgtcgaggtcttcccaagtggccgactcatcagcctcgtcgcgccactggacgagcacctgccgaacgccgcgagccagacggccacgtgtgacgcgtgcacgttctggaaccaccaccccatggagagtacgaggcagcgccggggtggaagtgggcggcctgcccacaaacttgttgagcattcctacatggaagacatcatgaagacaggcgcccggcggaagctgcagccgcacggccacatcgttgatgacttccgtgacgcggatgggcccgacgtatatgaggcttcagtttccccgtagtggtgcgc

SEQ ID NO: 108747 - DNA, 1311 bp, Oryza sativa
aactagtgaaatgataagcatacccaacagcaacctgttatacaccgtaatcatgcatctagcatttgggggctggacatgtttcttttcaaagaaccgtgcataaatattcttgtgcactttttttttcaccttttgaaactccactaataacataatgaatatcaaatcacatctttgaacaagaaagacaggcctcatgtcatgtcaacacataaaatagttagctacttaatactacagtgaaagacagccacctaaatcaacagattagtagttatatggaactgaatgaactgacattcaaaatgttttatcctttgaccaacagcttaaaagtttaagtgctggattttctagatgcgctcaacagtcaccattaagcagcaaaaaagctgcatgcttaataaacatgacttagaggttgggatttgggaaagggtgcaattgcactgatatattataaacaaccatctgacagaattaattgcgaataacagaacattgctagcaatcaatttgtgtaattccaatttgttcaaatctccaacatcttttttttttctttttcagtagcattgcagtataccagagatctagatgacttctcaaggttagatgagacattggtactgctaatttggcaatagcttcataagtctttacctttcaagagttaagacctaattattgtgactaatcctgatgtctgatggcacacatactacaatccagcagagtatgtatcacatgagacaactaagatgggacatcagctgcggcattaaacccaacagaaacccaccactcttcagcatctccaatcgaaccaacccacattatctaaaaatcgaaacaaagaaaaagcacaaaaatagccaaggtaccataccaggatgctcccaagaaccacttccaagaacagtccccccagctcaccgagatccaagatggaggtcacgcaaccgcagatctgccacctccctgcccacagcaagaacatatatcagcggagctcgaccaagcagagagagaacgccacttcaagaaacatgaaagatgagtcaccttcttgagtgagtccggcgactgtggcggcgaacggcggtgacggcgctcggcggtggcagcgaacggcggtgacggcacgcggcggtgacggcgcgcggttgtggcggcggcggcggcagtgcgcggcggcgcaccgcgcacaggcgcgtgcggggagtgtagggtttggaatggagtggggatagtccggtttgttttggaggctaacccatgggctgaatccatggatagtcttcacag

SEQ ID NO: 108748 - DNA, 674 bp, Oryza sativa
ccattagatgtcacaccctgcccctgtatatataggggtcttaggaggagatagaccttatctctactccggttcggattggcccacaagaaacttatctccaagagatttgtttcacaacactcccccttgggctaatccacgaccaactcatgcctcgtcaaaactcctaccaaaacccagtgggaaaaaggctaggagaaagtgtacgtagttatcactcatgcattgcacgttgttgcctcgttaaaaaccttatgtgaggagcaccaacttcactcactcaagggaaaaagagtacgacactaaggactgcacggtccatcttgtgggtcatgttctagggtgctctccccctgaacctagcaaacatcaaagtcttctcatcccgattctctggaaaagcttccgagaactaaaagctgggagagactaagtgatcaatcctctagattatcactcaacttgaattgctactcacctcacctcgcctcaggagtctgtgaggtagcccacttgtatttggtgtcggtcaataaagacatatcttattatgataggaccttaggaacaggtctaagtgatcgtcatcgagtcaatgccctgggcatactctaagacatttcaatgtctcgcaaatgacaatcaacacatagcacatactccccctgatg

SEQ ID NO: 108749 - DNA, 703 bp, Oryza sativa
aacataattcatcataacaagcctttacctcttgttgaagatcaaaaccgatgcagctcaacccgaaagcaagaactcgtcgaaataaaactaaagcaaaaaggtggcgatgcaccgagattgtattgaacgtgtgtgttaaaagttacatagggctcgggtctatttatacccgaaaattacaagatatgtccataacggacacaacaactatctctaacaaactctaagataccataagcctttgcgacagacttttgcccaagcatatctctaaggaaattacataaaacaccctaattaatagatacaattgccttctcaggactctatccatgtgcggcaatcatcttgaagcacctcaatttaacccgatgtcatacatcaagttgcattgtcggaatcggctgcatcggcttgcctagcccgactcagacccagccgatcctaatcgtagccgatctggactccagctgatttctgctctgttttcgaactcgatctccgcctccgactttgcttcgatctaatcttctttcccgatgccgatattaccaaatttggttgttaacacgtgtattaacggtgtagtatatttttatagttagctactgtattaatggactattagattagctatagatgatttggagccaacagttggctgtactattaaactcttaagaggttagctagcccaata

SEQ ID NO: 108750 - DNA, 964 bp, Oryza sativa
tggggaaaagagtatttccctgcttaatatctctgatttgtccgtgactcggtgtctcgacaaaattaatttgatgttgtagatgtcgatatattttctatacttagttaaagttaggaaagttttgacttatgaaataaataaaattgtcttacaatatgaatggcattaagggagtaaggcagtaagagccatgcattagttctcacaaaacatattaaacttctccaactttaaagccttagccagcagtgcaccattcagccattccactattccagcccaacagattggaagcaggaggcctaattcccaatgaaaatattcccaggcggctgctccgtatgacctagcgtggttgaaggccttgaatggcgtggttttatttgtgaagacagcctttgaattgtgccaggatagaacaaaatgaagaagaaaaaataatattcaagttagtatagtaaagtacttctaacttcaccaggactcaaaggatgttcaatctttttctattttagctatttcttgaaatttcaatgtctaattaagttcttaccagacagtttgtccgtaggttgtagtttctaaatattgtttaattttttcagttgatataaggtagtcaattgggtataatctccattgaacaaaatagacgatggaagttataatatttaatttctccttttatcaatatgttcatatgtattaagtttttttaaaacaaatgtgttacgttgttaagttatgaataggaaaccggtaaaaaagaagtcatgaagagcaaggaaccagtagattttcaccgagctagcaaagaaatgctggccaaatttattaacaagagaagggccgtcatcataagaagaggaagaaaccaatagattgctttatattgagaatggtttagctcctagctaaggtctcatcttttctcttatgcttatgcttatcagctaaaatt

SEQ ID NO: 108751 - DNA, 787 bp, Oryza sativa
  unsure (1)..(787): unsure at all n locations
ttggattttggaggagaggaaatggggtgggttggtttggcatgccattccatgaggaggtgggctggggtggattcaaattggatctcagcccactggcaggcttattcacccgtcgtctttttcagctaaaacgcgggtattgggtggcattaagctgtaatcaattgttgttattggcggtctgtcatgaaaatgctctagaagtctagagtctagatgtaaaggcaaggaatgttcatgtggtgaatagcgatgcatctgaggagaaatatctagtgttctactatcatggtgatctcacgctcgtgggcttcgttggcagacaacgtggagagcatatataaaaggcacgcaggataatgctgaaggatacagtgggacaatcttgagttgctactacgtgattgaaacttgcccgaagctttttcagtagcgcgaacatgttcgactggattttccttatggaagagatgttgaactaactgttggtaacttttttttttgacaaattgacaagcacaattatagcacctaacatttgcggtgatcttagagtcgctaattacctcaatctaacaaaagctaaaccaagatgggttttgataactaaaccggctagtgtgagccgattctagaaactggctagcggagccgattctagatactacccgtctcgtgggcaaaacggaaggttttcaggacaaacctacaaagaggtgtcgcactctcgcagcggggcggacgatttacagcgcanatcgaccaagatggacaaactaagaga

SEQ ID NO: 108752 - DNA, 535 bp, Oryza sativa
agaacgtggacgagctgttgcggagggaatcgtgggaacgtgggttagtgcctgcaaaaggatagcgacgtgacgtgacgcacgcacgctgccagccacgccacgccacgcccacgccctcgcccacgggcccggcccggcccagcccggcgcgcgcgcgcgtgtatcattccgacccctacctcaactggtcaacagggagcctccaataactccctatttaggttgagatatttctcgcttaaatcctgaggtggtattattatcctcaacacttattatgggcctttgagatttaatattataagttgggcctagcccaattattctaacaatccccaccaaatttcaaggctcataagaaatgttctcaatgttgtgcctgtttgatataccagggttttggtggagactgttaagttgaacttccacctaggaaatgagctacatcagaccacaactgaacaatggactatgccttgaattgtgagttttgtgtaatcagatttcactcagaaccttgactggtactggg

SEQ ID NO: 108753 - DNA, 1013 bp, Oryza sativa
ttttaagatagagggagcaccttatttgggtagaattttgttaatagagtcatcagcaacaactagaaaagtgctcatgctttgttataggtaaaagacaatacattacaaaatgctatagacaatatatatattttttatcaaatatgcatgttactatcacttcattgcttatttaaatatatatatattcacttgtttgaaataaatactggactattccataatatcataaattatcaatggctcatttataaaaattgcaaaaacaaagggtgagttggtcgtggcatattcaatgttatcatcatcagtggcttctaaagaagtatatactccatccattttatattataagccgtttgattcttttatgaaaattctttaggtttaattaagtttataaaaataattagcaacatccacaccactaaattagttttattaaatttaatactgaatatatttgatacgttgttcgttttgtattgaaatgtattgctattttttttctataaactagcatagtggcccgcgcaaattgcgcggctagcatcattatattttctttcatataatagcatatatattttctcaatgtattattcaaatatattagaatggcaacataatttaaattttgtactaactttacgaaactattaatgtgtaatattcatattgtattttatatgcgtgttagttattaataattttaaatatcaaattttagttatttgtaaattatattcctatatggactctagactcgtctttcaatatttcttttctttaattccgattttttgttttctgtgaattgtatttctatataaactctagactcttctttcaatattatttatttttaattctgaatttttattattctaattgtatttttatgtgaactctaaactcatctttcaatattctttaatttttaatttcgaatttcagttacttctaaattatattcttatattgactttagactcttcttcccatgtttt

SEQ ID NO: 108754 - DNA, 640 bp, Oryza sativa
aaatcatatattactaggctcgttggaagctcgagcttcgcgagcttaggaagaggctcgggctcggctcgtctggagctcgagccgagctcgagcagctcgcgagcctcgagattttttgacagccctatccacaaccactatagtatgctttgctccactgctaccctaacagccactgaagcgttacattctgtcgctgctctaatacgattcaacagcggtagggatcgatttatgaacgcactatagcgaagatgctaaaatacaaaattgtcgccactgtggacaaccacgccaacgcatgagctgcggcatttgtactttggacctcgacttatgtaaagtatggatttcatatgacataggaaacttttatggtatcatagagactttggaaaagatgtacaaatttgtcctgatatcaagtatgttaaacctgcacggtgacatctaagaacctataattaaagagcaattttacggtccttaaggaggtaacatgaggtaccattttttctattgtaaatttagtacctcttggtaccttggtactaggtacctaggtaccaaaggtactaaaatttggtacctcatggtacctgctcaagaaccgtagaattgctcataattaaaaccg

SEQ ID NO: 108755 - DNA, 913 bp, Oryza sativa
aaaaaataacactcttttaccaaaataacatgcaagcacaatataatctagaaaactatccattttcttcttatttttattagatcaattttaagttgcgttgtttgagacaaaatttatttcaacatgcccgtcgcgtgcgggaggacgctaggtggcgtggcgcgccccggcaccgcacagtcaacaataccatgagagtcgttattagggcaagttttatatagaggtggtagtcatctccaattttatccacatcatccatccataaaattaaaactaacttatataaatgcattgcatttaatacactagtcccaatacacttgtcaccaataaacccctctcattttctcttgttcttgaaattcgtatggaggttgctccttgcatgaggggtgagtcctcctcctcctcctcctctctctctctcctccaaatcatcatttaagcatacatgacactttagagtttgtgcttagaactttatagtacttgcctttagggacgtcacactggcttggccttctgccgccgtcggacttttcactgggccgtacttcagtcgagatttcgaatgtagctgtatttgttgtatatcagttgtgttcttttggaggggttgggaacctctcccctccgcaagcaaaacgaagcgatagattaacacatgattaattaagtattagctatgattaattaagatgagttatgaactatgggagacaacatatcccgtagaagagaacctttgcctcctcgacgtggactagtctgcttgctctaaagctaaagctttttgggagcgtagttacaagtagtctatagtactacagtctctcttccaaaaagtttcattaggattttattcctataatatcctatcgattgaaagaatggaacttttaaaatc

SEQ ID NO: 108756 - DNA, 757 bp, Oryza sativa
tcagaaaaaaaaatgaacctagataacgttatattcagatttataggtaagaattaatttttttttgaataaagtgtggactgaggtagttttagagtagatattacgaggttgtctgatttgagtcatgctgtcatgcatgtgtgtgtgccgttaccatatatatatatacttcatgcatgtgagacgttgacgataggtcattagcacgcttgacagtggagaacgcaggaatttcataatgagtgtataaagtaaatcaagcaagatcctcgttcaaaaataaagctaatcaagaaaccattggttaatttaaaagttgaggcctatgagcaaacactaaaacagaggcagttccacatgtgatttggttgggttgaaactggtgtttctggtggagggaaccacacaattatttagatctaaccatagtataaatacatgatacatactggaattttttgttaaagtatttaggtgtacagatgtagacccatgacaactaggtccgccgcccctgacgctcttgacaaataggattgcttcacgaatgatcattcatgtgaggcttatatagcacaggcattgctgcaccgtgtagcaactaacgatctgattagcacgtcgttgtcgaaatgtcccaattaattttgctatcgccgctgtctttccttggactcaacaaccaatttaaggaaatcttcagacatggtggacatcatcaaggattaatatggcaagtgtcgtatgtcacgtt

SEQ ID NO: 108757 - DNA, 811 bp, Oryza sativa
tatatatgtgttttaaattacttttatcgtatatgtaaactacttttctatttgactaaaatactttttagacatttatgaaagaaaattcgataatacctaaaagtaaattatataaataattaaagtaacttagcacaaaatataagtaagttgtcacgacattataagtaaatccgttttaggggtgaaaacatgagtccacctagaaactaaattaaatcagcacaaattatggaactgactaaacacggtaataaaagtaaacagatcaaaacattatgaatgtataagaagtaatttaatcaaatctaaaacatatatatatatatatatatatatatataggacactcatatggggcaccatggtgcccgggcaccatgatatcaaatacacaaaatcactcaaatttttcaaaattttcaaattgtgagtatatacctagttataataactcgattcatacctatacctatcaacaaaacaactcaaatttaactttatttcacaatccatgattacatacctaactaattatatgcatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatatatatatacatatatatatatatatatatatatatatatatatatatatatatatatatatatatac

SEQ ID NO: 108758 - DNA, 716 bp, Oryza sativa
taactaaataacacttggttttaaggtcgtaacaaattccctttttaatcgatatatgtacgtgcccgatccatttttttgttctctccatttgctgcttgctgcctgccggttgctctttgcttgctgctgccctgcctcctactgcctgtcattccctgtctgcgctccttgcccctgactgcttccgtcgcccggatgccctgcaatgctgctgccgcttcctgcactgctgctgccgcgcctgtagcagttgcgcccgggtgccctgaagccacgacccttgactgctccgcatccccttgccgctgcgcgcctctggccgagccaccagtggccggcgcccttctgcggctccgccccttcccacgcacagagacgtcaatcgtggagttggggaatttccaaagacctaggttttgggtgcgcgggaagggcagatggaggaaaggaggtcggaaaatcgaatcaaatcacattcgcggtggctatcagcggcggcggtagcgcatgggacgaaggaaagcgaacggaattctctcgggccggatctgaccgaataagagaacgcgaaaatacaaaaaatactccatgcaaaaagatagaaagacaaatttacccttttcaatttatactgtaaactaatctaaaggaaggtcggatgaatcgacaccgttacatcatttactaatctaaaaggaagatcggatgaatct

SEQ ID NO: 108759 - DNA, 738 bp, Oryza sativa
ttgaactttgcttgtagatcatactcaacctaaagtacacaccattataaactatatacttattgtgtcaggaaaagaaaaggacttcagaagaatttttagaagctcccaagaaaacagaatttataaagaaaggataagcattaagaaaggaagctatttgagcataatgggtaagattcaaactgaacaacagaagttatagtatgatgatctaaccaaggggtgtcatcattaagaaattggatccatttggaacccgggaaatggaaaggaaatgcgagtgcagacctggtttggaaacacaaatactcaatgaaatagcaggaacagggagaaaacgtaattaacagatgacgattccaagagcaggcagtcagccttcttatccatatccatgtgctcttcggcattgcgccctggttccaatcaaataggggaagttttgcacttttgctctcttatcatcgagtgcacgcggggagagattgcggcagcacggaagaagccaaacgtggtcgcggctggtggtggaaatgacgccgacggcgaacgtccgaccgggcccccaaccccgagcaagacggaattcagcgatggacgactccggcgtcgagcgagaggatcggcagggaacgtcccccgcgacgggaccttcgtgccaccgacggctcagcgacagctgaacgcggaacctctagctcgccctcgcccgtaggaaagtttcaaaatcaagct

SEQ ID NO: 108760 - DNA, 715 bp, Oryza sativa
cagcaattctctaccaatcaacagctttccaaatagagtgaaactcaacatccatacctattttttagcagctccggtgagtactctcgcgtgtgagcatactcctggtcgctcagcatgtagtaggtttgtctctcccgatcactgacaagttcgaggtcggtgtcgtttaggagtcgcctcagagcttcggcatcttccatcgagacatctgctgatgaacgagtactagactcgtcatgatgacttgatgaagagccggaccccttgaacagacgagacagtcgcctcctcattctgcacaatggaacaagaacggactaactcggcgggggttaattaggaatgacaagaatttcacccgccggttagtttcacccaagcaacttgtatatatgcaactaagtatttgaatttgagggaaaccatcaaagcttgattgaacttgagagcaaactttggagagggaatgaaaatgtgtttaaacagggtggagttccctctcccggccggttggcttaagaagtgcacccacaacgatcaaaactgacctgtggggcccactaaccattgcctcaaaaagagaggcagccgaccgttggcctggccagtcactggttcggccgaacccctggtgggcccaaccggccccacttttggccgttggattccaacggtcagtgtggtcgtggcacagcaaatttacattgaaaat

SEQ ID NO: 108761 - DNA, 693 bp, Oryza sativa
ttgtgttattggttaggatctgccataatcttctctaaaagcggtatccttggaatatctttgcatgcattcacgggtgcaccgttggatcaagcagagatatttagatgtggtgtttctttaccggatgttttgttatacctattatgagtaaattggttcccggctcggaataaatcccagtctctcattactctatcataaatttgttactatactcctcattcccggtccggattgaatccgcgcgtaaccgaacaaggccttactggggatacaatggaaatatcttggcatctttgtttctctgtcaattcaaaccaccgtcttcaattcgtttcaaatcttttgaagtgtggtcgatctctcatggtcaagtagaaccgacgggacctaatgtttggttgtagtacaatgcactccttaattatggatggtaacttttgatccacaagaactgtttctagcttgccctttccaatttcaaaatgagtgttcctttcatgaaaagggtaatgtaatcatatgcgcatatatgcacctttgcagcgatagttagtaagaaatctttcatcaaaatgccgttaattaactagtgaatctgtggaaagatgaaatggtaatgtagtagtacaagctaggttgagtagtttctttgcttgttacctacgtgtatggcgtgtgtattgatcg

SEQ ID NO: 108762 - DNA, 1146 bp, Oryza sativa
catctggtggcatgaacttgaagtgagtcaataataataataataataataataataataataatcaacaaaggtggaaagaaaaatccatgagtaacctttcttttatagagtgtgtttagttcacgccaaaattagaagttcgttgaaaatgaaacgatgtgacaaaaaaattgaaagtttatgtgtgtagaaaagttttaatgtgatgaaaaagttgaaagtttgaagaaaaagtttgtaaataaactcggcctctataagaaatcataagtaaagcaaggatttgacacgtcgaggagcgcacattcgtgcacatcgccaaggtatccccgagaaaatctgaatcgtgacaaaggaaaacgcaaagaaaaagaaagcaaagtcagcgatagcaagacaagcgtcccagcgagaccagcggggtggcgtcatctcattctaagggcctatttgtaaaacttctgccagtggaagattcttctattagttacaactgccactaataaataatttaaaatttcaccaaaattctaagaaattataattataaaatccagaaaataaactaagaactgaaaactaagtttaccagcttctctaaattcttatgagtatctaagagcctgttgggggagcttctagctgctgcaacttcttccagaagtagaagctccccaaaaccgttcagcttttggtccaaattttaagaagctgtagttgtataattcagaaaataatttaaaagccagaagctgaaaaacctattttttaaaatttttaaaaactagttattaaattagttgtttctcagtattttaagctcccaaccagtaccttcgtttcttacaccgcatatcccgtaagttaagtcaccaacgacccaccaccagccgaggtcaacagtcatcctgacacctgggccccacctgccagcgaccccacacctcccccccaacatcgcatcggcacctgccgccggtgcgctgttctcatcaaccgcctcgtcgaaagcaacaacaaaagcctccctctctctctctctctctcttgcggcttcagcgcggccagccgagagggaagaagaatttggtactctttgccctcgatcgaagctaccacccatcccaccttgcccttccttcg

SEQ ID NO: 108763 - DNA, 2796 bp, Oryza sativa
cgatttttaaaaacatgtggtttttgggtcatgtgcacatagaataaaatagaatggattttcgttcggaattcattgtccagaccgggtcgaaaaaaaatgcttgggttttcgatcatgcacacatagattaaaccataaatactattttaagacaaaattgattacgtctggaatcagtcaagtctgtccggaccggttcgatttaaaaacacatgatttttcagtcgtgcacacatagaataaagcagaacggattttttttatgacaaaaacatattaaggactgtccggaccgggtcgccactaaaaaagcgtgttttttcagtcatgtatgtatgtatgtatagattaagccagaaatattattttaggacaaaattggttatgcccgaaatacgtccgatctgtccggaccgggttgatttaaaaaacacgtggtttttggtcatgcgcaaatagaataaagcagaatgaattctttgacaaaaaaaaaacatgttatgtgcggaattcatctgggattgtttggtgggttctttatgaagttataattagttatttactccctctgtagaaaaaaccaaactagataaagatgagacataatctagctatgacaatatatcatatctcatctttatttaggtttggctttttatttggaatagaggaagtatgagagggtaggaatgaaaaaaaaatgaccgaacccaaaaaaaaaaccaacgacgagaattattaacaagtaggaaaacctaactcaatccctttttccactccaccccgctccataaccatcctacactctaaggactacgcgggtctacctgcattcgatcgtatctctctcgccacacctagtcacgtgctcctcgcaccgcctcctcactaggatcttggcagcgtaaaatggtggcacctccacagctccactccgatggtaatgatggaggtcaaactagagcaattccctcgatttctaaataagctttacaacggataaaaaattataatattttctaaaataaataaattatatttttatggcatatgttatcaacattcattttatatgtggctattcatttagatttagttgttatgtaatattaaaaatttaagggacaatatataaaaattacaacgagagtagatggatggcagattcaatgcaattggcattgaagtctttttaaaggaatatatattgtcattattgattaacaccattttaactgatgaacaaaaacctttttaaaggagtatatattatcattattgattaacaccattttaactgaattaattagtaatagcttttgaataattagattacgatgaacaaaagcttaacgctcatgcttagggtgtgacacacttcgatgattcggtattttttgcagtactataaatattttgagaaaaggaaaaatgagtggtcgaattttaaagtaaataatattagtaacaagtactcaggtgtatctttggtgatggtacatttgattcatggtgttgagtctactaatattggacatgctctcttatttgtttcaagagcacagagtacaatgctgccttctcatgtgcacatgatcccgtgtaggaacccacactactactagtagagaaaccatctttcccgggtcagccaaaatctacaatagccccggttcattaaaaaaccgaaactaaaaatcatctttagccctggttgaaaagcccatagccattttatgcaccaaccgagactaaggctatgtttagttccacgccaaaattaaaagtttgaagaaattggaacgatgtgacggaaaagttagaagtttgtgtgtaggaaagttcaatgtgatggaaaagttggaagtttgaagaaaaaagttggaatataaacgggtcctaaagatcatttttagtcccggttaaaaaagtgtccgcccctagtctttttattcctggttggaaacaccaaccgggactaaaaatcgacgtatagtatataatcccttacacttatcctctagcaaccacctcttcctcttcctttcctctctattcaatcttatcccctcaagagcaagtagattggacgcgtgagcgagtgagtagggtggcaaagggaggcgcggcggcggtcggatggagcggagggccgggcggcagcctgcgcggtggcgggcggccagcgcggagggccgcacgacggacgtcgcctctgccggaggggaggcgggaggcgattgcggcatcgccgaattgtttttggttgtttttacatcttttttagtatttataaatatttacgacatcttgtttagtatttataaatacttttgggaaaaggagaaaaaaatgagtggtcaaattttaagataaatcgacaaatatattggagcggagggcttatattatacctttggtgatggtgcattgtttcatgcatgttgaggacactagtattgtacatgttctctttaattgtttcaagagcatagagtaatctaatactggtttatcatgttcacatgtaccagtatacgaacccaacaccctaatagaagaatcctacttattaagaatatcatcatttgttttatgagactatacctccttcaagtagtatatttttttcctccagattctggaagttagcccgttgaattcagcaaccaactactagctagatggtgaagaaaccttcgaatatacagctatatagttttcttattggcttatcagctacagcgagatttaaattctaaaaaacttaattttaaagttgatttgaaggtt

SEQ ID NO: 108764 - DNA, 1990 bp, Oryza sativa
aggtgctcacgcatacgtacttaaacatagcttaacaatcatgtttgtttcctgtagcataggaaactaaacttttttcgaatatgaggcataggaaacgaaacttgacaagtagctagtaggaaggaaagaaaaaaggttaatttgaacagtattagtaagctctaatatactctctccgtttctaaatattttacaccattactttttaagcacatgttaaaaaaaactttttgtgaaatatgtaaaactatatgtatacatataagtatatttaacaatgaattaaataatagaaaaagaattaataattacttaaatttcttaaataagacgaatgatcaaatatatttaaaatagttaatggcgacaaatatttagaaatggagggattatttatttttttaaacaagctctaatatatccacgccaagatatctcgtgtctgggtcaacttaattaattaagacgtgtcatctaactgcaaattaaatggtacgtgtgaccccatcctgacctactctaaatctctaatctttttctatctagctcaaacttgcgcaatccagtacgtcacatgatctgacataagcattgtacatttgtactagtaccgtaattttcctctagatcaaattgatgtcactaaaattactccagtgatatttttgtaaaatcgatgccccaccaacggtttacttacctcgtaagaaatcgcacgctcctcattcctaattaaagaaaattaatcagatatacgccttccatcgttcgacctaagctgataaaattagcaagaggcatttacattcactaaaaaatagtactactagatatgtattccgctcactatacttaaaaaaaatgattttcaactgatcagagctccatgtgtacatgcaggtggcccgtatgaaatagattattagacatattatatgtgattgtctataagggtaaattaaattaaataatgtttataaagctaaaaatatactgaagtcatctgaataatattataaataccatagaaagtttttgaaagcgtgatggctaaaacttgatcaaactattttgattattaaaggagcgttcgagagaagaggagtgtacaagattgagacgtacgtaaaacgaggtgaaccattagtgtgcagttaattactccctccgtcccataatataagggattttaagtttttacttgtaatgtttgaccactcgttttattcaaaaatttttgaaattattaattattttatttgtgacttactttattatttatagtactttaagcacaacttttcgttttttatatttgcaaaaaaaaaatttgaataagacgagtgatcaaacgttgcaagcaaaaactgaaaatcccttatattgtgggacagagggtgtaaatattaattattcaaacttaaaaatgaattaataacacaccatttaggctgagttcatttggacaagatgagaaccaatctgctgcgcacgaaaaatgaaacggttcattagcacgtggttaattaagtattagctatttttttaaaaaaaaagatcaatatggtttttttaagtaactttcgtatagaaattttttgtaaaaaaaacacaccatacgtttagcggtttgaaaagcatgcacgtgtaatacgagggagaggagttgggaacctattgtgccgaacacaggcttagtagttcgggcgagggagaggagttgggaacctactgtgccgaacacaggctagttcgggaagtgtgcacgccaaggaatttcttctccttatcttctccgaatgaacacttaggctgtgtttgagggagataggattgggaagatcgggaagagacacaaaacgagttgagtcattagcgtatgattaattaagtattaactattttaaacttcaaaaatggattaatatgattttttaagcaacttttctatagaaattttttgcaaaaaacacaccatttagtagtt

SEQ ID NO: 108765 - DNA, 568 bp, Oryza sativa
ctttcaatatgaatcacacgagatagctaagaaaagggatatgctagcttgacatgttgttagttttgtactatattattaattaggtcgggtcctccatggtccacgctcacctggtgaacataatggggctcatatatagcacatcgtcaagttcttttgcataaaatattggtgtgtgacgacacaacctatcttttccgctagcagtttttccgcgagttcaagtagatatatgtgaaaggcatccaaagcatagagtgtgccaaggccagcccttcctctcattttttttccaagaacacaactctaaaattatttttagagataagcttcttgttgttatgcttatggtgataccttagtgtaatactgcactaaattcaacaaaaagaaatcacctttgctactttatatgcattggccggcccactgaataaaaagaagaaaaatgtccactgtaatttaattgaaaacataatcagtgtcatctactcaaagaacatttgctgatgtctcaccattgtgtatatatatatatatatatatatatatatatatatatata

SEQ ID NO: 108766 - DNA, 655 bp, Oryza sativa
tgtaaagagagatataatagctttggaattcaaatataccttgattgtatatatgaaatatatacttctccaaacctagatccagtatcgactaggggaatcgcactatggggagtttggccggcagtccgctagctcatgcgggggaccggccggtgtttggaatggggtacggtagtccgtggggaactacccagcgaagggtcaggactacaacatagcggggatgaccgtcggactatcgtgtggagggccaacacaggttgaagatagcccaggcagatggctgacgtgcgcgaggatgacgatggcataggctagctgatgaagtatggtcttgtggtggccggctagaagttgtagcagggtggcccgtgcaggctgcccaggtgaatggccacgacggcggcaaagcaggcaattaattgccagttggcagtcgtcagatctagaatcctccgaccggatctgaccactctactatgcaagcggtggtgttggggacaatatgaaggttgtcggtttggttaagttgggcactgagtctctctttgtagtatagtcctacctttcctccttggactcctctccttctttgtgttgagctcttactcgggatgaggtggcttggtctacagggcattgccttggccga

SEQ ID NO: 108767 - DNA, 700 bp, Oryza sativa
agagaaagccaaccgctgtatgatgggaaaatatatatatactacttgaaaaataagatttcacatgtagatgtaacattattgaaagtatgtgtcaaattttttctagaattttctgtgacatttgctagttggtgtgcacggaaaatttctgtgtatagatatgtttcccataaattaagactagaaagtgcaatatgttctaaaccttctccagcatcgcaaaatcatgctcacaataatatcattcatgaaatattattagtttaaaattcatgtgttactcacttacccttaacaagtaccttaattacacgactcgtaaaaaagacgagtcatctcgatttgaggtgttgcccaacacacttatacgacagctttgagtcgaggtccaacaacctgcccacatcgtcgtcgttcaccttacgtacgtaccaacacactgacctatcatggttttccatcgtcgtctttgtatcgcaccaccgctttgtagtggcagagtgatcttggcggaatttgcaaggcatagttcgcatagaagagaagatgcgggtaacgacaaaaacaaaatgtgagaacttaattcgtttgtattttgttgacaaggtttttttagtcctttttaattatctattcaccactaaatgatttcttcctccctgttatgatgttttctaaccgttagactactttaaaa

SEQ ID NO: 108768 - DNA, 5456 bp, Oryza sativa
cggaggtggaggtggccatggcggcggcggcggcggcgagagggggggcggaaatggagatgggagagaggaggtgggggtgttaaagtggatggacggtgaggatggcattggcattgggcgtatcggaatcggaacagcggctgcgtgcacccggtgttcctggaccatagtggcactagtccactcactcccatgcccacattattaccctcgtcttttcgttatcttattagctaaaatttaaattttcaaccttaaatttggagctgatcttgggtttttttattaaagtttatttttcagcctttgcttttagatagataagaacacatatataaaaactttattcataaattatttttcatttacaaatatgttgtaagcgaaacaatggggatgtgttttgatatagctccggatccaaatccatggtagttgaagtttgtaagttaattaaagtggtaaatttcatctaaaacattaacaagattatttatctaaaatgttatcaacatagtcaaaatctagatatatatagatttgtaaagctttgaagtgaagggaaccgttcgaagtgagcgctttgactcagcccccgcgtcgctctcacgggcgacacaggtggcgaccccatcccgcgccaccgccggtttcctccctcccctccactgcctcgccgccgctagagccagctcccgcacgtccgtgcagcgacgaggacagcggcggcggggcctctgcccagatcctagcttcctctccctctagctcgtctcttcctctccccccagctcctagatctggcctatcgcgagagctgaccgacggctaggacggcggtggcgaggaagtggcaaggcatcggcgacggaatctctttggacggcggtgggggcggcggctcgacggctcccgtcggtggaggcggcctaagaaggcggtggcttccgtcggcgtcgatggccctggggctgcgacggaggacaacagtggctcccgtcggcgctgcggccggcggcggtggttcccatcggcgccggctgccctagaggatgtggtggaggacggcggcagcttccatcggcgccggcggccctagaggctgcggcagacggcggcgacggctcccgttggtgttggtggccctaggggctacagtggctctcgtcggcgccggcagccctaggggttgcgatggaggacgacggcggcttccgttgacaccggcggcactaggggctgcggcggcccaggacggcggcgcccccgtcggcacagggccctaggggttgcggtggcttgaaacggtggcggtctgagcactttggatagtagatgcctaggaatctggcaaagtggaagccgatcctgtcggttcgtgtctagttggctagttccgactatacgacgaatgacgacggttgagagtgggcttagaagcgacgcgtgacgtcagctcatctgaaactgatgaagatggcacaaatggaggtttgcatcaatggcgcactaggggcggcagcgactagtagacttccactcgtcaaatatggctgtttcaggagaatatggtgggagacagagaaccaggatgtgctgaggtcgtttgggtttattttcttttttggttgtgttctccttcttgttgagatgtgagtctaaattactcttgtatccttttggccgcgtatatccttcgtggatatagaggccggattaatgaaaatccattatctaaaaaatatagatttgtaaagctaggaatactcaacttcaagaaatcttggatatatggagatgtgccaaaaggacctatggtagcaagagagttagtcctttttttttctaatttaagaacgaaatattatacgataggatgaaacatgccaaagtcaataatattatacgataggatgaaacatggtcacagtgataccagataatttagacaaccctttccactttccagataaaataactagagcgaaaatgctatttctacatgcaattatcgccattgttaattaccaacaatgcatgtaaagacgaccactttcctgcagctagaaaaaaaaaccaagtttgtttcatttcgtgaaaggaggatactggaatcgcactttaataggtaaacacgatttcccttgatgttaattttaatgtgatttcccttgatgttaatttaatgtataaaatttgattaggattccctacaaccagttataaacttggaaaaaacaaaggcaatccacgtgaccacatctcatacattgtttttacatggttttaaacattttcctatatactttgctacaatattaataagtgcattacaatagctcttacattacatggctatgcctatgatattttcatcatcgcatggacaatacaaatcttaccgccagcggcggagatagggcttcgctggtggtgtcgccgctgttaattatcgataatgcacatagaaattagttagtgaccagagaacgctatgtgttgtccatgcttcacagtgtcactggctcagttacttattacttcctccatattttaattccatattttaatgtatgacgccgttaacttttcgaccaacgtttgaccatttgttttattcaaaatttttgtgtaaatatgaaaatatttatgtcatgcttaaagaatattcgatgatgaatcaaatcataataaaataaatgataattacataaatttttttgaataagacgaatgatcaaacgttggaaaaaagttaatggcgtcatacattaaaatatggaggtagtacaactctatccttttatatacatgttctccaccaattacatgcatcgattactaataccatctcgcctttattgagtacataaacactaaggatgtgtttggataatgagaaatgaagggtgggattgggattaggaaatgaatgaagggttagaattaaatgaaagagggagaataaatagttaggataccttttgatgggtgggaatcattttcctatctcattatctaaacaatgcctaaaaacttttctcactagtatgagcatcaaagtagcaagtacttcctccatctaaaaaataaaacctagaacatgatgtaatatattctaatactataaatttagaataataattgtttagattcgaaatactatacagtaatgtgttatatcatattcaacattgagaatgtcccaagtgttcaacattgagagagaagaaaacaacagctgcctagcctacagaccgggtccagccaaaaaactacaagaggttgggtcccccatacgtgtagccttgacattgcagtagtggccatgtgtgcgtccttgtgattgtggctgagacgagactgacgagcggtggagatccacccctgtggggacaggattgggcaccgacgcctcctggccgtccgttctccctctcaactctcagaacaaaagaaaagcagaggagggaaatcttcagagttggcgagtgagacgtgtctgtttctgaagaaatgtaatactccctccattccattttaaatgcagccatagttttccacatccaactttaatcgttcatcttatttaattttttttaaaaaaattaaaaacataagtcacgagtaaagtactatttatattttatcatttcataacaacaaatatactaattataaaaaaatttaaataagatggacgataaaagttgagcgcgaaaacttattgttgcatttaaaataagacggaggtagtatgtagtatgttgtttggattcagttgttttgtagcgatggaattcataaactgaaatgagactggaaaagagctgctttaataatggaatacattcggactttgcttgattgcttcccagaagctatagtcccttgttacaggggccgtacaggagttgatgatgaaattggcgcaattgtttttagtaatttggagattttatacgtttgattacatggcattctgtattggtttaggaagtagtagcagatggctaaatgtgcttaacaaaattgtactactactacaaggtttacattactgtcggtaaccgtggttaccagtcttaccacggggtacggtaatagaaaaaccacggtaacctccttaaattcaaataaatttaaaaaataattttaatttttgataaattttgcacggtttcgtacagttttttaccgcggttaccgtacggtaaccgtgcttaccgccgggacgcggtaacctggccccggcggttttggaaaccctaactactactactattacaacaacaactagtatattttgtaagatgataccgtatttgatagtctattggtcttgcatacgcatgcatggagcaaatatgtgttcttgttattgctgtataatttaccatcaagggtctgtttaacaaatggacatgcttagctggacagatctgaatctcgactccaagaataaattgattttgttctttagtccacgatcctctcaagaacctgccagaacattcatattacaaaaattcgtactacagacaaattttgtcacaatcgcacactgaaccagattaactgaaggatgtggccaccctaattaagccattgaatgtctaacttggggaaatgggaatagtccgaagttgcattgcctctgaccatttttgttgggcagcttgaaaagataatacctctgcatgctgttattaggatctgaaagtctgaagtctgaacatgtagtatataatagaagagcagcgacatggatggagctagcttgtgattgattgttttttttcgctaacgcattttttttcgcgaacgcgcgcgtgattgattgttgtttacttaatttggtcgataaagatgcattttcttttcttaactagcaaaagtgcccgtgcgttacaccaggtgattacggagtgtgtatattgaccaaaagtattgtttggtttagcaaaactgcccgtgcgttgcaacgggaagcgtacagattagaaaaacatgcaattaattaaaatacaaattcgctgaaatatttggtatttttaagtaggtatgtgtataattaaataaatttataagtaaagcaagtatgagaaataaaatgacatggttaaatctaattttattaaattctccatgattagttacgctctttgaagttttattggaattttcagagcttaattattaattttaataatacaaacaacatttaacaattatttaattagaaaaagaaagaaaatacttctttttaggtttgcttagaaataaacacattcaataactataattgtaatgcttctgaaaaaacgaaatactaaaaatgaacctcttctcttttttttttggcccgagggatgtaaaatagacttatttccgtcccatcccggtcggcccatggccttatgaaaaccttaaccctaaccctccccctccat

SEQ ID NO: 108769 - DNA, 2363 bp, Oryza sativa
atgttcttcaacacctttgcttcatttcttgcgtgctttttgcaaaaagatatgctcaaatgggagccttcgccctgcaagtctaagcacctttttagctttctctctttgatgagagagctggtgaaactaaagcttatagtcccattaattcatccaatcggctagttgtcgtgacctttacagaaccaatgatgcatattgttttctgtgtggaagaagaatcctcttttgcatggattgtaattctcatttgcacattgacctttgcacttatattagtctcatgtattctttcaacacctaaaagttttatcataagtatttcatttgcccatacattgacctgctaaaaacctatatatatatattctggatgagaaatccttttaaaagcttttctagctaggatgagtttaatgcatatatatgaaaccagccacacacatgatcaacctaacattgcacaatgctagcaagattataatatcgagatgtcaaattcaatcattagcaatatgaaaattagtgctgttgtggtctgaatatgatagattatctcttttatataaatcaatataaataattacctgttgaaaaccaacactgatctcataatatgatttgtaaaaaaagggtagcatatgtgtgtcccacttcatttttcatgatctatatgggcaggggctgatgctttaatttagatctcatctgtaattaaccagctagtacttttccagtagccagggctttctttctttgattatttgcttttctttcttgtttgtttcattcgcgaaaagactatggaccatgcataatgcatctttgttttcaaaaagtcactttctagatggaacctcgacctgagaaatcatggttttcttgtagagcttaaagtttggtcatgcttccttttactataggaaatagtgaagacatcccataaatcaataaataattagccagctaggcatgtcttgatctcgagaaatgttcatatttgctatgagattttgttcaaatttcctgtgaaaaatccttgcagtccaagcgatgccttaactattttgcatcggggcatagtactggtactgaaccaactaattaattaagcttagagagtggcttagctagctagcagagataccagctagctagtgatcataattaatttctaggggatttccattattaactctataggttttttttggctaaaaaagggtataccatttcgttgaaaaacaaggaatcaaaataacctatgctgttatcctatttttgcagcaagtccctgcatgtaattagaatattaaaattagtacctattttttttgcagggagagactacattaagtatgccttcattacgacattaatcgtgccctaactaacaaccttaaattggagctgtataaattagtcacgtgcagccagtcttgattaattcttgaaactttagttaatcatttgtcaagtgttgcttaatgttgtatccaccaggcaaaaaatagtaccacttaattattttgtagcaagctatagctttcttcagtacttcccactgattgcagtgtggaattaaattaattaattagtctgcttctgacttcgttagtttcttcccctttttttttctgaaagaacgttttcttccctttcttctgaataaaataaaggagatgaattggttttcatacaacctggcactcaattgagagaaaatactgatagagtttttttttgaaggaataatgaaagagtttcatgtgcaacaaaacttagaaattaaaggtgccaactccagaatcagaatgtgcaagaatgaatctttcttcctgacttgtgtgcgatgcagctgaaattttaggtcagaattattcctgttctaaatgtagccttacctcgtttctgagcccaagtgtgtattgggtttgaaactgatagtaatggcccaaatggcttaattacaaggaggacgctctcttggatcgctaactaattgagtccattccaccaacagcaagattcatagcaggccttcatgcgggccagagcccactttaggcccagccttctctgatgcagttcagtgctgcttcagttttcagatagtgacagatggggctgaaaaattgcagatcgagtcccttttccttcatcaccggagaccagggtttccccgacggtaggcacggtaaccacggtaaaatttaaattattttctaatttaaaatttaaattattttctaaatttatttaaatttaaggaggttaccgtggtttttttaccgtaccccacgataaaactggtaaccgcgtgattaccgacggtaatgtaaaccctgcagagacataga

SEQ ID NO: 108770 - DNA, 562 bp, Oryza sativa
gttctttccccaactataacaacccacttccctcgttttccacgcgcacaattttcaaacagctaaacgtcacttttttgcaaaaagtttctagaaagttgcttaaaaaaaatcatattaatccatttatttaaaaattagtaaatacttaattaatcatagaaaatatgttgctccgttttccgtgcttagggaatgagttcgcaactcaaaacaatgaacacagcctaagtgttttgagttttgggtaacatgaataatgttatagccttgctggcctaaccaagtcttattttagcttaattggagctatagcgtattttctataaattgcatcatttataatttgtgatttaatacttatttcacccattaaggtttagagatgattttcatattaaatgtactactttttattatttttattttactgtgattaaggagtacatgttttgtgcaactagcaggactccgttcactttattttgagttcactttactttcgtcgacgatgcggaggaagcactaggcctcgggggtgaggtgagtggctggactggct

SEQ ID NO: 108771 - DNA, 1831 bp, Oryza sativa
agtgagtatcggctgaagtccgaatcggctacgactaagatcggcagggttcgagtcggactgggttagcggattgagccgaatccgacaaaatatgacgcagcatatgttgttggtttaggttgacgtgcttcaagatgattgccacacatggatagagtcctgagaaggcaattgtatatattagttaggatattttatgtaatttccttagagatatgtttgggcaaaagtctgccgcaaagacttatggtattttagagtttgttagagataagagtcatgtccgatatgaacatattttgtaattctcgggtataaatagaccacgagccccatgtaatcaaactaacacacgttcaatacaatctcggcgcatcgccaccctttttactttcgttttattcgacgagttcttgcttttgggttgagctgcatcggtttcgatcttcaacaagagataaaacttgctatggcggcttacgttctcgggattagtgcttccatctttatgatactctaatcttgtttatgtaatacgtcgagttatcatatatcttacataatcttcgacgatatcgttatctaacctataatcggctaacatctgtcagaagagggcagccgattaggttaaataccgacgttgacttagattatatatgatatccaccactctatgaaatttccaacggcttgattgtctagatattttctttcttttcatacttatagctgcatcagttgagtttgatcttatgagtcgtgataagaatctcaatctctagcctgtctttggttgccgattagggtagtatcgaaggtttcagccgatcttacgtgatttaactacatttatcttatttgcgttattgacatgttaaatctgccctttatgttaagatcttgttacatctaagtatattaggctttttgtttggtatatcttacttactttaatatcttaatatagagtggtatcggagtattagccgatatacgctagatctatctgatcggctttgctataaacacatatagtcttgttattaatatatatttcgatctaagtgatttatactgtctcggcacggtgaccgatctatctcaacacttgatttaagtatatatcgatataaggactatataccgttaatatctacagccgattgagcagatctagttcttattaatgactgtcgatcgatgcatttatgacatcggctcaaagataaatgatatgtcatcggcacttagccgatcggctatcgtttatggatttaaccgcggtttttttttgtctttgtttcttgttgattgcaggatcaaattaactggtacgctagcatacctaaagacaagtttttgacctgcactggagttaagcagatctcccggacctcgtgttttcacatcaacacgcttttggcacgcctggtgggactgatcagaagtcagaatcacaacaacgttttctcatggctgagaaaccgccggcatcaccgtcttcagctagtaaagatgattcttctaaatctaagacccagaagcctggtctatctgaagttaatgagagcaacatcatgcccatcactccggacaagttgaaacccgagcaacagaaggatcttgaggcaatgatgcagcaagcatgaaaccaattcttgaattcattcatggagacccaaggttcagaagtataaagtaaaagtaattgttgatgttcccgcaacaggttcttccaaggatggagaggtacaacaagttgcagatggtgcagctcaatcaagtgataaaggtgctgcagatggttttcaaggggttcaaggtg

SEQ ID NO: 108772 - DNA, 723 bp, Oryza sativa
caagatttcatacttcaactgtccaacacttggttgaaggattgcaaagctatcgggcccttctatatatcaacaagccatgtctccatttccttttttgacacttaaaaagggattaattatttgtggtagaaaaatgctagatattgttgaagacagttgtatctaaagcagggatatttagatatacctaatgtggtatttaataagtcatttttggcatgtcaaaaaatctatgcaaactttgaagtatcattcacaagctatagcaagtttggcatatattagttttaccaaaatatgtgaatttcaaggccagtgagtgattctattcatatgtctacatatagtatatatgttcaggaactcaaactcgggatttgaagtgtcataaattatttattttattcaatttccacatattcttttagcttggatatactaagttcaaaacataaaacttgttctattcaatacaaatatatatgactgcaaacctagctagctagaagttaatccaatactgaaaatgcagatgtgaatccatcaatgcagcacacgattaaaattttcatatatatatgcgtgcgtggttagggatgttgcatgcatgattgcaactgctacgctgaacttgaaagcttaaatgagaaagcattgtccttagattgttggcccaggttggaaaacactccttttgttttcttccgtcttaccatgacc

SEQ ID NO: 108773 - DNA, 1283 bp, Oryza sativa
  unsure (1)..(1283): unsure at all n locations
aattcctaagaatggaaccttacgattctttctcataattttgtattaacgctatagctttttttcgctaagacctgtaaaagttgaattttaacttacgtgtttaaagagtgatatatcacatattaatatatctttctatttttttaaaaaaataatataactatttgggatatcttctcgagagtttagaatccacttctttatcttagataaatgcatccccttccttactcggcaatatagtgcgcgtgtatactatctctctctaaaaacataatctctaagaacttctaaaagaaggccttgtttagttcctttttaaaatttttttaagtatatgaacacacatttgaagtattaaacatagacaaataacaaaataaattacagattccgcctgtaaactgcgagacgaatctattaagcctaattaatttgtcattaagtaaatattgtaaccgtaggcaccnatattgtcaaatcatggcgtaattaggctcaaaagattcgtctcgcaatttacatgtaaactgtgcaattagtttttttcgttcacatttaatgcttcatacatatgtacaaatatttgatgtgacggaatttttgaaagtttgaaggggactaaacacaaccaaagatatattttctctttgtaaataatatccctatgatatcagtacgttgtttaaagtataaacataatccccatcactatctaaataacaaaggagcagtagctgcatcaagtatctaaaatcaccactactatactgtttgactgggtatattttaatcttctttagtcgcttccaccgtcttgttcctccgcatcaacgccaaaaatccgcacaacgattgatggaggcgccaacactgtccctgctccatctccatgtttagccacctccgtttctgtctcagccagtggcaatgccaccgccgcggcgatggccgccgaagctggagcaagtgtaggcggcgccgcaagttgtccgcgtggcgcgaggagagggtaaggtcaaggtacttattgtagtgctccctcttgtggccgccaagtgccactcctgtcagttactatttcccgcacacattgcacgggtgcttgccctccgtcttgccggcaccggcgccgccactgccgccggcggcagccagcttgtccctgtttgatgtggccagccacgtggccacccatcccctggtgtgtcttatactccatgccgcaaccctcgtacttgcacctgtacggtccacctgatcgtgatactctaggtaac

SEQ ID NO: 108774 - DNA, 527 bp, Oryza sativa
ccatagccgatgacctggttcttctctttttactggcatcggctggttctctgatgagcccttggagaagagttgaagtctggggggcatgatagccgatgacaggaggagatggcccacctccatttggaataaggcctggtgcatactctatgtccctgccactattggtctggtgaggaggggagaactctgtggtctgcaagtcagaaaagaaaattaattaagttatgaatcggctaagcaattatttaaacggagttaattaaatgaagacatacctgagggataacatctggaaagagatctgtcatgtacatagaagccgattgatggaatagatgcaatttccattcaccccaccatctgtcaaagtttttgctcctgaactttgccatctctatattttcaatgatgcccagaggaggtccttggagattgagcagccgatccgtcatcaaggttgatgaaattccccctcagcactggatcttgtcagcaaagaataagccgattgggagttggcc

SEQ ID NO: 108775 - DNA, 715 bp, Oryza sativa
tcctgcagcccatctaactttcaggttataaaattttataatattgcctatattcatatggatgttaatgaatctaggcacatatacatattcattaatatatatatatatatatatatatatatatatatatatatatatatatatatataaatgtggacaatgctataaagtcttataatatgaaacgaaggaagtaacagataacacacacgtacacgtttatgttcattggttatgccccatccaaggagctaagacaaaattaggctacagatcaccggtgttgtatgcttgtgtacatgggtttgcctattcctctcccggacagatcaaagttttggaaattacagtaattttggtttgaattaaatttaaatgttaaacaaaatttggtcacatctatataaattttgctaaattcaactttaatgaaagattcaaaaaataattaggagaaatagttgcttgtcagaaggggtgacaaaatccagaaccttgatggtttagatcttgctgacgggtgggaatcaaccatacattttagggatacatagaaatacaaaacagtttgaattttttaagttattattatccaatatatataagtgaagaatattgtaacgccccgcaataatgtgaatccactttgaatttgataaatgtattgcttgtgaagtatgtgttcgcgtttgaggaaaagaaaagagagaat

SEQ ID NO: 108776 - DNA, 546 bp, Oryza sativa
gtccttttaaaaaattattttacaaatagctccttaaaaagtggaggcgcctctaaatcgggcacccgatttatgaacatcaactagatcgaacatgtttcactaaacaaatcgaaaaaaattcagtatttttaaaaagctgaaacacaaccaaatcatctcatgaaacattttgctacaacgtatgaaacaacggtttccaaaaaaattaagcgttgtttcaccctatataaaaacaatgttttagcaaatatcgaaagaatgtttcaatttactggaacatttgatctatacacagtgaaacattatgagtacactatgtgaaatattttttgtggaaaaaaatgaaacggattcccttaataaagggtttctataatatgtgggtgatttgttgtaaaagaataattcaattcactgcaacattttatctatacatagtgaaacattacgagtacactagctgaaacattgttagtggaaaaaaatgaaacgaaatcccttaatagagcgtttccgtaatatgtgagggatttgttgtaatgg

SEQ ID NO: 108777 - DNA, 813 bp, Oryza sativa
tgaaagtcagagacactcgtgtggtccttgatctgaaattaggttttgctcgcaacagtaatgagtaacagttaatatgggcctatatcacgtaaatgcatgatcaggaaaaaaaaatactgtgtcaaccagactatagtagttggtaaaactgctgtacttcacctatagagaccaggctcttatattcaagagaagaaataagaggacattttttggtggaagctgacaaaagaattttggttcacggaattcgaaacttaacagagttgatattagaggagagcacctcagtcccagtgtgatagttttgcctttcacataccacttattataaggcgtaacgctgattagcaaatataaactaattttatatataacttctacatatatatattttagcgacttaaaagctaatgttgaaaataaactacgataaaaagcatcaaaatcaattttaaatttaagttttaaaatttaaattttagctacgtccgataagctttgcgaagatatgaaatatcaaaatcaacatgcaaaatgcgttgacagatgaccccatgatggaacatttaagctagctttgcgaggatatgaaatgtcccacgagaccatgcgaccatacgccgaatctgatctccagtcttaaactacaaaaagtcagcgcctaacagttgacagttggaaagcatagttgttagtacatcaaaatttatatttggactttacaaatgcaccaaggaaagaatagggccaatgatcaagtagtgggaagatgtttaacctccttcccacctattcaaatcctcttat

SEQ ID NO: 108778 - DNA, 668 bp, Oryza sativa
tatgtcctcatcatgagccgtccaattttggatactctcagtttctcaaacgtgtcgaattgctcagcagtacatgtacagtaatatatatattgtagaagtgaataagctaaacgagggggaataattaatttgattgtgatttagcatgcttaattgaattgaccacacgttgcaacttaacacgtacgcacgtataccatttatatatcttttgctactttctttaaagcaaaccaaaagaaattagaaaacgacgagactgaataaagttaaatttatgagaacaaatcaccacgcatatgaacaaaaaaaatggaagatgatatgggatgatagagcagattaaataggaaaaaaacggaagatcagaatatgggatgacaaagtggggtggttatttaatctgatgaatttgaagtgacttattttattttcatgcaaaatattcctgtaattagttattactaaccaatatccaatctaagaagacttctcatctagaggttactgccatcattcacaatctcttggatctgatcgagttgagttattaaggtaaactgccattgacgtgcatgcatcccatcagaaagtgacactgcatcacacctaagtggatgagttaaaaagagggtgaagcaactagaaaaaaaacccatttaagc

SEQ ID NO: 108779 - DNA, 1227 bp, Oryza sativa
gcccttcagtataccgcccagtttccagccctcaagtaacaccgcctcgtgaaccgtggagtcgccgcacatgctgccggggccagtgaattctcaatgtgcctaagccagtactattttcttcttttttttctctctttttcaccttattaccctgtgcactttgccatcttttacctgaataaaacgtactactggtagtacgttgaagtagcattggttcactcttctctctcaccaaaagaatcttctgcagccacctctctgcatgagggcctgccttttccatgcacaaactctcagtggatggccctgttgcagattacctagggggtgtttgggaactagggattaaatttagtccctgggactaaagtttagctccactttagtccctccaaccaaacaccaccctagtatccaggtaagaaaaggaaatttttcttggacttggaatattgtttcagattttgaggtttgtgtgcaaaatgcctttagaatttggtttgtctagcattttctaactgtttgttacacttgttactggtctagatagttatacatatgcggatgctattgccacatgattgtacactgaatttacacacgcagatctcaacaggttggcagatgatgaattggcccttctacgccttggacatatgacttaatagttactaccaccctgacaggataaaaggccgggggaaaaaaaataaaggaacaaaagctaagggagcacaagtaggaagcaaggtggcattgtgtgggctcctcctggacatgtctgttcctaatttcctatctctccctctttttaactttctcaccatcccatgtgcaacattcagcctgcagccagaagaaagtagaagtgtagagccaagctctcccttctcatgccaattgcccaagaagctatgaagagtgtgaaaaaagatgcatgaatagtgtgtactagggaattagagtgtagatgtagctcatgtaaatctattgtcataagatagcaaacattatcaaacacgataaacttatataataaatttatcactcttcttttaagataatggatagatttatcactaaattattgcaacgtgtatgcatagtgcactatcttgacagtgtattatacggccctcctagtgtttcccttcacaaaagaaaatagtggaaatgttgcattcaaatccacaaatataatgtactcctaggtacatggca

SEQ ID NO: 108780 - DNA, 3786 bp, Oryza sativa
cccccccccccccaacacccccccactcccagacccaaccccactaggtggcccacacgcttacgccactgacatgtggggcccacatgcgcatgggcccacgtgtcatgtcagccgcgttggtggtatccgcgtgccaatggttcaggggcagaggagtataaaaatggccatgcattggcatgttgtgggttaatccctccctttccaggtaataaatggccatgtggcccttttttttaatgattaggcaaaaaatcttggtgattaaattaagttaaccaccccaattattatgccccggcttaagttaatgtatgggcaagaccgggattggcatttcgtttcacatgggagattaattttagaattgggcccaaaagggagttgaatttgagctttgctatggtcacaacagtgcatcacttctatattgtttactggtattttctccattagcctcaacagttagaaattcaaataaatattgagcctgatgtaaatgaacaagtaggtacaagaattgggaatttcaaaatggtttttccatgctcccttcgaaacaagagttcgagtaacgcctgtgatctcactgtatatttattcgtgcatatgtatctactctattcgtgataaatagggatgtgcatgtacagttaggaagtaagagttgcccatactttcaatgtgaattttcttgcaaatgcatgcatcatgtagtatatcatgcattcatatataataaaatatatagatggtgaatggtgtagtactcattaaataatgtgtacaaatgtaggtatctctacgtcatgtcttcaagcggcatttttggatttacactatcaatccatatctccatattgcctataaaaaaatactatgtctccataaaccaatgtagtagaaatttgactgacaacttcattgaattaccttcccttaattcacaatgtagaaatttacacaactatatataaatttaattctactatacacgtaaaactttgagttgttttggtaaaaaaaaatgagttgtcattgatttcactatttcttttgtagtagaattcatcattggtgtattacttcacacaacaaataaatgaaagaagttattatgtatgtaatggaaaccatgggatgcttctctggtttgaccattggtttgtatgtcggtttgtgtatgcatacgtttgtgacataactctagctagctgttgacagtaagaccaaaactatctttaaggagaagtttttgtagccgaacgtttgagcctgatacttcacggtgcaataccaacaggggaagcacttatccttttttgtgtaccttcaatcacattcttcatttttggcaccttaattctctaaggaaggggtgcaaataaaaaaaaatctttatggaaaacaagcacataactaattagacgtggtaccagctttacctatctacatgaatgcaaaatgaaacaattttacgcacacatcctataccttaattatatagatgaatacacggtaaacatggcaatatacataggaagagaggaggttaattttctgccttttagggtgggcatgatgctcatgcattgcgtgttatttatcctggtacagcatcaagtgcgtgtagcactagcaccaccaccactaagagcaggtacaatagcaggctatagccagctgcaaacgtattttgaggagataaatgaggagagagaagagcagcgggctacagatttgtagccagctgtagcacggactccaagacacggtgtgtatgacaggtgggaccaggtattaatagtgtagtatgtaactattttatgaataagctattagattggctatagataaattagagctagcagttagctatactattaaacttgctcaaaggctaagaaaaacgctgaagtttagggtgagagaaagaggaatcttcccctccaggtggcacacgatcccacctgcatcacacctcatcatctgccgggagccggaggaaggataatgattgatgatgccttgagggatgtaaaagcacaatccatccatccccaaatcaccccctttaattaactaaaactaccaaggctaatcctatcttgcacaaataaaataagtactacccagctagggcttcatagcctcttaattagcatgttaattagggcttttgttgatgagatgtttacttattcatttggctctcatctatcgtcgtcgccggccatcaggagccagcggtgacaggtgaagattggccacacgacgtcgtcgtcggcgttgaagttggtaacaactgcgtacaaaaaacctgttgtgacaggctgttccaacctccaactctccttgttggaccttttagccgccggattgttcaacaattattcatcctagacgtggtaaattataattcaattcaacgatccagtatatatgattctaatagatcgaagatatatgtgtatttacttggttataaagtaagacatgcatataagtaagggtctagtgttgtacttttgtgtgtgtgtgtgtgtgtgtgtgtgtgtatatatatatatatatataggtaaattaactggtgctacatacagtatgggctctaagattcaaattgagtatatatccaatttgaatgagtatgaatttttttaaaatgtttagatatgaacattaacttctttactaacaagttcaaacaagtttgaactgagtttgtacttttttttgttagattttggttctaggtatataacatccagacatataattcgttaggtatgtaataattaattgtgaaataaagttgagtttgagttgttttgttgttaggtatttgtatgaatcaaatttatatacctagatatctacttacaatttgtaaatttttaaaaatttaagagaatttgtgtgttttataccttggagcccgggcaccatagagtcccatatgggtatccatatatatatatatatatagtgcttttgcacctatacaaaagattagggatatgcaatagttctagggaatatttaaaaaatgtcacaagtttgttcagtaaaaaactttcaaacataactatagtgcaatcgcaatataattagattgtaactatactagaattatacaataacttttatgtacttgtagctcttgaaagaaaagaggggcacccatttataatataaaactttaaccatttatttctaaatatttatatagtttaacatcatatgaataatctattatgaaattattttccatggaaaatgtaaaatcatatatctataatattaattgaccaataatatgtgttcaaatgggatactttttctcattattgaggacaagattttactctcaaactggtggctgtaattaagctaggtcatttttcattgaactaccaacatcatgtagacacgtgccgtcaaaatcaccttatgttgggtcaaagaaaatcgacgttttcttaacctatctgggttgaactcgtagaactcatacctaactatatatgaaactcacatttacatgtagacttgtaccaaaatagttcggtctatactctatcctgataccataatatacactatcatgtatattctttatgtagcaagaaaaaaagaagtggtaggatgcatgcttagataaatttagttgctcaaaactctcatatcaccatctaatcacattttcattaatcaaatccgggccccacatttttgcaagtagaatgcccacttttcctgaccatattggcggcgtgttaa

SEQ ID NO: 108781 - DNA, 5101 bp, Oryza sativa
ctccctccatccacaaaaggtatacctattacttttgtcatcaagaccaaggagaaattaaatcatcttggatgttacaaattcaacgagtgaatgaaagcatgcaaccaatgagtatttatatgactccttgggttctaatcaaacatttaatttatctctttatttaagtcttgaatgcataaagactacaaataggaataacttatttggaaaaactcaaatgtgaaatatttctaacttttgtggatggagggagtattttaaagagatttcttatatgattcttttttatttctaaaaacaaatgaatttaaaatccgacttaaatacggatctgtatttttaaaagcgaacgaactttaaaacgaactcaaatacggatgaggtaacaaaataccggtaacaatatatttagtttttataatactagagtaaaaagcacttagttaaccgaatctccttatttggaatggccaaggtctagcacttccactgattacccactatctggcttaagctactctccccaggagctagtacgagtggcccaggaagccgcaggtctaggcatgcaccactgtggccagcagcatgacgtaccacgtccatctccgcccgcaccgcagtgctcctgccggcttttgcagctttccctccgaccacccacacacccacaccacacctttcatccggcggcgcgcgcatctcgcgcctgcaaaagccggcagtgattagttcgtgtcctaaaactttttaaatatacatacacacgtttaaagtattaaacatagactaataataaaacaaattataaatttcacctgtaaactgcgagacgaatttattaagtttaattaattcgtcattagtaaatatttactgtagcatcacattatcaaatcatgttgcaattaggctcaaaagattcgtctcgtaatttacatgcaaactttctaattggtttttttttctatccatatttaatactctatgtatatatttaaatatttgatgtgatgaaatttttgggagtttgaatggaactgaacactgagtaaccatagccacccaatcacccaccccgcggcggcgcacggtgcacgcactcgaacgcggccgcgcgcatcgaccaaccacaccacaccaccaccaaaccgcctcggggacttcggctacgtacagctacctctttccaattggcaacgtgacagaggatttcacatcaaaccagaggagagagggacaccgaagaattaatcacaaattctattcgctcgggggattggggattggtttattagcccgcagcgtcctaccagcacgcactagggcgctcatgccggcctgccagccgcgcagctaccgaggctcttggttccatggaacagggaactacccttttgtgtacatatgcaaagtatgttatctccttccctgtcattttgttaagtagcaacttgtccgggggcaataatatgcgcggtgggctgcagcttagtgtattacaaatggcaacatacgtcgtactattatacgttgctgtctacaggcgctactagtacaaaaatcagagtcgggtcgctgcttggtctactgcgtgtgcatcccaatgcccgtgagagtgagagatgtttatatgtatgcttgctaactagttgctttcccgtcaaagaatgagagatgtttatgctgaggaagcaactggagtatacacagatgtggtgctgcatctgctcactttcgcaacgaaactttttgactcccgtagtttgagtttgcaacgtgcagcaccggatgataccgaccgatatatcgatctcgtttatcggatgttgagattcccaacctgtttctagcagggtttcccaaaacaccgggggtcagggttaccgcgccctggcggtaagcacagttaccccgataaccgtgacaaaccgtacgaaaccatgtaaaatttattaaaaatttaaattattttaaaattttatttgaatttaaggaggttatcgcagtttttttattaccgtacccccacgttaagaccgataaccgcgcggttaccgatggtaatgtaaaccctgctggcgtacatatcatctcgttagcttctggcaacaagataccgatcgatacatcgatctcgtgtatcatttcatttcatttcacacgagtgcgtgcattttagggttgaaaaaaaaagagagcagagtatacgaccagcgataaatcaactgtgaggctgaccgagattggtcgatgtgatgaaccaagtagtccagacttgaaataaactagctgtggatccccgttgagttttgaccggatacgcatgcaatgcgtgcatatccggcggcaagttgcagcgtgatttcgtctcgccttttccgcgagccgccagctgccgatcgagcgaagcgtgtcggctaacgaaacggcggctcgatcgatcgactagcttcatgtgttgcgtgcgagggctcacgcgcacgcggcgcgtgggctcgttcgatcgatcgatcgggcgcggggcgccgtctcccgcgacgcaaccacacgcaaacgccgcgcgcatgcgtgcatacgtgcgggtgagagggaaaatttgcccatgcggcacacgcgcgcgcgcgggcgggcgggcgggcggccgcggctgctcccacacttgcgcgcggatgcggaccgagcgatggctcggtgttttttttttcttccaggctttgcgctcggttagagcaagtttaatagtgtagccaactaccggctacttcctccgttttacaatgtaaatcattttagcattttctacattcatattaatgttaatgaatataaatagatatatatgtctagattcatttaacatcaatatgaatatagaaaatgctagaatgatttacattatgaaacggagggattataaattatctatagtcaatttagtagccaattcatacaatagttacatactatactattaatacctggttccacctgtcatatacacattgtgtctaggagtccgtgctacagctggctacaaatctatagcccactgctcttctctctactcttttatctcctttaaatatgtttatagctagcttatagcctgctattgtacctgctcttagtttgccttattaccggggacaatcgggggagagggaatagggttcacgatcctgatactggataaaaaccgctcacgaggtgtatctttggaattcaccaaagacattgataaaaatgaaaaagagatgaaatcgataattttttgtcgaaaatttatagtccagcttgaattttttgaatttaacatgaaaaagcgatttttgtttttttacctcgttagagaagtctggattatgtgaaatccagatcggttttcatcaagaatgcaaatccttaccctagccaaattaagataagcacgggtacagtgaatatagtatgaaaacaatatgtaaaattatactccaactcagtagtaccagtatgtgcccggtatacgtataccacagtaacgacggtaagaaaaaagctacgaagtacttgcactgtagcgcgcgcgtctcactcgaccgatcgctattcatttcgatgaaaaggtcggcttttggatgtgtttcggggatggtgtgtgcacgtatttacgtacatgcatggtggtcagagggaatggttagatttttcggcggtcaaatttggggtggtttgacggctagctacagtaatcggttaatttgaccactgctgaccctttcgtccgtacgctgtccacttgttagcaacagttatactcccagttttctaacgttgtttcactttcatccgtcgcacccatgctaaaaaacaaagttgatgttttgttctgcattttgtagtccgatatatcataaatttgactagtgaaatgtttactgatattatttactaattaagttgtatgcaacaataagttcatccaaagcttttctcacaaaaaaaaatgaaactcacccaaaagttcaaccaaaccagagaagtcgaaccattcacatcacatgcatattaaaacccaaccccataatgtgccacttttcaccattttcttatataaaaaagtaatttcacaaagttatagatatattgaccaaattagcacaaaattatagattaaagatgatatatcagaaaactataggtttaacacaaaatatattacaaaattacagatttaaagtagagtatcataaaactacagaatgtaccagtatcattctcattaaattaatgcttgaaatttatagatatttttatttgtgattaaaaagttttttttcttaaaagtgctatctaaagaatataccggaacattgagaatgatatatatctttatagtgtgtgcatccacgagtattacttctttgaccaatggcacaaaagtgtagaaactagagaagtaataattgaattggtcacgtcggactaattttggtagcatttaccaccagcagtacttcaactctcatgtcactgttcaaactcgtgcgccgtatcaacaaccggacacaaacctcattctagaaataacggtgaaattaaaccaaacacgtctagttaaaggttgttagaacaggtgattgattaaaatggcctcccatcttttgaagtcaaatatactgctcaaccccggcccataaattgacagtgatcataccactgcagctgctgcacatggaaaaggccatccattgatacgcgtaattaacaaagaaagaattggtcttttactactacttctaattgtccttatctgaaaaaaaatataccactgctaattgtaattgggttttatggcatgcagctgtcaattaatcaagtagtagtaacacaagcgagccgacatgccgtcagctagcgaccgctgtgaaaaggtgaatgaaccgaacgaacggctcgtgcatgaacaggttgaacgcctcagttttttttctctttttcaatgacgttttgactaggttttctggccggtgtgattgccaatttgacctggccttttcattgccatttcaagccattccctctccttgtcactctgtcctgttcgaattca

SEQ ID NO: 108782 - DNA, 1926 bp, Oryza sativa
tattaaagtgccattagtaagggcacggccacatctgcatatattcagcttcggcgccggcggcctcacgtaaccatcagtgtccgtagtggccgcagctttcagcacccaaaaaaaaaattcagatatctgcaacctcgtcagtgtcagaattcagacacggctctgcaggctttgcagtagtacggttcagagataggatcagtaccgggagaaatccactgcgtgaaatatctcggttcttcacgtaatctggagtgaggaattccagtcaatttactgcttccagtgcgagtatatggttttttttttttagaaaaaactagtagagtactgtacggagtatgttttttcagctttcaggagtcaaagatgaacagcggatgagatgttggtgattgctactgataacgaataaaatgactcgtggtaattaagtggtagtagtacagaaggactcgtaaaataaggatggggattaggtgaagatgggtaggtagttttaactccaagcttttgatgcacattttggattggtttgtattacacgcaagcaaactctgcacaattattggctaaaccactctgctgaatccgtgtttctgaaattacacgtactgtagcacactgacattctggaggagtataggagtatctctgtgtgatctgatgattgatgtacgtaatgggtcagtgagaggtggatgaagctgaggaaataaatggcatcagcgtgtaagtacacggcaattagttaggagatgtgaaaagggcagcagaagtggatgaatttgcagaaggtacaaatagtcagatgccaccttctgatgagcagttgagcacacaagatcaataattgggtttttacccaatgggagaagcaaacagagttgcagacggacacggccacactaggcagctcatctgacgtgtaattttggcctcttaacagagagcatcatcgaggtcttggagagttgaacacttggacgtttcgacgttaagctcaaagctcacttatgagaaacagagaaagagctttctacgtaattttgacctcttttctacgccaaattgggggcagagagatagagagctcgtgccatgggagaaattttgcagtcggttttctgaacttagtcaacttatcctgtgatctgtgaacgaatgatcaaagtgacaagtggctggtttagttattgagaaacatttttcattcccatagtttcgcctacagcagattttaaaccgtaaggtttattatatatagtataagtaaagcgttttatatatgtttttagtgatttaaaagctctaaactaaaaataaacaacgacgaaaaaaattgaaaatcaacccttaaattaagtctgataattttaaattttaattacggctgataagctgaagagcaaaacggtgaagttgtttggaataggtccacgtacgtgccaccgcagctcggcgactcccatgctcggcgtagctttgcttacggcggcgcgtgccagccatgcaccgggcgggatgacgcgaaaacgaaggcaatttgcatgcgcttttcctttgcggcacgcatcgtctctttgttcatcctcacacacacgcacgcacgctgcctgccagcgatatgatgttagttccaaccgcctagccttcacacaaaacatgtttcagatagcgtgcaaccgaactgctcgccttactgcacagttggtctcacctttcccacaattcccactgtactgttttgtatatcggttgcaaaatgttgggatcgatgagatggaatgatggatcgcatttcgcagaaagaaaaattagaaatggattagtagaaggcaaaaggactcctttctagaggttagatcatgcatgcaggtaggcttttcttaaatcctggtaataattgagcaatttcattag

SEQ ID NO: 108783 - DNA, 732 bp, Oryza sativa
attaggaaaaatgaagctcaaggcagtttatgactagacacaacagttttttttccttcaaataactaaaatggcaaatgcaacttaaattttcagagctttctgcaaaaagatcctcgtaactggaacataatagttgacaaccatgtcagtcaatgattattttctcataagatgtatgcaagacgtagaaaactggattcatcgtgcgaagcaactaggtattttcgctcatcgactcagccattagaccacaattaattttgaatcgtacgcctgtgtgctaacttatttttaacaacaaaaaaaatctctctccaatcagcaggcatatttttttccctgtcatttttcaactgtttgtatatctgcatatccttctgaattcctttttgtatattagcaatgatttgattgctctgatgcctaaacaaagttagaaactatatcctttaataacaaaatggtacatgacaagaagaaagtatcaaattttgatcaattaatcataatactgacggtcagaaactttgtaatgctcatttctactaatgaaaataggggggggggagggggggttatgatctcctagaagggtcctcttgcatccatatcaaaagacaacaccatgataagcatacatagcacatggaattaatttgcaactcaaagtaggtatggacaagcatgatgccattttttatgtaataagtaaggtccatatttatgtct

SEQ ID NO: 108784 - DNA, 565 bp, Oryza sativa
aaacaacttgttttcaggtaccatgtggttgtgctgtttttataacaataataagtgccgggacagctgcaggtttcaagatggaagtggtcaaaactacacatgctggtcatgcaaaatctcttgtatcaacaatagatttcagtacctgtccagatggtatatatatctttacatcttacctgaagtgttctacataactattttgatcatctgattcatgtttgtgcctgtcttctaggaattgtatgtgtgggtggcgatgggattgttaatgaggttagtctatgttaatttcatgcatgatttttttatgtttcctcatcttatttttaatgtgtttggtataccaactagagaaggtaatcttttatgacaacattaccaattacagtttcttaaattgccttagctcttctgaagttttgatctgttatatcaagaacaaataggatatacctatataaactgctgaaaattgcttgaagtttcgcaactttgttctgaaaccaaccttctacttcctcagcctgaactgtttcagggggaaactactaagttcaag

SEQ ID NO: 108785 - DNA, 2815 bp, Oryza sativa
  unsure (1)..(2815): unsure at all n locations
gcagagatcatcacatcacacatgtccaacaacaccatctcccggcctctcatctctttcgatcatggcggcaatgatggattcgccatggataaggtgaggtccagagcatgtgagctaatgcacaatcttatcctcctccatggtagaccaatggcaaatggcactatctcttcgatcttgttgttcttggagaaattaattaatatatagaatggttaatcgctttgagtgcattgcaactaacagagcagtagcacgttaaccctgcaactaggtaccaattatgctctgcgaaatgcaaggtcttattggcctctcgatcaatcaacatgtatctactactactactaccacctactgccagcttggctgcttgcattgctgatagatcactcgattaccggttaacaacgatgattaaaccaagccacatacgcaatctctgagaatgactgttccaaagtaacactgtgcatttgcatgtgggagattgctagagtaattggcaatgctgataataacattcttgatataaatatatttgaaagtaccgtttgatgggttgacctatcgatggaagtgaccaagtatgtcgaggatgtccctcatgctgctggatatgaccacagcattgccccaatgacaagtgtttggcatgtgccatgcttcctctaattaaactccattatggatcaacgcagaattgatgtttctgcatgttaggatgaataattataggttggttgatgatcacagcagcaatgcagttgggttgttcatgcaattcccccttttagctcaccagctaggaaccctttattctctcctgaactgttcattcccatggatggaattttaaaaaaaaaaatttaattttttaaaatctatatattacctcaaatggatcatgggtgatcatgggaatcattcactaagtatgcatgcaacnctnttnntactnnnnnnnnnnnntcttttggtncagaggcaggangggnnnnnnnacctcatgctaacatttagcatgggcttgtgtactttggatgacacaaacttatattgttaaacttccatctaaaaaatggctgtgaatgacgtctggtagtaggtggatgtgacataattacatatagtttttagttagtagttgaataattggattaacaaatgcccctcctcaagtgcatgcaaaaggtatcctactttctgattcattgttgcattgcattgcaccccgtgaagaagtagctactacaatctggactacttgatgtttggttcttgcagctttttcttgaacaacctgtacttagttcagttgatatatatcagcatgcaaagtttattattgttcagtgctacttgcaagtacatatctctaatatatactaacaattacttatatgaatcattcgaatgctagcaagatatgattctctcaaggtatgcattgctgcaggagcagatgaagaagagatttttcactcactctttacattgcaaaggacaggcatctttttctggctccaataatcagatgtagcagcagctattagcaatgaaacctacagttgatccatcgatcacctgatcatgtaactgacggatgcatctgcaatgccaacttaatcagttaattggtggtctcaggtcgacatgcatgtgatgtgctcctgtttagggtatcaaaaattaaggccataatcgtaagcaaggtgtaaagttgatcacattctcttcatgctaaggaaaggcgatccttgctatccacataaaaaatctcaccttccttggaaagacatcctgttcaaaaattctttatttgtcactgcttactaattgtgctaagaaagaagtcaatgcgaatttgtgagagaatttcgttgaaatgcacgagggattaaacaattcacaccacttgctggcttgctgcaaacgcaagaattgtaacatttcgaactggatataatgcatttgcattaacgggaatcgtcgcactggatatgagcagagagctcgtggctttgaattattgagagagatgaagagaggatttcttggcgagctaagctaaggagagcgcgcatgatccaaccaaacattccagccaagcagctcaagtcttttcttttcttttctgattccaaacaagagaagagaatgccttttactttagcatccacttgagttgtcgcgctccatgctctatctcatactactactcttccatccaactctacctagctagcttagctagctcttatcttgctactgtctcaactgctgcacaaataattcttcagtaaccaaccatttttttttatcgctgccattttgccgccatcctttcttcaggatcgcagcattttgctgtcattatttcttcgggattgaagttccatctacatgaaagatgagttgcaaatagtgtgatgatcaattatcagttgcacagctcatctggttggatttttttgttgattgttcagagtttcagcatttgagacatggtccatgatctgccgacatcacgtgaaacgagtgatttttttttaccacctgcaactgaggtaacatttgggagatgtaaagggccagatagattttgaccgaccaatctcgtcttaacatatagtactacattttttttactgcgattagatctgaaattattttactgcacctggtaaccacgcacagtaaaagcttcattttgactcagaacagtctgccatcccaaatctacagccgttgacagttaactgaactttcactagttcaatcactcaacttataaaactgccgtcagata

SEQ ID NO: 108786 - DNA, 503 bp, Oryza sativa
gcaccgccaccaccaatcaatcatgaacacgacagattaattagagtttaaatacttaaaactataggcatctttgagcgatgtgatgtgactcaaatttatttgctcaagacgagagcgtgaagcaagcaagaagcttcacgagtcattcagaagaagaaaaaaatcgaactttttaaggcagaaaaagatgtgtgcaacaggagctactagctagaggagtactagagaatcaatcagacaagaacaatcttcctaaaccgtgcgtgcggctactaaatatataatttagagacaataaatatgccatgtcttttgcttgccgtaccaccaattcaatcgtttggtgcaatggatatatggatattcagaggggaaaaataataattttgggggagttttgcagtgtgcttgaaagctacgtgcgaggagcgaatgagcaaaatggacatcagaactgacaagactgtgttcatctaacttccaagctcaacagcttcgca

SEQ ID NO: 108787 - DNA, 1120 bp, Oryza sativa
caagtcaagctatcctgcttttgcacgagcgtgtagtgttgtgcatagacgacggaaggggataaacgcctgtgatttagccgacaaatcccatttaggacagatgaccaaagctaaactatgctggttgctgccttacaaggaacatccctcctgcctcctgattcctgcacacactgcccggcatctctctctgtctgggtcaacgtacaaatcgttctagttttctactactatatattgtatactactagtatatttgatcaggtaagtgctagagaactgtgtatagctagcacaaaaatgtattataattaggattggtttaatctgtaaatgtgttgcactccaaccaagcacaagtccccatcagaagtttcagagccattagacaaagggttgcaccacactctgagctgcctgcacgtagcttcgtttctgtacttctctatttggatgccaaaccaagacgcttgtcccagttagtaggttcaagcaacaagaacagaaaatagtacatctcttctacgattaatattattcagagtttcggacacataaactggagctaatcagctaatcgcagcagcgtgcaaataatagagagaatctcttatatgccactagaatttaaccagttcccttatatgccatttaaaattggcttctctcttatatgccactagttcaagtttttccacccttttatgccactcccaccactatagtgttagttgactgttagtcaaaggttagttttttcataaatgaccaatatgccctctcaactaaaaaatgtgtaaacttcaaaaaaatcataactaatttattttaaatcctttttggatgaacaaaattttatcagaaccagtgaaaaatgctctttatattaaaaatattgttggaaaactgcatgtttcatgcttacattgaaaatttatttgtgatggtaatggctaaaattgcatgtgatgcataaaaaatcaattttcatatgttgtatccagtatagctatattagtactaaaatacctattattaagggcaaatgagtctttttacaataagttaacggtcaactgacggtggactgacggtatggcataaaagggaagagaaa

SEQ ID NO: 108788 - DNA, 618 bp, Oryza sativa
aacggtcaaacgttagacataaatagtgtaaaactgcatttattttgggacggagggagtataacgaatctaaactggagcagatttattatactaaattatgtcatattttattttaggttaggtttttcagtgacggcagagtgccaagagaagaaaatactagcagaggcagagacgatcagacgaatggctggcctctctacccacacccatgccaaggcatgaggatgatgttgtccttgtccacagtgcacagacactggtgcaccgtgatgcacagtcgcacacaggcacacagccttcttcacgaagccatatccctcattcccctctatatataagccagcaagctgcgccatgtcatatcccccgctaaactctccgcccgcgcagccttgcactcgcgtcgcacatatcgacccatccatccggcacgcatgcaggcgcagcaggccatggacgagcccgccaacgcgcagctgtacggccacgctcacgcgcactcgcaccaccaccggagcaagcgcccgtcgcccggtggcggcggcggcggcgcggcgactctgggcgcggacggtggcggtggcggcggctctctcagcgggacgcggtacc

SEQ ID NO: 108789 - DNA, 550 bp, Oryza sativa
tgacgggctttcacccgtcaaaggtgaggtgtagtcatcagtgaccacttgtctctgaccagaaccaaatccgtcaaaggtgagggttagagtccgtcacagatgactggatccggcctagtgtctaacatttaaattttattctaaaatatctaatttatttcaccattactcctatctcaatcaatcacaaccaactttcatttaatttctcaacttcatctcaaattgagattcagcgcggttgcacaaaagcaactgcatgcaattacaaccattcaagacctaacacagacgcaaacaattgctacaacaggatattcacaatggcactctttgctactattgaccatatgtgttgctactatgactgcagtcataatagggatggcaaacgggcgcgacgggcacgggtagtgcctacctatacccgtgcggccgtgcccgtgatattatttgtacccgtgggtatgcccgttactacatgacgggcaatgattgttgcccatgcctatcgtccgcgtgcgccttgtgcccgcgggcgtgcccg

SEQ ID NO: 108790 - DNA, 1681 bp, Oryza sativa
cctcctcaaggatcgtaaaattgctcatattagattgtgcaaaaaaatagttgatcaattaatctctaaagcatcatcctttcacttatgcttatataagccaaactttaaaatttaaaacttagttttaaagttgattttgttggtttttcatcatagtttattttacagcacatgcttttaaatctctaaggacagtatgtataaaaattttatccacattatttttcaatggctgataagcaatacggataaacacgaagtataagcgaaacaatggggccgctagtctctaatgaatatgatgataactgtacacttgtaaattttacaaaaattctttcaacacagttcacctgaagactatatttatattgaaaattttcaagcgtctatgtatcattttgtcaacaatatttggtgactaattatcatcactatgatagaaaaagaatatatccaaaatatactgcaaacaaagtcaaccacataggagaaaaaaaagagaacaataatgttgcatttttgtagaatatcttattagatgacacaaactcatgatctccaggacaatgaaatggcatgcatatgccttgatcaggctgctagcttgtctggatcacagtattaaacagataactaaatgaacatgatgaatcatcaaacaaatgcatagtctttttcaatatttattatcttactcctatatacatagaacatgcaccacattttatatagtagtacatggaacactctatcttcagtgctatatgtcgggtttgctatcctggtttgtttttgactttacatagtagcttttatcggtgtgctggttaggtacatgtgtgaagagggacatcaggaagcaaaagagaagagaaaattgaaaatgcttccaattttgtggcaggtagtacaaatgttttatcaagaaaatataccgcctgcaaaaaaaaaaaatcttcggaaggaacccaaagtgaatgatttaagatcacgcaatactcatttcattctgttggttggctaattagttatagatgctttgtgccttcgttgacacactcatatgccaatcaagcaaataaacaagtttatttccaagtccaaataggaatgcacacatataggaaatttagcattcggccggtggtcttcacgttagatgatgccattcaattaaccagggacgacctttcaaatagagtcatcgcctcattggtgtagttacgtaccctttgcatgtttctagttacacactcagtaatccgtttttaacgaaaaggccggatttcacacccaatcgattgaactatttttattaatgccacacaatgtctgaaaatgacacccattgattgtgttgttagtagcactgtggactaaaataagatataaacagtcatgtcccgtgagtacgtaccatccgcttaattgccgtgaatagtggttaaatgtatacaaaactctatcatgtttgcacaggatatgattaatcaaccaaccacattttcttgttaggttatataggggcatgtcattgactaattaagatgtgttaaagtaatcaccaaaacagcatttgatatagtaggtgtggcggtatattaatcctttttgtcttcattaaaatttgatggactttatacaaaaccaaatttgacaactagataggtagaac

SEQ ID NO: 108791 - DNA, 1422 bp, Oryza sativa
ggcagcggcggtggggggacggggacggcggcggcgggggacgggcgcgcgttgatgccttcagccgcgtcgcatggatgagaatcgcatctgtggagaaggagtatcccgttgggggatggtatctcgtccctagcattttcgtttcttttagataatggatcaaaccagcctctacgtaccatccatcttgagattacagttagttattagctgccatttgatttgaagcgtgcacgtatataaatagctgcatctttgttgatggagtttgtttaattagaggcgcggctgcaacccgacgacgggcacacgacgggcgctggtgacatgccgtttccggcgcgtgtgggagagggagagggagagggagaggaattaaccgctcacatgtagagttcacgtgggttccactcaccatgtaagtcaaaaccggtaactatactatcgaaggatcaaagttaaattaacacgatactgtaagttgaggaatgaactatacatgtatttcggttcagggatgaatttcagactcaacgacaaattgaaggacctaaaatgaacttatttatatttgtcttggctttggtttgggttggacaaactacagagtcgtgagaaacagcccaatcctcaagtccataacaagagagagtggattttaaacttatttctatttgtcttggctatggtttgatgtttgtttcaaacatgaacaaaattaaaaaataataataaaaattactaacatgtgatatatcactctacaaacatgcaagttaaaacttaacttctacaagttgcaaaaaaattaattaaactaccattacttaatgtatattcacattcaaatttattttttttacaacatgtagaacttaaattttatattgtatgtttgtgagatgatctatcccatattaatctatcttgttaaacttttttaaaaaaatttataactatttaagtgacatgtaaataatgatagtacatctcctcgagaatttagaattgttttcccataacgacgattcagccatgcaaactttgcaccgtgtgtgtagcagcgtaggggtgataatgtgcttaacttttaaccgtagaaaattccagtgctgaatctatagcaggttaaattttgatatcttgttaccaaaaaataaaggaaaaaatacaaattacacccctaaacaattgtgacggtatgaattatcccccttaactataaaaccgtgcatttgtcacctcaaactatagaaactggacaaattacccctttgacttaatccggaggggttttgctcctatgtggcagacacgtggcgccaacgtggcaatataatcagaaaaaaagtaataaaaaactatgggcccacttgtcatatagtactcctattcaacccatctctctcttttctctct

SEQ ID NO: 108792 - DNA, 1292 bp, Oryza sativa
aaaaagtcaacggtgtcaaacatttcgaaacggaggagtacgttgtgagtttttcgctcagtcagattaccttgatgatcctggcatcgtctactctgcagcgttggtgtgtaaaataatgaatggtggaaactggaaagtaactcctctggcattgccggccatctgcacggcgcccccgtgtctcctgctacgcatacgatcggcccgtgcgagccttagccgtaactaattgggccgtttctcgcgaatcgcgggaagtttgcccagcccaagccttaggcgagacaatccagcccagcgtgaggtctcggcctgctgctttaattggaaaaagtatacctgagaccccttatcttgtcgacgatttatttataaaatcatccatgaaccaaaaaccatatatatgacatcagtcaacttataaaactaaatcactctaagtccataggcggttttgtttgacatgacaactgaatcagtgtggaacccacatgggcccacaggtcagtggctacttccccttctctctcccccagtcatccccttctttggcgatagttgatgggcagaagggctgacgcggcgggcgcgaccgatggccggcggggaagagcacagctggcgaagggtagggagaaccggggacagatcgatctgtgccgccgttgccctcatgtccgatcacaaccaaacggagattgctgtgcaggtgtcactaatggttgtgtttagggaggatgatgtggggaggacatggcgggcatggctcggctattccgaagggaggcgatgctggtacggtgctgtggctagcgttattagtagatgttgagaggtgaggggcaacggtgatatgacgagacgatgaaggtccacgaaggtcgccgggagaaatttttcccgagcttgggatgacgcgagtggtggaacatgtttcatgccgagccgccgggaaagaggaatgggagggtttcctatggggttgatgcgagctcatgctgaaggagacacaaagatatggacgacttgccttcttaccggggagatgatgagaggggcgagaggattcgagagagcgtgagatgggaggaggaagaagagcacagggaagaaaggggaaggtactgacaggagcaggacgtcgtcgcgcgtctccggttcttcccacccgtcgtcggccgtgctcctgcctcaccggccgccgaccatgcccctcatgcctgcccttctccacgtggcccgtgcccaagaaggagagtactagaggagagagagaagagaaagtagtt

SEQ ID NO: 108793 - DNA, 1895 bp, Oryza sativa
ccaccacctattaggtgtaatgggagtaaatcttcgatcggtgtggggtattttaaatatatttattagaatttgaatacagatttcactcacccatgttagcggtttgaaacctgcacgtggagtaggatggtgggctttgagtgtttagtggtagaccactgttctacgaaatagttttgacttgtagtgtatgtgcatcatatgcttttttaaaaaagaatatctttgtgtggcgatctatacattaagctattaggatgcttactaatgtcctgccatgtgtttagaacttgtgatcaaaggaatttcattttcattcttttgggaccttgtagaacatattctgtgatccatcccatcaatcattgttcctatgttgtgattactcctatactctgcttaactgtactcctatactctgcttaactgtggccatgtttagtttcttggctaatttttttaagtatattcggatacatatttatatttaaagtattaaatataatctaataataaaataaattatagattccgcctgtaaactacaagacgaatttattaagtctaattaatccgtcattagtaaatatttactgtagcattacattgtcaaataatgacgtaattaggctcaaaagatttgtctcgtaatttacatgcaaactgtgcaattggttttttttcgtccacatttaatgctctgtgcatgtgttcaaacattcgatgtgacatttttggaaaaaaaaattgaatctaaataaggcctgtttttgtttggtcaatactgctttaatggtgatacaagtgtcatctgaaacaaatgtgcaaaaggcgtatgagcagtttgatagtataatctgcttcatccatggcttcttttttggcggtatttttcaatttggaggtttaatgtcagccaaccatgtctatttttgttctcctgttttttgtgaggaattcctatcttttatttgaggaccatagcatccatatcttgataaactttattcctctattcaagtatgccacgtgtccaaacatcaccacaagaaggacaaaatagttgcctttgcacaaaccacatggagaggagaaaagggaaaataattgtgactcaaattcttggagcattgggggctgtaggctgtaattctagccattcacataggatagatgccaaaactcatgtaagagcaggtacaatagcaagctataaactagctataaatatattttaaagagataaagaagagagagaagagtagcgggctacagatctgtagctagctacagcatggactcaaaaacataacgtatatattacaggtgagactatgcattaatagtatatagtaagcaactattatatgaattggctactatattggctgtacatgatttggagctagtagtgagctatactattagacttgctctaaagcatacaacacctaactacttttttgcatgtacctaaaatgtttggatatgtatcctaaggctcatatgcaccatttaaaagaggctttaacaccaaactaataaaaagttaatacgccatttaagggtcacaggtaaaaagattcttctgagaaggtctaaaacgagtattttctaatgtagtctgggaaggcatagatggaattacaacaataccatcaacattagttgcggatcgagaaaaaaatagtttattggtgttactctaaacttaatatccctcggtacacgatgtcatattttcgttttataggccatttaacaatggattttctcggagttcatcgggtctattgatccaatagatctaatttacatctcctccttctcgagggtagtagaataaaagactttggattttgatcaccaatgaaaaggcccaaaactcctag

SEQ ID NO: 108794 - DNA, 783 bp, Oryza sativa
tttggcttaaatccgtgctatatgtaaagaggagtattgaagtgaacactactaaataaaaaacgagtttttaggtaaaggaatattcccttcttgggatttttttcagcagtactcgtcattctattctataattctgactgctccttttactattgactagtttctctgcatttatctgtttttcacgagcttgaaacttttataagcacttacatatctttggattgattacctgtagatgcctaaaatagttcagcctaggatatctgaacaagttggaacaatagagtggtataatgggataaaaatgacaaaatacacgggggattgatcgaattcgcttcgttatgggaataaagaaattattgcgtaccttcatgatgggcgtctagatatttccgcttgaggctgggcagctgttgccgcaggcatgtagggagcacttttagagcagggcattcattaatgataagctgttggagggatgagtatgcttgcggtgaatcttgtagcgatgccaggcttttgcagtggtggagattgagttgtaccaacgaagggagctcgcccgagtgagactccagtgattcaggaggagagaagcggtccccagctggtgatgatggttccaacgcaacagcagacacaatgttgtcgctgcaaggccctgctggcccgtgtctctgctggccgaatatcgactcaagcttagggttgtcgtctatgtccatttccttgagagatggtggggcgttgaagatctctaccaaactttcacat

SEQ ID NO: 108795 - DNA, 1105 bp, Oryza sativa
cctgcagcccctatactgtctacgaactttgaacctttctgactgcagtgatctctatcgacttccaaaacaaatgaagtacatgacagccctctgtcacctccacactcatggatgtacaagtttgaagcacatgcctccagatttgggaaaactcacttccttacaaacactcacttgttttgtagctggtactggctctggttgcagtaatgtcggagagctacaacatttagatatcagcggtcaactagagctacgtcagatggaaaatgttaacgaggaagatgcaagactgatgaaacttgaaaacaagaagctctcaacactttctttagtatggaatgaaaatgacaaagaagatcgatcttacaccaatgcatcagattgtcatgagaaggtgatcgaagctctcaaacctcatgatgagcttcgcgttctgaatgtcaaatcctgcaagagctcatctttcccatcatggatgggtatgcttaaacgccttgtagagattgatctaaataattgtacaatgtgccaaaatattccttcagtttggcagctacaagatcttcaagttcttcggctggatggattccatggactgcagtatttgtgcagcattggtcaaaccatgagataccgtcaacattcccaaaactaaaagagcttaaactaacaaacttgaagagtttcaaccgatggtgggaaataaatgagagacaagaaaagcttgattttcctcagcttgagaagctggttattaagggatgtggggttggagagctaacatcactgcctactagtgacagtaatatgtcagagcctgcattaccagctttaaaggaactcgaactctgtgatttaaatcaattcgagagatggcaggcagcggaaggaacacaagacaaaccaccgaccttccctaaccttgagaacattagtattgtgaaatgtccagaagtgacaagtctaccagaagcaccaaagctcagtgtgttagacataggaaatggctctgaacagatgctcctttgcatacctagatacatggcttcattgtccactctgagattgcagcatgaaggtgaagaaacaacacctctaa

SEQ ID NO: 108796 - DNA, 733 bp, Oryza sativa
aaactccataggcaacatacatacatgttgatatccatgtcttcttttggagatgattcacttttatcaactgtcacgaccggaattaacccaatgggcgttccttacgtgcgtgtattattccttgtcccagaaggcaaggtacaccaagagttgatacatttcagagtttatcaagcggaagcgtaaatagttaatttattacatgggcagcgaaggcccggcacacacaaaaacaaacgagaaacagcggaagactagggcgacgaccaaggcgcttgacggcaggcacgagctagacaccaaaaccttcatcttccagggactcctcttctgagtttgggaaaaattgagcaagactgagtacaaccaccgtactcaacaagacacacccacaagtgcataataaatgcaagggagtacaagggagttgtaatataaagggttagggttgcagtaaacagcatttaaatatacttagttgctcaaagctattttgtaaacacgattctagaactatacaatattatttatcaaggccgtgaacccacacgaacctgcctaacccaaggcctacgatgattcagaccgaaccggcaacccgaccctgggtcccagctcgtcccaagccaacccaggtcaaccattccacattttagttgttaagcaggtttcaagaattaaaacactaacttgggtacattgctcggcttgcccataaccgagggcgcgg

SEQ ID NO: 108797 - DNA, 739 bp, Oryza sativa
catgtggccagccacgctgtatgcgtcgtaaggcatatgaaaatcatatatctcataggtcgggtgggcgggcgcctgtaattaaaagtcgattttcatagataagtctcttaagatatatctgtctacgaaaatatattttcacatacagctaatctatgttgtcccgataacttacgtagtagtagtagtagtgtgcattattatcgttgttatattctgcggctaattaaaattctgagttcctcactgaaagatacgaacaacatatttagttacatattgaggcagaatttgttccacgataaattcaatttagcacatacactatactcccgcacagtgcgcacatacatcgtaaggtatatggggtcaaaattaaacctaacaatgattataggtccattaattttcggctgtatctgaccaaagatggacggaaactagagacgtacgcactgttattttgtacgatatcaaaaagtatatattttgtttggggtttgctagcattcctaatttaattgggacgctacacaaccacgaatgattcggccgtgtgacatgggatgaatgattcactcgccccaaatcatgaactcgtccgtgatctctccggtgtgaagatcacatttcattacctgagttgaacatctcgtgtctgctacacccacaagacaacacgttttcttcctgacacctcccaactctacaactaattaacgaatatgcatacaca

SEQ ID NO: 108798 - DNA, 921 bp, Oryza sativa
atagtttatttaaaaattatctcataaataacagactaaggatcgaacaatatccttttaaaataattcaggggttctatttttctaacttattgttgaaggaaaacacgatggcctaggagagcgtccagttttagctcagtttttattcttcgtttttttcagtttttatttttttccttatcccctggcattggccctctggccgattgcggtgtgtatctgaactttttttgacgtgcaatttttttgcgtgtttggaaaaaaggacaccatacatgtcagcatatgtagatatttagtgttaaggtaaaaggtgcgcccacacaaccattcagttcttcaaactcagagagcttaatttttcttggaaatgcattctcatgagtagatgtcaatatagttgactgggtgaacccaagcacaaattgtacattgtaggcttgggaagcatcaagaatacgtgcaacattccaattccccttctggccgccatgatgtgtgagctcgctgcttgattttccaatgaagcatacgctttgcttgaagcatcaggactgcagctgctcgtcgcagcggagatggcgattgatggtagctttggcctttaattttgagcagctggaataagcaatccgcactttgttttgatggaacgtactagatcgttatgaagcagttagcctaattggatctgaattagtggtactaattagtattagttatgctaattagttgtggtaccactgtcaatgtaatctcactgagtcgttttgttgatcattgattagtattcagaatttttttaaaacataatacgcataattcaggtacaagattaacgaaagactgtgtgacataatttaagattaacgaagtcaccacgagcaccccaatataaatgtgactactcatatcaag

SEQ ID NO: 108799 - DNA, 1127 bp, Oryza sativa
ctggagctcgcgcttgcttagtaaaagttgcagaggtataccttgtgtgtagtgagagagtattttcaacaactaagctaaattacgtttaggaatgtatttcatacgaatgcttcaataaagttttaaaacaattagttagaaatattgtgataatataagttagtgcacaaacatactgctacaaattcgttctacactaaataaaaaaaataaaaacaacaaattatgtctgcactatatatatataatagtgcccagtttttttttatttcctactactttaaaaaagggatttcgcaagcgagccacattgaccatcgaggtggttcatgaggcaagtcgcttgtgcagctcgtgagaggtggcggtaaggaccaactaaggaaatagttagcctctaaaaatcagttttttttccatgcaatcaactaaactgacaactcgcgaaaataccatattttcgttggtggttggtttatgctcccctatgccgtaaaccgactgtctttgaaaatagccttcactatatacatcttcttcctcaaactcctctatttcagttacattgttcgtgtgagcatggatgaaaccaaaccatgcatgcattcacaaactaaaaggcttgattaatatttataaaagattctgagcgacctatggctaggcaggatgagtgaatatgcaagcacatatgtgggcttgggaagcgtcgagaacacccgtggcacaacgaactatccttttgctgcttgagcatttgtggtcagtgcaaagtcaccttcagcgttggtacggcatgattgtggccacgacgcgcgtgtccatcgaaaatgtgtttttttggcgtggctcagcttgtgttcccctgatctaatcttatcgaattgaagttggagttaccatttcgcgtcgatggtgtgatgacgatctatgaaggcgagttgttattaccggtgttcatcgataaaaccaacattgtgcttttgaggttgctagtcttgttcctgtggttgtatatgttgactggtagtgtgttctttgtgtccatggtaacttaatttagtctggtttttcctaagggaataatagctatacgaaacttagtcagagagaggatcaaaccg

SEQ ID NO: 108800 - DNA, 2171 bp, Oryza sativa
ttgcaaagtgacatatcacatattgatttatcatactaaatttttttaatttttttatgacttttaagtgacatgtaaaaacgaaggaatatccccttaaagatgaatatagttttcccttctcaagaaagtaatatttgtccctcaagaggacatgccctggttatgcgcatggcgttcaattaataaagattcctggtcacatcagtagcaatgtttcacagagtttaataaaactgtggacatctctatacataactttcacagccgggcacatgctgaacacaaattttcaagtttcagaatttacagagttaataataatgtaatgtaaggttgccgtgttttatttctctcttctattaatgaatgacagagctcctgtcttttccctcaaaaaagaggtaaggttgcccattgattgatcttgcaatattatgcaaaattatagttatgtcacctgtacgcaaatttcttgtcagatgagccatgtgcaacaatacaatttcacatgaatgaacagtgtactcccagtacagaactacaatcaagtgttgaaattaaatattgagatggatcaaggaggcgcatatgcagaagcagtacattggtttattggttcttggcgacaagggttttattggttttcagtcgcggttttccgtaaaccggtgaagagcggtttttataacgaaaaagaaaaggtaaacctggttgtaattcatgcggttttagaagttcaatactatcaaatttctggcattattgtttaggggataaattggattaattaatgcaatatttcaggcggtaaatcggacctttttaattaagaaagcgtgtcacccgtttcatcagaccgacggttgctgctgataactcctcgtgtcatcgtgttaactaccaaaggatattctaatatattaccgaaagatatgagcaggccgaatgcagagtttcgtaggttttttgtctgactagcactgctgaacgtttcaatatgtatagaaaagagataaaaggcgcacaaactgacccaagccatctatctatctatctatctatctatctatctatctatctattatctatctatctatctattatctatctattatatactaaaagtccattaaactccctacaaacgctcttaagctgccacgtgtctccctcaaaacactctcaacttgccacgtggcgtaacgagaggaattcagcacctcgtagggcccgcacattatttccataaatatatgtacgtgtacacaaggcaagatttgaaatctatctaaaagcaaaacatgtacttgtcgtgaacgaacatagattagttccatatttgtgtgtgagaggcaatattccaaatctctcaaagcaaaacattccaaatctcaaaaagcaaaatttagatcactaggaaagattattaattgcaacaaggattagttccatatacatgagacaatattcgtaaggcttgcatgcatatatatacaccccgccagcatgcgacattagtcgattccggaagaagtcgattccgacgacggagcagaagaagtcgattccggcggacggagcagaagaagtctgcggcaccttgcgaatcatctttggcataagaaggtatatcacgcacccacaaaagaacacaatcatgacatcatctaatcatgatcttgcagctaggaaataacatatgcatctatacagttttgtcatcatattttcaacagaagaaactaacattgcacctacaaaagaacacaattacgatatcctgtattagttagaggtacattatgttgcatctatgtatacaattttgtcaattttttttccagcacaaaaaagtaaccttgcacctatcaaagaacacaattatgagagtttgtattaattagttctataaaataacataaacatgtatacgactctctgtcaaatttgtttagtaactatatgcagtactactcatttgcagataacatggcacctagcaatttgattactgcattaacaccaaagaacgataggtggagaatcaaagtaaaagttattaggctatgggatgcggttaatcctacaatggttgatgagttctatggtatacatatgattgtactagatgcagaggtatgattgttgtaaacatgtgatttaatata

SEQ ID NO: 108801 - DNA, 967 bp, Oryza sativa
aaacaaaacatcggacctttaattttcgcttaacatggtggacccattattcttcaccattagatctatctttaaaaaaaaaatcttaaaacccaatccataatctcctcccaccccaaccccaccacctaacttatgtacgtgacctcctctcccctcacgtacgtacgtacgtctctccctctcatgtccttcctttcgtcctgccatttaccttccaatctaccaattttctacctagcaaaattcaatatgtaaataaaagcaaattatctaaatgattataatttttacaatatttatttatctacattggccatgtttggatatacaagaatatatcatttggaaaaaaaactcctatcttttacatcaaaaaataaaaagttattaaatattaaattaataacgtgtatatgatcttcgctcactttctcctccctatttttttagctcgcaactcagtataaaaataaaaagagtaaatttcacaatattatatctatatatctatcatatactctctccgtcgcagaatataacaacctaggatataacaacctagaatgggatgagacccatgctaggacaatgtatatggacatgagctaggatgggtctcatcctatcctaggttattacattctaggacagaggcagtactaaaagtctattaaacttcgtacaaaagatactaagccaccacgtggcgctctaataatttagagaaatccaaaaaattatgagagaaaagcaaaacatccgagatgaaccaccatacctaaggcagctaatgtgatttaccaaggtcatcacgagtgtcgcaacagtactgatttgccaaggtgaagatgaatcaaatcatcagtgtataatggtttgttttgttaataacatgaaaacaaattgaaggtgtgatgatagaaagaaaagaatcaagcaccgaggtttgaaccattggatccat

SEQ ID NO: 108802 - DNA, 695 bp, Oryza sativa
ttcctgcagccccaagtgcacatatatgaaactatgaaatagtgcagtgcattaattacattaaccagatttaaaccaaacactctagccaaaatttaaattttcaaccataaatttaaaactgattttgaggatttttcggctaagcttattttttagcttttatttttagatcgctaagaacacgtatataaaagtttatttataaattacttttagtttgaaaatatgctaagcgaaacgatggctccgatgattattcctaaaagttgtgctagaagtagtagtcagcaaccagtagctagcaataaaaagtggacagaagacggtagaggacttcaataattgtgttagattcgccgagagtaccaacttaattatataatcatcttgaacatacaacatataggtccacccacctatataaaacgttggatatatatctaaatggatcgatgtacagaacacattactctagaaaactaacacatcatctgggctctccaatcggtggagctcgtgcatatatttaatttattagtgctttttaggctttggtggtgccgggacgaaatgaggtagctgctcctttagaggttatagcggtatattcagatgagcaaatttaatatttgttcaaattcaactaaattttgaaccgaaatttttgaaattttcaaaatttcggaaatttc

SEQ ID NO: 108803 - DNA, 676 bp, Oryza sativa
tcctgcagcccctgaaacctgaatgtaaactctttgtgaatccaaacacatggtatacatatatttgtgggcttggggagcatcgagaacatgcgacgcagtgaagacatttttcaggcagcaaaagatatgacaaagtcgcctgactttccagttggacctgatgaacgtcgcaaggtttccaggccgacattgctacgtgagattgatggatgcttcacgcaggttgttctgattatgtttagtatatggccgagtggattaactaggtgacgaattaaccaaccaaaattaagctgtttgatctcactaccagacttagcacctagcctgtaggcacgaaacccacaggaaaatacattttaccgtcagaaattgtttttctgtggatggaccgacagaaattgccatcagaaaaaagaccacggaccgacagcgctgtgagagaagagacaagagagtgcagagatgatccgtgcatatatatgcaacatagcttctcatgggaagtgcatttttgtccatagctcaaggggatatcctctcgttatgtgcatggcgttcaaaaagttatcaaaaatttttaaaaaattatcaagatagatcaatatataatatatcttttcacaaatatgcaagttaaaattcgacttatacaattcgaaacaaatatagc

SEQ ID NO: 108804 - DNA, 1203 bp, Oryza sativa
acttacattgtgaaacggaggaagtagctcatgctgctagaagacatagttggccaaagaatactagtcgtacaacgggtagaatgattgagagcaagtactataagcatctaaaacacaagcccctagatgccacatatgcataaatggtgaggtggaggagagaagaaaaaagagaaaaaatgagccaccccgcatgcaagggacaacctctttacaaactttaaaaaagaaagagaaaatagtgatgtaaattggatgaaaatgaataaaacaaatagttatgttgtattggactagtatatattggaggcaatatataagtatatgttgccttctaattaactagttgattatgtgaataatattagaggtggcaatcacctctactataaaacttgctctaatgaagcaggtttcagcagcgtaaatgggagctcatctcccaaagaaaatctgcaaatatatgtgtccaggccgacaccccaaacataggactttgtctggaaaattaaacagagcgtcgccaaaagttcagttctttacgtggctcatagcgaaagtgaggtcatcaaccaaaaaaaatattgataagaaaataataatgtcgtctcctatgtgtgacctcgtgaaagagaagatgaagctgccctctacatatgtgcctccaatgccctttcttttgctagacaacttgcttctgttttgctaaacaataattcacttggcgtgcatatccagcccatcgagtgaactagaaccaaaaaggtaggaaacccatgttttcagaattttggaagcaacattgtttatttgaatcttaaactcgcctaaactgaggatttgattaatttggaaacatttttaatttcccccttcaattcccctttcaatcccctccgactctaggtcatatgttatgttagaaatttggtcataattcggcatattttaatccaaaatattaagaccataaacatgacatttgcaatatgagtagatctagtgacagtgctagatgtatacaacttgagtatgcttaatatgaaataagcatcaacatttacatagtaacgcaatgctgccattgcgaagagtattaacaaagaaacatttaatagaatcaggagaatgaaagtataccccgagaacgtcccaccgctggattttgaggcagtattgcctccgttgatgtcgttcatc

SEQ ID NO: 108805 - DNA, 1810 bp, Oryza sativa
ttgtccaacaaaaaaattgcttccaaactttttgattcgacataatgtggatctccaagctagtattgcgatgtgtgctcgttaaatggaatcacatatgcggtcagaaaacacggagacctatatcttgagacacggaaaatgcaataatagaactcaaaatacaaagtaataaaataaatctaggtccccagtgaagcctaagaaaacagttatagcatgggcacagatatagtgctctgcttttttgaagccattaagataaaacagaaatgctataaattatcactacaaatgaataaaatatataaccttaatctgaggtttcatgcttaaagaatagtaccggctttcaattggaagcaagctcaaaattattaaataaataaaatgtgaaaccagaccatacatgaaaaatctaggagaaaatttcaggtagatggtgaacacccgaagggtaactactgcattaatgctgtctcaattcataactgaatgtaaagtaagcaaatagcaatagtgcagccgctgtatcttacacaaatgtcaagcatatacattatcggtttgcaagtttgatgaaaattatatctagtttatatatcatatcaaacggcgggagacttttacacaaagataccaaacatgggcacattttcaagctccaactattgctcagttacagaacaaacaaattaaaagccaaggcagcacacaatgaaacatcaagtttgtatcccccagtactgtacactactagacggtaaaacctgacggtccacccatagaaggtaaaatctattttcctgatggttttcggcatacaggctagccctcgaatttggtagtgacagtgggctagtggccacccaaggaaccagccggcccattgatacatcacaaatcaattaaaggaacaaaatatttgcttctaccaaggaaccagaagtatacgtacctagttaataagataacatatgattcgatgagcctctgggaagccattgattattatcaagtactatagttatataccttgaatagatgaaattgcagatgatgaactaaatagcaggggttattttgtgctcggtatggggggactggtgatctcttcttgttgctccatggagtagccccgttcctcatgtccttctgtcaccatcattttcccagccaatctgaccatatgttgtgaggagcagttgggaagtaggcttgcttcgttcttgatggcggcctcaactgcctctacctcctcaaccctcgcgccttggcagtgaatatataaacactgagttccttaagggttgagaggtggtggatgcccagatttcgattggcacatgcatactctgtggaatgtggcttgattctaaacgagatgtattcaagctttagcatggctccagcgtggaacatcatatcagtggcagaaaaatacaagtctagacacttcagacatctgaacttatttctgtttatgctaaacctttcagtggtgtcatgtgcgtacaaccttaacataagagaaagcaaggcaggcaagtctccaaggataaccaacacataaaaatttcaaccgccacagtttaactatacttttgggcagttcctttgtaccaataccatgaggtagatccaatgtctccaaaaacaacagttctcctacgtgcactgtccggttgtgcctgtttacctgctgcaggaagcagccgttgccctgccgtcgattctttgtgtacactctcgaaagacagctgttttagctagtaataaatatgttaagcaagatttttaaatattacta

SEQ ID NO: 108806 - DNA, 833 bp, Oryza sativa
ccaggatctgaaaatgacgaaccacatcctccttgactacgtgttcgctcgccaggtctagcaccaagttctttcccctgctggttggctagacctcgttccttgccacggctgctctctttaggtttggtggcagtcgtctaggacctgcctaagcatatgtgtgacctcgtcaaacagaagatgaagctatgacccatacatatgtgcctccaatgccctttcttttgctagacaacttgcttcttttttgctaaacaataattcatttggcatgcatatccagcccatcacgtgaactataaccaaaacggtaggaaacccatttttttttcagatttttagaagcgaccagttgttcatgagaatcttaagctggcctaaacaggggctttgtttaattaggaggcgtttttcccccttcccccttcaatcactgtaaccttccgactctagggtcatgtaatcttgatcactctttcgtaattgaaaattcaagtgcggaactcttctctcccatgatttgacaaaaaaaatgcttccaaatttttgattcgacataatgtggatctccaagcttgtattgcggtgtgtgctcgttaaatggaatcatatgtgcgttcagaaaaacatggagacctatatcttgagacaaggaaaactcaataatataattgaaaatagaaagtaagaaactaaatctgggtccccagtgaagcctaacatgggcacagatatagcgctctgcttttttgaaatcattaagataaaacataaatgctataaattatcactacaaattaataagatatataacttcagggctgcaggaa

SEQ ID NO: 108807 - DNA, 715 bp, Oryza sativa
tttttttctcccagcaaagattaggaaagttttgttttcaatcacatacaatgtttgtacgtacggaaagaaagcaggggccgtacaaactcatatgtacatgaggaagttattattttttaataatagatgtaatctaatggtgtaaaataacgggtccaccaatttaagtgaaaatcaacgatgagattagatagtgccatgtggcgacttaggagcatttgtaggagtgccacgtggcggtctaagagcatttgtaggagtttaatggacttttagtatataataatagatagatggcgaaatgaactttttttttaagaaaaacagtcggcacttgatttttttttctttttcttctttggagcaaaggagatcggcagggaataaatggccaaaaggccttacatcaggtctaccaaaagatgcccagaaacagaaattttaaaggagatatacaggggaaaaagggtgaaatgaattttccattatctagaaaaatcatctatgaggatgtagatcctctgcagtactgcatacgtcagtatctgctactgcatcagcagtactgcagacaatccccattgcatctatgggtggtgcttcacagcaaatcaacagctagacaaagcctaatccagcctcaacaacctgccaaaacaagaatcagagcacaggaaagtcatgatcatttctcaaccaaaagctcaaaaga

SEQ ID NO: 108808 - DNA, 687 bp, Oryza sativa
acactaatttattagagtgccacgtggtggccactgtgttctttctccaactttcccaacatctactcccttatttttcacatgcatgcttttcaaattattaaatggtgcatttttttacaaaagaattatatagaaaagttatcgtaaaaattcatactaatccattttcaagttttttaagctaatacttaactaatcatgcgttgatgagctacctcattttccgtgcagggagaaaaagtttttgtaggaatccactaagagcatttgtagcaagttttatagcgcttttagtatataatatatagattgatatttcattactatttggttgtcatataaaggatatgttctatgtcatacaacgtattttcatatatagcaaaaatatgagcaatataggttgctttaattataaattaagtaacaatttaaataaattaaaaagtaaagaaatttctaaaaaaaatgatggtcgtgacaatacggaggatggtggaggtgaaagggatttgttttcttataaaagttggtctaatagtctaactaatattgcatgaaaataagagataattaatattgcataaaaataagagatagaacagaaggaaggagagacttgcctgattaggatggtgtaggggtgtcaatacacgtaccgatgtacgtatatatatatatatg

SEQ ID NO: 108809 - DNA, 579 bp, Oryza sativa
aacgatattctgttgatgatacacatgggacttcaaacggtgacttttgattatttccaggtaaagcggattagttagttagtcatgttagcagttgctggtggaactagactttaaatttatttttcatttataagtttaagctcttgcttgcagttgcactagctcagttaactggcgaactgaaacttccaacttccaggatgaatgcacgtaataactgtctctattttgttgactgccatagacgactcacacctctgttaccaactcttatttaatactcttgggttctagttcagttttcacatatttgatttctgtaatgtagcaatgtccatttgtaatttgtactgagttagaaaaactggcttatgaccgaattcttccaaaacaagaaatgatatgttgttcaattttttttttgacgtgagatgttcctgttcaattgtttcagatcacaattcacaacactcaacacagaagtggatttaggtcaaacagttagttctaacttctaaaccccagtgtatgtacaacatatggacagacagaatactgcatggctgattcaacact

SEQ ID NO: 108810 - DNA, 589 bp, Oryza sativa
tggaatagtagtgtttttctattcaaatgcaaatcacgtgctctgagccctactcatgaacaatgattggagcatactaacactacagtacaattattgccaagaaaaaaaatggtacttgatgcgcagccatgttttttttttatgcttaaccgatgaatatgcaagtacacacgctttcagttatgatttttgtaaaacagctttacgcacatactactaaatcttttagaaaaaatgtttagattgttttaaactttataatagttaatttatttatttatactattttataattatcataaattatgaaggtattcagccattgatgtaagaacattatgcaagtggagactatttcatctgaaaaatgtcagtatccagcgatgacatcaccctctcggcaaaccattttattttgaaaacgacctccacaaaccaaacatatttggctcacaagcttcccaaaaattccaggacgaattcgaaaaccaaatttcttaggggctctttagttcgcaaaacaaaattttcacctatcacatcgaatgtttggatacacgcatggagtgtaagtgggctgcaggaa

SEQ ID NO: 108811 - DNA, 696 bp, Oryza sativa
taagcagagaagatctgtaatttcagtttctttttgtcagaacacagctactgcactttgtattgaaatgatcgtgtcagcgtgtctctgcactcatcccaatctccgcatgcatcgcgtgttcttgcttgtttcctgtgtggtcgatccaatggtcggatctccacttatcacggcgtatgaattcgtcaaagtcagctgctgccatggatcgagagcttcgaggtcgcctctacaatgtcaatttctctcttgatatatataattatattcatcagtagattcttgttctgattttgcataagtcaaagtcaattaaacagttagtaattctgctaggtatagcagtgtgagtcatcagtcatggagtgtaatcgagttggtggtttgtttactatagtttcctgctgtgttcaattaaatggtcgatctttcatacacgatctcgatcttgatatatgcacacatggctagcgtaatcatgctgatgtttgcactattaacaaaaaagaagaacaacgttatattttggagctgtatgaaggtcttttgatttgcattttcagttatatatatgaagaatgtttttagaaatacttgtttaacctaaacatttttaagaacatatataggagtgctataatgggctatattttgaatccaagtgatttcacggtttgagaagttattggggag

SEQ ID NO: 108812 - DNA, 1409 bp, Oryza sativa
aaggtctatatgattttacttatttggttttggtccgcatactggtagtatgcctgagagtggttatgttgatgactgttaagagaatgacaagtcaatatcttgctttgatacctttttttttttgcatttttgatttagctaaaaataaccatgtactgataatggttatttttattgttacaaattccaattacatgaggatatgttttataaattttgggtaaataggttgtgcttcagaaggtgtagtttctaaaatttttagtgtaattatgtactcgggtgatatattttgtcaaaaacgtgcattgcacgtgcacgattactagtttagtaacaaaagcaacagaaaaggatgctttaacatatagaagttgaatctataggatgaagattaagggtgcacgtaaaacgagacaagtcattagcatatggttaatgaagttttaattattaaaaaaaataaaaaaatagatttatttgatttttttagagcaacttctatatagaaagttttcgcacgaaatatacttgttagtagtttgaaacgtgctaacggaaaccgagaaaaaatctgtatgttattggaggttagaacgggaccataataaagtgaattaactacaccaaccattgttttagagttgaaaacttctcttcaccggtttgccaaaaatggataatctcccatgactttcgatgttataggaaaaccagctcaaatcgataggtttatacaaatcaaccaccgatggactgaaaaaactgatcaattttgttagacatgaacttcacataataaactaaataatacaaccgatatagatcactactacaaccgatattggggagcttataattctgagaagcagctggtgaaaagctagctagtgagaatctagataagctgacaaaccttgcttctagcttctaatttattttctagattctacaattacaacatttcaaaatctaggtgaatatatgtactgtttggaggagcttctgacaacaggagatcataggagaagctgcaacggtcaaaagctccccaaacatgcccattaattagctgaacaatttatgatgccacatttttattaaaagaatattcaaaacattttagctgcaaataaaatttttgttagacacactatataagagaatatgataaaatagttgattatctacttaaaagagaagatagaatagattttagaaagatgttcattaaacagattaatttgggctataaacaccgtaaaacagagtgcagagtgtagactacgacaggaagggaaaggtgcgaatattagatcagcatctctccggcttcaccgaactggcaagtgggcccatccctccaatctcggcggatcactctcataccccatcggtccatccgc

SEQ ID NO: 108813 - DNA, 1018 bp, Oryza sativa
cgctccagagtgagggaagtaattcgtctggtatgaaaagctaaggatgaagaatgtctagttttgtgatttagggggtaattcgtactgtccctatagtttaggggtgtaattccgactttttcctagtgggaatgggaacttataaaacatataaaatgattctgtaaaagtaaatctgaaagcacctcaccctatcacaaatatggatgtatacacaattgtgttcgatttcacattatttccttttttttattcaatgtgcggatatcaaaactttaaaacctcccaaaatatccatcctacctcctcccgcacacagatacacatagaaacaagaaagccaggctgtgctcaagatcctgtgctctctccaatggaacctgagtcctccctccacaaggtaacttaaggatcggaagcttagattgtactcaatttcttcctgctataattatcacaaactcatatgaccatcttggtgttttggcgttgaaggttgttgttcctttagatctaaactatccgaggatttgttcccactgccaaaccagcaaaacatcggtatggcgcaacggcccctttggccccaaggtaaagaatagatctataaatcatctagatatagcacctatatgttgctcagagcttgttgatttgaggccaattctttttttaattacgatatgtttatgtagtctttgtgcaatgcttgtgggatccgatatcacagaaagggaattgatgctcttgagttagaaggtaagaggagcaaagacaagaagaggaagacgagtagaaacgaggttccactccggaggggattgaggaaaaataataagaatgcaaaggaggtagattttggagtgaggatgatgatggagggatgccaatcagaaccgatgctaacacagggccaacaatacgaagatgatgtgaagaaggctgctatccaactaatgtacctttcaagggccgcaaacacttaatcaagcacaagcaatagagctctctatgt

SEQ ID NO: 108814 - DNA, 1178 bp, Oryza sativa
gctccaccgctcacatcttttatgcagaatttgcactgaggaaagatttggctataacattttgtgactgctattttcctgcatttgaactgaacgttcttatttagttttaattctgatgttataaaagttcttgcatttgatattttttctccttccctttgatgctacaaatttactgatcacaaacgattgaaacataaaaaccttctctgttgttttccattttctattacaattactgattatgctaaatgatatttctaatatttggtggcagtcataatgtttttatatatcccgaagctgtttggtcattttttatagtatctggtgttggggaagtatgtgggttgcactcctattaaatttcacttgagatgttccaagagtataaaattggattcatttttgccaaggacaacctttgccacaagtctggagaagattttgtgaagcatctgttttgtgttatttctaatatatatatctttggcaaaagagtattatgaaatagagtgctctacaaatatttataaaggcattcatataagatgttggtccacaaactgcacatgttttttatgcaatcaaaccacaccttgcttttatttttgttgttctcctgcacttccggtctttccacagtgtaaatcttgttacacacatatttgcttgctgctatttattgtcagatattaacaaaaaaaggaacttggtaattagtctccatttttttgttattgcgccttagatcaataccaaaaacttcataatgtttgggacataagaagctgaatagtttcccttatatgctgaagtgcagtgcatagctctcttttttaatagaatcaattcagtctacttccctcaaatgcaaatccccttaattactaataattggctccatgccagccgggtgagttggtaccttgtcattttatatcttttttacatttaaaaggatgatctcaaaatgaactatccaagtaaggtgatcttgataaataaacatacaactataagtagtgtcacattaacggtaccaaggctctattttcaaatccaaggattgtctgatcttatcaatggcacgtaaaccaagccaagtaattaatgtgtgattaattgattattactaatataaactttaaaatatggatttatttgatttctta

SEQ ID NO: 108815 - DNA, 627 bp, Oryza sativa
taataaatttcttgaaaatcagtaaatcaagatgtaaaagatcgtgtggattctattttggactttgagtttatgggctttctttaagatggaggagcagcatccagttagtttcactgggtcaggcaattttcatctgagttgagattaatcttcagtcaatttttatttctctgtttaatggtcatagaatgacatcgggaaatattacagatttgtgctttccatttaatgatgtttattagaccttttttactgatgacatcttattacactaatgcagacatctttataacatttattgaattcatcattggagctctgcatcatactaataagagtgattttatagttcttgaggaggtaccacattttctaatgtaaaatttggtacctctcggtacatccggtactaggaggtacgaaaatttgcactaaaaattttggtacctctcaaggactgtaaaatttctctactaataaagccacctataacttgtatgatagaagcttttgaaagaaaacccccgcagaaacaacaattacctaagtttcctcttcatataaaatacacttccaaaattcatattagtattctagagcatctagatagctttctgtttccct

SEQ ID NO: 108816 - DNA, 690 bp, Oryza sativa
gagcaatctgatgttgaatttgctgaagactctgatgatgaccgtccattccctccacttactaataatgacaagttagcattagaggaatgtcgtgcatttgagaaggtgtttgggaggaagccggacattcctgagtttagggacctaacacatgcccatggtgcactactagatggcggcatcaacctagatcagttgccagaaccattccaggtggatggtctcagaaagggtttagagttcccatccatggtcgcattgaagctatggctccaggagtacgccatcgtgcaccatcgtccataccgtgttgtcaattctgccgcaaataggaggtacactgttaaatgtgaaaacccacggtgcaaatggaaggtccatgcaactaagaggtctagtggcacgtggaggatatcacgggtaggtaaggaacatagttgtgctactgccgaaggttcagggagccaccggcaactgacatcaaagttcatagcaaataggttatgcaatgccataaaactgcaacctacactctctgcttctgcgttagctttgtatatatttgaggttttccagtatagggtgaagtatggcaaggcttggagggcacgagaggaggcaattaaactcatttacggtgaatggggtgaagcgtatgtccgtttgcccactttgctgcaagccatt

SEQ ID NO: 108817 - DNA, 1738 bp, Oryza sativa
atttatatgtagacatttaatttagtgaattttcatcctatatagcccaattttttttttgatttcttagttccaaaagatatatgtaccgctaaattactagtcatgtgatctggatatctgacaatggtattgttgttgcttgcatttcctatagctctaatgatcaccggttaacgttgttgacgcctgaaaatcatcattggcgtagctgaggagggtggcgtggtgtttccgtggacaatgttggggatcttcaagttatgtcctggatcgatggagcttaagaatgtttgtgaagcaactcaagatatggagattgtgcatctgtacatgtccttttatgtaccaactcgcaactcccactgttatatcttcctaaatcatcttagcttctgatcaacaattcaattcaaataggtttcatggatccattatacaaatttcctagtgtcattctaaagcgcagaaccgttaataatttttactatttgtgtgcatccaactgaaccatgtaatcatatatcatttcttatattagaatcctgaaatgtttgttttgattttgccttcagtttttttttccatattttggactattgtcatagttaagtttattggaaatgcttggctatgtacatatagtttggatgtagaggctaggttttaatccattttctaaaaaacatatattggaaattctaaattaaaatttatgtatgtatgtatgtgtgtgtgtgtgtgtctatatatagagacacacacacgacctgaacacggttttcgtatttccctgacattttgtctaccttgcggagatgatggcagatacacatacacgacctgaactgtgctgcgagcaaatgtgtgaaacatgaagaatccagggtgttgcaaaattctcactgaagaacagttacagacaagccaacgaagacctgaacatgagatgtcagtggagtgccgctcgatcatcgcttgtgccagaattttgcgcttcagcagcctttaatcgatcgatccccattcctcatcccaaacactaattccccattctgaggttgcagccgcgcgccgccgggaagtgagagggatcagcttaattaattaactcgaggatgagatttaatttgtgagtgcaattaattatcaagcttatgcaatatacatttttgtttttacaaagcaacataatatgtgggctagacatttattgagtgatctttatatgtagacatttaatttagtgatttttcatccgaatatatatatatatatatatatatatatatatatatatatatatatatatatatatatgccaaaaaattgatttcttagtgcaatcagtgtaagcagtgttttgatatatgcaaatttgcctatgttcctaaataaacacatattttgaattaattactagtcactaattccattttcctgtatgcatttattttttctgtgagctcagattcatatgtgcattttgtgttaccaaccttttcggccatgatcaaataagacatgcaccttgtatgtggactagtcatatacgtactgcaggatatcttttattggatgtatgtctaagttttgaagtgaccaagtgttagtacagatttatcttccactgcagtttcttagcattcgggtttgctgtatatttagtgcaacaaccatatagctagctagctaggggcaaacatataaaaaaagttcaagtctctatattataggg

SEQ ID NO: 108818 - DNA, 1029 bp, Oryza sativa
atttttcttgttctaattatttgaggtgtggggcagcatatgagttattctgatcattgttcaccaaattttgcatagtctttctgcatatgtagttgctacaataggacttcacaaactgcatatgtgtttcaatacattaggttttcctaaatataaaatacatatttatttaaactatttgttagctagtcgtcaattccattttcctctctgcattttatggttggccacagcagattatacatacaattaagttcatcaactaatgtatatttttattacaacgtcttgagctgagctaataagcaagacctatgcaagcatgtgggatatataatataatacaacaggaaaacaccttcgaaatatgaactgccaagtgcatcttgaaaattattcaaacagaaatttagtttattcaatagctttgttactcaagtgataactagaattgaattcgtgcttttatacatactgaatttaacaaactgcagataattaatcttagttatttattatagcaaaaaaactggatgtatatgcagacataatagttagcaaaaaatcttgtaagatagacttgaattatagtctgacgatgcattttatatgttgacctgcgccttcatatattcttcaattcttttagtttatttagttaccagttccccaattcaagatagacttaagaagtttcgggcaaagaaatgacgttttcattagcaacacaccatcatttcactatgtcattttttgtaaaaatatttacatcaagttgtatttggagaaattatttttctggaacaacagtaaatgtgtggactttgggatcagtttttataattgataattgatgatagttatatatcttattaattattatacaccggggcatcaagattgggcgtacattcaggatgtctcgatcggcgtggctagctactaataatcaggctatcgcacattcagtcaatgagatctttatatgtagacatttaatttagtgatttttcatccaaatatata

SEQ ID NO: 108819 - DNA, 734 bp, Oryza sativa
ccaaagacaaggatggagatttaaaatggtttgcttttattttaattgattaaatgaactttgtaactttaaaattatgtcttgagctctgaaaattcgtggaaaaatccagagagtacattagggcacagagaatattacaaaatattttcggccatgatttttaaaggaaatttttaattccctcactatgtcacttgattaaattgatttaatttttaatataatttctggaaatgcattattaattgatttttaatcccgaccgaaaattggggcgttataatgtttcattggtcgtaattatccaactaaaatgcgactgaatggtgggttgtgggtgcatggttttgctagtcgcacctatagcaattaaggaccagttcacgggaaaccctggaagacatacaacgcttaccacaagcgggagtgggtaattgcttgatctgtagtatagctcgaccctgttgatgaccaaatttggtaaatcatgcatcaaattcaaagctaaagtcgaagcggatttgataggagatcgtttctcataaacagagtacgtgtcggctacgggggcacgtcggctaacgtctgcatcggctgacattggatcggacaaagaactgagcttctataatatgatcaaagttgtttgcacttgattttggcccaaagttttttacataagatcaagtgaacacaacttttgggcaaaatgtatatgctcaatcagctat

SEQ ID NO: 108820 - DNA, 569 bp, Oryza sativa
  unsure (1)..(569): unsure at all n locations
agcatcagccatgccgagaagaagacgagaggcggatgcagaggacgcctctccattgcatctcatccggatgcacagcacgttctatcttctcgtctccaaggtagatcaggggcagtatcaggatgtatcgatttcttattgttcgataggaagatcgaatcagggccagtcctgacattttggaggcccttttgcagacttgacgctatgggccttggagttagcccttaaggagttatatctattttttttacttctaatacatacagtatactctataaagcacatataccatagagtgacacaaataaacatttttaacacggtaaataataaatcaagcagtttgcaagttgcgatagagcaatttaatctttaataaataatatcaatagtataattgacaactaaaaataccatagaaacaaattagtatgaacaccttaataggagaccacaaatatcccatgtcccttataaaaaagagccttttcgcgaccttatgagttatgtatagcacccgacaaatgtntctaggtaatattgtaacacctgaagcagtgaaa

SEQ ID NO: 108821 - DNA, 1616 bp, Oryza sativa
catatacatgcatcctcttgatctccagcttatgccctcgctcgaaaatcatgcctgccatatttgatatatctgaatcagtatcagttactaaaagatattcccattttcgctgaatctacttgtcattgctgtctgaagattagcagtatacgctttggcgtctgcatgtgagattgactcgttttgcttgtaaccatatggggctgtgattctgtgaagattactttgagagaagagtaaaacagccacgtgaccacagagtttggctttgggatatgagtgaaagaaagattattgtggggaccttcaaagctttgggggtaaaaagctttctttagggtaatgctactttctccgtttcatattataagactttctagcattgttcacattcatatatatgttaatgaatctagacatgtatatctatatgaatgtaggcaatgctagaaagtcttataacttgaaaaggaggtagtacaattgtagaggcctccaatttcaatatgtccatccaaatttacctagaaaagaaaaacgtgcttggtataaagaatctggggtacattgcctatacaaattctcgtgttgctatagcaaccatcagtatgaccttttgcattcattcaatgaatgtcgatgcaggaacatgttccatgaaccgaagtgagagctagtattacagaaaagaaaagacaaatattgtgtccagactccaggctgaactctagctttaactcgagatcacttggattctcagtgtgatcaatctgacatgcagcaaccccgatatatgaccacatatgaaggtttatacataacaaaggtagaggaaaatagtgaagtctactgactgccatagtcgccaccttatacgcatgatgcgatcatcagagctctatcctgattcacttgttaacagccacccacatttttaggccatcaggtgtgcatgtggcttaaatctatctcagattagcactattgattcgagtttcactctagtaattcccaacactatgctttattatgacaaaacagctaaagattggggtgcatcgatgatttcagtaggaactgttgttttgtagcctgtgtcaatgtctaactatccatgtagctaattgtgccaaactctgttcccagagagaatctgccaagagtgaagggctaacaatcccttttgataaacacaagtaattcaatccccttaggcacccccaccaaatgaggtcattctaatgttttatatcaaattacccgcgtaaagaattcgatcctgtgaatacaacaggccctatatgacaaaatgcatagggtacagaataatagaacatgtcacatggatggaagagtttcttactgtttctgatggagtgatggtaccattgaagctcttcaatatctcagcactgcagtaactttacttacagtgcacacggaacactagggcagcattctttgagaacaggaccatttacagtattttgctatgtcctgagtaaacagcatgttacaaattagaaaaaaaaaaaagatagggaattcaaagatagacacaggattttctctaggacaggaattaataattaaaaatgatttacctgatgcga

SEQ ID NO: 108822 - DNA, 1618 bp, Oryza sativa
atcgatggcatggcaatcatctagagtatttcctttgaggagaaggaagagtggatgtctaagattgagtctagacaagggtttcactctaagggcaattgtgacattttcttagcgatcttgggctataattctataaacagagaggtggatgcaatgatggagtgtgcctttggtaatagtggatgcaacggtagagtgtgcctttggcaatcttttgagtggttttttgagagagttttgggtgagttatgcgtgtgttgcctttggggcttttttgtgtttaaatttacatttaagtggtgtatgtttgctcctcttgagcggttgtacttctgatccttcagttacttccctctaaatgtttttggaaaaagcatataagtgaaacatctttggtaaaattataaaactaaaaagaaaaatgaaacaaagataaaatatataatcacgcaaaccagaaagacaatatttttaaaataaccaaaaagtacatttttaaagtaatcctaaagttatatgtgaagagaaatagaaaacatgtttttatgttttttcaactagtagtttttatctttattcttcagtaacttaatttgagcatataactgaaaggaaaatgaaaaaaagttaaaatagataagcacgcaaaccacaaagataacatttataaagtaactcaaaagttatatgtgaagagaaatagcaaacctattttgttaagttggtagtaatctaggggaagtatacttctctggaacactatttatgataaaatttctgaattgcaagttgatagtaatcgaggggaagtatacaatagttagtgtgaaattaccatctaatgtaccatcattctcaatttcataaaaatatcgatgcatatggagaaacgacagcttaatgttatcttccttaatgcatttagagttatccaaaaaaaaaaattcaaatcttcgtccaatttattgttagcatattgctcaaagtatgtattgtttacttgctgctttgacaacttagtaatgaaaacaagatcaattagcaacaagataattagttaatgtaaataataatgacaggtttttaacgaatccaacatacatacatgcatataatatactccctccattttaaaatgtaaaatgtatgacgccgttaactttttgcataacgtttaaccattcatattatttaaaaatttagtataaatatgtaaaatataagttaagattatattttatttaatgataaagcaagtcataatgaaatagatcatatttatatagttttttaataaaatgaatgatcaaacgttgtacatacattttaaaatggagatagtatttgtttatatctggagtacctttagtacttgatgcgataaagcgcatggcggattaagaggtcctgaatttgatcatcatcagtgagttgggtatcatcatgaggacgaggaggctggcgttcgtctggcgtggcaactgatagaagtaggtatcatcatgagaacgaggaggctggcgtggtagctgatagaagtaattgaggaattcttcgtcaatgatgctctccaccaaaccaaactcgttcagctcttggatcatacgctctgatt

SEQ ID NO: 108823 - DNA, 710 bp, Oryza sativa
caaaaaatctggtcagctcacttgtctttcatttgtcaaaaagttaatcaactgtcgcctcacaattagggcaaagctaaacttgtctgcacaaacaccaacaatatggttgctaaagataacaccaaactttatgtagttactccataaaaatactccaaactgggagtagcactatctagtctcgtctgttatgtcccgaaacttttcatcaacgaaccttttagtggagaggttgggaacctctttcttagtcaccgaaaacggtgttacccattagcgtgtaatgaattaagtaatagtctaaaaaaaatttaaaaataaattaatatgttttctaaaataatttctatagaattttttttaaaaaatgtaccgtttaacggtttgaaaaacgagcgcacgaaaaacaaagggtgaagatgggaaagtaaggaaaagaaaacaatctcaaagttagacctcaaagtgagtctctataaacatcagatcagtagtatacacagcagggagtgagctggttattgcacaactaatgttttaccactccgaacaaagtattggcaatttctgacgagatgaacaacaagtacagtactaactagggcacgtaccacaccaactctgcaattattatcaagattgaagggacaaatggaatcgcggatctctactttgaaagaaccatgtaaaaatgtcggagtccgaaa

SEQ ID NO: 108824 - DNA, 653 bp, Oryza sativa
tgatcgacccaaacaattcttagaaacagaatatattggcttggatagtctcggatttggaaacaaattcagaagtgctaagttaacacgatgtattataaattagcgtaagaaaatacggtaaataccacgtagtttcacctcaagcgtgtaaaatggattgtttgcagaagtgtcggctgtaactctgttcttgacttcttgttggacaggaagtgccaatgtacgtatcatgcacgggtagtggccagacacttcattatggatgtgtttggttgcacgggtagtggcctaacccagttctcgactgagtttggtccagataaaacagaaaatctatagaactacataccgtttgaacggagtagagtaatgatcaacgccctacaccttatcttcttgactcgtctatgcagcgtcgtccaccacccaccacgcacaagttactccctccatcctctgtccccctctctacgcccacgaccactagccgctggccaccgggagccgttttctcgccgcatcgaccgtaacaccatctgagccggccatcggcgatgtccccagcaattcaacatgagtgcaacaatggcagagcctgcatggggttagatgtccacaggaagaaggaagaatatgaggatatggctttt

SEQ ID NO: 108825 - DNA, 633 bp, Oryza sativa
ctgcagcccaattcaaaccaacaaaaagtttgcccaaaaatccccaaactttccaaaggccaatccacactacacagtgccatgtaccggtacccagcctctctctccctccctccctgtgcaggctgtgtgcagcagccttgaccagaaccgggccagaccggatcacttccttctggtccctgtcgggtcggtcccctcctccctctccctctctctctccaccgcgccggcccggttcgactcgaccacaacacgcgacgccacgcctcctcccgatccgctccggccgcgccgcctatgtaggcctctgggtccattcacaccgcctcttttcgtttcgtttcgccgcccgcttccgccgcgcgcgcgcacgtgcgagaggggagagggggatagcgacgccgcgcccaaaccctactactactcctcctcctcctccgcgtcctcgccggccactcgtcgccggcctccgtcgccgcctccgcctggttatccaccagaaggtaggcgccgacctcctcctcctctttctccttctcgagcctacgcgggcgagggttccgaggtgtgcgagtgtggtctcgtctccctcccggagacgcgtgctccggtgggtgggaaggatggtgt

SEQ ID NO: 108826 - DNA, 535 bp, Oryza sativa
gggggggggggccgggtgacagcgagtgggcggtcaacagaggagagggagagagtaggcacgatcggatcggacggcctaggaagaatgaaagccccgaattgtgggcgcagggtagcgatctcgccggagtggcatgtcgcgggagtcccgttccggaatgtggtgaacagtgacaacggccatccctctactggttgagctcctcgatctccatctctacagtgacagtctagtactagtagtatacaactacatgcgacttgcacatctctgatctctcttgctgccttgtgtctttttttttcttctcccggatgacttgtgtgtatgtgcatgctgagactaggccagtacaccccaaaattttacactccatcacatcgaacgtttgaacatatgtatgcatgaagtattaaatataggctaaagaaataactaattgcacagattacgactactttgcgatacaaatctttgacaatgcggtgctacagtaaacatatactaataacggattaattaggcttaataa

SEQ ID NO: 108827 - DNA, 1491 bp, Oryza sativa
cacttatatgtgagtcattagagctagcttttaaaaaccaatatcattatgtgagacatcacagtgggtttttaaagaaaaccagtattgacagatcgaaccgagctggtaggaggcaggggtcggttttatcttccaccaaatcctcttcttattgcttcccccacccttttatcttctcgatccatccacatcttcttctcttctcttcttctcccgtgcgagggtgtgcccccctatcaggggtgggtggcctccgatttagggcgtgcagcgagcagctttccccacagcaagggcacggcttgcacaacacgatgcgtggcagacaacctccccatggtagctcgatgtgctcgaggccctgctcgtattccactctagtcgccctgcctccttccctcgccgtgagctctaggtcatctagatatacctgccacgaggtcggtagaggctagatccagccgccacgagctcaaggcgtggctagatctggctaagggggagtggtggttgggggattcgacaacagacaacgcactagatgacgtgtggcagtggcaacgctcaacgcacaagtgggaggacttcatcacggcaagcagtggcaacggcggtgacattctcttcctagatatatgtgttcttagatgctaacttatacatgtttgattacgtaactttgtcgtttgattatcttgaaaacctttcgatctcatggtctctatgctgttgttggatggatggttgatatgttcttgaaaccattcaataatagatgttgactaatgtattcttggatgtgcgatgctttgggataatagggagctaccttattcatctgctcaaatccagccgaaataatgaggattcatagaacctcggggtgcctgttactaaatcaacacctatgttttctcattagttccgtctcaattgtgccggttgaaaaacaaacacctatgtgggggtttccgatcgacatctatagtgttctatttacaagtgtgtttgggaagtttggttccaattcttaatcggaatatacgctccatctgtttttttttctctgatcaatgatcgatcaggccttctctgactgacgatacttctacaccattgttgagcacaactaaatcaagttttctgcacacgttaagcgcaattaaattctctttagggcaacggaccaccgctagatggtgtggtgttggtgactatgctggtgcgatggttggtggtagagatggtgctacaactatggttcaggtttatcgttttgaggattatatcagggtattgataagatcataattttgtttatttcggtccgaaattatttgattttttaacaaaatttagtgaaattttacaaatattaccaaattgactaaaaaattaaaatcaaaaattaaaaattatggccgaaataatattgtacggggtccaatagaaatttcggaagtttttagtccgaaatttgaaccctgg

SEQ ID NO: 108828 - DNA, 659 bp, Oryza sativa
cctgcagcccagtgtagtccatggacggaaccgacctagacaccaaaattctccatgcattttgttttcgtcattctttgatgattaaggaactttgcagattatctaaacttgtggatttatataccctttttgtctatgaataggtgaattgcatgaattgttctttatatacatgattatatacccttgatgctgctgccacataaatgattgtgggctgttttattatctacacttgattgaattgaatggatgaattgctgtttacatgaagttagtagtactgtctcattttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattttaactagataaatggccagtgatgttttatgttaatacacccctattgttgctgcccttgtgagtatctttgcccctgttgctgctgcccaatgtgttccttgttaaatggccagtgatgaattgctcaataagaacaaattatctacacttggtttttttttatgcacaaaaacagattttctgcacttgctcttttttct

SEQ ID NO: 108829 - DNA, 2461 bp, Oryza sativa
ttagtgttggcctcaaggtggatgtgggtcccgaatgtactttttatgttggcatttaaatatagtcaatatgaatatatgatttcactaaaaatataatagttcaaatagatcataagttgaatatatgatttgaaaagttataattatttttatttatattgtttctattagttctaagaggagaaagagaagaatagggacagtgggatacctggctagaccttatatgtggagggttcatttgtggttttttctccataaagataattttaattttaattatcataaataaacataaaaataagagaaaaggaacgatacacaccgcacggggagagagagagagggagagggtgttttttcataaaaaaagattgatctaacaacctaaaataatgtgttggatgtttaagcgaaactaatggtcggatgttttgcttttcctcacataattttgtacgatttttttaacttaagagagacccctagtgtgtccctgggtggtttagaaacatttataagatggttaatatgttttgacgccgcatgggagcgcggaggaagatttgggatgtttttttgttgaaaaagatcgatctaataacctaaaataatgtaaatcgattgtcgaatgttttattttttttaagatttcctctaatttaagagtgctatatattccctccgttccataaaaactcaaattagaatatgatatgacatatttaagaacaacgaatctggaaatgtatttacaaatatttgtatgatgttgaattttattaggagagtatatatgaagaggtggctaaatataatatgttgatgggctttttaagcccataaaaaagtatttaactttaattgttatggggattatagaaaaaagagaggaacggtggttggagccttgcggggattgtacgtacgtgcgcatgaaggttgacatccggactccggacggagattttttttccacgtgaaataaatctaacgataaaaattaatgggcccatcaatttaaatgaaaattaatggtcagatttttactattttattagagtgtcacatggtgactcgagagcgtttataggataccacatggcaacctaggagtgtttgtagaaagtttaattgattttagtatataatagatagatataatagatgtacgtttgaccatttatcttattcgaaaactatatcttttaatctattctatgactaaaggcacttatgtacgttttatttatttttaatttatacatcttttaaataagacaaatgatctacatggtataaaatcaaaaatacatatctccgttgtaggtctacatgttggcgcgctcatgttgtggtggtgatgtctgcgtcgcttatcttccctgttaccatcaatgaagacgaggcaactattgttgtgttcatcacatctaaaagctcgttgtcatcaccatcgccgtacgtgcccctccgaagcatgtcaccatcgccaccgctattcctgtggtccctgacatcgttgctggaccgtacccatggaggctcgaatgcatgggtatgttgtgttcagtacatataagggccggatcagcataactttagatctttggatctgaatatttgattacgtcaataatatttacataaattattttatttctattttagatgaaatgtgaaattttaaaccactgcaatgtgactacaaacttgaaatgcagcgcgtatttgaaatctacaactatatctgtcggaggtatgggcccagaggtatgcgaagtgagggaaagttacctttctatccagccgcgtggctctacagcctggccctactcccacgcctcgcgagtcacagaagtggccggggggcctcggggtgccacgtcgtgcccctcaggctctcccgctgcctcgccccgaggccctcgcccagctgccatatggcggggggagcgagcaggaagggggcccaggctgaacaaccatcaatgcgcagcgccccaactgtccctcaccgcatttaatgcggtaagggcagacgtgcggtgccgcctagctgatccacgtcaatcggatgtaaccagtctgtgaccggcctgttgccggtcacatccgattgaacgggtggccgtgcccccacgtcacctctgtaacaggcggagtggaagtaggtatgacccgtcctatcatggtgtcattcggggttccctccatgagagaaggaacaccacaagtcttcactcatttatgagggaatgacagggctgtcccctgtgtcaggcgaggggtggcgctgggtcccactcaaggacaggctgctgcttagcttccgagcgaaggcacggatcgtggcccggtcaaggtaaggtgggtccccctcccagggaaggataggtagaggcggtgcatgtggtatccccttgaactataaaaggagggccttgcccaccgagca

SEQ ID NO: 108830 - DNA, 951 bp, Oryza sativa
cttcactgtaccgatcgtgtacgtaccgccaacgatcacatccgtattaccttatttgtttgaagattgtagaaaaatgttgaagttatggttggaggtttatcgctcattgctaacgtcactctagcaacctcttggcaaatcaaggtaaaggctgacctgtagtgtagaaggtcaatattacatggaaatatgacaaagtgtgcattcgtgagtgcatgtatatagagaaaaggaacctaaaagtgataaatatcacgctggttttttagacagtgattgtagatatgatcgtttgtttttcacatgttatataactatttgtttgcgtgcttggtaattcgtctagattaaatagattgagggtgtcaaatgtctgaaattatagttaggagggtaaatcatatttttcacaatagtcgtgtggtaaattagacttaacctaattcaagaaactaagaacaaaaatgaatggtgtaatcccataatcgatcttattggttaggatcgtcaaccaaattaatctaaaaatttgtgtcgtacttatgaatcgtgtgttgttccataagtctggaaccatttaatccataatcatggacaaggtttcctatgatgatgcatgccaagcatttaacaaatgagggtacaacaggtggtgcaaggatacaacagttcaaccatagtcataaactcgatatttgtcacttcctaattccttttcttcacatgcatgcacccatgaatgcatggttttatcgcatttccatgtgatttttatctttacgatatagtccagcctcaaacttttgatttgcttaataggtggctagcattacaagttagcaatgttagtattaagcttccaaaaggcactccaacattttttttgtttgtgttctaaaaagccccacgtatgcaatcgttagtgttagtggtacatgatgggaggaa

SEQ ID NO: 108831 - DNA, 516 bp, Oryza sativa
ttcctgcagccctggaggattctccctaatacgaaactgacagctactgaaaagaatgcaatgcgtgagactaaacttaaccgcctagatctgtattcgccgacaacttgtgaccaccttctgcagcctgcaggcctatctgctatcactggaagacattgtttcttagatattctacttgttgcccgttcccaccattctagcaacaaatcacaagagaagtgaccaagggcctcagctgtaggtgccaaaaggataactgaccataactgtccacagtggccattgcatttcatatttagcttatcaaaaattacattgttacaaacttaaaaattatcaaatatgagataactcacctcttaaggctgcaactttaggaatggaatttgataactcctgaattgcagatagtcgtttgcgtctgtcatcctccactggtttgattagagagaggatgtttttaacacactgctccaccacatcataatttatatgttcagccatactgaaatc

SEQ ID NO: 108832 - DNA, 565 bp, Oryza sativa
ttcctgcagccctcaaactcgctgagtagataattcttttgttggccttgaaaaatgacactgccgttgttttgtattattatgagccgttttgatttttttctaattatttttaaaaataaattaaataagtttactaaaaagtatagccaacatttttaacttaaaactagtatattattaaaatactagaaaaaatatccgtgcgtttcaacgggaagaaaacacgagaaaattaataaaaagtcgaaaaagattagcattatgtaattaattaaaatacatatttcaccatcctccatgattaatcacattatttgaattttttcagaatttccagagctccattaataattttaaaaatacgaacatcatttcagcatttatttaaatgaaaacctaaaggaaaaggttcgaattacctcctgaactatcgcggtcgaccgaattacccctttaaacccgaaaacccagacatgttcaccctcaactttcaataccggacaaattaccccctcgacccaattcagagcggttttgtcctacgtggcgtacgcgtagcaat

SEQ ID NO: 108833 - DNA, 734 bp, Oryza sativa
tatgtaaaacttcaaatagcataaaaaaaattagacattttgagcaaatgtttgggggtaagatatctctgtaggaagtcaaaattcccaaaatttactcataggaactacacatattgtttcgacataatattttctcataaattaagaagtgtacgttcacaagtaattttagtttagaatttatgcgctgtaaaggtaatcagaagaaaattataaccagcattcaaaacacattaaataagttcaattcttatttagatatagtaaaagaatattttaaaacaaagtcacacacacatggacattcataataaaattttacgtacattaaataaggtgcacgcgcatgtgcgcgggctaccttcctagttatatatatactaaaagtccattaaactttctacaaacgctcctaagcctccacgtgacatcctataaacactcctaagtcgccatgtggcactgtaatttatagaaatttataaaaattctctagccattgatcttcattaaattaggtggacccaatatttaccaccattaaatttattaaaaaagattgcctaacccccaaaccgggtccaccttgagcctgtacgtattaccatatgtataggtatgttttttttaagatagtacttatgtacgtacttccaccccttcttccctcaatttcttcatatttttgcacacatttattcttctattatcatactttttagaaaaaaaaa

SEQ ID NO: 108834 - DNA, 515 bp, Oryza sativa
cctttgtttttcttgcggattaatcaaacggtctttcttatatttttcctatattttacatttgtattcatgtcagaatcctatattttttctattcctccgttttctaagataaagtaaatacaaccttcgaaagagaataacttgtatccttaaatctagacatgaggtatgctcagattcataattgaaagtttaatttattttacggaaggaacatagtaggcttcttattcaaaatcttgtggagatttaaccatctgctttttttttgtctcatactaagggcatgtttgggggagctttagattctgagaagcagctgtttggtagccagcttctaaaaatctggaaaagctctgaaacccagcttatccagcttctggcttcttagttcatttttcagaatctgtaactatagattctcagaagctgtggactatttagggcagcttctagcagaagccaaaagctgcagctgggagaagctcccccaaacaggacctaagatgtgg

SEQ ID NO: 108835 - DNA, 805 bp, Oryza sativa
gaggccaacacaagacctcgccgagacgccggatacggagggaaaaggaagaagacaccggatcaggaggaagaggaaggagtgagaagggaagaatgcaacctcgccgccacccttctcttctccaccatcaccgagctggcgagatggttgtcgtggtgctgccgagcttgccgtccttggaggtgccgtcgccggccatcccgccggtggccgactcctccgcctccccctccctcccatagttggcaagaaaagagaagaaagaataggctaatttgtgggccccatatcttttttttaactagtatgccacgtcaacgaaaccagataactatggccgtgtttagttcacccccaactaccacaaactttcaactttccatcacatcacatcacatccaaaactttcctatacacaaacttccaactttttttctgaacttccaacttttttcaggaacttaacacagcctatactattataggacctaaattgcacggtttgtatagtttaggagtgatgatttctggtgttgggagacaagggatgtcaaataaactcgacgtaaagttgagggatgattagtagacttaatccgccaaccaaaggcaatcttaattacaaaccagtcgatttagcccattgccatccagcccattagcaggcccggcaccatcatggtctccaattaacgtcagacactgctcctccttgtaataacaaccacacaccacaatttttcaggcaatttttggccaagcttttggttcataatactactactactactgggctgcagga

SEQ ID NO: 108836 - DNA, 682 bp, Oryza sativa
acatgcacccacactaatgcacactttatcgtatttccatgtactatggtacactacaggtcagcctctaccttgatttgccgagaggtttgctagagtgacttttagcgatgagcggtaaagccccaagcccccaatcagcacttcaaacatttcttagaatcgtagggaaaaaaaagggcaattgcgcacgtgtttgttggctgtacatgatagttagagcgggcgggtcactggctctcgggttgcacagggtcgtaacaaattaggcttggctaggctcggacgctcggttagagaaacgagttaaagcgtgagctcgtcttggcttgttttctggcttgagctggcttgtgagcctacctgttgaagcatctcttcatgtataatttgtaatcattaagaaagcaagaacaaattattgacatgtaaaattaaaacaagttcatatattcaattcttcaaaatccagatgataaattacaatttgatatattaataactccactaaaaagtaaaataatccatataagtacatgacgacataggctcataagccaactcgtgctcacgagccaaataagcggctctagagccatcaacgagctgaaaacggaagcttgggcttgactctttggcatagagccgagccgagccatgctcgagctggacccaaacaaac

SEQ ID NO: 108837 - DNA, 615 bp, Oryza sativa
ttcactcattgtcacctatgggcatcgatgaatcgcagcagctcctcctctgaccaacacctcttctccctgccagcgtcgctgtccctcagccggcgcccctctcctccttcctgactagcacgcctcctttcctagccgatgcccctcccgcttccgtgggcttgccggatttagaccaagcagagttcggaggagacggctcggtccagcaagctcggcaatgacaccagcaacaagctccccctaccaggtcaacggcagcaacaagcccaacggggagcagctcatcagctggtttcaagccaatgtcgttccctccccctcctcctgtccttcgcttgtcgcaacctttgctggcggcagttgctagtggggcgaagcggtggtggaagaagggtgacaaagatctaggcgcggggcttggagcagcggtggtggcgcagttcttggcaaagggccacgagctccaccgacggtggccgacgactcctcgagctcccctatcccactccactggccgttctacccctcctcttttaaagctaagggggggtagattgacctccacaattctggatgatgagggaccatgtcgttattggattgtggggc

SEQ ID NO: 108838 - DNA, 544 bp, Oryza sativa
ttttttatacttgtggttgctctaagctggtggcaatggagcgcatgccagagccagtgagccgaggcggcggtcatggagttcggtggccacaggcaaagcacctccggcatgttagagaaaggtaggagtcaaggatatttttgtttttatgacattttttatatggatttaattgagagtagcaatttaacaaaaccaaaatacaggatagtatcattctagcaaacctgtgctttggagatgggacaagagccgtgtcgggaggtgggacccacccacacgtgacaggccacggctgctccagtaccggttctttccttgtagctttacctttccaatgcttcgtcgtgttgtctggccggccaccggcggtccgtccggtggtttctctttgcatgcgccgaccgcggggtggtcatctgtctgttggctacaacataatgcagtcagtgtactcctaagcggtatcaaacgattgggggggtttagatctactccctccgtcccaaaaattaataatctagaaagagatatgatccct

SEQ ID NO: 108839 - DNA, 2889 bp, Oryza sativa
caaccctcacccttccatgctactcaccctcacccttccatgctactccaacggaatatcattaggacactactcacgtggatgcttcttcaactagcgctatttatatttgtactttaaccatttatatttctcttcaaaattttacaaaatattgaaatacatgtcatattattaaagcgtattacatactaaatattaacacaagtagtaggctttcattcatcataattaatctaataattctagattgttagttatccaagtgcagatcagcgatgataaatagtacatccatcttaaaatatattccctccgtcacattttaagtgtagtcatgagtttccatatccaaccttaatcattcgtcttatttgaaaaaaaaaataaaaacataaatcactcataaagttttatcatctaaaaagaaaaaaatactaatcataaaaaaatgacggacgatcaaaatcagacacggaaactgatgaatgtatttaaaatgggacgaagagagtaacaaacttttaaccgctaagacaatgactaaacttgatgactatttttgactgccaatgatatcatgtggtcatcaagaaaactacaaattattgtggtgaggacatatcaatctactccctccgtcccaaaaaaagacaaaccctggtttccgtgcgcaatgtttgaccgttcgtcttatttgaaaaaattatgaaaaaaattaaaaagacaagtcacgcacaaagtattaatcatgttttatcatctaacaacaataaaaatacgaattataaaaaaatttcatataaaacggacagtcaaagttggacacgcaaacccagggtttgccttttttttgggacggagggagtagacgtgtctactatccaaatccatagtatcgtgtcttctatttggtactatctccgtcccaaaataagtacagccataagttttcgcgtccaactttcatcgttcgtcttatttgaaattttttatgagtagtatttttattgttatgagatgataaaagatgaatagtactttactcgtgacatattttttttagtttttttaaaaaaatttaaataagacgaacgattaaagttagatacggaaactcatagctgcacttattttgggacagagggagagtaataggttaattcgacatcattgctactaaggataatggcctcggttaataaacaccacatgctcatcttattgtttgtttcgtttcacctctagtacgttcgaccgctgtcgccgccactgaatgcatcccggccgcttgctaagcggctagcgcccacaccgccgcaatataaacccgtcctcatcacacacacacacacacacagagtgtctctctctccctctctctccccccgatccatcgttgctgcattagaaaatgcattcagcacgaggtctactgcgagagatggacaattcggtgtcggaccggagcttcctcatcgacagcgacgaggaggacgacgccgccgccgccgtcgaggatgggaagcgtcgcggccacggcggcgatgagtcggacgacgggtcggactcgtcgtcttcgtgcggtaccccgcgggtcgccgccgccggcggtggcggtggcggccgcggcagccagcccagctcctatacgcagcagtggcctcagagctacaggttcgccgacgcaagttcatttcttctttatatttttttcttttctttcgcagtgccacgcgtcaataaaagtccaaacttttctgtttacagtcgaataatttcagtcttttccattcttttctggagagttcagtttgccatcccgtactaattaatcaccactagtcttactttttttaactgtgaattttgcaatgcaacacttttttcaaaaaaaaaaagaaagtatggcagtttttctgttgtttctcaacaactcatttggtacgtttcttggataatgaacatctggtaggtagaaaagcaaaatacaaatttagattctaacttctttttactagcacacaaaggcctgtttggctaatgggttggggaaacaaagagtttcttctaatcctagccatccattatccctccctcgttttatcatagccctttatccatttccctattccaatcccactattcttatcccattatccaaacacactaaaagagtctctgcaagaacagtttgaaactaagaacaatgatttatacatttttatttggcatagacataccacatgacatattcttcgaaaattttagttgattatatttcagatgccttctgatcctgataggcctatgatggccagaatattcaggatatgcagtagccatttgggatggcatcggggtgtgaggacacgtgttggtgaacctataggtggattgcagaagccattgacatgtgggcccacgatagtgacgtgtcacggctagtactggaattggtgctacgtgtcactgttcctgtggtccctggtgctgacttggcagcttcagttggtccccatctgttcttccaaaataattttgtctgagagaaggagagagaatcagtggggcgttgtgcaatctgaatattcagaatttcagatcaatattatcggcgcctttgccaattttttatctgttctgaatatatagtattttacattttggaaagaaattaagaaaacgaaacacggcgactgaaatttccgaaaattttcagaaatatcaaaatggaattttcagtgaaattagtttttgctgtgtatgcgcaaatttcgttgcagtgaaacaaaatcaaaaaatttagaccagagtaaattcctaccaagaattaaacagaagtagatccgaaattccaaaccgaaattccaaactctggttccgttt

SEQ ID NO: 108840 - DNA, 639 bp, Oryza sativa
ggattaaagcgtgtatgcaatcctattcgtttatttttcctattcctatgcgttgaaattcctccaaaatgaataggccctttggggttttctgtgttacttccttgtctatttcttttttttcatgattatgagaggacaattaaactccctacttcattcttagaaaatcaaactttaaaattctactccctccgtcccataatataataagttttagagtttgatacggttattaataaagtaggtagaagtgaatggtggagggttgtgattggatgagtagtggaggtatatagaaaaagtgaatggtggagggttgtgattggttgggaagataatgtggtgaagaagttattatattttgggataaattctgaggctaaaagttgttatattttgggacggagttatgtgtgttttctctattcctgtaattttatataaaaatttcctccaagggagactcttcattctaaccttactacgggtgaacagaaatacttcattattagagtatcaacattaaacgtgtacagaacaccgtttgccagcttgcctatgtttcatgcgtacaattttatgtttctttttttttaaaaaaaaacatagactagatcatgtcatactcaattaacc

SEQ ID NO: 108841 - DNA, 787 bp, Oryza sativa
ttttaatataatttattattagttttaaaaaattcacatttgttgactcaaagtacatatacctctactttatatttttttctcaattttgcactgcacaattttagtgcagtgcacatcttaagtttttgtgcagtgcaaaattcttttggcaaagtttcgtttggcatgtgtaccagcagccttgggagagtcaggttctcaggttgcagagaatggaagtaaagcatagtgttagttatctgtggaaaataccctggcttcttctggacagttgtttaagaacttgattacatctgttagtgaacttggcttacgtccggttggatgtagaggtcggatttatccccttttgttaaaaaaaaaatatgtcggtgaacttacgatcagacgcacattcctgaggtccattggaatcctgatctcaaattacatggtggactcgccacctggcacagtgtaacatgtgcctggaagggttccaaaatgccgaagataactactatctccatctcataatataagggattttggaggaatatgacacatcataatagtacgaatctagacttgtcacattcctttaatatcccttatattatgggacagagtgagtatttggttattgtggttattggccttgttgagtcgtatccacatttattttttttgaaagtaaagagagatttcattaatgagaaaacagagggttacattcctggttcaagagatcaagaatttctgcaggggaacacaatctccagaccgtattagttcctgatcccat

SEQ ID NO: 108842 - DNA, 642 bp, Oryza sativa
atcatgtccaccatatatcacacacactttgcacgatcttgatcttgagtatgtttagttatctgctttagtctgggtttttgatttagtaataaatatgaatgcaagtaagccatgttttatctctaccaaactccacatatcaaaccttagaataggaataaaaagggcaaaaaatggtgaggaatttatattgatatacttagagagattgagtgaatcatttgaggaacttagctttgttttgcaaaatcatctgaaaactttcagaataaaagttgaataaagatttggtgattggtgctctaattgttgttctgcctttcaaccgcccaaggaaaggagaagcagtgtcagagctaggaaagcattgcatcaatgcaaaataaaataaatcaggaaatgtaaatcaggaaatgcaaccacccgaacatttgtagctagatcaatatggacttaattttgcaactgagctggtagactataaatcaaattttgtagaaaaaaaaggtgacatgtacaagccaaaagcattgttttgttcaatgaattttgttgcaacatcacctcagtttcccatggattaatattcttcagctcagtcactgtttttttttgtaccactcgagccggacactatga

SEQ ID NO: 108843 - DNA, 697 bp, Oryza sativa
ataaagtaaatggccggtcctgcacattactgtagagatgcatctaactgaatggccaacttacttatatctccaaagaagtggtctcgttattttgtgaatattaatttagtacatttttctgttcctttccttttctttctttcgtttttcttttttgtaacggacatgttattttgaagatgtaaaatactatatatgctgataagaacatatatacaacatttcaagaaaccatatagcttttttttattccaattgcagaaaccatatagttgtagaagagatgaaataagttcatggtcaagaatatctaatatcatctctttctatataagaaaatgttttaatccgacaggttcatagtcagtgatacacatagtgacatgcatctatctgcatctttcatagatatgtaagctacttattgtaggtaagcatcagtgcccgaacacaatgccttattgaggaatcagtctaaagcatgctcttgcttcaaactacaatctatttattaacaggaagactgttttcatgcaagtgaactgatataggaggaaggatcaggaggcgttggtatttgtactgctccatcaagcatttgtgtcaccttaagcatggttggccgcatcgatggctcctcctggaggcaccacagtgccacagcaacgaagcgctccaccttttttatgttgaa
